(12) United States Patent  
Inze et al.

(10) Patent No.: US 7,847,156 B2  
(45) Date of Patent: Dec. 7, 2010

(54) PLANTS HAVING IMPROVED GROWTH CHARACTERISTICS AND METHODS FOR MAKING THE SAME

(75) Inventors: Dirk Inze, Moorsel-Aalst (BE); Lieven De Veylder, Drongen (BE); Kobe Vlieghe, Aalter (BE)

(73) Assignee: Cropdesign N.V., Zwijnaarde (BE)

( * ) Notice: Subject to any disclaimer, the term of this patent is extended or adjusted under 35 U.S.C. 154(b) by 270 days.

(21) Appl. No.: 10/531,475

(22) PCT Filed: Oct. 20, 2003

(86) PCT No.: PCT/EP03/11658

§ 371 (c)(1),
(2), (4) Date: Apr. 15, 2005

(87) PCT Pub. No.: WO2004/035798

PCT Pub. Date: Apr. 29, 2004

(65) Prior Publication Data

US 2006/0021088 A1    Jan. 26, 2006

(51) Int. Cl.
 C12N 15/82    (2006.01)
 A01H 5/00    (2006.01)
(52) U.S. Cl. .................. 800/290; 800/287; 800/298; 800/320.2
(58) Field of Classification Search .................. None
 See application file for complete search history.

(56) References Cited

U.S. PATENT DOCUMENTS

2006/0048239 A1    3/2006    Sanz Molinero

FOREIGN PATENT DOCUMENTS

| EP | 1 033 405 A | 9/2000 |
| EP | 1 033 405 A2 | 9/2000 |
| EP | 1 230 843 A | 8/2002 |
| WO | WO 96/39020 A | 12/1996 |
| WO | WO 01/36598 A1 | 5/2001 |
| WO | WO 01/90343 A | 11/2001 |
| WO | WO 2004/058980 | 7/2004 |

OTHER PUBLICATIONS

K. Vandepoele et al. Genome-wide analysis of core cell cycle genes in *Arabidopsis*. Plant Cell. Apr. 2002;14(4):903-16.*
Kim J.C. et al. A novel cold-inducible zinc finger protein from soybean, SCOF-1, enhances cold tolerance in transgenic plants. Plant J. Feb. 2001;25(3):247-59.*
Kleinow T. et al. GenBank Accession No. AF250337, the *Arabidopsis thaliana* zinc finger protein AZF2 (AZF2) mRNA, complete cds., Sep. 6, 2000.*
Sakamoto H. et al. Expression of a subset of the *Arabidopsis* Cys(2)/His(2)-type zinc-finger protein gene family under water stress. Gene. May 2, 2000;248(1-2):23-32.*

Iida A. et al. A zinc finger protein RHL41 mediates the light acclimatization response in *Arabidopsis*. Plant J. Oct. 2000;24(2):191-203.*
Kleinow T. et al. Functional identification of an *Arabidopsis* snf4 ortholog by screening for heterologous multicopy suppressors of snf4 deficiency in yeast. Plant J. Jul. 2000;23(1):115-22.*
Sakamoto H. et al. *Arabidopsis* Cys2/His2-type zinc-finger proteins function as transcription repressors under drought, cold, and high-salinity stress conditions. Plant Physiol. Sep. 2004;136(1):2734-46. Epub Aug. 27, 2004.*
Temple S.J. et al. Down-regulation of specific members of the glutamine synthetase gene family in alfalfa by antisense RNA technology. Plant Mol Biol. Jun. 1998;37(3):535-47.*
De Veylder L. et al. Control of proliferation, endoreduplication and differentiation by the *Arabidopsis* E2Fa-DPa transcription factor. EMBO J. Mar. 15, 2002;21(6):1360-8.*
Vandepoele et al, "Genome-Wide Analysis of Core Cell Cycle Genes in Arabidopsis", The Plant Cell, vol. 14, 903-916, Apr. 2002.
De Veylder et al, "Control of proliferation, endoreduplication and differentiation by the *Arabidopsis* E2Fa-DPa transcription factor", The EMBO Journal, vol. 21, No. 6, pp. 1360-1368, 2002.
Lin et al, "*Arabidopsis thaliana* chromosome 1 BAC T8L23 genomic sequence, complete sequence",, EMBL AC079733, 2000.
N. Alexandrov et al., "*Arabidopsis thaliana* DNA fragment SEQ ID No. 72617", Database EMBL [Online], Oct. 18, 2000, XP002283128, Database accession No. AAC52840.
N. Alexandrov et al., "*Arabidopsis thaliana* protein fragment SEQ ID No. 72618" Database ENBK [Online], XP002283129, Database accession No. AAG56488.
Database EMBL [Online] XP002283411, Database accession No. AC079733.
L. Veylder et al., "Control of proliferation, endoreduplication and differentiation by the *Arabidopsis* E2Fa-DPa transcription factor", EMBO Journal, Oxford University Press, vol. 21, No. 6, Mar. 15, 2002, pp. 1360-1368, XP002227182.
K. Vandepoele et al., "Genome-wide analysis of core cell cycle genes in *Arabidopsis*", Plant Cell, American Society of Plant Physiologists, vol. 14, No. 4, Apr. 2002, pp. 903-916, XP002259203.
International Search Report of PCT/EP03/11658 mailed Sep. 1, 2004.
Claims pending on Jul. 13, 2009 in U.S. Appl. No. 10/537,897.
H. Takatsuji, "Zinc-Finger Proteins: The Classical Zinc Finger Emerges in Contemporary Plant Science", Plant Molecular Biology, NIJHOFF Publishers, vol. 39, No. 6, Apr. 1999, pp. 1073-1078, XP001005447.
Merriam Webster Online Dictionary 2005, www.m-w.com/home.html.

(Continued)

*Primary Examiner*—Cynthia Collins
(74) *Attorney, Agent, or Firm*—Nixon & Vanderhye P.C.

(57) ABSTRACT

The present invention concerns a method for altering characteristics of a plant. The invention describes the identification of a gene that is downregulated in transgenic plants overexpressing E2Fa/DPa and the use of such sequences to alter plant characteristics. A preferred way for altering characteristics of a plant comprises modifying expression of one or more nucleic acid sequences and or modifying level and/or activity of one or more proteins, which nucleic acids and/or proteins encoded thereby are essentially similar to SEQ ID NO 1835. The gene identified in the present invention have an E2Fa target consensus sequence in their 5' upstream region. The identified gene is postulated to play a role as transcription factors.

12 Claims, 10 Drawing Sheets

OTHER PUBLICATIONS

Bowie et al, "Deciphering the Message in Protein Sequences: Tolerance to Amino Acid Substitutions", Science 247:1306-1310, 1990.
McConnell et al, "Role of *PHABULOSA* and *PHAVOLUTA* in determing radial patterning in shoots", Nature 411 (6838):709-713, 2001.
Kano-Murakami et al, "A rice homeotic gene, *OSH1*, causes unusual phenotypes in transgenic tobacco" (1993, FEBS 334:365-368).
Payne et al, "Heterologous myb genes distinct from *GL1* enhance trichome production when overexpressed in *Nicotiana tabacum*", Development 126, 671-682 (1999).
Pineda et al, Accession No. AAD06454, 2001.
Ayala and Kiger, In Modern Genetics, Second Edition, The Benjamin/Cummings Publishing Company, Menlo Park, California, 1984.

* cited by examiner

MATDB - entry At1g57680 from contig t8l23  mips
(Chromosome 1 / BAC clone T8L23 / sequence database accession EMBL:AC079733)

Type: gene/protein
Code: At1g57680
Old code: T8L23_15
Title: putative protein
Contig: t8l23
Position: 53392-54480 (C)

Notes

-

Classification

- known protein

Functional Category

- UNCLASSIFIED PROTEINS

TargetP prediction

- Targeted to secretory pathway
- TargetP score: 0.968
- TargetP reliability class: 2
- Probable signal sequence length: -

TMHMM transmembrane prediction

- Very likely to be a transmembrane protein (or have a signal peptide) (Exp number of AA in TMHs: 110)
- A transmembrane region could actually be a signal peptide (Exp number, first 60 AAs: 21)
- Orientation of N-terminal: external side (probability: 0.9)
- Transmembrane regions:
  - 40-62
  - 83-100
  - 138-160
  - 181-203
  - 213-235

EMBL

- AY072149 mRNA matches: 1 found

Arabidopsis ESTs

- found 10
  AA585779; AI992654; AI998042; AV518701; AV538415; AV538372; AV541088; AV550688; AV550640; AV554579;

FIGURE 4 run report

- Full report includes FST matches and external annotation... slow.

Protein properties

PEDANT and Interpro data are being recalculated. To access old PEDANT data, use the link in the left frame, but be aware that some protein sequences have been changed due to update of gene models based on cDNA data and PEDANT data may be outdated.

Click here to submit new information about this entry

FIGURE 4 (contin.)

A. thaliana - contig t8123 - entry At1g57680                                                    mips

```
>P1;At1g57680
putative protein
MPLTKLVPDA FGVVTICLVA LLVLLGLLCI AYSFYFQSHV RKQGYIQLGY FSGPWIIRIT
FILFAIWWAV GEIFRLSLLR RHRRLLSGLD LRWQENVCKW YIVSNLGFAE PCLFLTLMFL
LRAPLKMESG ALSGKWNRDT AGYIILYCLP MLALQLAVVL SESRLNGGSG SYVKLPHDFT
RTYSRVIIDH DEVALCTYPL LSTILLGVFA AVLTAYLFWL GRQILKLVIN KRLQKRVYTL
IFSVSSFLPL RIVMLCLSVL TAADKIIFEA LSFLAFLSLF CFCVVSICLL VYFPVSDSMA
LRGLRDTDDE DTAVTEERSG ALLLAPNSSQ TDEGLSLRGR RDSGSSTQER YVELSLFLEA
EN*
C; Length 362 aa
C; Sequence At1g57680 was extracted from t8123
C; Fragment (54480-53392(C))
```

FIGURE 4 (contin.)

A. thaliana - contig t8l23 - coordinates: 53392-54480 (C)　　　　　　　　　　　　　mlps

```
   1 ATGCCCCTGA CAAAATTAGT TCCCGATGCA TTCGGCGTTG TGACGATATG TCTAGTCGCT
  61 CTGCTAGTTC TTTTGGGTCT CCTTTGCATC GCTTACTCGT TCTATTTCCA GTCTCACGTT
 121 CGTAAGCAAG GCTATATTCA ACTTGGTTAC TTCAGTGGTC CCTGGATTAT CCGAATCACT
 181 TTCATTCTCT TTGCTATCTG GTGGGCTGTT GGTGAGATTT TTCGATTGAG TTTGTTGAGG
 241 CGTCACAGAA GGTTGTTGAG TGGGTTGGAT CTGAGATGGC AAGAAAACGT TTGCAAGTGG
 301 TACATCGTTT CCAATCTAGG ATTTGCGGAG CCTTGTCTCT TTCTGACTCT CATGTTTCTT
 361 CTGCGTGCTC CCTTGAAGAT GGAATCAGGG GCTTTGAGCG GAAAATGGAA CAGGGACACA
 421 GCAGGTTATA TTATTCTTTA TTGTCTCCCG ATGCTTGCTC TTCAACTTGC GGTTGTGTTG
 481 TCCGAGTCAC GCCTAAATGG TGGTAGTGGC TCTTATGTAA AGCTGCCACA CGACTTCACA
 541 AGAACGTATT CCCGAGTTAT TATTGATCAC GACGAGGTGG CCTTATGCAC ATATCCTCTA
 601 CTGAGTACCA TCCTTCTTGG TGTGTTTGCA GCCGTCCTAA CAGCTTACTT GTTCTGGCTT
 661 GGAAGGCAGA TACTGAAACT TGTCATTAAC AAGCGTTTAC AGAAGAGAGT ATACACTTTG
 721 ATATTCTCGG TCTCGAGTTT CCTTCCATTA AGGATTGTTA TGCTCTGTTT GTCGGTTCTC
 781 ACAGCAGCAG ACAAGATTAT ATTCGAAGCC CTTTCTTTCT TGGCCTTCCT CTCCCTCTTC
 841 TGCTTTTGCG TGGTATCCAT CTGCTTGCTT GTCTACTTCC CGGTTTCAGA TTCCATGGCC
 901 CTGAGAGGTC TAAGAGACAC AGATGATGAG GATACGGCTG TGACCGAAGA ACGCAGTGGT
 961 GCTCTGTTAC TTGCACCAAA CTCTTCACAA ACTGATGAGG GATTGAGCTT AAGAGGTCGG
1021 AGAGACTCGG GATCGTCTAC ACAGGAGAGG TATGTGGAAC TCAGCCTATT TCTGGAAGCT
1081 GAGAACTAA
```

FIGURE 4 (contin.)

A. thaliana - contig t8l23 - coordinates: 53392-54480 (C)　　　　　　　　　　　　　　　mlps

```
   1 gtattatctc ttgagattct gtgtttaaag gttatgactt ggcttatgt atttcaatat
  61 tgttattgat ttgtgtgcta atcatcttaa tcttcaaggt tgcttagtt ttgagaaagg
 121 ttatgacttt ttaagatcta gggttaagat ggtttgatag gtctttgttt caaatttttg
 181 gtatatttgg taagttttg attatttgtt gttttgttta gtttatgtag gtaacacgca
 241 tatcaagtgt taaagagtca agatcacaaa aagttctatc gggtgatctg ggctgctttc
 301 ttttgtaatc taattgcaga aactttgctc tgacttggat agcttcgtaa aaggttcaat
 361 cttctccgt tttcatcaa tgagtagtaa ctaatctgga aatttgttgg gagagaaagg
 421 gcacattgca ctgctattgc tagagaacgt ttctgcatcc atgctggtag agagcatgcg
 481 tggatactgt gtttgggtg ATGCCCCTGA CAAAATTAGT TCCCGATGCA TTCGGCGTTG
 541 TGACGATATG TCTAGTCGCT CTGCTAGTTC TTTTGGGTCT CCTTTGCATC GCTTACTCGT
 601 TCTATTTCCA GTCTCACGTT CGTAAGCAAG GCTATATTCA ACTTGGTTAC TTCAGTGGTC
 661 CCTGGATTAT CCGAATCACT TTCATTCTCT TTGCTATCTG GTGGGCTGTT GGTGAGATTT
 721 TTCGATTGAG TTTGTTGAGG CGTCACAGAA GGTTGTTGAG TGGGTTGGAT CTGAGATGGC
 781 AAGAAAACGT TTGCAAGTGG TACATCGTTT CCAATCTAGG ATTTGCGGAG CCTTGTCTCT
 841 TTCTGACTCT CATGTTTCTT CTGCGTGCTC CCTTGAAGAT GGAATCAGGG GCTTTGAGCG
 901 GAAAATGGAA CAGGGACACA GCAGGTTATA TTATTCTTTA TTGTCTCCCG ATGCTTGCTC
 961 TTCAACTTGC GGTTGTGTTG TCCGAGTCAC GCCTAAATG TGGTAGTGGC TCTTATGTAA
1021 AGCTGCCACA CGACTTCACA AGAACGTATT CCCGAGTTAT TATTGATCAC GACGAGGTGG
1081 CCTTATGCAC ATATCCTCTA CTGAGTACCA TCCTTCTTGG TGTGTTTGCA GCCGTCCTAA
1141 CAGCTTACTT GTTCTGGCTT GGAAGGCAGA TACTGAAACT TGTCATTAAC AAGCGTTTAC
1201 AGAAGAGAGT ATACACTTTG ATATTCTCGG TCTCGAGTTT CCTTCCATTA AGGATTGTTA
1261 TGCTCTGTTT GTCGGTTCTC ACAGCAGCAG ACAAGATTAT ATTCGAAGCC CTTTCTTTCT
1321 TGGCCTTCCT CTCCCTCTTC TGCTTTTGCG TGGTATCCAT CTGCTTGCTT GTCTACTTCC
1381 CGGTTTCAGA TTCCATGGCC CTGAGAGGTC TAAGAGACAC AGATGATGAG GATACGGCTG
1441 TGACCGAAGA ACGCAGTGGT GCTCTGTTAC TTGCACCAAA CTCTTCACAA ACTGATGAGG
1501 GATTGAGCTT AAGAGGTCGG AGAGACTCGG GATCGTCTAC ACAGGAGAGG TATGTGGAAC
1561 TCAGCCTATT TCTGAAGCT GAGAACTAA a atcgccaaag gctgttcta ttttggctttt
1621 ggcaatgtac agattcctgg tgaaacaagc agagagagag ggataaagag tttaagtatg
1681 agaatatgtt tgcgcaaaaa aaggcataat ttcagttttg tggcaaagac actttgactg
1741 taaaggaggg cttaaggggg cttactcttg tgagggtttg ttgtttgaaa tgtttctgc
1801 ttgatggatc atattttgt accttattta tgtgatcaat tttgatttag aaaaaaaaaa
1861 aaaaaacaat agccgtgaac atgagcatga cttaaaaga taaatcagcc ttttaccctc
1921 tattcttttgg actcatgaac atgagacttc ataagaaaat tagagaaatt gtaccaagca
1981 aaacagccat atagtgttct aaacttccat gtcaattcga cctagacaaa tacacttatg
2041 acttcagaaa atttgacata attttaatat ttaaccaagt ttgtcaaga
```

Sequences of 5' leader, 3' trailer, and introns (when applicable) are printed in lowercase.

FIGURE 4 (contin.)

PLANTS HAVING IMPROVED GROWTH CHARACTERISTICS AND METHODS FOR MAKING THE SAME

This application is the US national phase of international application PCT/EP2003/011658 filed 20 Oct. 2003, which designated the U.S. and claims priority of EP 02079408.7, filed 18 Oct. 2002, the entire contents of each of which are hereby incorporated by reference.

The present invention concerns altering plant characteristics. More particularly, the present invention relates to identification of genes and proteins involved in E2Fa/DPa-mediated processes and further relates to use of such genes and proteins for altering characteristics in plants.

The present invention concerns a method for altering one or more plant characteristics, whereby the altered plant characteristic is selected from altered development, altered plant growth, altered, for example increased, plant yield and/or biomass, biochemistry, physiology, architecture, metabolism, survival capacity or stress tolerance by modifying expression of one or more of the genes according to the present invention and/or by modifying levels and/or activity of the proteins encoded by these genes. The present invention also concerns genetic constructs for performing the methods of the invention and to plants or plant parts obtainable by the methods of the present invention, which plants have altered characteristics compared to their otherwise isogenic counterparts. The invention also extends to recombinant nucleic acids and the use thereof in the methods according to the invention.

Growth, development and differentiation of higher organisms are controlled by a highly ordered set of events called the cell cycle (Morgan, 1997). Cell division and cell growth are operated by the cell cycle, which ensures correct timing and high fidelity of the different transition events involved. Cell cycle regulation at both G1→S and G2→M phase transitions depends on the formation of appropriate protein complexes and both transitions are believed to be the major control points in the cell cycle. The cell's decision to proliferate and synthesize DNA and ultimately to divide is made at the G1→S restriction point in late G1. Overcoming this point of no return requires the cell's competence to initiate DNA synthesis as well as the expression of S-phase genes. Transcription of S-phase-specific genes requires binding to the DNA of an E2F transcription factor. Dimerisation of E2F with DP is a prerequisite for high affinity binding to the E2F consensus DNA binding site (A/T)TT(G/C)(G/C)C(G/C)(G/C) (SEQ ID NO 2775), for example (TTT(C/G)(C/G)CGC), that can be found in the promoters of genes involved in DNA replication, repair, checkpoint control and differentiation (Ren et al., 2002; Weinmann et al., 2001; Kel et al., 2001). Variants of this consensus sequence as well as other locations of this consensus sequences are also found. The heterodimeric E2F/dimerization partner (DP) transcription factor also regulates the promoter activity of multiple genes, which are essential for DNA replication and cell cycle control (Helin, 1998; Müller and Helin, 2000). E2F transcription factors are critical effectors of the decision to pass the restriction point and to allow the cell to proceed in S-phase.

In the *Arabidopsis* genome, 3 E2F (E2Fa, E2Fb, and E2Fc) and 2 DP genes (DPa and DPb) are present (Vandepoele et al., 2002). The phenotypic analysis of plants overexpressing E2Fa and DPa was described recently (De Veylder et al., 2002). Microscopic analysis revealed that E2Fa/DPa overproducing cells underwent ectopic cell division or endoreduplication, depending on the cell type. Whereas extra cell divisions resulted in cells being smaller than those seen in the same tissues of control plants, extra endoreduplication caused formation of giant nuclei. RT-PCR demonstrated that expression levels of genes involved in DNA replication (CDC6, ORC1, MCM, DNA pol α) were strongly upregulated in plants overexpressing E2Fa and DPa (De Veylder et al., 2002).

The present invention provides genes having altered expression levels in plants overexpressing E2Fa and DPa relative to expression levels in corresponding wild type plants. Furthermore, the present invention provides means to modulate expression of these genes, which in turn allows for modulation of the biological processes that they control. The present invention provides methods to mimic E2F/DP level and/or activity by manipulating downstream factors involved in E2F/DP pathways. This strategy allows a fine-tuning of the effects of E2Fa/DPa. Whereas overexpression of E2Fa or DPa or both can be pleiotropic and/or can have pleiotropic effects, it is the invention provides methods to alter plant characteristics in a more controlled and targeted way, by using the E2F/DP target genes as defined by the present invention. Modulation of particular biological processes is now possible and may give rise to plants having altered characteristics, which may have particularly useful applications in agriculture and horticulture.

Therefore, according to the present invention, there is provided a method to alter one or more plant characteristics, comprising modifying, in a plant, expression of one or more nucleic acids and/or modifying level and/or activity of one or more proteins, which nucleic acids or proteins are essentially similar to any one of SEQ ID NO 1 to 2755, and wherein said one or more plant characteristics are altered relative to corresponding wild type plants.

The inventors designed a microarray experiment, comparing transcript levels of more than 4579 genes of wild type and transgenic *Arabidopsis* lines overexpressing E2Fa/DPa. Surprisingly, the inventors found that particular genes are up or down regulated in E2Fa-DPa overexpressing plants. The sequences which were at least 1.3 times upregulated or downregulated, are represented with their MIPS (Munich information center for protein sequences) accession number MATDB database URL: mips.gsf.de/proj/thal/db/index) in Tables 4 and 5. Sequences which were at least 2-fold upregulated or 2-fold downregulated are shown in Tables 1 and 2, respectively. Further classification of these genes according to their function is provided in Tables 1 and 2. Promoter analysis of these genes allowed for the identification of genes under the direct control of E2Fa and/or DPa proteins and genes that are indirectly controlled by the E2Fa/DPa complex. Examples of mechanisms for such indirect control include, (i) recognition by E2F/DP of other sequence elements that diverge from the consensus recognition site; (ii) possible association of E2F/DP with other DNA binding proteins capable of recognizing other DNA elements; and (iii) sequential transcription activation of a first gene capable of regulating transcription of a second gene. It is to be understood that having an E2F target sequence is not a prerequisite to be regulated by E2F.

The gene that corresponds to the sequence deposited under the MIPS database accession number At1g57680 is an example of a gene, which is likely to be indirectly controlled by the E2Fa/DPa complex. This gene is of unknown function. It was surprising to find this unknown gene and the other genes of Tables 1, 2, 4 and 5 to be involved in E2Fa/DPa controlled processes. The genes according to the present invention are represented herein with their nucleic acid sequence and corresponding amino acid sequence as set forth in SEQ ID NO 1 to 2755.

Preferably expression and/or level and/or activity of one of the genes and/or proteins according to any of SEQ ID NO 1 to 2755 is modified. Alternatively expression and/or level and/or activity of one or more of those genes and/or proteins is modified. According to a further embodiment one or more gene/and or proteins of the same functional category as presented in Table 1 or Table 2, are modified.

The term "modifying expression" relates to altering level (increasing expression or decreasing expression) or altering the time or altering the place of expression of a nucleic acid. The term "modified" as used herein is used interchangeably with "altered" or "changed".

Modified expression (or level or activity) of a sequence essentially similar to any one of SEQ ID NO 1 to 2755 encompasses changed expression (or level or activity) of a gene product, namely a polypeptide, in specific cells or tissues. The changed expression, activity and/or levels are changed compared to expression, activity and/or levels of the gene or protein essentially similar to any one of SEQ ID NO 1 to 2755 acid in corresponding wild-type plants. The changed gene expression may result from changed expression levels of an endogenous gene essentially similar to any one of SEQ ID NO 1 to 2755 acid and/or may result from changed expression levels of a gene essentially similar to SEQ ID NO 1 to 2755 acid previously introduced into a plant. Similarly, changed levels and/or activity of a protein essentially similar to any one of SEQ ID NO 1 to 2755 acid may be due to changed expression of an endogenous nucleic acid/gene and/or due to changed expression of nucleic acid/gene previously introduced into a plant.

Modified expression of a gene/nucleic acid and/or increasing or decreasing activity and/or levels of a gene product may be effected, for example, by chemical means and/or recombinant means.

Advantageously, modified expression of a nucleic acid according to the invention and/or modified activity and/or levels of a protein according to the invention may be effected by chemical means, i.e. by exogenous application of one or more compounds or elements capable of modifying activity and/or levels of the protein and/or capable of modifying expression of a nucleic acid/gene according to the invention. The term "exogenous application" as defined herein is taken to mean the contacting or administering of a suitable compound or element to plant cells, tissues, organs or to the whole organism. The compound or element may be exogenously applied to a plant in a form suitable for plant uptake (such as through application to the soil for uptake via the roots, or in the case of some plants by applying directly to the leaves, for example by spraying). The exogenous application may take place on wild-type plants or on transgenic plants that have previously been transformed with a nucleic acid/gene according to the present invention or with another transgene.

Suitable compounds or elements include proteins or nucleic acids according to SEQ ID NO 1 to 2755 or proteins or nucleic acids essentially similar to SEQ ID NO 1 to 2755. Essentially similar proteins or nucleic acids are, homologues, derivatives or active fragments of these proteins and/or portions or sequences capable of hybridizing with these nucleic acids. The exogenous application of yet other compounds or elements capable of modifying levels of factors that directly or indirectly activate or inactivate a protein according to the present invention will also be suitable in practicing the invention. These compounds or elements also include antibodies that can recognize or mimic the function of the proteins according to the present invention. Such antibodies may comprise "plantibodies", single chain antibodies, IgG antibodies and heavy chain camel antibodies, as well as fragments thereof. Additionally or alternatively, the resultant effect may also be achieved by the exogenous application of an interacting protein or activator or an inhibitor of the gene/gene product according to the present invention. Additionally or alternatively, the compound or element may be a mutagenic substance, such as a chemical selected from any one or more of: N-nitroso-N-ethylurea, ethylene imine, ethyl methanesulphonate and diethyl sulphate. Mutagenesis may also be achieved by exposure to ionising radiation, such as X-rays or gamma-rays or ultraviolet light. Methods for introducing mutations and for testing the effect of mutations (such as by monitoring gene expression and/or protein activity) are well known in the art.

Therefore, according to one aspect of the present invention, there is provided a method for altering plant characteristics, comprising exogenous application of one or more compounds or elements capable of modifying expression of a gene and/or capable of modifying activity and/or levels of a protein according to the present invention.

Additionally or alternatively, and according to a preferred embodiment of the present invention, modified of expression of a nucleic acid and/or modified of activity and/or levels of a protein, wherein these nucleic acids or proteins are essentially similar to any of SEQ ID NO 1 to 2755, may be effected by recombinant means. Such recombinant means may comprise a direct and/or indirect approach for modifying expression of a nucleic acid and/or for modifying activity and/or levels of a protein.

Therefore there is provided by the present invention, a method to alter plant characteristics, comprising modifying gene expression and/or protein levels and/or protein activity, which modification may be effected by recombinant means and/or by chemical means and wherein said gene and/or protein are essentially similar to any one of SEQ ID NO 1 to 2755.

An indirect recombinant approach may comprise for example introducing, into a plant, a nucleic acid capable of increasing or decreasing activity and/or levels of the protein in question (a protein essentially similar to any one of SEQ ID NO 1 to 2755) and/or capable of increasing or decreasing expression of the gene in question (a gene essentially similar to any one of SEQ ID NO 1 to 2755). Examples of such nucleic acids to be introduced into a plant, are nucleic acids encoding transcription factors or activators or inhibitors that bind to the promoter of a gene or that interact with a protein essentially similar to any one of SEQ ID NO 1 to 2755. Methods to test these types of interactions and methods for isolating nucleic acids encoding such interactors include yeast one-hybrid or yeast two-hybrid screens.

Also encompassed by an indirect approach for modifying activity and/or levels of a protein according to the present invention and/or expression of a gene according to the present invention, is the provision of a regulatory sequence, or the inhibition or stimulation of regulatory sequences that drive expression of the native gene in question or of the transgene in question. Such regulatory sequences may be introduced into a plant. For example, the nucleic acid introduced into the plant is a promoter, capable of driving the expression of the endogenous gene essentially similar to any one of SEQ ID NO 1 to 2755.

A further indirect approach for modifying activity and/or levels and/or expression of a gene or protein according to the present invention in a plant encompasses modifying levels in a plant of a factor able to interact with the protein according to the present invention. Such factors may include ligands of the protein according to the present invention. Therefore, the present invention provides a method for altering characteristics of a plant, when compared to the corresponding wild-type plants, comprising modifying expression of a gene coding for a protein which is a natural ligand of a protein essentially similar to any one of SEQ ID NO 1 to 2755. Furthermore, the present invention also provides a method to alter one or more plant characteristics relative to corresponding wild-type plants, comprising modifying expression of a gene coding for a protein which is a natural target/substrate of a protein essentially similar to SEQ ID NO 1 to 2755.

A direct and more preferred approach to alter one or more plant characteristics, comprises introducing into a plant a nucleic acid essentially similar to any one of SEQ ID NO 1 to 2755, wherein said nucleic acid essentially similar to any one of SEQ ID NO 1 to 2755 is any one of SEQ ID NO 1 to 2755 or a portion thereof or sequences capable of hybridizing therewith and which nucleic acid preferably encodes a protein essentially similar to any one of SEQ ID NO 1 to 2755, which protein essentially similar to any one of SEQ ID NO 1 to 2755 is any one of SEQ ID NO 1 to 2755 or a homologue, derivative or active fragment thereof. The nucleic acid may be introduced into a plant by, for example, transformation.

In the context of the present invention the term "modifying expression" and modifying level and/or activity encompasses "enhancing or decreasing". Methods for obtaining enhanced or increased expression of genes or gene products are well documented in the art and are for example overexpression driven by a strong promoter, the use of transcription enhancers or translation enhancers. The term "overexpression" of a gene refers to expression patterns and/or expression levels of said gene normally not occurring under natural conditions. Ectopic expression can be achieved in a number of ways including operably linking of a coding sequence encoding said protein to an isolated homologous or heterologous promoter in order to create a chimeric gene.

Alternatively and/or additionally, increased expression of a gene or increased activities and/or levels of a protein in a plant cell, is achieved by mutagenesis. For example these mutations can be responsible for the changed control of the gene, resulting in more expression of the gene; relative to the wild-type gene. Mutations can also cause conformational changes in a protein, resulting in more activity and/or levels of the protein.

Examples of decreasing expression of a gene are also well documented in the art and include for example: downregulation of expression by anti-sense techniques, RNAi techniques, small interference RNAs (siRNAs), microRNA (miRNA), etc. Therefore according to a particular aspect of the invention, there is provided a method to alter characteristics of plants, including technologies that are based on for example the synthesis of antisense transcripts, complementary to the mRNA of a gene essentially similar to any one of SEQ ID NO 1 to 2755. Another method for downregulation of gene expression or gene silencing comprises use of ribozymes, for example as described in WO9400012 (Atkins et al.), WO9503404 (Lenee et al.), WO0000619 (Nikolau et al.), WO9713865 (Ulvskov et al.) and WO9738116 (Scott et al.).

Gene silencing may also be achieved by insertion mutagenesis (for example, T-DNA insertion or transposon insertion) or by gene silencing strategies as described among others in the documents WO9836083 (Baulcombe and Angell), WO9853083 (Grierson et al.), WO9915682 (Baulcombe et al.) or WO9953050 (Waterhouse et al.).

Expression of an endogenous gene may also be reduced if the endogenous gene contains a mutation. Such a mutant gene may be isolated and introduced into the same or different plant species in order to obtain plants having altered characteristics. Also dominant negative mutants of a nucleic acid essentially similar to any one of SEQ ID NO 1 to 2755 can be introduced in the cell to decrease the level/and or activity of the endogenous corresponding protein.

Other methods to decrease the expression of a nucleic acid and/or activity and/or level of proteins essentially similar to any one of SEQ ID NO 1 to 2755 in a cell encompass, for example, the mechanisms of transcriptional gene silencing, such as the methylation of the promoter of a gene according to the present invention.

Modifying expression of the gene also encompasses altered transcript level of the gene. Altered transcript levels of a gene can be sufficient to induce certain phenotypic effects, for example via the mechanism of cosuppression. Here the overall effect of overexpression of a transgene is that there is less level and/or activity in the cell of the protein, which is encoded by the native gene showing homology to the introduced transgene.

Cosuppression is accomplished by the addition of coding sequences or parts thereof in a sense orientation into the cell. Therefore, according to one aspect of the present invention, the characteristics of a plant may be changed by introducing into a plant an additional copy (in full or in part) of a gene essentially similar to any one of SEQ ID NO 1 to 2755 already present in a host plant. The additional gene may silence the endogenous gene, giving rise to a phenomenon known as co-suppression.

According to the invention, "nucleic acid" or the "gene" essentially similar to any one of SEQ ID NO 1 to 2755 in a plant may be the wild type gene, i.e. native or endogenous or heterologous, i.e. derived from another individual plant or plant species. The gene (transgene) may be substantially modified from its native form in composition and/or genomic environment through deliberate human manipulation. This transgene can be introduced into a host cell by transformation techniques. Also expression of the native genes can be modified by introduction in the plant of regulatory sequences capable of altering expression of the native gene, as described above.

The term "modifying activity" relates to enhancing, decreasing or altering time or place of activity of a protein or polypeptide. According to the invention, the "protein" or the "polypeptide" may be the wild type protein, i.e. native or endogenous, or alternatively, the protein may be heterologous, i.e. derived from another individual or species.

The term "essentially similar to" in relation to a protein of the present invention as used herein includes variants such as homologues, derivatives and functional fragment thereof. The term "essentially similar to" in relation to a gene includes variants such as at least a part of the gene in question; a complement of the gene; RNA, DNA, a cDNA or a genomic DNA corresponding to the protein or gene; a variant of the gene due to the degeneracy of the genetic code; a family member of the gene or protein; an allelic variant of the gene or protein; and different splice variant of the gene or protein and variants that are interrupted by one or more intervening sequences. Advantageously, nucleic acids or proteins essentially similar to nucleic acids and the proteins according to any of SEQ ID NO 1 to 2755 may be used in the methods of the present invention. These variant nucleic acids and variant amino acids are described further below.

Any variant of a particular protein according to the present invention is a variant, which upon construction of a phylogenetic tree with that particular protein, tends to cluster around the particular protein which is any one of SEQ ID NO 1 to 2755. Such a phylogenetic tree can be constructed with alignments of amino acid sequences or with nucleic acid sequences. A person skilled in the art could readily determine whether any variant in question falls within the definition of a "a nucleic acid or protein essentially similar to any one of SEQ ID NO 1 to 2755". Hereto the man skilled in the art would use known techniques and software for the making of such phylogenetic trees, such as a GCG, EBI or CLUSTAL package, or Align X, using default parameters. Advantageously, the methods according to the present invention may also be practised using such variants.

Any variant suitable for use in the methods according to the invention may readily be determined using routine techniques, such as by following the methods described in the Examples section by simply substituting the sequence used in the actual Example with the fragment to be tested for functionality.

A first example of such variants are "homologues" of the proteins of the present invention, which homologues encompass peptides, oligopeptides, polypeptides, proteins and enzymes having amino acid substitutions, deletions and/or additions relative to the protein in question and having similar biological and functional activity as an unmodified protein from which they are derived. To produce such homologues, amino acids of the protein may be replaced by other amino acids having similar properties (such as similar hydrophobicity, hydrophilicity, antigenicity, propensity to form or break α-helical structures or β-sheet structures). Conservative substitution tables are well known in the art (see for example Creighton (1984).

The homologues useful in the method according to the invention may have at least 30%, 32%, 34%, 36%, 38%, 40%, 42%, 44%, 46%, 48% or 50% sequence identity or similarity (functional identity) to the unmodified protein, alternatively at least 52%, 54%, 56%, 58% or 60% sequence identity or similarity to an unmodified protein, or alternatively at least 62%, 64%, 66%, 68% or 70% sequence identity or similarity to an unmodified protein. Typically, the homologues have at least 72%, 74%, 76%, 78% or 80% sequence identity or similarity to an unmodified protein, preferably at least 81%, 82%, 83%, 84%, 85%, 86%, 87%, 88% or 89% sequence identity or similarity, further preferably at least 90%, 91%, 92%, 93% or 94% sequence identity or similarity to an unmodified protein, further preferably at least 95% 96%, 97%, 98% or 99% sequence identity or similarity to an unmodified protein. This % identity can be calculated using the Gap program in the WISCONSIN PACKAGE version 10.0-UNIX from Genetics Computer Group, Inc based on the method of Needleman and Wunsch (J. Mol. Biol. 48:443-453 (1970)) using the set of default parameters for pairwise comparison (for amino acid sequence comparison: Gap Creation Penalty=8, Gap Extension Penalty=2; for nucleotide sequence comparison: Gap Creation Penalty=50; Gap Extension Penalty=3).

The percentage of identity can also be calculated by using other alignment program well known in the art. For example, the percentage of identity can be calculated using the program needle (EMBOSS package) or stretcher (EMBOSS package) or the program align X, as a module of the vector NTI suite 5.5 software package, using the parameters (for example GAP penalty 5, GAP opening penalty 15, GAP extension penalty 6.6).

These above-mentioned analyses for comparing sequences may be done on full-length sequences but additionally or alternatively the calculation of sequence identity or similarity can be based on a comparison of certain regions such as conserved domains.

The identification of such domains, would also be well within the realm of a person skilled in the art and involves, for example, running a computer readable format of the nucleic acids of the present invention in alignment software programs, scanning publicly available information on protein domains, conserved motifs and boxes. This type of information on protein domains is available in the PRODOM (URL: biochem.ucl.ac.uk/bsm/dbbrowser/jj/prodomsrchjj), PIR (URL: pir.georgetown.edu, INTERPRO (URL: ebi.ac.uk/interpro) or pFAM (URL: pfam.wustl.edu) database. Sequence analysis programs designed for motif searching can be used for identification of fragments, regions and conserved domains as mentioned above. Preferred computer programs would include but are not limited to: MEME, SIGNALSCAN, and GENESCAN. A MEME algorithm (Version 2.2) can be found in version 10.0 of the GCG package; or on the Internet site URL: .sdsc.edu/MEME/meme. SIGNALSCAN version 4.0 information is available on the Internet site http://biosci.cbs.umn.edu/software/sigscan.html. GENESCAN can be found on the Internet site URL: gnomic.stanford.edu/GENESCANW.

As mentioned above the nucleic acid suitable for practising the methods of the present invention can be wild type (native or endogenous). Alternatively, the nucleic acid may be derived from another (or the same) species, which gene is introduced into the plant as a transgene, for example by transformation. The nucleic acid may thus be derived (either directly or indirectly (if subsequently modified)) from any source provided that the nucleic acid, when expressed in a plant, leads to modified expression of a nucleic acid/gene or modified activity and/or levels of a protein essentially similar to SEQ ID NO 1 to 2755. The nucleic acid may be isolated from a microbial source, such as bacteria, yeast or fungi, or from a plant, algae, insect, or animal (including human) source. Methods for the search and identification of other homologues of the proteins of the present invention, or for nucleic acid sequences encoding homologues of proteins of the present invention would be well known to person skilled in the art. Methods for the alignment of sequences for comparison are well known in the art, such methods include GAP, BESTFIT, BLAST, FASTA and TFASTA. The BLAST algorithm calculates percent sequence identity and performs a statistical analysis of the similarity between the two sequences. The software for performing BLAST analysis is publicly available through the National Center for Biotechnology Information.

Two special forms of homology, orthologous and paralogous, are evolutionary concepts used to describe ancestral relationships of genes. The term "paralogous" relates to gene-duplications within the genome of a species leading to paralogous genes. The term "orthologous" relates to homologous genes in different organisms due to ancestral relationship. The term "homologues" as used herein also encompasses paralogues and orthologues of the proteins used in the methods according to the invention.

A preferred homologue is a homologue obtained from a plant, whether from the same plant species or different. The nucleic acid may be isolated from a dicotyledonous species, preferably from the family Brassicaceae, further preferably from *Arabidopsis thaliana*.

Suitable homologues for use in the methods of the present invention have been identified in the genomes of rice and maize. These homologues are represented by their Genbank accession numbers in Table 1 and 2. Other homologues, especially orthologues from other plant species, are identifiable by methods well known by a person skilled in the art. In silico, methods involve running sequence alignment programs with the sequence of interest as mentioned above. In vivo methods involve the DNA encoding the protein of interest and are for example PCR techniques using degenerated primers designed based on the sequence of interest, which is any one essentially similar to any one of SEQ ID NO 1 to 2755, or hybridisation techniques with at least part of the sequence of interest.

"Substitutional variants" of a protein are those in which at least one residue in an amino acid sequence has been removed and a different residue inserted in its place. Amino acid substitutions are typically of single residues, but may be clustered depending upon functional constraints placed upon the polypeptide; insertions will usually be of the order of about 1-10 amino acid residues, and deletions will range from about 1-20 residues.

"Insertional variants" of a protein are those in which one or more amino acid residues are introduced into a predetermined site in the protein. Insertions can comprise amino-terminal and/or carboxy-terminal fusions as well as intra-sequence insertions of single or multiple amino acids. Generally, insertions within the amino acid sequence will be smaller than amino- or carboxy-terminal fusions, of the order of about 1 to 10 residues. Examples of amino- or carboxy-terminal fusion proteins or peptides include the binding domain or activation domain of a transcriptional activator as used in the yeast two-hybrid system, phage coat proteins, (histidine)$_6$-tag, glutathione S-transferase-tag, protein A, maltose-binding protein, dihydrofolate reductase, Tag•100 epitope, c-myc epitope, FLAG®-epitope, lacZ, CMP (calmodulin-binding peptide), HA epitope, protein C epitope and VSV epitope.

"Deletion variants" of a protein are characterized by the removal of one or more amino acids from the protein. Amino acid variants of a protein may readily be made using peptide synthetic techniques well known in the art, such as solid phase peptide synthesis and the like, or by recombinant DNA manipulations. The manipulation of DNA sequences to produce substitution, insertion or deletion variants of a protein are well known in the art. For example, techniques for making substitution mutations at predetermined sites in DNA are well known to those skilled in the art and include M13 mutagenesis, T7-Gen in vitro mutagenesis (USB, Cleveland, Ohio), QuickChange Site Directed mutagenesis (Stratagene, San Diego, Calif.), PCR-mediated site-directed mutagenesis or other site-directed mutagenesis protocols.

The term "derivatives" of a protein according to the present invention are those peptides, oligopeptides, polypeptides, proteins and enzymes which may comprise substitutions, deletions or additions of naturally and non-naturally occurring amino acid residues compared to the amino acid sequence of a naturally-occurring form of the protein as deposited under the accession numbers presented in Table 1, 2, 4 and 5. "Derivatives" of a protein of the present invention encompass peptides, oligopeptides, polypeptides, proteins and enzymes which may comprise naturally occurring altered, glycosylated, acylated or non-naturally occurring amino acid residues compared to the amino acid sequence of a naturally-occurring form of the polypeptide. A derivative may also comprise one or more non-amino acid substituents compared to the amino acid sequence from which it is derived, for example a reporter molecule or other ligand, covalently or non-covalently bound to the amino acid sequence such as, for example, a reporter molecule which is bound to facilitate its detection, and non-naturally occurring amino acid residues relative to the amino acid sequence of a naturally-occurring protein of the present invention.

Another variant useful in the methods of the present invention is an active fragment of a protein essentially similar to any one of SEQ ID NO 1 to 2755. The expression "functional fragment" in relation to a protein refers to a fragment that encompasses contiguous amino acid residues of said protein, and that has retained the biological activity of said naturally-occurring protein. For example, useful fragments comprise at least 10 contiguous amino acid residues of a protein essentially similar to any one of SEQ ID NO 1 to 2755. Other preferred fragments are fragments of these proteins starting at the second or third or further internal methionin residues. These fragments originate from protein translation, starting at internal ATG codons.

Advantageously, the method according to the present invention may also be practiced using fragments of DNA or of a nucleic acid sequence. The term "DNA fragment or DNA segment" refers to a piece of DNA derived or prepared from an original (larger) DNA molecule. The term is not restrictive to the content of the DNA fragment or segment. For example, the DNA fragment or segments can comprise many genes, with or without additional control elements or may contain spacer sequences. A functional fragment refers to a piece of DNA derived or prepared from an original (larger) DNA molecule, which DNA portion, when introduced and expressed in a plant, gives plants having altered characteristics. The fragments may be made by making one or more deletions and/or truncations to the nucleic acid sequence. Techniques for introducing truncations and deletions into a nucleic acid are well known in the art.

Another example of variants useful in the methods of the present invention, encompasses nucleic acid sequences capable of hybridising with a nucleic acid sequence as presented in any one of SEQ ID NO 1 to 2755 or a nucleic acid encoding a protein as presented in any one of SEQ ID NO 1 to 2755.

The term "hybridisation" as defined herein is the process wherein substantially homologous complementary nucleotide sequences anneal to each other. The hybridisation process can occur entirely in solution, i.e. both complementary nucleic acids are in solution. Tools in molecular biology relying on such a process include the polymerase chain reaction (PCR; and all methods based thereon), subtractive hybridisation, random primer extension, nuclease S1 mapping, primer extension, reverse transcription, cDNA synthesis, differential display of RNAs, and DNA sequence determination. The hybridisation process can also occur with one of the complementary nucleic acids immobilised to a matrix such as magnetic beads, Sepharose beads or any other resin. Tools in molecular biology relying on such a process include the isolation of poly(A+) mRNA. The hybridisation process can furthermore occur with one of the complementary nucleic acids immobilised to a solid support such as a nitro-cellulose or nylon membrane or immobilised by e.g. photolithography to e.g. a siliceous glass support (the latter known as nucleic acid arrays or microarrays or as nucleic acid chips). Tools in molecular biology relying on such a process include RNA and DNA gel blot analysis, colony hybridisation, plaque hybridisation, in situ hybridisation and microarray hybridisation. In order to allow hybridisation to occur, the nucleic acid molecules are generally thermally or chemically denatured to melt a double strand into two single strands and/or to remove hairpins or other secondary structures from single stranded nucleic acids. The stringency of hybridisation is influenced by conditions such as temperature, salt concentration and hybridisation buffer composition. High stringency conditions for hybridisation include high temperature and/or low salt concentration (salts include NaCl and Na$_3$-citrate) and/or the inclusion of formamide in the hybridisation buffer and/or lowering the concentration of compounds such as SDS (detergent) in the hybridisation buffer and/or exclusion of compounds such as dextran sulphate or polyethylene glycol (promoting molecular crowding) from the hybridisation buffer. Conventional hybridisation conditions are described in, for example, Sambrook (2001), but the skilled craftsman will appreciate that numerous different hybridisation conditions can be designed in function of the known or the expected homology and/or length of the nucleic acid sequence. With specifically hybridising is meant hybridising under stringent conditions. Specific conditions for "specifically hybridising" are for example: hybridising under stringent conditions such as a temperature of 60° C. followed by washes in 2×SSC, 0.1×SDS, and 1×SSC, 0.1×SDS. Depending on the source and concentration of the nucleic acid involved in the hybridisation, alternative conditions of stringency may be employed, such as medium stringency conditions. Examples of medium stringency conditions include 1-4×SSC/0.25% w/v SDS at $\geq$45° C. for 2-3 hours. Sufficiently low stringency hybridisation conditions are particularly preferred to isolate nucleic acids heterologous to the DNA sequences of the invention defined supra. Elements contributing to heterology include allelism, degeneration of the genetic code and differences in preferred codon usage. The stringency conditions may start low and be progressively increased until there is provided a hybridising nucleic acid, as defined hereinabove. Elements contributing to heterology include allelism, degeneration of the genetic code and differences in preferred codon usage.

Another variant useful in the methods for altering growth characteristics encompasses a nucleic acid sequence which is an alternative splice variant of a gene of the present invention (deposited in the MIPS database under the accession numbers as presented in Tables 1, 2, 4 or 5). The term "alternative splice variant" as used herein encompasses variants in which introns and selected exons have been excised, replaced or added. Such splice variants may be found in nature or can be manmade. For example, introns or exons can be excised, replaced or added such that the mRNA has altered expression (e.g. seed-preferred expression), or altered response to specific signals). Preferred variants will be ones in which the biological activity of the proteins of the present invention remains unaffected, which can be achieved by selectively retaining functional segments of the proteins. Methods for making such splice variants are well known in the art.

Another example of a variant useful to alter plant characteristics, is an allelic variant of a gene essentially similar to any one of SEQ ID NO 1 to 2755. Allelic variants exist in nature and encompassed within the methods of the present invention is the use of these isolated natural alleles in the methods according to the invention. Allelic variants encompass Single Nucleotide Polymorphisms (SNPs), as well as Small Insertion/Deletion Polymorphisms (INDELs). The size of INDELs is usually less than 100 bp. SNPs and INDELs form the largest set of sequence variants in naturally occurring polymorphic strains of most organisms. Allellic variation can also be created artificially, such as for example by the techniques of EMS mutagenesis. Typically such variants are created with the purpose of breeding the altered plant characteristic according to the present invention in a plant. Alternatively, naturally mutated alleles are the subject of such selection and breeding programmes, wherein the allele capable of conferring altered plant characteristics to the plant are selected and plants containing such allele are used for further breeding the trait.

Accordingly, the present invention provides a method for altering plant characteristics, using a splice variant or an allelic variant of a nucleic acid sequence according to any one of SEQ ID NO 1 to 2755.

The term "plant characteristic" means any characteristic of a plant, plant cell or plant tissue described hereafter. These characteristics encompass but are not limited to, characteristics of plant development, plant growth, yield, biomass production, plant architecture, plant biochemistry, plant physiology, metabolism, survival capacity, stress tolerance and more. DNA synthesis, DNA modification, endoreduplication, cell cycle, cell wall biogenesis, transcription regulation, signal transduction, storage lipid mobilization, photosynthesis and more.

The term "altering plant characteristics" as used herein encompasses any change in said characteristic such as increase, decrease or change in time or place. According to a preferred embodiment of the invention, altering a plant characteristics encompasses improving the plant characteristic, such as for example increasing the plant characteristic (e.g. yield), or accelerating the characteristic (e.g. growth rate).

"Growth" refers to the capacity of the plant or of plant parts to expand and increase in biomass. Altered growth refers amongst others to altered growth rate, cycling time, the size, expansion or increase of the plant. Additionally and/or alternatively, growth characteristics may refer to cellular processes comprising, but not limited to, cell cycle (entry, progression, exit), cell division, cell wall biogenesis and/or DNA synthesis, DNA modification and/or endoreduplication.

"Yield" refers to the harvestable part of the plant. "Biomass" refers to any part of the plants. These terms also encompass an increase in seed yield, which includes an increase in the biomass of the seed (seed weight) and/or an increase in the number of (filled) seeds and/or in the size of the seeds and/or an increase in seed volume, each relative to corresponding wild-type plants. An increase in seed size and/or volume may also influence the composition of seeds. An increase in seed yield could be due to an increase in the number and/or size of flowers. An increase in yield may also increase the harvest index, which is expressed as a ratio of the total biomass over the yield of harvestable parts, such as seeds.

"Plant development" means any cellular process of a plant that is involved in determining the developmental fate of a plant cell, in particular the specific tissue or organ type into which a progenitor cell will develop. Typical plant characteristics according to the present invention are therefore characteristics relating to cellular processes relevant to plant development such as for example, morphogenesis, photomorphogenesis, shoot development, root development, vegetative development, reproductive development, stem elongation, flowering, regulatory mechanisms involved in determining cell fate, pattern formation, differentiation, senescence, time of flowering and/or time to flower.

"Plant architecture", as used herein refers to the external appearance of a plant, including any one or more structural features or a combination of structural features thereof. Such structural features include the shape, size, number, position, colour, texture, arrangement, and patternation of any cell, tissue or organ or groups of cells, tissues or organs of a plant, including the root, stem, leaf, shoot, petiole, trichome, flower, petal, stigma, style, stamen, pollen, ovule, seed, embryo, endosperm, seed coat, aleurone, fibre, fruit, cambium, wood, heartwood, parenchyma, aerenchyma, sieve element, phloem or vascular tissue, amongst others.

The term "stress tolerance" is understood as the capability of better survival and/or better performing in stress conditions such as environmental stress, which can be biotic or abiotic. Salinity, drought, heat, chilling and freezing are all described as examples of conditions which induce osmotic stress. The term "environmental stress" as used in the present invention refers to any adverse effect on metabolism, growth or viability of the cell, tissue, seed, organ or whole plant which is produced by a non-living or non-biological environmental stressor. More particularly, it also encompasses environmental factors such as water stress (flooding, water logging, drought, dehydration), anaerobic (low level of oxygen, CO2 etc.), aerobic stress, osmotic stress, salt stress, temperature stress (hot/heat, cold, freezing, frost) or nutrients deprivation, pollutants stress (heavy metals, toxic chemicals), ozone, high light, pathogen (including viruses, bacteria, fungi, insects and nematodes) and combinations of these. Biotic stress is stress as a result of the impact of a living organism on the plant. Examples are stresses caused by pathogens (virus, bacteria, nematodes insects etc.). Another example is stress caused by an organism, which is not necessarily harmful to the plant, such as the stress caused by a symbiotic or an epiphyte. Accordingly, particular plant characteristics according to the present invention encompass early vigour, survival rate, stress tolerance.

Field-grown plants almost always experience some form of stress, albeit mild, and therefore the terms "growth", "yield" "biomass production" or "biomass" do not distinguish the performance of plants under non-stressed from performance under stress conditions. Advantageously, the effects of the invention on growth and yield are expected to occur under both severe and mild stress conditions (i.e. under stressed and non-stressed conditions).

Characteristics related to "plant physiology" encompass characteristics of functional processes of a plant, including developmental processes such as growth, expansion and differentiation, sexual development, sexual reproduction, seed set, seed development, grain filling, asexual reproduction, cell division, dormancy, germination, light adaptation, photosynthesis, leaf expansion, fiber production, secondary growth or wood production, amongst others; responses of a plant to externally-applied factors such as metals, chemicals, hormones, growth factors, environment and environmental stress factors (e.g. anoxia, hypoxia, high temperature, low temperature, dehydration, light, day length, flooding, salt, heavy metals, amongst others), including adaptive responses of plants to said externally-applied factors. Particular plant physiology characteristics which are altered according to the methods of the present invention encompass altered storage lipid mobilization, photosynthesis, transcription regulation and signal transduction.

Characteristics related to "plant biochemistry" are to be understood by those skilled in the art to refer to the metabolic characteristics. "Metabolism" as used in the present invention is interchangeable with biochemistry. Metabolism and/or biochemistry encompass catalytic or assimilation or other metabolic processes of a plant, including primary and secondary metabolism and the products thereof, including any element, small molecules, macromolecules or chemical compounds, such as but not limited to starches, sugars, proteins, peptides, enzymes, hormones, growth factors, nucleic acid molecules, celluloses, hemicelluloses, calloses, lectins, fibres, pigments such as anthocyanins, vitamins, minerals, micronutrients, or macronutrients, that are produced by plants. Preferably, the methods of the present invention are used to change the nitrogen or carbon metabolism.

As shown in Tables 1 and 2, several of the E2Fa-DPa target genes identified have an E2F recognition sequence in their promoter and most of these genes are involved in DNA replication. Therefore, provided by a particular embodiment of the present invention is a method as described above to influence DNA synthesis and DNA replication. The secondary induced genes, which are the genes not having the E2F target consensus sequence in their promoter region, encode proteins involved in cell wall biosynthesis, transcription, signal transduction, or have an unknown function. Surprisingly, a large number of metabolic genes were modified as well, mainly genes involved in nitrate assimilation or metabolism and carbon metabolism.

The putative direct E2Fa-DPa target genes as identified by the presence of an E2F-DP-binding site, mainly belong to the group of genes involved in DNA synthesis, whereas the secondary induced genes are mainly linked to nitrogen assimilation and carbohydrate metabolism. Therefore, it is elucidated by the present invention that enhanced levels of E2Fa-DPa in plants have an impact on expression levels of genes involved in nitrogen assimilation and/or carbon metabolism. The experimental data suggest that in E2Fa/DPa overexpressing plants there is a drain of nitrogen to the nucleotide synthesis pathway causing a decreased synthesis of other nitrogen compounds such as amino acids and storage proteins. Corresponding to these findings, the inventors found that the level of endoreduplication of E2Fa-DPa transgenic plants depends on the amount of nitrogen available in the medium. Also, these data suggest that the growth arrest observed upon E2Fa/DPa expression results at least from a nitrogen drain to the nucleotide synthesis pathway, causing a decreased synthesis of other nitrogen components, such as amino acids and storage components.

As purine and pyrimidine bases are nitrogen-rich, the induction of nitrogen assimilation genes in the E2Fa-DPa transgenic plants is a mechanism to supply enough nitrogen for nucleotide biosynthesis. Most likely this drain of nitrogen from essential biosynthetic pathways to the nucleotide biosynthesis pathway has its effects on many aspects of plant metabolism, as can be seen from the reduction of expression of vegetative storage protein genes and genes involved in amino-acid biosynthesis.

Therefore a particular aspect of the invention is the use of genes involved in carbon and/or nitrogen metabolism or allocation, for altering nitrogen and carbon metabolism and/or to alter the balance between carbon and nitrogen or to reallocate carbon and/or nitrogen or to alter the composition of components containing carbon and nitrogen. The elucidation of genes that are able to shift the nitrogen assimilation from one biological process to another biological process is important for many applications. These genes can for example be used to alter the nitrogen composition of nitrogen-containing compounds in a cell, such as nicotinamide-containing molecules, amino acid, nucleic acid, chlorophyll or any other metabolites. Also within the scope of the present inventions are these altered components obtainable by the methods of the present invention, with altered balance between carbon and nitrogen.

Therefore, according to the present invention, there is provided a method as described above, wherein said altered metabolism comprises altered nitrogen and/or carbon metabolism.

In a particular embodiment, said carbon metabolism comprises the processes of carbon fixation, photosynthesis and photorespiration. In another embodiment, said nitrogen metabolism comprises nitrogen fixation or the reallocation of nitrogen residues from the pool of amino acids into the pool of nucleic acids or vice versa.

Microarray analysis of E2Fa-DPa overexpressing lines, as herein described, identified a cross-talking matrix between DNA replication, nitrogen assimilation and photosynthesis. It has been described previously that there is a link between carbon:nitrogen availability and growth, storage lipid mobilization and photosynthesis (Martin T. (2002)). Therefore according to the present invention there is provided, a method as described above, wherein said altered plant characteristic comprises altered storage lipid mobilization and/or photosynthesis.

The microarray studies elucidated for the first time particular genes that are upregulated and particular genes that are downregulated in a plant cell overexpressing E2Fa/DPa, many of which were of unknown function. It is now disclosed how to use these genes and/or proteins for altering plant characteristics.

According to a preferred embodiment, recombinant means are used to alter plant characteristics. More preferably, one or more of the genes essentially similar to any of SEQ ID NO 1 to 2755 is introduced into a plant as a transgene. Accordingly, the present invention provides a recombinant nucleic acid comprising:
(a) one or more nucleic acid sequences essentially similar to any one of SEQ ID NO 1 to 2755; optionally operably linked to
(b) a regulatory sequence; and optionally operably linked to
(c) a transcription termination sequence.

This recombinant nucleic acid is suitable for altering plant growth characteristics.

Constructs useful in the methods according to the present invention may be constructed using recombinant DNA technology well known to persons skilled in the art. The gene constructs may be inserted into vectors, which may be commercially available, suitable for transforming into plants and suitable for expression of the gene of interest in the transformed cells.

The genetic construct can be an expression vector wherein said nucleic acid sequence is operably linked to one or more control sequences allowing expression in prokaryotic and/or eukaryotic host cells.

The methods according to the present invention may also be practised by introducing into a plant at least a part of a (natural or artificial) chromosome (such as a Bacterial Artificial Chromosome (BAC)), which chromosome contains at least a gene/nucleic acid according to the present invention, optionally together with one or more related gene family members or genes belonging to the same functional group as for example the functional groups presented in Table 1 or 2. Therefore, according to a further aspect of the present invention, there is provided a method to alter plant characteristics, comprising introduction into a plant at least a part of a chromosome comprising at least a gene/nucleic, which gene/nucleic is essentially similar to any one of SEQ ID NO 1 to 2755.

In a particular embodiment of the present invention said regulatory sequence is a plant-expressible promoter. In a further embodiment of the invention the promoter is a constitutive promoter, such as the GOS2 promoter, the ubiquitin promoter, the actin promoter. In another embodiment of the invention the promoter is a promoter active in the meristem or in dividing cells, such as, but not limited to the cdc2 promoter, RNR promoter, MCM3 promoter. Alternatively, the regulatory element as mentioned above can be a translational enhancer, or a transcriptional enhancer that is used to enhance expression of a gene according to the present invention.

The term "Regulatory sequence" refers to control DNA sequences, which are necessary to affect expression of coding sequences to which they are operably linked. The nature of such control sequences differs depending upon the host organism. In prokaryotes, control sequences generally include promoters, ribosomal binding sites, and terminators. In eukaryotes generally control sequences include promoters, terminators and enhancers or silencers. The term "control sequence" is intended to include, at a minimum, all components the presence of which are necessary for expression, and may also include additional advantageous components and which determines when, how much and where a specific gene is expressed. Reference herein to a "promoter" is to be taken in its broadest context and includes the transcriptional regulatory sequences derived from a classical eukaryotic genomic gene, including the TATA box which is required for accurate transcription initiation, with or without a CCAAT box sequence and additional regulatory elements (i.e. upstream activating sequences, enhancers and silencers) which alter gene expression in response to developmental and/or external stimuli, or in a tissue-specific manner. The term "promoter" also includes the transcriptional regulatory sequences of a classical prokaryotic gene, in which case it may include a −35 box sequence and/or a −10 box transcriptional regulatory sequences.

The term "promoter" is also used to describe a synthetic or fusion molecule or derivative, which confers; activates or enhances expression of a nucleic acid molecule in a cell, tissue or organ. "Promoter" is a DNA sequence generally described as the 5'-region of a gene, located proximal to the start codon. The transcription of an adjacent DNA segment is initiated at the promoter region. In the context of the present invention, the promoter preferably is a plant-expressible promoter sequence. Promoters, however, that also function or solely function in non-plant cells such as bacteria, yeast cells, insect cells and animal cells are not excluded from the invention. By "plant-expressible" is meant that the promoter sequence, including any additional regulatory elements added thereto or contained therein, is at least capable of inducing, conferring, activating or enhancing expression in a plant cell, tissue or organ, preferably a monocotyledonous or dicotyledonous plant cell, tissue, or organ.

Preferably, the nucleic acid sequence capable of modulating expression of a gene encoding an E2F target protein is operably linked to a constitutive promoter or a tissue specific promoter. The term "constitutive" as defined herein refers to a promoter that is active predominantly in at least one tissue or organ and predominantly at any life stage of the plant. Preferably the promoter is active predominantly but not exclusively throughout the plant Additionally and/or alternatively, the nucleic acid of the present invention may be operably linked to a tissue-specific promoter. The term "tissue-specific" promoter as defined herein refers to a promoter that is active predominantly but not exclusively in at least one tissue or organ.

Examples of preferred promoters useful for the methods of the present invention are presented in Table I, II, III and IV.

TABLE I

Exemplary constitutive promoters for use in the performance of the present invention

| GENE SOURCE | EXPRESSION PATTERN | REFERENCE |
|---|---|---|
| Actin | constitutive | McElroy et al, Plant Cell, 2: 163-171, 1990 |
| CAMV 35S | constitutive | Odell et al, Nature, 313: 810-812, 1985 |
| CaMV 19S | constitutive | Nilsson et al., Physiol. Plant. 100: 456-462, 1997 |
| GOS2 | constitutive | de Pater et al, Plant J Nov; 2(6): 837-44, 1992 |
| ubiquitin | constitutive | Christensen et al, Plant Mol. Biol. 18: 675-689, 1992 |
| rice cyclophilin | constitutive | Buchholz et al, Plant Mol Biol. 25(5): 837-43, 1994 |
| maize H3 histone | constitutive | Lepetit et al, Mol. Gen. Genet. 231: 276-285, 1992 |
| actin 2 | constitutive | An et al, Plant J. 10(1); 107-121, 1996 |

TABLE II

Exemplary seed-preferred promoters for use in the performance of the present invention

| GENE SOURCE | EXPRESSION PATTERN | REFERENCE |
|---|---|---|
| seed-specific genes | seed | Simon, et al., *Plant Mol. Biol.* 5: 191, 1985; Scofield, et al., *J. Biol. Chem.* 262: 12202, 1987.; Baszczynski, et al., *Plant Mol. Biol.* 14: 633, 1990. |
| Brazil Nut albumin | seed | Pearson, et al., Plant Mol. Biol. 18: 235-245, 1992. |
| legumin | seed | Ellis, et al., Plant Mol. Biol. 10: 203-214, 1988. |
| glutelin (rice) | seed | Takaiwa, et al., Mol. Gen. Genet. 208: 15-22, 1986; Takaiwa, et al., FEBS Letts. 221: 43-47, 1987. |
| zein | seed | Matzke et al Plant Mol Biol, 14(3): 323-32 1990 |
| napA | seed | Stalberg, et al, *Planta* 199: 515-519, 1996. |
| wheat LMW and HMW glutenin-1 | endosperm | Mol Gen Genet 216: 81-90, 1989; NAR 17: 461-2, 1989 |
| wheat SPA | seed | Albani et al, Plant Cell, 9: 171-184, 1997 |
| wheat a, b and g-gliadins | endosperm | EMBO 3: 1409-15, 1984 |
| barley Itr1 promoter | endosperm | |
| barley B1, C, D, hordein | endosperm | Theor Appl Gen 98: 1253-62, 1999; Plant J 4: 343-55, 1993; Mol Gen Genet 250: 750-60, 1996 |
| barley DOF | endosperm | Mena et al, The Plant Journal, 116(1): 53-62, 1998 |
| blz2 | endosperm | EP99106056.7 |
| synthetic promoter | endosperm | Vicente-Carbajosa et al., Plant J. 13: 629-640, 1998. |
| rice prolamin NRP33 | endosperm | Wu et al, Plant Cell Physiology 39(8) 885-889, 1998 |
| rice-globulin Glb-1 | endosperm | Wu et al, Plant Cell Physiology 39(8) 885-889, 1998 |
| rice OSH1 | embryo | Sato et al, Proc. Natl. Acad. Sci. USA, 93: 8117-8122, 1996 |
| rice alpha-globulin REB/OHP-1 | endosperm | Nakase et al. Plant Mol. Biol. 33: 513-522, 1997 |
| rice ADP-glucose PP | endosperm | Trans Res 6: 157-68, 1997 |
| maize ESR gene family | endosperm | Plant J 12: 235-46, 1997 |
| sorgum gamma-kafirin | endosperm | PMB 32: 1029-35, 1996 |
| KNOX | embryo | Postma-Haarsma et al, Plant Mol. Biol. 39: 257-71, 1999 |
| rice oleosin | embryo and aleuron | Wu et at, J. Biochem., 123: 386, 1998 |
| sunflower oleosin | seed (embryo and dry seed) | Cummins, et al., Plant Mol. Biol. 19: 873-876, 1992 |

TABLE III

Exemplary flower-specific promoters for use in the performance of the invention

| Gene source | Expression pattern | REFERENCE |
|---|---|---|
| AtPRP4 | flowers | URL: salus.medium.edu/mmg/tierney |
| chalene synthase (chsA) | flowers | Van der Meer, et al., *Plant Mol. Biol.* 15, 95-109, 1990. |
| LAT52 | anther | Twell et al Mol. Gen Genet. 217: 240-245 (1989) |
| apetala-3 | flowers | |

TABLE IV

Alternative rice promoters for use in the performance of the invention

| PRO # | gene | expression |
|---|---|---|
| PRO0001 | Metallothionein Mte | transfer layer of embryo + calli |
| PRO0005 | putative beta-amylase | transfer layer of embryo |
| PRO0009 | putative cellulose synthase | weak in roots |
| PRO0012 | lipase (putative) | |
| PRO0014 | transferase (putative) | |
| PRO0016 | peptidyl prolyl cis-trans isomerase (putative) | |
| PRO0019 | unknown | |
| PRO0020 | prp protein (putative) | |
| PRO0029 | noduline (putative) | |
| PRO0058 | proteinase inhibitor Rgpi9 | seed |
| PRO0061 | beta expansine EXPB9 | weak in young flowers |
| PRO0063 | structural protein | young tissues + calli + embryo |

TABLE IV-continued

Alternative rice promoters for use in the performance of the invention

| PRO # | gene | expression |
|---|---|---|
| PRO0069 | xylosidase (putative) | |
| PRO0075 | prolamine 10 Kda | strong in endosperm |
| PRO0076 | allergen RA2 | strong in endosperm |
| PRO0077 | prolamine RP7 | strong in endosperm |
| PRO0078 | CBP80 | |
| PRO0079 | starch branching enzyme I | |
| PRO0080 | Metallothioneine-like ML2 | transfer layer of embryo + calli |
| PRO0081 | putative caffeoyl-CoA 3-O-methyltransferase | shoot |
| PRO0087 | prolamine RM9 | strong in endosperm |
| PRO0090 | prolamine RP6 | strong endosperm |
| PRO0091 | prolamine RP5 | strong in endosperm |
| PRO0092 | allergen RA5 | |
| PRO0095 | putative methionine aminopeptidase | embryo |
| PRO0098 | ras-related GTP binding protein | |
| PRO0104 | beta expansine EXPB1 | |
| PRO0105 | Glycine rich protein | |
| PRO0108 | metallothionein like protein (putative) | |
| PRO0109 | metallothioneine (putative) | |
| PRO0110 | RCc3 | strong root |
| PRO0111 | uclacyanin 3-like protein | weak discrimination center/ shoot meristem |
| PRO0116 | 26S proteasome regulatory particle non-ATPase subunit 11 | very weak meristem specific |
| PRO0117 | putative 40S ribosomal protein | weak in endosperm |
| PRO0122 | chlorophyll a/b-binding protein precursor (Cab27) | very weak in shoot |
| PRO0123 | putative protochlorophyllide reductase | strong leaves |
| PRO0126 | metallothionein RiCMT | strong discrimination center/ shoot meristem |
| PRO0129 | GOS2 | strong constitutive |
| PRO0131 | GOS9 | |
| PRO0133 | chitinase Cht-3 | very weak meristem specific |
| PRO0135 | alpha-globulin | strong in endosperm |
| PRO0136 | alanine aminotransferase | weak in endosperm |
| PRO0138 | cyclin A2 | |
| PRO0139 | Cyclin D2 | |
| PRO0140 | Cyclin D3 | |
| PRO0141 | cyclophyllin 2 | shoot and seed |
| PRO0146 | sucrose synthase SS1 (barley) | medium constitutive |
| PRO0147 | trypsin inhibitor ITR1 (barley) | weak in endosperm |
| PRO0149 | ubiquitine 2 with intron | strong constitutive |
| PRO0151 | WSI18 | embryo + stress |
| PRO0156 | HVA22 homologue (putative) | |
| PRO0157 | EL2 | |
| PRO0169 | aquaporine | medium constitutive in young plants |
| PRO0170 | High mobility group protein | strong constitutive |
| PRO0171 | reversibly glycosylated protein RGP1 | weak constitutive |
| PRO0173 | cytosolic MDH | shoot |
| PRO0175 | RAB21 | embryo + stress |
| PRO0176 | CDPK7 | |
| PRO0177 | Cdc2-1 | very weak in meristem |
| PRO0197 | sucrose synthase 3 | |
| PRO0198 | OsVP1 | |
| PRO0200 | OSH1 | very weak in young plant meristem |
| PRO0208 | putative chlorophyllase | |
| PRO0210 | OsNRT1 | |
| PRO0211 | EXP3 | |
| PRO0216 | phosphate transporter OjPT1 | |
| PRO0218 | oleosin 18 kd | aleurone + embryo |
| PRO0219 | ubiquitine 2 without intron | |
| PRO0220 | RFL | |
| PRO0221 | maize UBI delta intron | not detected |
| PRO0223 | glutelin-1 | |
| PRO0224 | fragment of prolamin RP6 promoter | |
| PRO0225 | 4xABRE | |
| PRO0226 | glutelin OSGLUA3 | |
| PRO0227 | BLZ-2_short (barley) | |
| PRO0228 | BLZ-2_long (barley) | |

Optionally, one or more terminator sequences may also be used in the construct introduced into a plant. The term "terminator" encompasses a control sequence which is a DNA sequence at the end of a transcriptional unit which signals 3' processing and polyadenylation of a primary transcript and termination of transcription. Additional regulatory elements may include transcriptional as well as translational enhancers. Those skilled in the art will be aware of terminator and enhancer sequences, which may be suitable for use in performing the invention. Such sequences would be known or may readily be obtained by a person skilled in the art.

The genetic constructs of the invention may further include an origin of replication sequence which is required for maintenance and/or replication in a specific cell type. One example is when a genetic construct is required to be maintained in a bacterial cell as an episomal genetic element (e.g. plasmid or cosmid molecule). Preferred origins of replication include, but are not limited to, the f1-ori and colE1.

The genetic construct may optionally comprise a selectable marker gene. As used herein, the term "selectable marker gene" includes any gene, which confers a phenotype on a cell in which it is expressed to facilitate the identification and/or selection of cells which are transfected or transformed with a nucleic acid construct of the invention. Suitable markers may be selected from markers that confer antibiotic or herbicide resistance, that introduce a new metabolic trait or that allow visual selection. Examples of selectable marker genes include genes conferring resistance to antibiotics (such as nptII encoding neomycin phosphotransferase capable of phosphorylating neomycin and kanamycin, or hpt encoding hygromycin phosphotransferase capable of phosphorylating hygromycin), to herbicides (for example bar which provides resistance to Basta; aroA or gox providing resistance against glyphosate), or genes that provide a metabolic trait (such as manA that allows plants to use mannose as sole carbon source). Visual marker genes result in the formation of colour (for example beta-glucuronidase, GUS), luminescence (such as luciferase) or fluorescence (Green Fluorescent Protein, GFP, and derivatives thereof. Further examples of suitable selectable marker genes include the ampicillin resistance (Ampr), tetracycline resistance gene (Tcr), bacterial kanamycin resistance gene (Kanr), phosphinothricin resistance gene, and the chloramphenicol acetyltransferase (CAT) gene, amongst others The methods of the present invention are particularly relevant for applications in agriculture and horticulture, and serve to develop plants that have altered characteristics.

Accordingly, another embodiment of the invention is a method for making a transgenic plant comprising the introduction of a recombinant nucleic acid as mentioned above into a plant. "A plant" as used herein means plant cell, plant part etc. as defined herein below.

According to a preferred embodiment this method for the production of a transgenic plant further comprises the step of cultivating the plant cell under conditions promoting regeneration and mature plant growth.

A further embodiment relates to a method as described above, comprising stably integrating into the genome of a plant a recombinant nucleic acid as mentioned above. Alternatively, the recombinant nucleic acids comprising the nucleic acids of the present invention are transiently introduced into a plant or plant cell. The protein itself and/or the nucleic acid itself may be introduced directly into a plant cell or into the plant itself (including introduction into a tissue, organ or any other part of the plant). According to a preferred feature of the present invention, the nucleic acid is preferably introduced into a plant by transformation.

The term "transformation" as referred to herein encompasses the transfer of an exogenous polynucleotide into a host cell, irrespective of the method used for transfer. Plant tissue capable of subsequent clonal propagation, whether by organogenesis or embryogenesis, may be transformed with a genetic construct of the present invention and a whole plant regenerated therefrom. The particular tissue chosen will vary depending on the clonal propagation systems available for, and best suited to, the particular species being transformed. Exemplary tissue targets include leaf disks, pollen, embryos, cotyledons, hypocotyls, megagametophytes, callus tissue, existing meristematic tissue (e.g., apical meristem, axillary buds, and root meristems), and induced meristem tissue (e.g. cotyledon meristem and hypocotyl meristem). The polynucleotide may be transiently or stably introduced into a host cell and may be maintained non-integrated, for example, as a plasmid. Alternatively and preferably, the transgene may be stably integrated into the host genome. The resulting transformed plant cell can then be used to regenerate a transformed plant in a manner known to persons skilled in the art.

Transformation of a plant species is now a fairly routine technique. Advantageously, any of several transformation methods may be used to introduce the gene of interest into a suitable ancestor cell. Transformation methods include the use of liposomes, electroporation, chemicals that increase free DNA uptake, injection of the DNA directly into the plant, particle gun bombardment, transformation using viruses or pollen and microprojection. Methods may be selected from the calcium/polyethylene glycol method for protoplasts (Krens et al., 1982; Negrutiu et al., 1987); electroporation of protoplasts (Shillito et al., 1985); microinjection into plant material (Crossway et al., 1986); DNA or RNA-coated particle bombardment (Klein et al., 1987) infection with (non-integrative) viruses and the like.

Transgenic rice plants expressing a gene according to the present invention are preferably produced via *Agrobacterium*-mediated transformation using any of the well known methods for rice transformation, such as described in any of the following: published European patent application EP 1198985 A1, Aldemita and Hodges (1996); Chan et al. (1993), Hiei et al. (1994), which disclosures are incorporated by reference herein as if fully set forth. In the case of corn transformation, the preferred method is as described in either Ishida et al. (1996) or Frame et al. (2002), which disclosures are incorporated by reference herein as if fully set forth.

Generally after transformation, plant cells or cell groupings are selected for the presence of one or more markers which are encoded by plant-expressible genes co-transferred with the gene of interest, following which the transformed material is regenerated into a whole plant.

Following DNA transfer and regeneration, putatively transformed plants may be evaluated, for instance using Southern analysis, for the presence of the gene of interest, copy number and/or genomic organisation. Alternatively or additionally, expression levels of the newly introduced DNA may be monitored using Northern and/or Western analysis, both techniques being well known to persons having ordinary skill in the art.

The generated transformed plants may be propagated by a variety of means, such as by clonal propagation or classical breeding techniques. For example, a first generation (or T1) transformed plant may be selfed to give homozygous second generation (or T2) transformants, and the T2 plants further propagated through classical breeding techniques.

The generated transformed organisms may take a variety of forms. For example, they may be chimeras of transformed cells and non-transformed cells; clonal transformants (e.g., all cells transformed to contain the expression cassette); grafts of transformed and untransformed tissues (e.g., in plants, a transformed rootstock grafted to an untransformed scion).

The present invention also encompasses plants obtainable by the methods according to the present invention. The present invention provides plants having one or more altered characteristics, when compared to the wild-type plants, characterised in that the plant has modified expression of one or more nucleic acids and/or modified level and/or activity of a protein, wherein said nucleic acid and/or protein are essentially similar to any one of SEQ ID NO 1 to 2755.

In one embodiment of the present invention, such a plant is a transgenic plant. According to a further embodiment such transgenic plant comprises an isolated nucleic acid and/or protein sequence essentially similar to any one for Seq Id NO 1 to 2755.

Alternatively, according to one embodiment of the present invention, such a plant having one or more altered plant characteristics and having modified expression of one or more nucleic acids and/or modified level and/or activity of a protein, wherein said nucleic acid and/or protein are essentially similar to any one of SEQ ID NO 1 to 2755, is created by breeding techniques.

The present invention clearly extends to any plant cell or plant produced by any of the methods described herein, and to all plant parts and propagules thereof. The present invention extends further to encompass the progeny of a primary transformed or transfected cell, tissue, organ or whole plant that has been produced by any of the aforementioned methods, the only requirement being that progeny exhibit the same genotypic and/or phenotypic characteristic(s) as those produced in the parent by the methods according to the invention. The invention accordingly also includes host cells containing an isolated nucleic acid molecule encoding a protein essentially similar to any one of SEQ ID NO 1 to 2755. Such host cell may be selected from plants, bacteria, animals, algae, fungi, yeast or insects. Preferred host cells according to the invention are plant cells. The invention also extends to harvestable parts of a plant such as but not limited to seeds, leaves, fruits, flowers, stem cultures, stem, rhizomes, roots, tubers and bulbs.

The term "plant" as used herein encompasses whole plants, ancestors and progeny of the plants and plant parts, including seeds, shoots, stems, roots (including tubers), and plant cells, tissues and organs. The term "plant" also therefore encompasses suspension cultures, embryos, meristematic regions, callus tissue, leaves, gametophytes, sporophytes, pollen, and microspores. Plants that are particularly useful in the methods of the invention include all plants which belong to the super-family Viridiplantae, in particular monocotyledonous and dicotyledonous plants including a fodder or forage legume, ornamental plant, food crop, tree, or shrub selected from the list comprising *Acacia* spp., *Acer* spp., *Actinidia* spp., *Aesculus* spp., *Agathis australis, Albizia amara, Alsophila tricolor, Andropogon* spp., *Arachis* spp, *Areca catechu, Astelia fragrans, Astragalus cicer, Baikiaea plurijuga, Betula* spp., *Brassica* spp., *Bruguiera gymnorrhiza, Burkea africana, Butea frondosa, Cadaba farinosa, Calliandra* spp, *Camellia sinensis, Canna indica, Capsicum* spp., *Cassia* spp., *Centroema pubescens, Chaenomeles* spp., *Cinnamomum cassia, Coffea arabica, Colophospermum mopane, Coronillia varia, Cotoneaster serotina, Crataegus* spp., *Cucumis* spp., *Cupressus* spp., *Cyathea dealbata, Cydonia oblonga, Cryptomeria japonica, Cymbopogon* spp., *Cynthea dealbata, Cydonia oblonga, Dalbergia monetaria, Davallia divaricata, Desmodium* spp., *Dicksonia squarosa, Diheteropogon amplectens, Dioclea* spp, *Dolichos* spp., *Dorycnium rectum, Echinochloa pyramidalis, Ehrartia* spp., *Eleusine coracana, Eragrestis* spp., *Erythrina* spp., *Eucalyptus* spp., *Euclea schimperi, Eulalia villosa, Fagopyrum* spp., *Feijoa sellowiana, Fragaria* spp., *Flemingia* spp, *Freycinetia banksii, Geranium thunbergii, Ginkgo biloba, Glycine javanica, Gliricidia* spp, *Gossypium hirsutum, Grevillea* spp., *Guibourtia coleosperma, Hedysarum* spp., *Hemarthia altissima, Heteropogon contortus, Hordeum vulgare, Hyparrhenia rufa, Hypericum erectum, Hyperthelia dissolute, Indigo incarnata, Iris* spp., *Leptarrhena pyrolifolia, Lespediza* spp., *Lettuca* spp., *Leucaena leucocephala, Loudetia simplex, Lotonus bainesii, Lotus* spp., *Macrotyloma axillare, Malus* spp., *Manihot esculenta, Medicago sativa, Metasequoia glyptostroboides, Musa sapientum, Nicotianum* spp., *Onoblychis* spp., *Ornithopus* spp., *Oryza* spp., *Peltophorum africanum, Pennisetum* spp., *Persea gratissima, Petunia* spp., *Phaseolus* spp., *Phoenix canariensis, Phormium cookianum, Photinia* spp., *Picea glauca, Pinus* spp., *Pisum sativum, Podocarpus totara, Pogonarthria fleckii, Pogonathria squarrosa, Populus* spp., *Prosopis cineraria, Pseudotsuga menziesii, Pterolobium stellatum, Pyrus communis, Quercus* spp., *Rhaphiolepsis umbellata, Rhopalostylis sapida, Rhus natalensis, Ribes grossularia, Ribes* spp., *Robinia pseudoacacia, Rosa* spp., *Rubus* spp., *Salix* spp., *Schyzachyrium sanguineum, Sciadopitys verticillata, Sequoia sempervirens, Sequoiadendron giganteum, Sorghum bicolor, Spinacia* spp., *Sporobolus fimbriatus, Stiburus alopecuroides, Stylosanthos humilis, Tadehagi* spp, *Taxodium distichum, Themeda triandra, Trifolium* spp., *Triticum* spp., *Tsuga heterophylla, Vaccinium* spp., *Vicia* spp., *Vitis vinifera, Watsonia pyramidata, Zantedeschia aethiopica, Zea mays,* amaranth, artichoke, asparagus, broccoli, Brussels sprouts, cabbage, canola, carrot, cauliflower, celery, collard greens, flax, kale, lentil, oilseed rape, okra, onion, potato, rice, soybean, straw, sugar beet, sugar cane, sunflower, tomato, squash tea, trees. Alternatively algae and other non-Viridiplantae can be used for the methods of the present invention. Preferably the plant according to the present invention is a crop plant selected from rice, maize, wheat, barley, soybean, sunflower, canola, sugarcane, alfalfa, millet, leguminosae (bean, pea), flax, lupinus, rapeseed, tobacco, popular and cotton. Further preferably, the plant according to the present invention is a monocotyledonous plant, most preferably a cereal.

The term 'gene(s)' or 'nucleic acid', 'nucleotide sequence', as used herein refers to a polymeric form of a deoxyribonucleotides or ribonucleotide polymer of any length, either double- or single-stranded, or analogs thereof, that have the essential characteristics of a natural ribonucleotide in that they can hybridize to nucleic acids in a manner similar to naturally occurring polynucleotides. A great variety of modifications have been made to DNA and RNA that serve many useful purposes known to those skilled in the art. For example, methylation, 'caps' and substitution of one or more of the naturally occurring nucleotides with an analog. Said terms also include peptide nucleic acids. The term "polynucleotide" as used herein includes such chemically, enzymatically or metabolically modified forms of polynucleotides.

With "recombinant nucleic acid" is meant a nucleic acid produced by joining pieces of DNA from different sources through deliberate human manipulation.

The inventors identified genes that are upregulated in plants overexpressing E2Fa/DPa. These genes can be used to simulate E2Fa/DPa related effect in a plant.

Therefore, according to the invention, there is provided a method to alter characteristics of a plant, comprising overexpression of one or more nucleic acids essentially similar to any one of SEQ ID NO 1 to 2755, or wherein the method comprises enhancing the level and/or activity of one or more proteins essentially similar to a protein sequence essentially similar to any one of SEQ ID NO 1 to 2755.

Also identified were genes that are downregulated in plants overexpressing E2Fa/DPa. These genes can be used to simulate E2Fa/DPa related effect in a plant. Therefore, according to the invention, there is provided a method to alter plant growth characteristics, comprising downregulation of expression of one or more nucleic acids essentially similar to any one of SEQ ID NO 1 to 2755, or wherein the method comprises decreasing level and/or activity of one or more proteins essentially similar to any one of SEQ ID NO 1 to 2755.

Genetic constructs aimed at silencing gene expression may comprise the nucleotide sequence essentially similar to any one of SEQ ID NO 1 to 2755 or one at least a portion thereof in a sense and/or antisense orientation relative to the promoter sequence. Preferably the portions comprises at least 21 contiguous nucleic acid of a sequence to be downregulated. Also, sense or antisense copies of at least part of the endogenous gene in the form of direct or inverted repeats may be utilized in the methods according to the invention. The characteristics of plants may also be changed by introducing into a plant at least part of an antisense version of the nucleotide sequence essentially similar to any one or more of SEQ ID NO 1 to 2755. It should be clear that part of the nucleic acid (a portion) could also achieve the desired result. Homologous anti-sense genes are preferred, homologous genes being plant genes, preferably plant genes from the same plant species in which the silencing construct is introduced.

Detailed analysis of the promoters of the genes identified in the present invention allowed the identification of novel E2Fa/DPa target genes that are under the direct control of E2Fa/DPa and that are mainly involved in DNA replication. For all the genes identified in the present invention, reference is made to the MIPS database MATDB accession number. This unique identification number refers to the deposit of information related to the gene in question, e.g. the unspliced sequence, the spliced sequence, the protein sequence, the domains of the protein etc. An example of the information deposited under the accession number At1g57680 is shown in FIG. 4. Based on this unique accession number, a person skilled in the art would be able to locate the gene provided by the present invention in its genomic environment. From this information one can identify and isolate the upstream control elements of these genes. Especially interesting are the promoters of these genes as control elements for driving or regulating transcription of heterologous genes. Therefore, according to the invention is provided an isolated nucleic acid comprising one or more of the regulatory elements upstream of the start codon of the nucleic acids essentially similar to any one of SEQ ID NO 1 to 2755. Furthermore, the invention provides an isolated nucleic acid as mentioned above, wherein said regulatory element is the promoter of said the genes essentially similar to any one of the sequence presented in SEQ ID NO 1 to 2755.

Further the invention also relates to the use of a nucleic acid sequence or protein essentially similar to any one of SEQ ID NO 1 to 2755, for altering plant characteristics.

Another method for altering plant characteristics and/or growth characteristics of a plant resides in the use of allelic variants of the genes of the present invention. Allelic variants exist in nature and encompassed within the methods of the present invention is the use of these natural alleles. Alternatively, in particular breeding programs, such as for example marker assisted breeding, or conventional breeding programmes, it is sometimes practical to introduce allelic variation in the plants by mutagenic treatment of a plant. One suitable mutagenic method is EMS mutagenesis. Identification of allelic variants then takes place by, for example, PCR. This is followed by a selection step for selection of superior allelic variants of the sequence in question and which give rise to altered growth characteristics. Selection is typically carried out by monitoring growth performance of plants containing different allelic variants of the sequence in question. Monitoring growth performance can be done in a greenhouse or in the field. Further optional steps include crossing plants in which the superior allelic variant was identified with another plant. This could be used, for example, to make a combination of interesting phenotypic features.

According to another aspect of the present invention, advantage may be taken of the nucleic acid sequence of the present invention in breeding programs. In such a program, a DNA marker may be identified which is genetically linked to the nucleic acid of the present invention. This DNA marker is then used in breeding programs to select plants having altered growth characteristics. Therefore, the present invention also encompass the use of a nucleic acid sequence essentially similar to any one of SEQ ID NO 1 to 2755, for marker assisted breeding of plants with altered characteristics.

These marker assisted breeding processes may further involve the steps of crossing plants and using probes or primers having part, for example having at least 10 bp, of a sequence corresponding to any of SEQ ID NO 1 to 2755, to detect the DNA sequence corresponding to SEQ ID NO 1 to 2755, in the progeny of the cross.

These methods for marker assisted breeding also may involve the use of an isolated DNA molecule being essentially similar to SEQ ID NO 1 to 2755 or a part thereof as a marker in techniques like AFLP, RFLP, RAPD, or in the detection of Single Nucleotide Polymorphisms.

Further these methods for marker assisted breeding also may involve determining the presence or absence in a plant genome of a qualitative trait or a quantitative trait locus (QTL) linked to a transgene essentially similar to any one of SEQ ID NO 1 to 2755 or to an endogenous homologue of any one of SEQ ID NO 1 to 2755, which method comprises:

(a) detecting a molecular marker linked to a QTL, wherein the molecular marker comprises a sequence essentially similar to SEQ ID NO 1 to 2755 or an endogenous homologue thereof; and (b) determining the presence of said QTL as by detection of the molecular marker of step (a) or determining the absence of said QTL as failure to detect the molecular marker of step (a)

Alternatively, methods for marker assisted breeding may involve detecting the presence of a quantitative trait locus linked to a DNA sequence essentially similar to SEQ ID NO 1 to 2755 or to an endogenous homologue thereof in the genome of a plant. The methods described above may involve the steps of:

(a) extracting a DNA sample of said plant;

(b) contacting the DNA sample with a probe that hybridises to a DNA sequence according to claim 1 or to an endogenous homologue thereof, or to the complement thereof;

(c) performing a hybridisation reaction under conditions suitable for hybridisation of the probe to the DNA sample of (b); and (d) detecting the hybridisation of the probe to the DNA.

Further, the present invention also encompass the use of a nucleic acid sequence essentially similar to any one of SEQ ID NO 1 to 2755, for conventional breeding of plants with altered characteristics.

In conventional breeding programs, the nucleic acid essentially similar to any one of SEQ ID NO 1 to 2755 is used to select plants with better plant characteristics compared to the normal wild-type plants. The plants with better growth characteristics may originated from natural variation in the alleles of the gene corresponding to any one of SEQ ID NO 1 to 2755, or may originated from manmade variation in these genes, for example variation created by EMS mutagenesis or other methods to created single nucleotide polymorphisms.

Further the invention also relates to the use of a nucleic acid or a protein essentially similar any one of SEQ ID NO 1 to 2755, as a growth regulator.

In a particular embodiment such a growth regulator is a herbicide or is a growth stimulator. The present invention therefore also provides a growth regulating composition comprising a nucleic acid and/or a protein essentially similar to any one of SEQ ID NO 1 to 2755. The growth regulating compositions according to the present invention can additionally comprise any additive usually present in growth regulating compositions such as growth inhibitors, herbicides or growth stimulators. Also a kit comprising a sequence essentially similar to any one of SEQ ID NO 1 to 2755 (for example in the form of a herbicide) is in the scope of the present invention. Also any other plant effective agent comprising the sequences according to the present invention are provided herein. Methods to produce the compositions, kits or plant agents as mentioned above are also provided by the present invention and involve the production of any one or more of the sequences essentially similar to any one of SEQ ID NO 1 to 2755. Such sequences and methods are herein provided.

Further, plants of the present invention have improved characteristics, such as improved growth and yield, which makes these plant suitable to produce industrial proteins.

Accordingly, the present invention provides a method for the production of enzymes and/or pharmaceuticals, which method comprises modifying expression of a nucleic acid, and/or modifying level and/or activity of a protein, said nucleic acid and/or protein being essentially similar to any one of SEQ ID NO 1 to 2755

The present invention therefore also encompasses the use of plants as described above, for the production of (industrial) enzymes and/or pharmaceuticals. The (Industrial) enzymes and pharmaceuticals produced according to the method as described above are also encompasses by the present invention.

Also the invention as presented herein offers means to alter the characteristics not only of plants, but also of other organisms, such as mammals. The plant genes of the present invention, or their homologues, or the plant proteins or their homologues, can be used as therapeutics or can be used to develop therapeutics for both humans and animals. Accordingly, the present invention relates to a nucleic acid or a protein essentially similar to any one of SEQ ID NO 1 to 2755, for use as a therapeutic agent.

In a particular embodiment, the use as a therapeutic agents encompasses the use in gene therapy, or the use to manufacture medicaments such as for example therapeutic protein samples. Also the nucleic acids and/or proteins according to the present invention can be applied in diagnostic methods.

Accordingly provided by the present invention is the use of a nucleic acid or a protein essentially similar to any one of SEQ ID NO 1 to 2755, for use as a therapeutic agent, a diagnostic means, a kit or plant effective agent.

Further encompassed by the invention are therapeutic or diagnostic compositions or kits or plant effective agent, comprising a nucleic acid and/or a protein essentially similar to any one of SEQ ID NO 1 to 2755. These compositions may comprise other additives usually applied for therapeutic compositions. Methods to produce these therapeutic or diagnostic compositions or kits are also provided by the present invention and involve the production of any of the sequences essentially similar to any one of SEQ ID NO 1 to 2755.

The plants according to the present invention have altered characteristics, such as for example improved growth and yield, which makes them suitable sources for many agricultural applications and the food industry. Accordingly, provided by the present invention there is a food product derived from a plant or host cell as described above and also the use of such a food product in animal feed or food.

In molecular biology it is standard practice to select upon transfection or transformation those individuals (or groups of individuals, such as bacterial or yeast colonies or phage plaques or eukaryotic cell clones) that are effectively transfected or transformed with the desired genetic construct. Typically these selection procedures are based on the presence of a selectable or screenable marker in the transfected genetic construct, to distinguish the positive individuals easily from the negative individuals. The nucleic acids and proteins according to the present invention are capable of altering the characteristics of the host cells to which they are applied. Therefore, the nucleic acids and/or proteins according to the present invention can also be used as selectable markers, screenable markers or selection agents. According to one particular embodiment, the present invention provides the use of a nucleic acid or a protein essentially similar to any one of SEQ ID NO 1 to 2755 as a positive or negative selectable marker during transformation of plant cell, plant tissue or plant procedures.

DESCRIPTION OF THE FIGURES

FIG. 4: Represents the information which is deposited in the MatDB (MIPS *Arabidopsis* database) under accession number At1g57680

Figure 1:
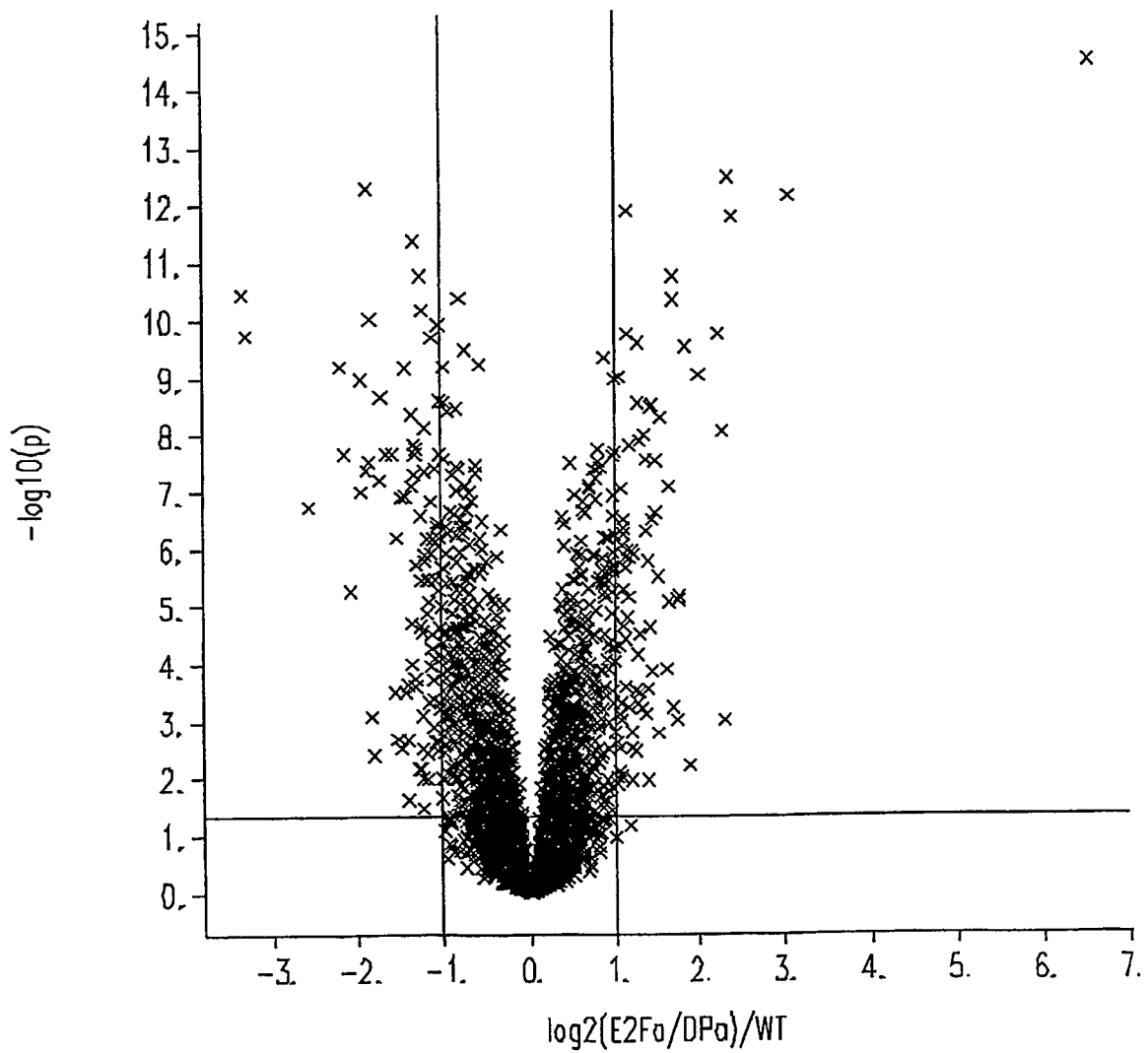
FIG. 1: Volcano plot of significance against effect. Each x represent one of the 4579 genes, with the negative log 10 of the P value from the gene model plotted against the difference between least-square means for the genotype effect. The horizontal line represents the test-wise threshold of P=0.05. The two vertical reference lines indicate a 2-fold cutoff for either repression or induction.

Table 1: Presentation of *Arabidopsis* genes that are 2 fold or more upregulated in E2Fa-DPa overexpressing plants. The genes are presented according to the functional category to which they belong. For some of the genes, no function has been described in the public databases and they are named unknown, putative or hypothetical protein. All the genes have each a unique MIPS accession number, which refers to the identification of the sequence in the MatDB (MIPS *Arabidopsis thaliana* database). The MIPS accession number refers to the protein entry code for the MatDB of MIPS. Also, there is an accession number provided as an internal protein code. The fold of induction is also given for each sequence. Furthermore, where an E2F target sequence has been identified in the upstream region of the gene, the sequence of that site is also presented in the Table. Finally, other plant homologues which have substantial sequence identity with the *Arabidopsis* gene are mentioned in this Table.

Table 2: Presentation of *Arabidopsis* genes that are 2 fold or more repressed in E2Fa-DPa overexpressing plants. Data are presented in a similar way as for Table 1, as explained above.

Table 3: Different E2F target sequences and the frequency of their presence in the upstream regions of the *Arabidopsis* genes described in the present invention.

Table 4: Selection of the *Arabidopsis* genes from the microarray that were 1.3 times upregulated in E2Fa/DPa overexpressing plants, compared to the wild-type plants. The gene name is given, as well as the MIPS database accession number and a ratio indicating the degree of upregulation of the gene. Furthermore, the E-value indicates if a significant homologue has been found in the public databases.

Table 5: Selection of the *Arabidopsis* genes from the microarray that were 1.3 times repressed in E2Fa/DPa overexpressing plants, compared to the wild-type plants. The data are presented as in Table 4. The fold repression is calculated as 1/ratio. In this Table only the genes that have a ratio of less than 0.77 are selected.

Table 6: genes selected for *Arabidopsis* transformation

Table 7: genes selected for rice transformation

EXAMPLES

Example 1

Overexpression of E2Fa and DPa in *Arabidopsis*

Double transgenic CaMV35S-E2Fa-DPa overexpressing plants were obtained by the crossing of homozygous CaMV35S-E2Fa and CaMV35S-DPa plants (De Veylder et al., 2002). Double transformants were grown under a 16 h light/8 h dark photoperiod at 22° C. on germination medium (Valvekens et al., 1988).

Selection of Transgenic Lines

*Arabidopsis thaliana* plants were generated that contained either the E2Fa or the DPa gene under the control of the constitutive cauliflower mosaic virus (CaMV) 35S promoter.

Crossing Experiments of Overexpressing E2Fa and DPa Lines

Plants homozygous for the CaMV 35S E2Fa gene were crossed with heterozygous CaMV 35S DPa lines. Polymerase chain reaction (PCR) analysis on individual plants confirmed which plants contained both the CaMV 35S-E2Fa and CaMV 35S-DPa constructs.

8 days after sowing, these plants were used to isolate total RNA, from which cDNA was synthesized and subsequently hybridized to a microarray containing 4579 unique *Arabidopsis* ESTs. These experimental steps are described in the following examples.

Example 2

Construction of Microarrays

Construction of Microarrays

The *Arabidopsis thaliana* microarray consisted of 4,608 cDNA fragments spotted in duplicate, distant from each other, on Type V silane coated slides (Amersham BioSciences, Buckinghamshire, UK). The clone set included 4,579 *Arabidopsis* genes composed from the unigen clone collection from Incyte (*Arabidopsis* Gem I, Incyte, USA). To retrieve the functional annotation of the genes relating to the spotted ESTs, BLASTN against genomic sequences was performed. To make the analysis easier a collection of genomic sequences bearing only one gene was built according to the available annotations. Each of those sequences had its upstream intergenic sequence followed by the exon-intron structure of the gene and the downstream intergenic sequence, intergenic being the whole genomic sequence between start and stop codons from neighboring protein-encoding genes. From the BLASTN output the best hits were extracted and submitted to a BLASTX search against protein databases. To retrieve even more detailed information concerning the potential function of the genes, protein domains were searched using ProDom. The complete data set can be found on the website URL: psb.rug.ac.be/E2F and is cited herein by reference. The cDNA inserts were PCR amplified using M13 primers, purified with MultiScreen-PCR plate (cat: MANU03050, Millipore, Belgium) and arrayed on the slides using a Molecular Dynamics Generation III printer (Amersham BioSciences). Slides were blocked in 3.5% SSC, 0.2% SDS, 1% BSA for 10 minutes at 60° C.

RNA Amplification and Labeling

Antisense RNA amplification was performed using a modified protocol of in vitro transcription as described earlier in Puskas et al. (2002). For the first strand cDNA synthesis, 5 µg of total RNA was mixed with 2 µg of an HPLC-purified anchored oligo-dT+T7 promoter (5'-GGCCAGTGAATTG-TAATACGACTCACTATAGGGAGGCGG-T$_{24}$(A/C/G)-3') (SEQ ID NO 2756). (Eurogentec, Belgium), 40 units of RNAseOUT (cat#10777-019, Invitrogen, Merelbeke, Belgium) and 0.9M D(+) trehalose (cat#T-5251, Sigma Belgium) in a total volume of 11 µl, and heated to 75° C. for 5 minutes. To this mixture, 4 µl 5× first strand buffer (Invitrogen, Belgium), 2 1 0.1 M DTT, 1 µl 10 mM dNTP mix, 1 µl 1.7 M D(+)trehalose (cat#T-5251, Sigma Belgium) and 1 µl, 200 Units of SuperScript II (cat#: 18064-014, Invitrogen, Belgium) was added in 20 µl final volume. The sample was incubated in a Biometra-Unoll thermocycler at 37° C. for 5 minutes, 45° C. for 10 minutes, 10 cycles at 60° C. for 2 minutes and at 55° C. for 2 minutes. To the first strand reaction mix, 103.8 µl water, 33.4 µl 5× second strand synthesis buffer (Invitrogen, Belgium), 3.4 µl 10 mM dNTP mix, 1 µl of 10 U/µl *E. coli* DNA ligase (cat#: 18052-019, Invitrogen, Belgium), 4 µl 10 U/µl *E. coli* DNA Polymerase I (cat#: 18010-025, Invitrogen, Belgium) and 1 µl 2 U/µl *E. coli* RNAse H (cat#: 18021-071, Invitrogen, Belgium) was added, and incubated at 16° C. for 2 hours. The synthesized double-stranded cDNA was purified with Qiaquick (cat#: 28106, Qiagen, Hilden, Germany). Antisense RNA synthesis was done by AmpliScribe T7 high yield transcription kit (cat#: AS2607; Epicentre Technologies, USA) in total volume of 20 µl according to the manufacturer's instructions. The RNA was purified with RNeasy purification kit (cat#: 74106; Qiagen, Germany). From this aRNA, 5 µg was labeled by reverse transcription using random nonamer primers (Genset, Paris, France), 0.1 mM d(G/T/A)TPs, 0.05 mM dCTP (Amersham BioSciences, UK), 0.05 mM Cy3-dCTP or Cy5-dCTP (cat#: PA53023, PA55023; Amersham BioSciences, UK) 1× first strand buffer, 10 mM DTT and 200 Units of SuperScript II (cat#: 18064-014, Invitrogen, Belgium) in 20 µl total volume. The RNA and primers were denatured at 75° C. for 5 minutes and cooled on ice before adding the remaining reaction components. After 2 hours incubation at 42° C., mRNA was hydrolyzed in 250 mM NaOH for 15 minutes at 37° C. The sample was neutralized with 10 µl of 2 M MOPS and purified with Qiaquick (cat#: 28106, Qiagen, Germany).

Array Hybridization and Post-Hybridization Processes

The probes were resuspended in 30 µl hybridization solution (50% formamide, 5×SSC, 0.1% SDS, 100 mg/ml salmon sperm DNA) and prehybridized with 1 µl poly-dT (1 mg/ml) at 42° C. for 30 minutes to block hybridization on the polyA/T tails of the cDNA on the arrays. 1 mg/ml mouse COT DNA (cat#: 18440-016, Invitrogen, Belgium) was added to the mixture and placed on the array under a glass coverslip. Slides were incubated for 18 hours at 42° C. in a humid hybridization cabinet (cat#: RPK0176; Amersham BioSciences, UK). Post-hybridization washing was performed for 10 minutes at 56° C. in 1×SSC, 0.1% SDS, two times for 10 minutes at 56° C. in 0.1×SSC, 0.1% SDS and for 2 minutes at 37° C. in 0.1×SSC.

Scanning and Data Analysis

Arrays were scanned at 532 nm and 635 nm using a Generation III scanner (Amersham BioSciences, UK). Image analysis was performed with ArrayVision (Imaging Research Inc, Ontario, Canada). Spot intensities were measured as artifact removed total intensities (ARVol). No background correction was performed. First, within-slide normalization was addressed by plotting for each single slide a "MA-plot" (Yang et al., 2002), where $M=\log_2(R/G)$ and $A=\log_2 0.54\sqrt{R\times G}$. The "LOWESS" normalization was applied to correct for dye-intensity differences. Subsequently, in order to normalize between slides and to identify differentially expressed genes between the two genotypes, two sequential analyses of variance (ANOVAs) were applied, proposed by Wolfinger et al. (2002), as follows: 1) firstly, the base-2 logarithm of the "LOWESS"-transformed measurements for all 73,264 spots ($y_{gklm}$) was subjected to a normalization model of the form $y_{iklm} = \mu + A_k + A_k D_l R_m + \epsilon_{iklm}$, where µ is the sample mean, $A_k$ is the effect of the kth array (k=1-4), $A_k D_l R_m$ is the channel-effect (AD) for the mth replication of the total collection of cDNA fragments (m=2; left or right), and $\epsilon_{iklm}$ is the stochastic error; 2) secondly, the residuals from this model were subjected to 4,579 gene-specific models of the form $r_{ijkl} = \mu + G_i A_k + G_i D_l + G_i C_j + \gamma_{ijkl}$ where $G_i A_k$ is the spot effect, $G_i D_l$ is the gene-specific dye effect, $G_i C_j$ is representing the signal intensity for genes that can specifically be attributed to the genotypes (effect of interest), and $\gamma_{ijkl}$ is the stochastic error. All effects were assumed to be fixed effects, except $\epsilon_{klm}$ and $\gamma_{ijkl}$. A t-test for differences between the $G_i C_j$ effects was performed, where the t-tests are all based on $n_1 + n_2 - 2$ degrees of freedom corresponding to the $n_1$ WT hybridizations and $n_2$ E2Fa-DPa hybridisations. The p-value cutoff was set at 0.01. No further adjustment for multiple testing was performed, as Bonferroni adjustment for 4,579 tests, to assure an experiment-wise false positive rate of 0.05, results in a p-value cutoff of $1e^{-5.0}$, which is certainly too conservative; therefore it was chosen to set the p-value cutoff arbitrarily at the 0.01 level. Also $G_i D_l$ effects were estimated and t-tested for significance at the 1% level in a same way as described above.

Genes with a significant $G_i D_l$ effect were discarded. Genstat was used to perform both the normalization and gene model fits.

Example 3

Results of the Microarray Analysis and Statistical Analysis

A micro-array containing in duplicate 4579 unique *Arabidopsis* ESTs, representing about a sixth of the total genome, was used to compare the transcriptome of wild type with that of E2Fa-DPa overexpressing plants. cDNA was synthesized from total RNA isolated from wild type and transgenic plants harvested 8 days after sowing. At this stage, transgenic plants were distinguished from control plants by the appearance of curled cotelydons which display ectopic cell divisions and enhanced endoreduplication (De Veylder et al., 2002). In the first two hybridizations Cy3 and Cy5 fluorescently labeled probe pairs of control and E2Fa-DPa cDNA were used using independent mRNA extractions of the E2Fa-DPa plants. Subsequently, a dye-swap replication was performed for both hybridizations, resulting in a total of four cDNA microarray hybridizations.

Fluorescence levels were analyzed with the aim to establish whether the level of expression of each gene varied according to overexpression of the E2Fa-DPa transcription factor. Two sequential analyses of variance (ANOVAs) were used, as proposed by Wolfinger et al. (2002). The first ANOVA model, called the "normalization" model, accounts for experiment-wise systematic effects, such as array- and channel-effects, that could bias inferences made on the data from the individual genes. The residuals from this model represent normalized values and are the input data for the second ANOVA model, called the "gene" model. The gene models are fit separately to the normalized data from each gene. This procedure uses differences in normalized expression levels, rather than ratios, as the unit of analysis of expression differences.

Prior to the estimation of genotype-specific signal intensities of the genes ($G_i C_j$ effects), which are the effects of interest, gene-specific dye effects ($G_i D_l$ effects) were estimated and t-tested for significance at the 1% level. One hundred and thirty one genes showed a significant $G_i D_l$ effect and were discard from further analysis. For each of the remaining 4,448 genes on the arrays, a t-test on the $G_i C_j$ effects for significant differences (p<0.05) was performed. FIG. 1 plots the obtained p-values (as the negative log 10 of the p-value) against the magnitude of the effect (log 2 of estimated fold change). This volcano plot illustrates the substantial difference significance testing can make versus cutoffs made strictly on the basis of the fold change. The two vertical reference lines indicate a 2-fold cutoff for either repression or induction, while the horizontal reference line refers to the p-value cutoff at the 0.05 value. These reference lines divide the plot into six sectors. The 3,535 genes in the lower middle sector have low significance and low fold change, and both methods agree that the corresponding changes are not significant. The 188 genes in the upper left and right sectors have high significance (p<0.05) and high fold change ($\geq 2$); 84 of these genes show a significant two-or-more-fold induction of expression, where the remaining 104 genes show a significant two-or-more-fold repression of expression in the E2Fa-DPa plant. Finally, the 715 genes in the upper middle sector represent significant (p<0.05) up- or downregulated genes, but with a low (≦2) fold change. The full dataset of genes can be viewed at URL: psb.rug.ac.be/E2F, which dataset is incorporated herein by reference.

All the sequences that are 1.3 times upregulated (ratio of more than 1.999) in E2Fa-DPa overexpressing plants are presented in Table 4. All the sequences that are 1.3 times repressed (calculated as 1/ratio of less than 0.775) are presented in Table 5. Particularly interesting genes that are more than 2-fold upregulated or 2 fold repressed are selected and separately represented in Tables 1 and 2.

Example 4

Sequencing and RT Mediated PCR Analysis

Figure 5:
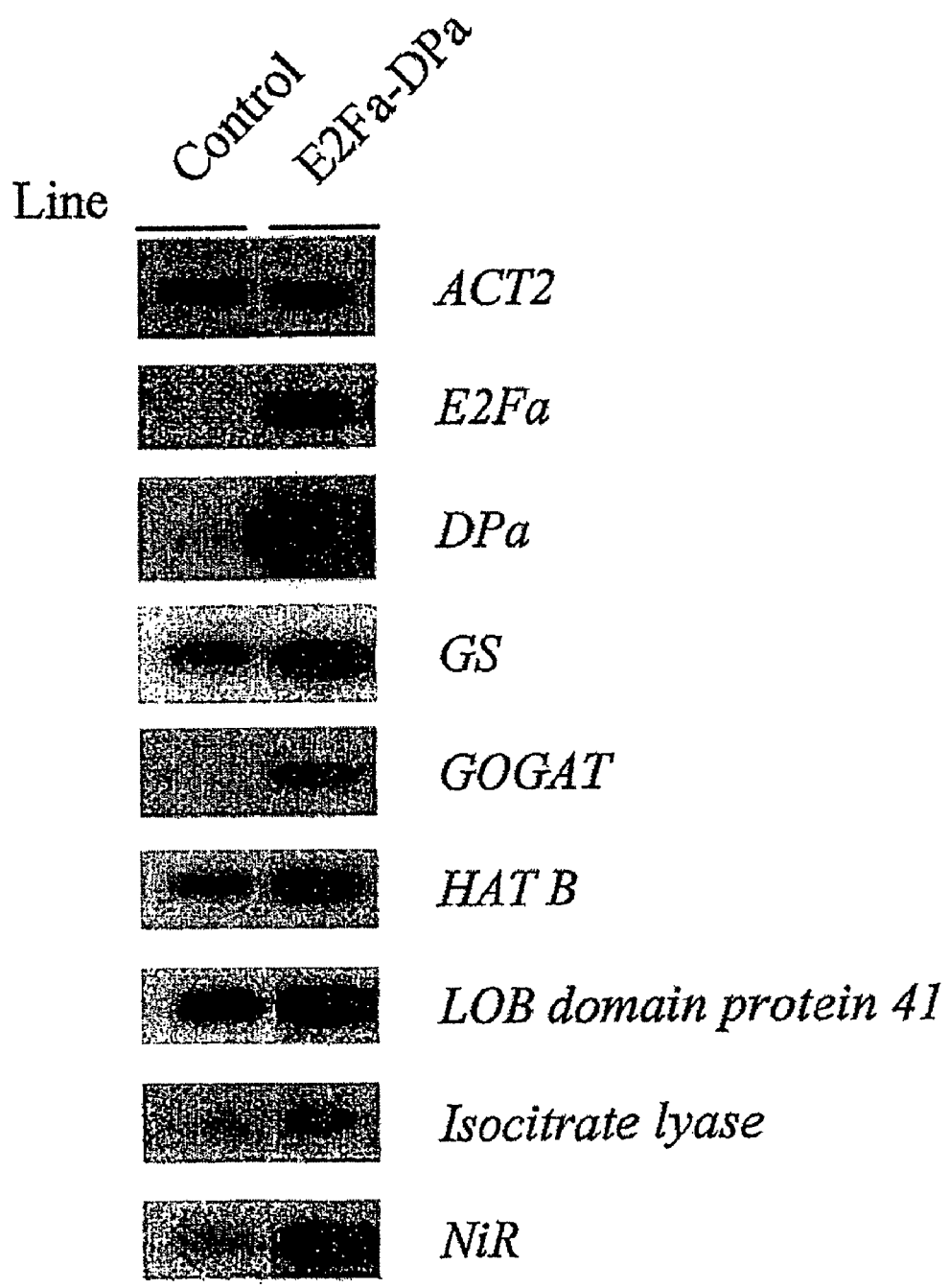
FIG. 5: Verification of microarray analysis by RT-PCR. RT-PCR analysis was carried out under linear amplification conditions. The actin 2 gene (ACT2) was used as loading control. GS, glutamine synthetase; GOGAT, glutamate synthase; NiR, nitrite reductase.
Figure 6:
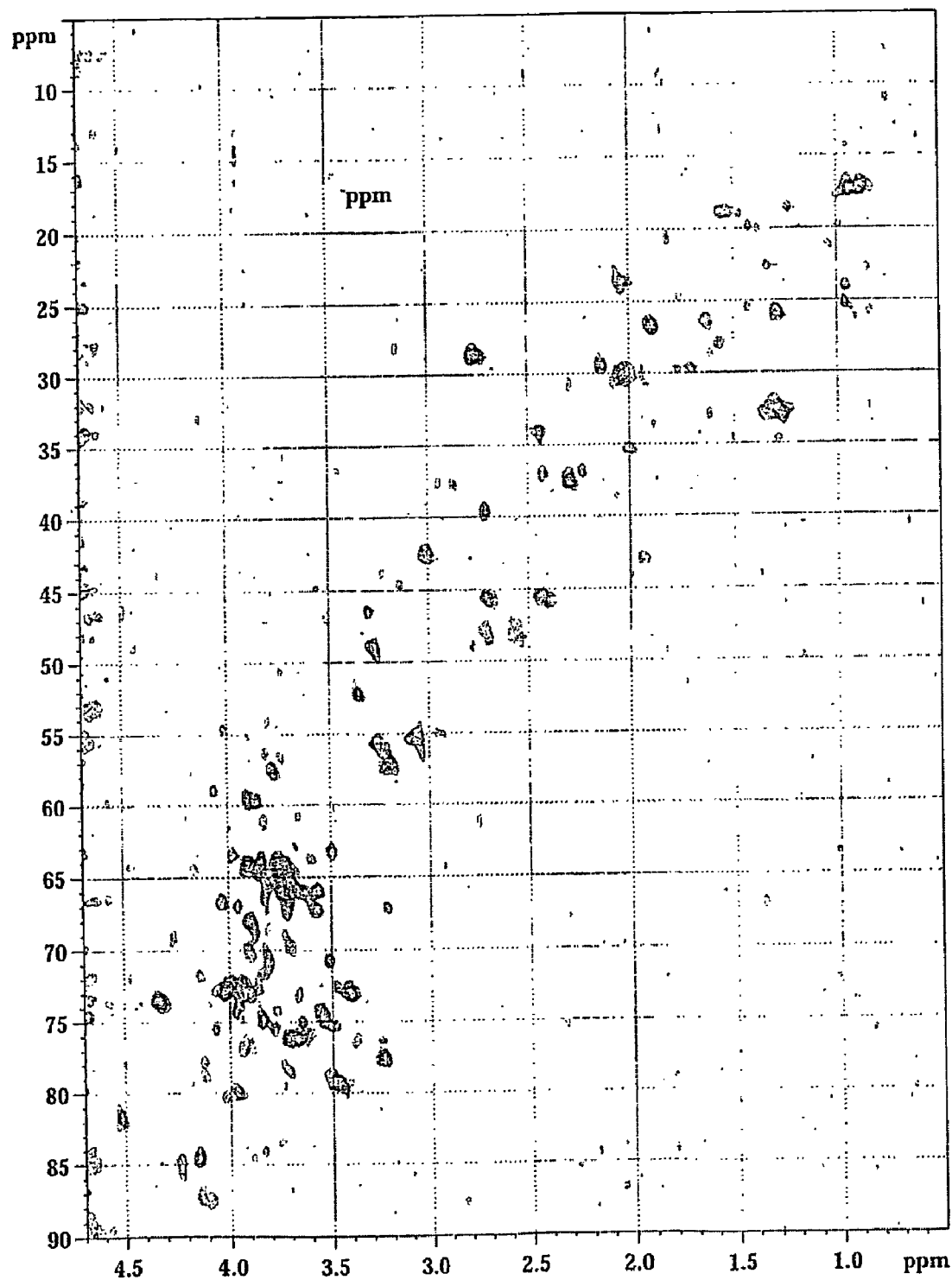
FIG. 6: NMR spectrum of E2Fa/DPa overexpressing plant cells.

The identity of the genes was confirmed by sequencing, and the induction of a random set of genes was confirmed by RT-PCR analysis (FIG. 5).

RNA was isolated from plants 8 days after sowing with the Trizol reagent (Amersham Biosciences). First-strand cDNA was prepared from 3 µg of total RNA with the Superscript RT II kit (Invitrogen) and oligo(dT)18 according to the manufacturer's instructions. A 0.25 µl aliquot of the total RT reaction volume (20 µl) was used as a template in a semi-quantitative RT-mediated PCR amplification, ensuring that the amount of amplified product remained in linear proportion to the initial template present in the reaction. From the PCR reaction, 10 µl was separated on a 0.8% agarose gel and transferred onto Hybond N+ membranes (Amersham Biosciences) that were hybridized at 65° C. with fluorescein-labeled probes (Gene Images random prime module; Amersham Biosciences). The hybridized bands were detected with the CDP Star detection module (Amersham Biosciences). Primers used were 5'-AAAAAGCAGGCTGTGTCGTACGATCT-TCTCCCGG-3' (SEQ ID NO 2757) and 5'-AGAAA GCTGGGTCATGTGATAGGAGAACCAGCG-3' (SEQ ID NO 2758) for E2Fa, 5'-ATAGAA TTCGCTTA-CATTTTGAAACTGATG-3' (SEQ ID NO 2759) and 5'-AT-AGTCGACTCAGCGA GTATCAATGGATCC-3' (SEQ ID NO 2760) for DPa, 5'-CAGATCTTGTTAACCTTGACAT CTCAG-3' (SEQ ID NO 2761) and 5'-GGGTCAAAAGATA-CAACCACACCAG-3' (SEQ ID NO 2762) for glutamine synthetase (GS), 5'-GGTTTACGAGCTACATGGCCC-3' (SEQ ID NO 2763) and 5'-GAGCAATCCGTTCAGCCTCC-3' (SEQ ID NO 2764) for glutamate synthase (GOGAT), 5'-GCGTTTGACCACTCTTGGAGAC-3' (SEQ ID NO 2765) and 5'-GAACGCCA TTGAGAAAGTCCGC-3' (SEQ ID NO 2766) for histone acetylase HAT B, 5'-GTTACCGG CTCGACTTGAAGATC-3' (SEQ ID NO 2767) and 5'-GAATCGGAGGGAAAGTCTGACG-3' (SEQ ID NO 2768) for LOB domain protein 41, 5'-GTGTGGTTTC-CAAGCTTTCCTACG-3' (SEQ ID NO 2769) and 5'-GGT-GAAGGGACTAGCCTTGTGG-3' (SEQ ID NO 2770) for isocitrate lyase, 5'-GGGATCAATCCTCAGGAGAAGG-3' (SEQ ID NO 2771) and 5'-CCGTCCATCTTTATTAGCG-GCATG-3' (SEQ ID NO 2772) for nitrite reductase (NiR), and 5'-TTACCGAGGCTCCTCTTAACCC-3' (SEQ ID NO 2773) and 5'-ACCACCGATCCAGACA CTGTAC-3' (SEQ ID NO 2774) for actin 2 (ACT2).

Example 5

Characterization of the Genes Identified as Being Involved in E2F/DP Regulated Cellular Processes The genes of the present invention identified from the microarray experiment of Example 2 have unique identification numbers (MIPS accession number e.g. At1g57680). The MIPS accession number is widely accepted in this field as it directly refers to the genomic sequence and the location of the sequence in the *Arabidopsis thaliana* genome. Accession numbers are allocated by the Munich Information Center for Protein Sequences (MIPS) and are stored in the MIPS *Arabidopsis* database. Publicly available sequence and annotation data from all other AGI ("*Arabidopsis* Genome Initiative") groups are included to establish a plant genome database (Schoof H, et al. (2002)). The MIPS *Arabidopsis* database can be accessed via the Internet URL: mips.gsf.de/cgi-bin/proj/thal and the database can be searched with the protein entry code (e.g. At1g57680). An example of the type of sequence information and protein domain information that is provided for a certain sequence in the MIPS database is shown FIG. 4.

An additional blast search with the genes according to the present invention was performed on public databases containing sequences from other plant species and other organisms. For some of the genes identified by the microarray, significant levels of homology (low E-values) were found with sequences from other organisms (see Tables 1 and 2 with reference to their Genbank accession number). So far, mainly corn and rice homologues were identified, but as more genomes will be sequenced in the future, many more homologues will be identifiable by the person skilled in the art as useful in the methods of the present invention.

DNA Replication and Cell Cycle Genes

Genes up or downregulated in the E2Fa-DPa overexpressing plants can be classified into clear groups according their function (Tables 1 and 2). 14 Genes that are 2-fold or more upregulated belong to the class of genes involved in DNA replication and modification, correlating with the observation that E2Fa-DPa overexpression plants undergo extensive endoreduplication. Most of these genes have previously be shown to be upregulated by E2F-DP overexpression in mammalian systems including a putative thymidine kinase, replication factor c, and histone genes (4 different ones). Other E2Fa-DPa induced S phase genes include a linker histone protein, the topoisomerase 6 subunit A and two subunits of the histone acetyltransferase HAT B complex, being HAT B and Msi3. The HAT B complex is responsible for the specific diacethylation of newly synthesized histone H4 during nuclease assembly on newly synthesized DNA (Lusser et al., 1999). Also a DNA methyltransferase responsible for the methylation of cytosine in cells that progress though S phase was identified among upregulated genes.

Besides the overexpressed E2Fa gene (being 90-fold more abundant in the E2FaPa overexpressing plants, compared to control plants), only one cell cycle gene (CDKB1;1) shows a 2-fold or more change in expression level upon E2Fa-DPa overexpression. CDKB1;1 was previously predicted to be a candidate E2F-DP target by virtue of a consensus E2F-DP-binding site in its promoter (de Jager et al., 2001). Whereas CDKB1;1 activity is maximum at the G2/M transition, its transcript levels start to rise during late S-phase (Porceddu et al., 2001; Menges and Murray, 2002). Upregulation of CDKB1;1 might therefore be a mechanism to link DNA replication with mitosis.

Cell Wall Biogenesis Genes

Four members of the xyloglucan endotransglucosylase (XET) gene family were found to be 2-fold or more upregulated in E2Fa-DPa overexpressing plants, one of them identical to the Meri-5 gene (Medford et al., 1991). XETs are enzymes that modify cell wall components and therefore play a likely role in altering size, shape and physical properties of plant cells. Reversal breakage of the xyloglucan tethers by XETs has been proposed to be a mechanism for allowing cell wall loosening in turgor-driven cell expansion (Campbell and Braam, 1999). However, there are several reasons to believe that E2Fa-DPa induced XETs are not required for cell expansion. First, cells divide more frequently in E2Fa-DPa overexpressing plants, but the overall cell size of the cells is smaller. Therefore, no overall increase in expansion-rates is needed. Second, correlated with the absence of increased cell expansion in the transgenic lines, no induction of genes with a known role in this process, such as expansins, can be seen. Therefore, the hydrolytic activity of the XETs might be required to incorporate the newly synthesized cell walls formed during cytokinesis into the existing cell wall structure. Alternatively, as XET activity has shown to be involved in the postgerminative mobilization of xyloglucan storage reverses in Nasturtium cotelydons (Farkas et al., 1992; Fanutti et al., 1993), induction of XETs in E2Fa-DPa overexpressing plants might relate to polysaccharide breakdown to serve the metabolic and energy needs which are required to synthesize new nucleotides (see below).

Interestingly, two XETs were identified in the set of 2-fold or more downregulated genes. These XETs are more related to each other than to the induced XET proteins. This differential response of XETs towards the E2Fa/DPa induced phenotypes suggests that plant XETs can be classified in at least 2 different functional classes.

Genes Involved in Metabolism and Biogenesis

Both the group of up and down regulated genes contains a relative large group of genes involved in metabolism and biogenesis. Most remarkable is the induction of genes involved in nitrogen assimilation, such as nitrate reductase (NIA2) (see FIG. 2), glutamine synthetase (GS), and glutamate synthetase (GOGAT). Although not present on the microarray, the nitrite reductase (NiR) gene was found to be induced in the transgenic line, as demonstrated by RT-mediated PCR analysis. Nitrogen and nitrite reductase catalyse the first step in the nitrogen assimilation pathway, whereas glutamine and glutamate synthetase are involved in both the primary assimilation from nitrogen as reassimilation of free ammonium, supplying all plants nitrogen needed for the biosynthesis of amino-acids and other nitrogen-containing compounds.

There are other indications that nitrogen metabolism is altered in E2Fa-DPa overexpressing plants, such as the modification of genes reported to be involved in *Medicago* induced nodulation (MTN3 and a nodulin-like gene); and the downregulation of genes involved in sulfur assimilation (adenylylsulfate reductase (APR; 2 different genes) and a putative adenine phosphosulfate kinase). Genes involved in sulfur assimilation such as APR have previously been shown to be transcriptionally downregulated during nitrogen deficiency (Koprivova et al., 2000).

Upregulation of nitrogen assimilation genes in E2Fa-DPa overexpressing plants might reflect the need for nitrogen for nucleotide biosynthesis, as purine and pyrimidine bases are nitrogen-rich. If nitrogen assimilation was indeed stimulated by E2Fa/DPa overexpression, two requirements should be fulfilled. Since nitrogen assimilation through the GS/GOGAT pathway requires α-ketogluterate (Lancien et al., 2000), a first requirement is that there should be enough α-ketogluterate to act as acceptor molecule for ammonium. Secondly, because assimilation of nitrogen is energy consuming, the rate of reductant production should be higher in an E2FDPa transgenic than in wild-type plants.

Figure 2:
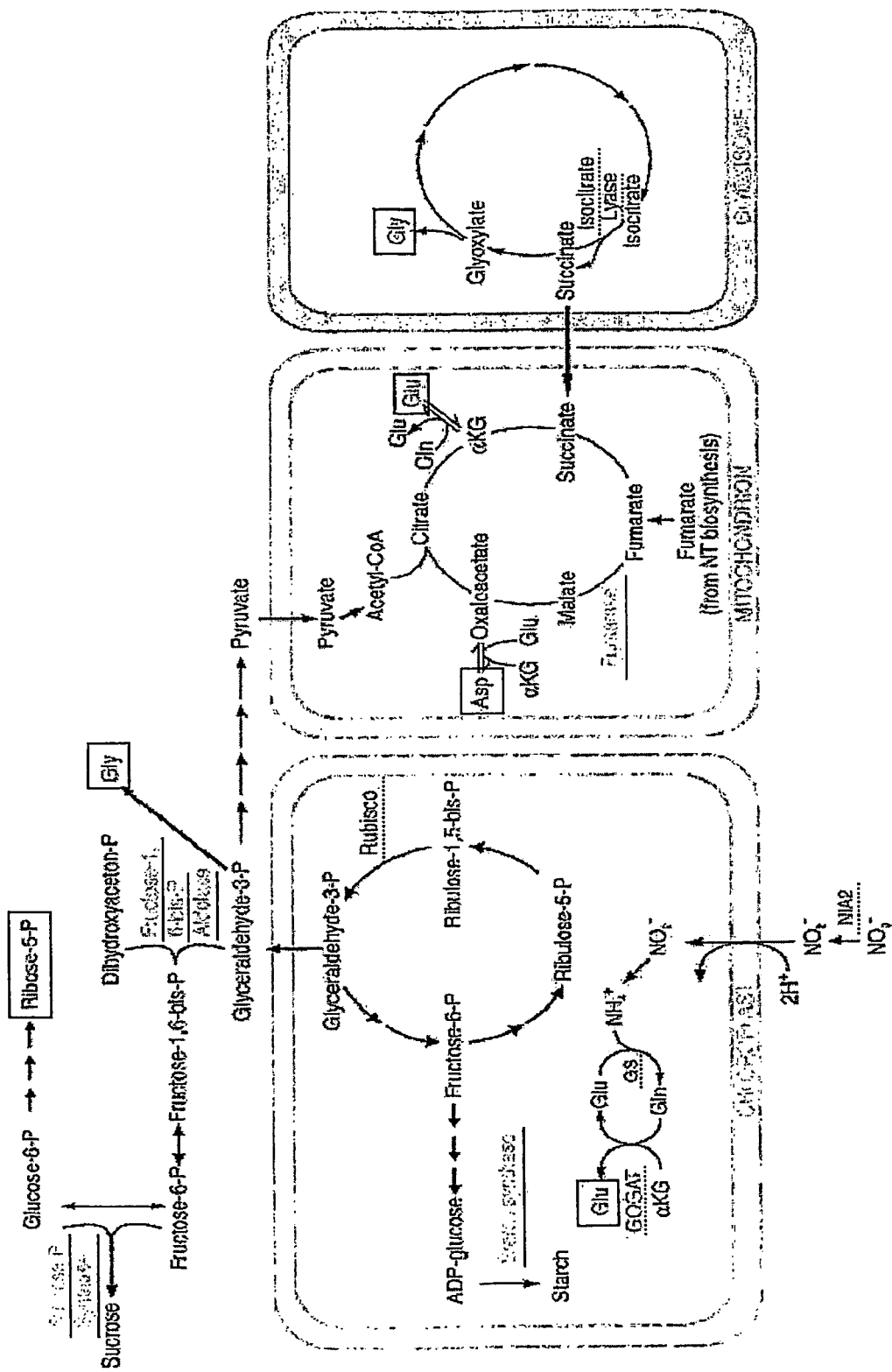
FIG. 2: Sources of alpha-ketoglutarate and other metabolites in plants, with annotation of up and downregulated genes in the E2Fa-DPa overproducing cells. Upregulated enzymes are underlined with a dashed line and enzymes underlined with a full line are downregulated in the E2Fa-DPa versus wild type plants. Products that are boxed act as precursors for nucleotide biosynthesis. A-KG, alpha-ketoglutarate; GOGAT, glutamate synthetase; NIA2, nitrate reductase, NiR, nitrite reductase.

Our micro-array data suggest that in the E2Fa-DPa overexpressing plants, α-ketogluterate accumulation is stimulated in different ways. First, α-ketogluterate production is improved by increased photosynthetic activity, as indicated by the 4.7-fold upregulation of large subunit of ribulose-1,5-bisphosphate carboxylase/oxygenase (FIG. 2). This results in an accumulation of glyceraldehyde-3-phosphate. Glyceraldehyde-3-phosphate can be converted into fructuse-1,6-bisphosphate by fructose bisphosphate aldolase. However, a 6-fold downregulation of the fructose bisphosphate aldolase gene rather suggests the conversion of glyceraldehyde-3-phosphate into pyruvate, which can be converted into α-ketogluterate during glycolysis in the citrate cycle. The preferential conversion of glyceraldehyde-3-phosphate into pyruvate in favour of sugars fits the higher need for amino-acids than for sugars for nucleotide biosynthesis. A shortage for ribose-5-phosphate for nucleotide synthesis is also evident from a downregulation of sucrose-phosphate synthase, resulting in decreased conversion of fructose-6-phosphate and glucose-6-phosphate into sucrose (FIG. 2).

A second source of α-ketogluterate is provided in the glyoxylate cycle by the 3.1 fold increase in expression of isocitrate lyase, suggesting an increased lipid turnover in E2Fa-DPa overexpressing plants. Isocistrate lyase activity cleaves isocitrate into glyoxylate and succinate (FIG. 2). Whereas the formed glyoxylate can be converted into glycine, which is also required for nucleotide biosynthesis, succinate can be converted into α-ketogluterate in the citrate cycle. A 2.3-fold decrease of the fumarase gene presumably stimulates the conversion of produced α-ketogluterate into glutamate by causing an accumulation of succinate and fumarate, which is also a side product formed during nucleotide biosynthesis (FIG. 2).

Assimilation of nitrogen is energy consuming. When rates of nitrate reduction are high, this pathway becomes the major sink for reductant. About 10% of the electron flux in photosynthesizing leaves is used for nitrate reduction. The amount of required reductant, which in leaves originates from electronic photosynthetic electron transport, is therefore expected to be higher in the E2Fa-DPa transgenics. Correspondingly, several components of the chloroplast electron transport chain and associated ATP-synthesing apparatus, such as cytochrome B6, a PSII subunit and the ATPase epsilon subunit are upregulated in the transgenic plants. Increased expression of the protochlorophyllide reductase precursor suggests that an increase in chlorophyll biosynthesis is stimulated in E2Fa-DPa overexpressing plants.

Famine of nitrogen has a putative impact on amino-acid biosynthesis, as three different amino-acid aminotransferases, are downregulated in E2Fa-DPa overexpressing plants. Accompanied with a putative decreased aminotransferase activity is the observed reduction in expression of an enzyme involved in pyridoxine biosynthesis. Shortage of nitrogen-rich amino-acids is also evident from reduced expression of genes encoding vegetative storage proteins (VSP1 and VSP2); and ERD10, a protein with a compositional bias towards glu (Kiyosue et al., 1994). Additional evidence for amino acid shortage comes from downregulation of a myrosinase-binding protein and cytochrome P450 monooxygenase CYP83A1. Both proteins are involved in the biosynthesis of glucosinolates, being nitrogen and sulfur containing products derived from amino-acids (Wittstock and Halkier, 2002).

Transcription Factors and Signal Transduction

A total of 4 transcription factors were identified among the genes being 2-fold or more upregulated, including two homeobox domain transcription factors. Among them the anthocyaninless2 (ANL2) gene was identified, which is involved in anthocyanin accumulation in subepidermal leaf cells (Kubo et al., 1999). The lack of an obvious increase in anthocyanin accumulation in E2Fa-DPa overexpressing plants suggests a role for the ANL2 protein in plant development different from anthocyanin production. This hypothesis is substantiated by the observation that anl2 mutant plants contain extra cells in the root between the cortical and epidermal layers (Kubo et al., 1999).

The second upregulated homeobox domain transcription factor is Atbh-6. Expression of Atbh-6 is restricted to regions of cell division and/or differentiation and has been shown to be inducible by water stress and ABA (Soderman et al., 1999). Other putative ABA sensitive genes can be recognized among the E2Fa-DPa induced clones, as well as the cold regulated protein COR6.6, a seed imbitition-like protein and a dormancy-associated protein. Here again, changes in expression level of these genes might be correlated with modifications in carbon metabolism. A link between ABA and sugar signaling is evident from the identification of several loci involved in both sugar and hormonal responses (Finkelstein and Gibson, 2002). Alternatively, it might be the occurrence of enhanced endoreduplication and/or cell division itself that causes a change in the osmotic potential.

Among the downregulated transcription factors a DOF family member is present. Many DOF transcription factors are participating in the regulation of storage protein genes and genes involved in carbon metabolism (Gualberti et al., 2002). Its downregulation might therefore be linked with the shortage of amino-acids due to the high demand of nitrogen for nucleotide biosynthesis.

Other regulatory genes modified in E2Fa-DPa overexpressing plants include protein kinases, several putative receptor kinases, a putative phytochrome A, and WD40 repeat containing proteins (Tables 1 and 2). Interestingly, a SNF1-like kinase is downregulated 2-fold in E2Fa-DPa overexpressing plants. In addition to its proposed role in sugar signaling, the SNF1 kinase also negatively regulates the activity of plant nitrate reductase (Smeekens, 2000).

Example 6

Endoreduplication Levels of E2Fa-DPa Plants are Nitrogen Dependent

Figure 3:
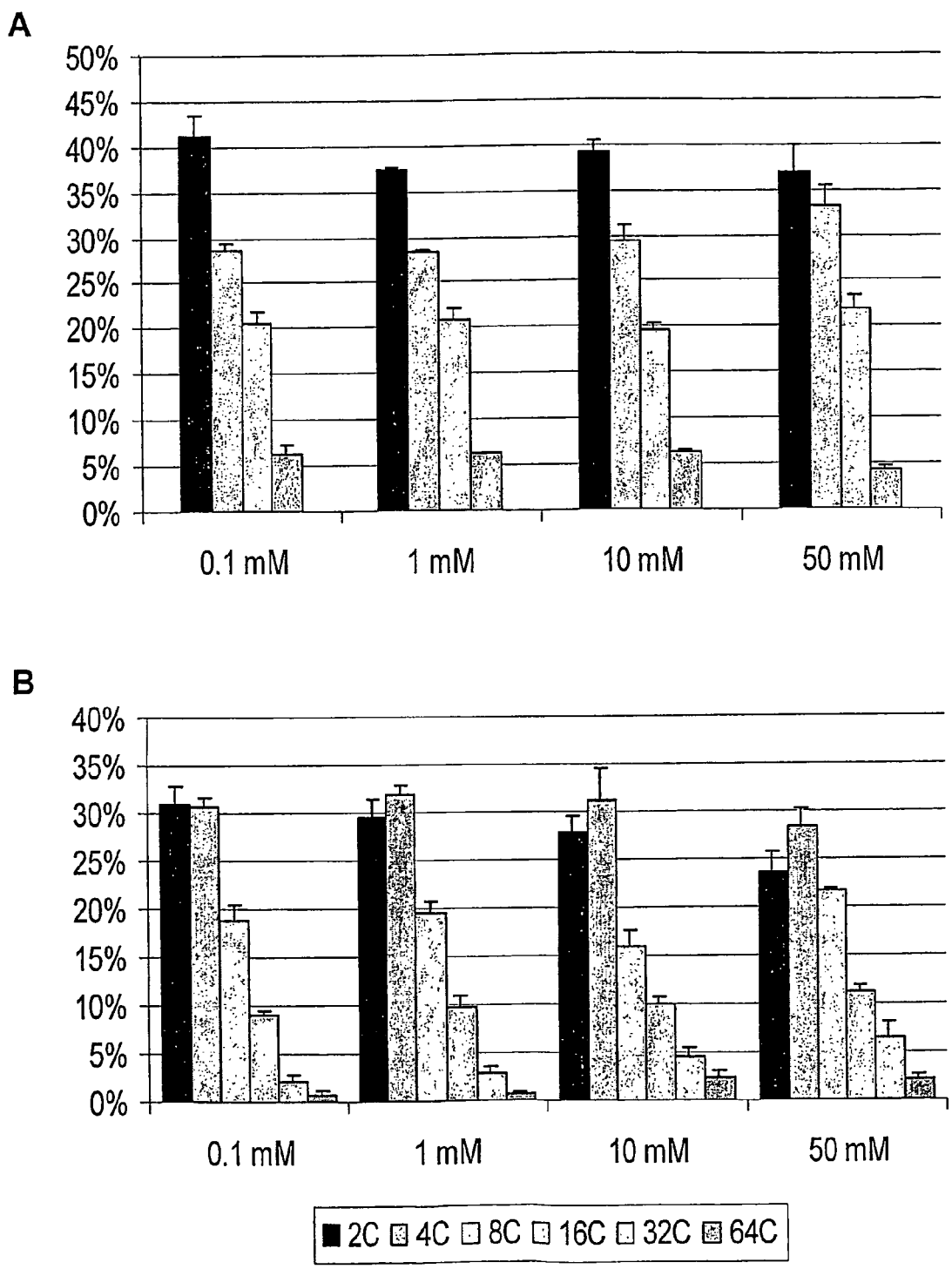
FIG. 3: Endoreduplication levels in wild type and E2Fa/DPa transgenic lines in relation to nitrogen availability. Wild type (A) and transgenic (B) lines were grown on minimal medium in the presence of 0.1, 1, 10, or 50 mM ammonium nitrate. Values are means of three independent measurements.

The modified expression of a large number of metabolic and regulatory genes, directly or indirectly linked to nitrogen metabolism, suggests a direct relationship between the high endoreduplication levels found in the E2Fa/DPa transgenic plants and nitrogen availability. To test this hypothesis, wild type and transgenic plants were grown on medium containing different levels of ammoniumnitrate, ranging from 0.1 to 50 mM. Eight days after germination ploidy levels in these plants was determined by flow cytometry. Increasing ammoniumnitrate levels hardly had an effect on the ploidy distribution pattern in wild type plants (FIG. 3A). In contrast, in the E2Fa-DPa transgenic plants increasing ammoniumnitrate levels resulted in a reproducible and significant increase in the amount of 32 C and 64 C nuclei (FIG. 3B). Comparing the lowest with the highest concentration of ammoniumnitrate, an increase of 32 C from 2.0 (±0.3) % to 6.5 (±1.5) %, and of 64 C from 0.7 (±0.3) % to 2 (±0.5) % can be seen. Increasing ammonium levels did not have any effect on the plant phenotype, as plants remained small with curled leaves on all concentrations of nitrogen tested. These data indicate that the endoreduplication levels in the E2Fa-DPa overexpressing plants are limited by nitrogen availability, and that an excess of nitrogen is incorporated into new DNA than in other nitrogen containing compounds.

Example 7

Promoter Analysis of E2Fa-DPa Regulated Genes

Promoter Analysis

The intergenic sequence corresponding to the promoter area of each gene spotted on the microarray was extracted from genomic sequences. These genomic sequences are easily accessible for example from the MIPS MatDB database (URL: mips.gsf.de/proj/thal/db). From those intergenic sequences, up to 500 bp upstream of the ATG start codon were extracted and subjected to motif searches in order to retrieve potential E2F elements. Both position and frequency of occurrence was determined using the publicly available execuTable of MatInspector (version 2.2) using matrices extracted from PlantCARE and matrices made especially for this particular analysis (Lescot et al., 2002). The relevance of each motif was evaluated against a background consisting of all the sequences from the dataset.

Results

To distinguish in the present data set the putative direct target genes of E2Fa-DPa from the secondary induced genes, the first 500 bp upstream of the ATG start codon of the genes with 2-fold or more change in expression was scanned for the presence of a E2F-like binding site matching the sequence (A/T)TT(G/C)(G/C)C(G/C)(G/C) (SEQ ID NO 2775). Of all the different permutations possible, only the TTTCCCGC (SEQ ID NO 2776) element was statistically enriched in the set of E2Fa-DPa upregulated genes, suggesting it is the preferred binding site of the E2Fa-DPa complex (Table 3). Moreover, target genes containing this element belong mainly to the group of genes involved in DNA replication and modification, being the main group of target genes in mammalian systems. These data illustrate that the TTTCCCGC sequence is the most likely cis element recognized by E2Fa-DPa. The observation that not all genes having this DNA sequence in their promoter suggests that the presence of the TTTC-CCCGC motif is not sufficient to make a gene responsive towards E2Fa-DPa, and that E2Fa-DPa co-operates with other factors to activate transcription.

It is not excluded that genes without an E2F-like-binding site are not directly activated by E2Fa-DPa. Chromatin immunoprecipitation experiments have shown that mammalian E2F factors can bind to promoters without a clear E2F recognition motif (Kiyosue et al., 1994), suggesting that E2FDP might recognize non-canonical binding sites, or might be recruited by promoters through the association of other factors. In this respect, the *Chlorella vulgaris* nitrate reductase gene, of which the *Arabidopsis* homologue was shown herein to be induced by E2F-DPa, binds an E2F-DP complex, although a clear consensus binding site is lacking (Cannons and Shiflett, 2001).

E2F can Activate as Well as Repress Promoter Activity.

In the *Nicotiana benthamiana* PCNA promoter a E2F sequence was identified acting as a negative regulatory element during development (Egelkrout et al., 2001). Also the tobacco ribonucleotide reductase small subunit gene contains a E2F element working as a repressor outside the S-phase (Chaboute et al., 2000). In the set of downregulated genes no particular enrichment of a specific E2F sequence could be seen (Table 3). Therefore the inventors believe that the E2Fa- DPa complex mainly works as a transcriptional activator, and that other E2F-DP complexes are involved in E2F-mediated transcriptional repression.

Example 8

Individual Characterization of Some Genes Identified by the Method of the Present Invention The genes characterized hereunder, are particularly useful for making plants with improved growth characteristics. These preferred genes are introduced into a plant and upregulated or downregulated in order to simulate E2Fa/DPa effects and/or to alter one or more characteristics of a plant. The particular growth characteristic that may be influenced by these genes, is described in the following paragraphs by reference to the biological function of that particular gene.

At1g07000 Showing Homology to Leucine Zipper

At1g07000 is a potential leucine zipper that is not preceded by a basic domain. The leucine zipper consists of repeated leucine residues at every seventh position and mediates protein dimerization as a prerequisite for DNA-binding. The leucines are directed towards one side of an alpha-helix. The leucine side chains of two polypeptides are thought to interdigitate upon dimerization (knobs-into-holes model). The leucine zipper may dictate dimerization specificity.

Leucine zippers are DNA binding protein with dimerization properties, having important functions in development and stress tolerance in plants.

At1g09070 Showing Homology to Soybean Cold Regulate Gene SRC2

This genes and its expressed protein is predicted in *Arabidopsis*, rice, corn, soybean, however, based on a homology search using the BLAST program, no functional homologue was known, not even a clear animal homologue, so no clear function can be predicted for this gene or protein (Takahashi, R. and Shimosaka, E. (1997)).

At1 g21690 Showing Homology to Replication Factor

Replication factor C(RFC) is a pentameric complex of five distinct subunits that functions as a clamp loader, facilitating the loading of proliferating cell nuclear antigen (PCNA) onto DNA during replication and repair. More recently the large subunit of RFC, RFC (p140), has been found to interact with the retinoblastoma (Rb) tumor suppressor and the CCAAT/enhancer-binding protein alpha (C/EBPalpha) transcription factor. It is reported that RFC (p140) associates with histone deacetylase activity and interacts with histone deacetylase 1 (HDAC1) (Anderson, L. A. and Perkins, N. D. (2002); Furukawa, T. et al. (2001)) RFC is poorly known in plants. It can be important for development for modulating gene expression during cell cycle at S phase, or through chromatin regulation.

At1g23030 Showing Homology to Armadillo Protein

Members of the armadillo (arm) repeat family of proteins are implicated in tumorigenesis, embryonic development, and maintenance of tissue integrity. ARM proteins participate in linking cytoskeleton to membrane proteins and structures. These proteins share a central domain that is composed of a series of imperfect 45 amino acid repeats. Armadillo family members reveal diverse cellular locations reflecting their diverse functions. A single protein exerts several functions through interactions of its armadillo repeat domain with diverse binding partners. The proteins combine structural roles as cell-contact and cytoskeleton-associated proteins and signaling functions by generating and transducing signals affecting gene expression. The study of armadillo family members has made it increasingly clear that a distinction between structural proteins on the one hand and signaling molecules on the other is rather artificial. Instead armadillo family members exert both functions by interacting with a number of distinct cellular-binding partners. Proteins of the armadillo family are involved in diverse cellular processes in higher eukaryotes. Some of them, like armadillo, beta-catenin and plakoglobins have dual functions in intercellular junctions and signalling cascades. Others belonging to the importin-alpha-subfamily are involved in NLS (Nuclear localization signal) recognition and nuclear transport, while some members of the armadillo family have as yet unknown functions. (Wang, Y. X. et al. (2001); Hatzfeld, M. (1999). ARM proteins are key protein binding units that are involved at several steps during development. Some are specific to the cell cycle APC degradation complex. These type of genes have been poorly studied in plants, some have been involved in light and gibberellin signaling in potato.

At1g27500 Showing Homology to Kinesin Light Chain.

The motor protein kinesin is a heterotetramer composed of two heavy chains of approximately 120 kDa and two light chains of approximately 65 kDa protein. Kinesin motor activity is dependent on the presence of ATP and microtubules. Conventional kinesin is prevented from binding to microtubules (MTs) when not transporting cargo. The function of LC kinesin is to keep kinesin in an inactive ground state by inducing an interaction between the tail and motor domains of HC; activation for cargo transport may be triggered by a small conformational change that releases the inhibition of the motor domain for MT binding. This protein is important to regulate movement controlled by microtubules within the cytoplasm, for example the flux of vesicles between the different cell membrane compartments.

At1g72180 Showing Homology to Putative Receptor Protein Kinase

Plant receptor-like kinases (RLKs) are transmembrane proteins with putative amino-terminal extracellular domains and carboxyl-terminal intracellular kinase domains, with striking resemblance in domain organization to the animal receptor tyrosine kinases such as epidermal growth factor receptor. The recently sequenced *Arabidopsis* genome contains more than 600 RLK homologs. Although only a handful of these genes have known functions and fewer still have identified ligands or downstream targets, the studies of several RLKs such as CLAVATA1, Brassinosteroid Insensitive 1, Flagellin Insensitive 2, and S-locus receptor kinase provide much-needed information on the functions mediated by members of this large gene family. RLKs control a wide range of processes, including development, disease resistance, hormone perception, and self-incompatibility. Combined with the expression studies and biochemical analysis of other RLKs, more details of RLK function and signaling are emerging.

At1g72900 Showing Homology to Disease Resistance Protein (TIR Virus Resistance Protein)

The TIR gene has been described by Kroczynska, B. et al. (1999).

At2g30590 Showing Homology to WRKY Transcription Factor (Toll/Interleukin-1 Receptor-Like Protein)

The sequence shows homology to tomato Cf-9 resistance gene Avr9/Cf-9 rapidly elicited protein 4 (NL27) (Hehl, R. et al. (1998)). WRKY proteins are a large group of transcription factors restricted to the plant kingdom. WRKY proteins are a recently identified class of DNA-binding proteins that recognize the TTGAC(C/T) W-box elements found in the promoters of a large number of plant defense-related genes (Dong and Chen, 2003). It has been found that the majority are responsive both to pathogen infection and to salicylic acid. The functions of all other WRKY genes revealed to date involve responses to pathogen attack, mechanical stress, and senescence (Dong and Chen, 2003).

At1g80530 Showing Homology to Nodulin

Infection of soybean roots by nitrogen-fixing *Bradyrhizobium japonicum* leads to expression of plant nodule-specific genes known as nodulins. Nodulin 26, a member of the major intrinsic protein/aquaporin (AQP) channel family, is a major component of the soybean symbiosome membrane (SM) that encloses the *rhizobium* bacteroid. These results indicate that nodulin 26 is a multifunctional AQP that confers water and glycerol transport to the SM, and likely plays a role in osmoregulation during legume/rhizobia symbioses (Dean et al. (1999). Rice (*Oryza sativa* var. *Nipponbare*) possesses two different homologues of the soybean early nodulin gene GmENOD93 (GmN93), OsENOD93a (homology of 58.2% to GmENOD93), OsENOD93b (homology of 42.3%). In intact rice tissues, OsENOD93b was most abundantly expressed in roots and at much lower levels in etiolated and green leaves, whereas the expression of OsENOD93a was very low in roots and etiolated leaves, and was not detected in green leaves. The level of OsENOD93a expression was enhanced markedly in suspension-cultured cells, whereas that of OsENOD93b did not increase (Reddy et al. (1998)). Homologues of genes that are produced in response to infection of soybean roots by bacteria are also present in other plants such rice. Their function is largely unknown, some functional homologues are identified such as a water channel involved in osmoregulation.

At2g34770 Showing Homology to Fatty Acid Hydroxylase

This gene has been described in Matsuda et al. (2001). A common feature of the membrane lipids of higher plants is a large content of polyunsaturated fatty acids, which typically consist of dienoic and trienoic fatty acids. Two types of omega-3 fatty acid desaturase, which are present in the plastids and in the endoplasmic reticulum (ER), respectively, are responsible for the conversion of dienoic to trienoic fatty acids. To establish a system for investigating the tissue-specific, and hormone-regulated expression of the ER-type desaturase gene (FAD3), transgenic plants of *Arabidopsis thaliana* (L.) Heynh. containing the firefly luciferase gene (LUC) fused to the FAD3 promoter (FAD3::LUC) were constructed. The results as discussed in this report suggest that the expression of ER-type desaturase is regulated through synergistic and antagonistic hormonal interactions, and that such hormonal regulation and the tissue specificity of the expression of this gene are further modified in accordance with the growth phase in plant development (Wellesen K, et al. (2001); Kachroo P, et al. (2001); Kahn, R. A. et al. (2001); Smith, M. et al. (2000)).

At2g43402 Showing Homology to Cinnamoyl CoA Reductase

CCR enzyme is involved in lignification. The CCR transcript is expressed in lignified organs, i.e. root and stem tissues, and is localized mainly in young differentiating xylem. Also, monolignols may be precursors of end products other than lignins. CCR catalyses the conversion of cinnamoyl-CoAs into their corresponding cinnamaldehydes, i.e. the first step of the phenylpropanoid pathway specifically dedicated to the monolignol biosynthetic branch. The two genes are differentially expressed during development and in response to infection. AtCCR1 is preferentially expressed in tissues undergoing lignification. In contrast, AtCCR2, which is poorly expressed during development, is strongly and transiently induced during the incompatible interaction with *Xanthomonas campestris* pv. *Campestris* leading to a hypersensitive response. Altogether, these data suggest that AtCCR1 is involved in constitutive lignification whereas AtCCR2 is involved in the biosynthesis of phenolics whose accumulation may lead to resistance (Lauvergeat et al. (2001)). This protein is involved during development, increase in growth diameter, lignification of vascular strands and interfascicular fibers.

At2g47440 Showing Homology to Tetratricopeptide Repeat Protein

The tetratricopeptide repeat (TPR) is found in many proteins performing a wide variety of functions, the TPR domain itself is believed to be a general protein recognition module. Different proteins may contain from 3 to 16 tandem TPR motifs (34 amino acid sequence). It has been shown that some proteins contain a TPR repeat are cell cycle regulated.

At3g23750 Showing Homology to Receptor Like Kinase TMK

The kinase domain of NtTMK1 contained all of 12 subdomains and invariant amino acid residues found in eukaryotic protein kinases. The extracellular domain contained 11 leucine-rich repeats, which have been implicated in protein-protein interactions. The amino acid sequence of NtTMK1 exhibited high homology with those of TMK1 of *Arabidopsis* and TMK of rice in both kinase and extracellular domains, suggesting that NtTMK1 is a TMK homologue of tobacco. The NtTMK1 transcripts were present in all major plant organs, but its level varied in different developmental stages in anthers and floral organs. NtTMK1 mRNA accumulation in leaves was stimulated by CaCl2, methyl jasmonate, wounding, fungal elicitors, chitins, and chitosan. The NtTMK1 mRNA level also increased upon infection with tobacco mosaic virus (Cho and Pai (2000)). This protein is involved in different aspects of development and disease resistance.

At3g61460 Showing Homology to RING H2

RING-finger proteins contain cysteine-rich, zinc-binding domains and are involved in the formation of macromolecular scaffolds important for transcriptional repression and ubiquitination. RING H2 act as E3 ubiquitin-protein ligases and play critical roles in targeting the destruction of proteins of diverse functions in all eukaryotes, ranging from yeast to mammals. The *Arabidopsis* genome contains a large number of genes encoding RING finger proteins. A small group is constituted by more than 40 RING-H2 finger proteins that are of small size, not more than 200 amino acids, and contain no other recognizable protein-protein interaction domain(s). This type of genes is very important for several aspect of development, regulation of developmental proteins, cell cycle proteins.

At4g00730 Showing Homology to Homeodomain AHDP (Antocyaninless 2)

This is a homeodomain transcription factor; similar to ATML1 and is very conserved and has epidermis specific expression. This sequence shows also homology to *Zea mays* mRNA for OCL3 protein (Ingram, G. C. et al. (2000)).

At4g13940 Showing Homology to Adenosylhomocysteinase (Glutathione Dependent Formaldehyde Dehydrogenase)

Glutathione-dependent formaldehyde dehydrogenase was described in Sakamoto, A. et al. (2002), *Arabidopsis* glutathione-dependent formaldehyde dehydrogenase is an S-nitrosoglutathione reductase. S-Nitrosoglutathione (GSNO), an adduct of nitric oxide (NO) with glutathione, is known as a biological NO reservoir. Heterologous expression in *Escherichia coli* of a cDNA encoding a glutathione-dependent formaldehyde dehydrogenase of *Arabidopsis thaliana* showed that the recombinant protein reduces GSNO. The identity of the cDNA was further confirmed by functional complementation of the hypersensitivity to GSNO of a yeast mutant with impaired GSNO metabolism. This is the first demonstration of a plant GSNO reductase, suggesting that plants possess the enzymatic pathway that modulates the bioactivity and toxicity of NO.

At4g35050 Showing Homology to WD40 MSI3

Members of the MSI/RbAp sub-family of WD-repeat proteins are widespread in eukaryotic organisms and form part of multiprotein complexes that are involved in various biological pathways, including chromatin assembly, regulation of gene transcription, and cell division. The *Zea mays* RbAp-like protein (ZmRbAp1) binds acetylated histones H3 and H4 and suppresses mutations that have a negative effect on the Ras/cAMP pathway in yeast. The ZmRbAp genes form a gene family and are expressed in different tissues of *Z. mays* L. plants. Determination of its expression pattern during maize seed development revealed that ZmRbAp transcripts are abundant during the initial stages of endosperm formation. In addition, the transcripts are specifically localized in shoot apical meristem and leaf primordia of the embryo. ZmRbAp genes play a role in early endosperm differentiation and plant development (Rossi et al. (2001)). Also Rb proteins are known to be involved in multi-protein complexes; there are Rb binding protein characterized; and Rb plays a role in chromatin remodeling and cell cycle control and is important in development and growth of organs. The retinoblastoma (RB) protein regulates G1 progression and functions through its association with various cellular proteins. Two closely related mammalian RB binding proteins, RbAp48 and RbAp46, share sequence homology with the Msi1 protein of yeast. MSI1 is a multicopy suppressor of a mutation in the IRA1 gene involved in the Ras-cAMP pathway that regulates cellular growth. Human RbAp48 is present in protein complexes involved in histone acetylation and chromatin assembly. Four plant RbAp48- and Msi1-like proteins have been identified: one from tomato, LeMSI1, and three from *Arabidopsis*. LeMSI1 can function as a multicopy suppressor of the yeast ira1 mutant phenotype. The LeMSI1 protein localizes to the nucleus and binds to a 65-kD protein in wild-type as well as ripening inhibitor (rin) and Neverripe (Nr) tomato fruit. LeMSI1 also binds to the human RB protein and the RB-like RRB1 protein from maize, indicating that this interaction is conserved between plants and animals (Ach et al. (1997)).

At4g36670 Showing Homology to Sugar Transporter

The ERD6 clone is expressed after exposure to dehydration stress for 1 h. The ERD6 is related to sugar transporters of bacteria, yeasts, plants and mammals. Hydropathy analysis revealed that ERD6 protein has 12 putative transmembrane domains and a central hydrophilic region. Sequences that are conserved at the ends of the 6th and 12th membrane-spanning domains of sugar transporters are also present in ERD6. ERD6 gene is a member of a multigene family in the *Arabidopsis* genome. The expression of the ERD6 gene was induced not only by dehydration but also by cold treatment (Kiyosue et al. (1998)).

At5g01870 Showing Homology to Lipid Transfer Protein

Nonspecific lipid transfer proteins (LTPs) from plants are characterized by their ability to stimulate phospholipid transfer between membranes in vitro. However, because these proteins are generally located outside of the plasma membrane, it is unlikely that they have a similar role in vivo. The LTP1 promoter was active early in development in protoderm cells of embryos, vascular tissues, lignified tips of cotyledons, shoot meristem, and stipules. In adult plants, the gene was expressed in epidermal cells of young leaves and the stem. In flowers, expression was observed in the epidermis of all developing influorescence and flower organ primordial the epidermis of the siliques and the outer ovule wall, the stigma, petal tips, and floral nectaries of mature flowers, and the petal/sepal abscission zone of mature siliques. Consistent with a role for the LTP1 gene product in some aspect of secretion or deposition of lipophilic substances in the cell walls of expanding epidermal cells and certain secretory tissues. The LTP1 promoter region contained sequences homologous to putative regulatory elements of genes in the phenylpropanoid biosynthetic pathway, suggesting that the expression of the LTP1 gene may be regulated by the same or similar mechanisms as genes in the phenylpropanoid pathway (Thoma, S. et al. (1994)). More background knowledge to this type of genes can be found in the following references: Clark, A. M. et al., (1999); Toonen, M. A. et al. (1997); Molina, A. (1997); Thoma, S. et al. (1994).

At5g02820 Showing Homology to SPO Like

Plant steroid hormones, such as brassinosteroids (BRs), play important roles throughout plant growth and development. Plants defective in BR biosynthesis or perception display cell elongation defects and severe dwarfism. Two dwarf mutants named bin3 and bin5 with identical phenotypes to each other display some characteristics of BR mutants and are partially insensitive to exogenously applied BRs. In the dark, bin3 or bin5 seedlings are de-etiolated with short hypocotyls and open cotyledons. Light-grown mutant plants are dwarfs with short petioles, epinastic leaves, short inflorescence stems, and reduced apical dominance. BIN3 and BIN5 were cloned and show that BIN5 is one of three putative *Arabidopsis* SPO11 homologs (AtSPO11-3) that also shares significant homology to archaebacterial topoisomerase VI (TOP6) subunit A, whereas BIN3 represents a putative eukaryotic homolog of TOP6B. The pleiotropic dwarf phenotypes of bin5 establish that, unlike all of the other SPO11 homologs that are involved in meiosis, BIN5/AtSPO11-3 plays a major role during somatic development. Furthermore, microarray analysis of the expression of about 5500 genes in bin3 or bin5 mutants indicates that about 321 genes are down-regulated in both of the mutants, including 18 of 30 BR-induced genes. These results suggest that BIN3 and BIN5 may constitute an *Arabidopsis* topoisomerase VI that modulates expression of many genes, including those regulated by BRs (Yin Y et al. (2002)). More background information on this type of gene can be found in the following references: Soustelle, C. et al. (2002); Kee, K. and Keeney, S. (2002); Hartung, F. and Puchta, H. (2001); Grelon, M. et al. (2001).

At5g14420 Showing Homology to Copine I (Phospholipid Binding Protein)

The copines are a newly identified class of calcium-dependent, phospholipid binding proteins that are present in a wide range of organisms, including Paramecium, plants, *Caenorhabditis elegans*, mouse, and human. However, the biological functions of the copines are unknown. A humidity-sensitive copine mutant was made in *Arabidopsis* and under non-permissive, low-humidity conditions, the cpn1-1 mutant displayed aberrant regulation of cell death that included a lesion mimic phenotype and an accelerated hypersensitive response (HR). However, the HR in cpn1-1 showed no increase in sensitivity to low pathogen titers. Low-humidity-grown cpn1-1 mutants also exhibited morphological abnormalities, increased resistance to virulent strains of *Pseudomonas syringae* and *Peronospora parasitica*, and constitutive expression of pathogenesis-related (PR) genes.

Growth of cpn1-1 under permissive, high-humidity conditions abolished the increased disease resistance, lesion mimic, and morphological mutant phenotypes but only partially alleviated the accelerated HR and constitutive PR gene expression phenotypes. The disease resistance phenotype of cpn1-1 suggests that the CPN1 gene regulates defense responses. Alternatively, the primary function of CPN1 may be the regulation of plant responses to low humidity, and the effect of the cpn1-1 mutation on disease resistance may be indirect (Jambunathan et al. (2001)). *Arabidopsis* growth over a wide range of temperatures requires the BONZAI1 (BON1) gene because bon1 null mutants make miniature fertile plants at 22° C. but have wild-type appearance at 28° C. The expression of BON1 and a BON1-associated protein (BAP1) is modulated by temperature. Thus BON1 and BAP1 may have a direct role in regulating cell expansion and cell division at lower temperatures. BON1 contains a Ca(2+)-dependent phospholipid-binding domain and is associated with the plasma membrane. It belongs to the copine gene family, which is conserved from protozoa to humans. The data here obtained suggest that this gene family may function in the pathway of membrane trafficking in response to external conditions (Hua et al. (2001)). The major calcium-dependent, phospholipid-binding protein obtained from extracts of *Paramecium tetraurelia*, named copine, had a mass of 55 kDa, bound phosphatidylserine but not phosphatidylcholine at micromolar levels of calcium but not magnesium, and promoted lipid vesicle aggregation. Current sequence databases indicate the presence of multiple copine homologs in green plants, nematodes, and humans. The full-length sequences reveal that copines consist of two C2 domains at the N terminus followed by a domain similar to the A domain that mediates interactions between integrins and extracellular ligands. The association with secretory vesicles, as well the general ability of copines to bind phospholipid bilayers in a calcium-dependent manner, suggests that these proteins may function in membrane trafficking (Creutz et al. (1998)).

At5g49160 Showing Homology to Cytosine Methyltransferase

DNMT3L is a regulator of imprint establishment of normally methylated maternal genomic sequences. DNMT3L shows high similarity to the de novo DNA methyltransferases, DNMT3A and DNMT3B, however, the amino acid residues needed for DNA cytosine methyltransferase activity have been lost from the DNMT3L protein sequence. Apart from methyltransferase activity, Dnmt3a and Dnmt3b serve as transcriptional repressors associating with histone deacetylase (HDAC) activity. DNMT3L can also repress transcription by binding directly to HDAC1 protein. PHD-like zinc finger of the ATRX domain is the main repression motif of DNMT3L, through which DNMT3L recruits the HDAC activity needed for transcriptional silencing. DNMT3L as a co-repressor protein and suggest that a transcriptionally repressed chromatin organisation through HDAC activity is needed for establishment of genomic imprints (Aapola et al. (2002)). More background information on this type of gene can be found in Chen, T. et al. (2002); Bartee, L. and Bender, J. (2001); Freitag M. et al. (2002). In *Arabidopsis* a SWI2/SNF2 chromatin remodeling factor-related protein DDM1 and a cytosine methyltransferase MET1 is required for maintenance of genomic cytosine methylation. Mutations in either gene cause global demethylation. There are also effects of these mutations on the PAI tryptophan biosynthetic gene family, which consists of four densely methylated genes arranged as a tail-to-tail inverted repeat plus two unlinked singlet genes. The methylation mutations caused only partial demethylation of the PAI loci: ddm1 had a strong effect on the singlet genes but a weaker effect on the inverted repeat, whereas met1 had a stronger effect on the inverted repeat than on the singlet genes. The double ddm1 met1 mutant also displayed partial demethylation of the PAI genes, with a pattern similar to the ddm1 single mutant. To determine the relationship between partial methylation and expression for the singlet PAI2 gene a novel reporter strain of *Arabidopsis* was constructed, in which PAI2 silencing could be monitored by a blue fluorescent plant phenotype diagnostic of tryptophan pathway defects. This reporter strain revealed that intermediate levels of methylation correlate with intermediate suppression of the fluorescent phenotype. Other background information can be found in Finnegan, E. J. and Kovac K. A. (2000). Plant DNA methyltransferases. DNA methylation is an important modification of DNA that plays a role in genome management and in regulating gene expression during development. Methylation is carried out by DNA methyltransferases which catalyse the transfer of a methyl group to bases within the DNA helix. Plants have at least three classes of cytosine methyltransferase which differ in protein structure and function. The METI family, homologues of the mouse Dnmt1 methyltransferase, most likely function as maintenance methyltransferases, but may also play a role in de novo methylation. The chromomethylases, which are unique to plants, may preferentially methylate DNA in heterochromatin; the remaining class, with similarity to Dnmt3 methyltransferases of mammals, are putative de novo methyltransferases. The various classes of methyltransferase may show differential activity on cytosines in different sequence contexts. Chromomethylases may preferentially methylate cytosines in CpNpG sequences while the *Arabidopsis* METI methyltransferase shows a preference for cytosines in CpG sequences. Additional proteins, for example DDM1, a member of the SNF2/SWI2 family of chromatin remodeling proteins, are also required for methylation of plant DNA.

At5g54940 Showing Homology to Translation Initiation Factor (Translational Initiation Factor eIF1), Protein synthesis has not been considered to be fundamental in the control of cell proliferation. However, data are emerging on the involvement of this process in cell growth and tumorigenesis. Protein biosynthesis is a central process in all living cells. It is one of the last steps in the transmission of genetic information stored in DNA on the basis of which proteins are produced to maintain the specific biological function of a given cell. Protein synthesis takes place on ribosomal particles where the genetic information transcribed into mRNA is translated into protein. The process of protein synthesis on the ribosome consists of three phases: initiation, elongation and termination. Brassinosteroids (BRs) regulate the expression of numerous genes associated with plant development, and require the activity of a Ser/Thr receptor kinase to realize their effects. In animals, the transforming growth factor-beta (TGF-beta) family of peptides acts via Ser/Thr receptor kinases to have a major impact on several pathways involved in animal development and adult homeostasis. TGF-beta receptor-interacting protein (TRIP-1) was previously shown by others to be an intracellular substrate of the TGF-beta type II receptor kinase which plays an important role in TGF-beta signaling. TRIP-1 is a WD-repeat protein that also has a dual role as an essential subunit of the eukaryotic translation initiation factor eIF3 in animals, yeast and plants, thereby revealing a putative link between a developmental signaling pathway and the control of protein translation. In yeast, expression of a TRIP-1 homolog has also been closely associated with cell proliferation and progression through the cell cycle. Transcript levels of TRIP-1 homologs in plants are regulated by BR treatment under a variety of conditions, and transgenic plants expressing antisense TRIP-1 RNA exhibit a broad range of developmental defects, including some that resemble the phenotype of BR-deficient and -insensitive mutants. This correlative evidence suggests that a WD-domain protein with reported dual functions in vertebrates and fungi might mediate some of the molecular mechanisms underlying the regulation of plant growth and development by BRs (Jiang and Clouse (2001)). The *Arabidopsis* COP9 signalosome is a multisubunit repressor of photomorphogenesis that is conserved among eukaryotes. This complex may have a general role in development. association between components of the COP9 signalosome (CSN1, CSN7, and CSN8) and two subunits of eukaryotic translation initiation factor 3 (eIF3), eIF3e (p48, known also as INT-6) and eIF3c (p105). AteIF3e coimmunoprecipitated with CSN7, and eIF3c coimmunoprecipitated with eIF3e, eIF3b, CSN8, and CSN1. eIF3e directly interacted with CSN7 and eIF3c. eIF3e and eIF3c are probably components of multiple complexes and that eIF3e and eIF3c associate with subunits of the COP9 signalosome, even though they are not components of the COP9 signalosome core complex. This interaction may allow for translational control by the COP9 signalosome (Yahalom et al. (2001)).

At5g56740 Showing Homology to Histone Acetyl Transferase HATB

Transforming viral proteins such as E1A which force quiescent cells into S phase have two essential cellular target proteins, Rb and CBP/p300. Rb regulates the G1/S transition by controlling the transcription factor E2F. CBP/p300 is a transcriptional co-activator with intrinsic histone acetyltransferase activity. This activity is regulated in a cell cycle dependent manner and shows a peak at the G1/S transition. CBP/p300 is essential for the activity of E2F, a transcription factor that controls the G1/S transition. It was found that CBP HAT activity is required both for the G1/S transition and for E2F activity. Thus CBP/p300 seems to be a versatile protein involved in opposing cellular processes, which raises the question of how its multiple activities are regulated (Ait-Si-Ali, S. et al (2000)). The BRCA2 is a histone acetyltransferase. Two potential functions of BRCA2 were proposed which includes role in the regulation of transcription and also in DNA repair. Forty-five-amino acid region encoded by exon 3 of BRCA2 was shown to have transcriptional activation function. Recent studies of the several enzymes involved in acetylation and deacetylation of histone residues have revealed a possible relationship between gene transcriptional activation and histone acetylation. Since BRCA2 appear to function as a transcriptional factor, Histone acetyl transferase (HAT) activity of BRCA2 was tested. Also, evidence that BRCA2 has intrinsic HAT activity, which maps to the amino-terminal region of BRCA2, was presented. It was demonstrated that BRCA2 proteins acetylate primarily H3 and H4 of free histones. These observations suggest that HAT activity of BRCA2 may play an important role in the regulation of transcription and tumor suppressor function (Siddique et al. (1998)). These types of genes are very important for regulation of genes involved in development, cell cycle control, and chromatin structure.

At5g61520 Showing Homology to STP3 Sucrose Transporter

For developing seeds of grain legumes, photoassimilates released to the seed apoplasm from maternal seed coats are retrieved by abaxial epidermal and subepidermal cells (dermal cell complexes) of cotyledons followed by symplasmic passage to their underlying storage parenchyma cells. In some species, the cells of these complexes differentiate into transfer cells (e.g. broad bean and pea, Patrick and Offler, 2001). Sucrose is a major component of the photoassimilates delivered to cotyledons (Patrick and Offler, 2001; Weber et al., 1997b).

Sucrose transporter (SUT) genes have been cloned, and functionally characterized as sucrose/H+ symporters, from developing cotyledons of broad bean (VfSUT1, Weber et al., 1997a) and pea (PsSUT1, Tegeder et al., 1999). SUTs and P-type H+-ATPases have been shown to co-localize to plasma membranes of dermal cell complexes in developing cotyledons of broad bean (Harrington et al., 1997; Weber et al., 1997a) and French bean (Tegeder et al., 2000). In contrast, for pea cotyledons, SUT is also present in storage parenchyma cells, but is 4-fold less active than SUT(s) localized to epidermal transfer cells (Tegeder et al., 1999). These type of genes are Important for seed filling.

At5g66210 Showing Homology to Calcium Dependent Protein Kinase

In plants, numerous Ca(2+)-stimulated protein kinase activities occur through calcium-dependent protein kinases (CDPKs). These novel calcium sensors are likely to be crucial mediators of responses to diverse endogenous and environmental cues. However, the precise biological function(s) of most CDPKs remains elusive. The *Arabidopsis* genome is predicted to encode 34 different CDPKs. The *Arabidopsis* CDPK gene family was analyzed and the expression, regulation, and possible functions of plant CDPKs was reviewed. By combining emerging cellular and genomic technologies with genetic and biochemical approaches, the characterization of *Arabidopsis* CDPKs provides a valuable opportunity to understand the plant calcium-signaling network (Cheng et al., 2002). These type of genes are Important for stress signaling.

At2g25970 Showing Homology to KH RNA Binding Domain

Lorkovic and Barta (2002) described RNA recognition motif (RRM) and K homology (KH) domain RNA-binding proteins from the flowering plant *Arabidopsis thaliana*. The most widely spread motifs are the RNA recognition motif (RRM) and the K homology (KH) domain. The *Arabidopsis* genome encodes 196 RRM-containing proteins, a more complex set than found in *Caenorhabditis elegans* and *Drosophila melanogaster*. In addition, the *Arabidopsis* genome contains 26 KH domain proteins. Most of the *Arabidopsis* RRM-containing proteins can be classified into structural and/or functional groups, based on similarity with either known metazoan or *Arabidopsis* proteins. Approximately 50% of *Arabidopsis* RRM-containing proteins do not have obvious homologues in metazoa, and for most of those that are predicted to be orthologues of metazoan proteins, no experimental data exist to confirm this. Additionally, the function of most *Arabidopsis* RRM proteins and of all KH proteins is unknown. The higher complexity of RNA-binding proteins in *Arabidopsis*, as evident in groups of SR splicing factors and poly(A)-binding proteins, may account for the observed differences in mRNA maturation between plants and metazoa. The function of this type of genes is largely unknown, but could be related to PUMILIO genes from *Drosophila*. Important for regulation of gene expression at the post-transcriptional level, role in development, stress tolerance.

At3g07800 Showing Homology to Thymidine Kinase

This type of thymidine kinase genes is cell cycle regulated, E2F regulated, is responsible for production of thymidine triphosphate. This type of gene plays a role as a precursor for DNA synthesis and is therefore a marker of S phase.

At5g47370 Showing Homology to Homeobox Leucine Zipper Protein.

This type of homeobox genes is important for development and growth and also for stress tolerance. At5g47370 is homeobox-leucine zipper protein HAT2 (HD-ZIP protein 2). Homeobox genes are known as transcriptional regulators that are involved in various aspects of developmental processes in many organisms. Homeodomain transcription factors regulate fundamental body plan of plants during embryogenesis, as well as morphogenetic events in the shoot apical meristem (SAM) after embryogenesis. HOX1 belongs to the subset of homeodomain leucine zipper (HD-zip) and is involved in the regulation of vascular development (Scarpella et al., 2000; Meijer et al., 2000). The sequences for the rice OsHOX1 orthologue are deposited in Genbank under the accession number X96681 (cDNA) and CAA65456.2 (protein), which sequences are both herein incorporated by reference.

BAA23337.1 OsMYB1

MYB-like DNA binding proteins are involved in the control of specific developmental steps in different organs. OSMYB1 binds to a seed specific element in the seed storage protein glutelin, is expressed in endosperm of rice seeds, and plays an important role during seed maturation (Suzuki et al., 1997).

BAA89798 OsNAC4

NAC domain containing genes, such as NO APICAL MERISTEM in petunia and CUP-SHAPED COTYLEDON2 and NAP in *Arabidopsis*, have crucial functions in plant development (Kikuchi et al., 2000). These genes are involved in the control of organ primordium delimitation and lateral organ development. It has also been recently shown that a member of the NAC family of transcription factor can induces formation of ectopic shoots on cotyledons (Daimon et al., 2003).

AAD37699 Rice Homeodomain Leucine Zipper Protein HOX6 (Partial)

Homeobox genes are known as transcriptional regulators that are involved in various aspects of developmental processes in many organisms. Homeodomain transcription factors regulate fundamental body plan of plants during embryogenesis, as well as morphogenetic events in the shoot apical meristem (SAM) after embryogenesis. HOX6 is a homologue of the *Arabidopsis* homeobox gene Athb-12 (Lee et al., 2001). Athb-12 is a transcriptional activator important in regulating certain developmental processes as well as in the plant's response to water stress involving ABA-mediated gene expression. At3g61890 is the *Arabidopsis* sequence corresponding with the rice HOX6 sequence of AAD37699.

AK104073 OsMYB Predicted

This gene is homologous to the *Arabidopsis* gene CIRCADIAN CLOCK ASSOCIATED (CCA1) gene that encodes a related MYB transcription factor, which regulates circadian rhythms (Carre et Kim, 2002). This gene as well as the MYB homologue, regulate the period of circadian rhythms in gene expression and leaf movements.

Example 9

NMR Study of E2Fa/DPa Overexpressing Plants

In support of the microarray studies identifying the increased or decreased expression level of E2F-target genes in E2Fa-DPa overexpressing plants, the effects of E2Fa/DPa overexpression on the protein level and ultimately on the level of metabolites were studied via the techniques of metabolomics. Metabolomics means qualitative and quantitative analysis of the metabolites present at a certain time in a cell culture or a whole biological tissue. Metabolites, as designated here, are small molecular weight molecules (typically under 1000 Daltons), of which many are already known (such as urea, lipids, glucose or certain small hormones) while others are still to be identified. Metabolites are the final product of the protein content of the cell. The main methods used to detect and quantify of those molecules are mass spectrometry or NMR spectroscopy (Nicholson et al., 2002) after extraction and purification of the metabolites from the organism.

Now NMR spectroscopy on whole organisms has been performed. The recording of spectra of the metabolites was possible without any prior purification of the plant material. Hereto, the samples were spun at the magic angle. This technique, dubbed "High Resolution Magic Angle Spinning" (HRMAS) NMR, has now been used on intact plantlets. 1H-13C HSQC spectra were recorded on intact wild-type and E2Fa/DPa overexpressing plantlets of *Arabidopsis thaliana*, and monitored the changes in metabolite pattern. From the spectra, a shift in the metabolome of E2Fa/DPa overexpressing plants when compared to wild-type plants, was observed. These spectra are processed in order to map the observed metabolic differences.

Example 10

Molecular and Phenotypic Analysis of *Arabidopisis* Plants Transformed with the Genes According to the Present Invention

*Arabidopsis thaliana* plants are transformed with at least one of the genes of the present invention as presented in Table 4 or 5, operably linked to a plant promoter.

In one example, *Arabidopsis* plants were transformed with the genes as presented in Table 6. The vectors used ware derived from the expression vector pK7WGD2, carrying the CaMV35S promoter for expression of the gene. For transformation, the flower dip method described by Bechtold and Pelletier (1998) was used.

TABLE 6

Genes that were selected and transformed into *Arabidopsis*

| CODE | AGI | GENE | PRIMERS PCR | pDONR207 | PK7WGD2 | Flower dip |
|---|---|---|---|---|---|---|
| 1 | At1g33960 | AIG1 | 282 + 283 | | | |
| 2 | At1g21690 | Putative replication factor | 284 + 285 OK | OK | | |
| 3 | At3g23250 | Myb transcription factor | 286 + 287 | | | |
| 4 | At5g08450 | Unknown | 288 + 289 OK | OK | OK(clone1) | OK |
| 5 | At3g45730 | Unknown | 290 + 291 OK | OK | OK(clone4) | OK |
| 6 | At1g56150 | Unknown | 292 + 293 | | | |
| 7 | At5g66580 | Unknown | 294 + 295 OK | OK | OK | OK |
| 8 | At4g33050 | Unknown | 296 + 297 OK | OK | OK | OK |
| 9 | At1g76970 | Unknown | 298 + 299 OK | partieel | OK(clone4) | |
| 10 | At2g41780 | Unknown | 300 + 301 OK | OK | OK(clone1) | OK |
| 11 | At5g14530 | WD40 repeat protein | 302 + 303 OK | OK | OK | OK |
| A | At3g02550 | Unknown | 310 + 311 OK | OK | OK(A10.7) | OK |

TABLE 6-continued

Genes that were selected and transformed into *Arabidopsis*

| CODE | AGI | GENE | PRIMERS | PCR | pDONR207 | PK7WGD2 | Flower dip |
|---|---|---|---|---|---|---|---|
| B | At5g47370 | homeobox-leucine zipper protein-like | 312 + 313 | OK | OK | OK(clone4) | OK |
| C | At1g57680 | Unknown | 314 + 315 | | | | OK |
| D | At1g07000 | leucine zipper-containing protein | 316 + 317 | OK | OK | | OK |
| E | At2g22430 | homeodomain TF Athb-6 | 318 + 319 | OK | OK | OK(clone1) | OK |
| F | At4g28330 | Unknown | 320 + 321 | OK | OK | OK(clone4) | OK |
| G | At3g23750 | receptor kinase | 322 + 323 | OK | OK | | |
| H | At5g66210 | Ca-dep kinase | 324 + 325 | OK | OK | OK(clone2) | OK |
| I | At4g02680 | Unknown | 326 + 327 | | | OK(clone4) | OK |
| J | At2g30590 | worky74 | 328 + 329 | OK | OK | OK(clone2) | OK |
| K | At2g46650 | Unknown | 330 + 331 | | | | |
| L | At2g47440 | Unknown | 332 + 333 | OK | OK | OK(clone5) | OK |
| M | At2g15510 | Unknown | 334 + 335 | | | | |
| 12 | At5g56740 | Histone acetylase HAT B | 348 + 349 | OK | OK | OK | OK |
| 13 | At3g24320 | Putative mismatch binding protein | 350 + 351 | OK | OK | OK(13, 4) | OK |
| 14 | At4g00730 | Anthocyaninless2 | 352 + 353 | | | | |
| 15 | At1g23030 | arm-repeat containing protein | 354 + 355 | OK | OK | OK(clone11) | OK |
| 16 | At5g54380 | receptor-protein kinase-like protein | 356 + 357 | | | | |
| 17 | At1g72180 | putative leucine-rich receptor-like protein kinase | 358 + 359 | OK | OK | OK | OK |
| 18 | At1g61100 | Unknown | 360 + 361 | OK | OK | OK(18, 1) | OK |
| 19 | At2g25970 | Unknown | 362 + 363 | OK | OK | OK | OK |
| 20 | At2g38310 | Unknown | 364 + 365 | OK | OK | OK | OK |
| 21 | At3g45970 | Unknown | 366 + 367 | OK | OK | OK(21, 3) | OK |

Code: internal reference code of the gene;
AGI: accession number of the protein in the internal dataset, here with reference to the MIPS database accession number;
Gene: name of the protein;
primers: PCR primers used to isolate the ORF of the gene by RT-PCR using cDNA;
prepared form E2Fa-DPa overexpressing plants;
PCR: PCR completed successfully;
pDONR207: cloning in this vector completed (www.invitrogen.com);
pK7WGD2: cloning of the genes in the vector under control of the CaMV 35S promoter (Karimi et al., Trends Plant Sci. 2002 May; 7(5): 193-5);
Flower dip: transformation of *Arabidopsis* plants with the pK7WGD2 vector.

The transformed *Arabidopsis* plants are evaluated as described below.

After molecular analysis (PCR, RT-PCR, Western-blot, southern-blot, Northern blot, NMR), the plants with modified E2F target gene expression levels, are submitted to phenotypic analysis. Special attention is given to root growth and leaf development.

The root of *A. thaliana*, which has a rather constant diameter and rather uncomplicated radial symmetry, is a perfect model system for studying and determining the effects of modulation of expression levels of an E2F-target on an intact, growing tissue.

The root of *A. thaliana* comprises a thick unicellular layer of the epidermis cells, one of cortex cells, one of endodermis cells and one of pericyclus cells that circumvent the vascular tube. Because of its transparency, the root of *A. thaliana*, these cellular layers can be visualized by interference contrast microscopy. By this means the origin of the cells in a specific cell layer can be traced back to a set of dividing mother cells in the meristem (Dolan et al., 1993). By measurement of the cell length of a specific cell layer in function of the distance to the root tip, and the rate of movement of the cells away from the root tip (measured via time-laps photography), it is possible to determine the contribution of both the cell elongation as well as of cell division to the total root growth (Beemster and Baskin, 1998).

The effects of the E2F-target overexpression in the leaves is determined via microscopic techniques after clearance of the leaves of lactic acid. This analysis is performed on the first developed leaf pear, since this leaf pear is most comparable between different plants. By measurement of the cell number and the number of epidermal cells at different time points during leaf development, it is deduced when the leaf cells stop to divide, when they start to differentiate, the duration of their cell cycle is, and their final cell size (De Veylder et al., 2001 a and b). Moreover, this method allows the analysis of the effect of E2F target overexpression on the formation of stomata.

The effect of the E2F-target overexpression is also studied via biochemical means. Functional assays are developed for the specific enzymatic activity of the studied E2F-target gene. These functional methods are based on expression of a reported gene in case the E2F-target is in itself a transcription activator or repressor. Functional assays are based on the incorporation of radioactive nitrogen or radioactive carbon or other radiolabelled metabolites when the enzyme is involved in the nitrogen or carbon metabolisms or other processes involving metabolites. By the comparison of the incorporated radioactivity between the control line and the transgenic line, the enzymatic activity of the E2F-target can be measured.

Functional assays are based on the incorporation of radioactive ATP, radioactive purines or pyrimidines when the enzyme is involved in DNA replication and/or modification. Functional assays are based on labeled carbohydrates when the enzyme is involved in cell wall biogenesis, or ATP when the enzyme is involved in processes of the chloroplast, or calcium when the enzyme is involved in signal transduction.

In *A. thaliana*, besides the mitotic cell cycle also an alternative cell cycle is observed, in which DNA is replicated in the absence of mitosis or cytokinesis. This so-called endoreduplication process occurs often in plants. Until today, the physiological significance of endoreduplication is unknown. Possibly, it is a mechanism to increase the number of DNA copies per cell, which allows more transcription. In support of this hypothesis, endoreduplication often occurs in cells with high metabolic activity (Nagl, 1976). However, as a consequence of endoreduplication the cells are bigger, which is especially useful for increasing yield of cytoplasmatic component, for example storage proteins of the seed cells.

To study the effects of E2F-target overexpression on the process of endoreduplication, the DNA content of the control plants and the transgenic plant is measured via flow-cytometry. A more detailed analysis is obtained by measuring the DNA content of individual cells colored with DNA-binding fluorochrome (e.g. DAPI). The intensity of the color of the nucleus is in proportion with Its DNA content. Relative DNA-measurements can be obtained via a microdensitometer. This technique allows determining a specific tissue the endoreduplication pattern of the transgenic plants.

Example 11

Use of the Invention in Corn

The invention described herein can also be used in maize. To this aim, a gene according to the present invention as presented in Table 4 or 5, for example a gene selected from Tables 1 or 2, or a gene selected from the group described in Example 8, or a gene selected from the group presented in Table 6 or 7, or a homologue thereof such as for example a maize ortholog or a rice ortholog, is cloned under control of a promoter operable in maize, in a plant transformation vector suited for *Agrobacterium*-mediated transformation of corn. These constructs are designed for overexpression or for downregulation. In a series of experiments, genes selected from Table 5 (downregulated in E2Fa/DP transgenics) are overexpressed in transgenic corn and genes selected from Table 4 (upregulated in E2Fa-DPa overexpressing plants) are downregulated in transgenic corn. Suitable promoter for driving expression of the genes of the present invention are as presented in Tables I, II, III and IV or in Table V.

Suitable promoter for driving expression of the genes of the present invention in corn are the rice GOS2 promoter or any other promoter as mentioned herein above. Vectors useful for expression of one or more E2F targets according to the present invention are standard binary vectors, such as the pPZP vector described in Hajdukiewicz et al. ((1994) Plant Mol Biol 25: 989-994) or a superbinary vector. Vectors and methods to use *Agrobactorium*-mediated transformation of maize have been described in literature (Ishida et al., Nat Biotechnol. 1996 June; 14(6):745-50; Frame et al., Plant Physiol. 2002 May; 129(1):13-22) and are herein incorporated by reference. Transgenic plants made by these methods are grown in the greenhouse for T1 seed production. Inheritability and copy number of the transgene are checked by quantitative real-time PCR and Southern blot analysis and expression levels of the transgene are determined by reverse PCR and Northern analysis. Transgenic lines with single copy insertions of the transgene and with varying levels of transgene expression are selected for T2 seed production. Progeny seeds are germinated and grown in the greenhouse in conditions well adapted for maize (16:8 photoperiod, 26-28° C. daytime temperature and 22-24° C. nighttime temperature) as well under water-deficient, nitrogen-deficient, and excess NaCl conditions. Null segregants from the same parental line, as well as wild type plants of the same cultivar are used as controls. The progeny plants resulting from the selfing or the crosses are evaluated on different growth parameters, such as biomass and developmental parameters. These parameters include stem size, number of leaves, total above ground area, leaf greenness, time to maturity, flowering time, time to flower, ear number, harvesting time. The seeds of these lines are also checked on various parameters, such as grain size, total grain yield (number and/or weight) per plant, and grain quality (starch content, protein content and oil content). Lines that are most significantly improved versus the controls for any of the above-mentioned parameters are selected for further field-testing and marker-assisted breeding, with the objective of transferring the field-validated transgenic traits into commercial germplasm. Methods for testing maize for growth and yield-related parameters in the field are well established in the art, as are techniques for introgressing specific loci (such as transgene containing loci) from one germplasm into another. Corn plants according to the present invention have changed growth characteristics compared to the wild-type plants, such as for example any one or more of increased biomass, increased yield, increased number and/or size of organs (including seeds), increased harvest index, increased rate of growth and/or development (e.g. decreased cycling time, decreased time to harvest, early flowering), increased tolerance to environmental stress conditions (e.g. tolerance to salt, drought and/or cold).

Example 12

Rice Transformation with the Genes According to the Present Invention

In a particular example of the present invention, the genes as identified above in Tables 4 and 5, or an orthologue from another plant, for example the rice orthologue, is transformed into rice. In particular, the genes as presented in Tables 6 and 7, or the rice orthologues are cloned into a plant expression vector operably linked to a promoter for overexpression or downregulation of these genes.

The genes as represented in Table 7 are cloned into a plant expression vector operably linked to a GOS2 promoter for overexpression or downregulation. For overexpression these genes are cloned in the sense orientation and for downregulation a hairpin construct as described in Wesley et al. (2001) is made. Other promoters that are used to drive expression of these genes are other constitutive promoters, such as for example the ubiquitin promoter or PRO170 (high mobility group protein), or PRO61 (beta expansin promoter). Also tissue specific promoters are used to drive expression of the genes of the present invention in rice, such as for example promoters specific for meristem (PRO120: metallothionein), or vegetative tissue (PRO123: protochlorophyllid reductase), PRO173: cytoplasmic malate deshydrogenase); or endosperm (PRO90: prolamin, PRO135: alpha globulin), or embryo PRO218: oleosin, PRO151: WSI18, PRO200: OSH1, PRO175: RAB21; or the whole seed (PRO58: proteinase inhibitor), or any other promoter described herein above. The vectors used are plant transformation vector suited for *Agrobacterium*-mediated transformation of rice, such as for example binary vectors of the pCAMBIA type or super binary vectors. Such vectors and methods for rice transformation have been described in literature by Aldemita and Hodges (1996) Chan et al. (1993), Hiei et al. (1994) or in EP1198985 and which teachings herein incorporated by reference.

TABLE 7 genes (presented by their encoded proteins)
selected for rice transformation

>CDS3435 NP_176081.1 At1g57680 (Arabidopsis)    SEQ ID NO 1
MPLTKLVPDAFGVVTICLVALLVLLGLLCIAYSFYFQSHVRKQGYIQLGY    and 2
FSGPWIIRITFILFAIWWAVGEIFRLSLLRRHRRLLSGLDLRWQENVCKW
YIVSNLGFAEPCLFLTLMFLLRAPLKMESGALSGKWNRDTAGYIILYCLP
MLALQLAVVLSESRLNGGSGSYVKLPHDFTRTYSRVIIDHDEVALCTYP
LLSTILLGVFAAVLTAYLFWLGRQILKLVINKRLQKRVYTLIFSVSSFLPLR
IVMLCLSVLTAADKIIFEALSFLAFLSLFCFCVVSICLLVYFPVSDSMALRG
LRDTDDEDTAVTEERSGALLLAPNSSQTDEGLSLRGRRDSGSSTQERY
VELSLFLEAEN >CDS3436 BAC42858.1 At3g45730 (Arabidopsis)    SEQ ID NO 3
MELPSPYSSRKEESTVPPKRGRVKIMIFRDLVRSETSMAPTPRRGRIKK    and 4
MIAGDLVGSGKQNNYDGDGKRGG >CDS3449 BAA23337.1 OS MYB1 (Rice)    SEQ ID NO 5
MGRSPCCEKAHTNKGAWTKEEDQRLIAYIRAHGEGCWRSLPKAAGLL    and 6
RCGKSCRLRWMNYLRPDLKRGNFTDDEDELIIRLHSLLGNKWSLIAGQL
PGRTDNEIKNYWNTHIKRKLLARGIDPQTHRPLLSGGDGIAASNKRHHR
RRIPYPSRRRRRPRRSSPCEAAAAAAPGRLLGRRLPQQQRHNEHGGA
AVPRPQPRALGRADAELAAGGDAHQRAAGLPLLPPRLPRRGGVQLSG >CD53448 BAA89798.1 OsNAC4 (rice)    SEQ ID NO 7
MAAAVGGSGRRDAEAELNLPPGFRFHPTDEELWHYLCRKVARQPLP    and 8
VPIIAEVDLYKLDPWDLPEKALFGRKEWYFFTPRDRKYPNGSRPNRAA
GRGYWKATGADKPVAPKGSARTVGIKKALVFYSGKAPRGVKTDWIMH
EYRLADADRAPGGKKGSQKLDEWVLCRLYNKKNNWEKVKLEQQDVA
SVAAAAPRNHHHQNGEVMDAAAADTMSDSFQTHDSDIDNASAGLRHG
GCGGGGFGDVAPPRNGFVTVKEDNDWFTGLNFDELQPPYMMNLQHM
QMQMVNPAAPGHDGGYLQSISSPQMKMWQTILPPF >CDS3447 AAD37699.1 OS Homeodomain leucine    SEQ ID NO 9
zipper protein HOX6 (rice)    and 10
MDGEEDSEWMMMDVGGKGGKGGGGGGAADRKKRFSEEQIKSLESM
FATQTKLEPRQKLQLARELGLQPRQVAIWFQNKRARWKSKQLEREYSA
LRDDYDALLCSYESLKKEKLALIKQLEKLAEMLQEPRGKYGDNAGDDA
RSGGVAGMKKEEFVGAGGAATLYSSAEGGGTSSTEQTCSSTPWWEF
ESE >CDS3446 AK104073 OSMYB predicted (rice)    SEQ ID NO 11
MASIVTATVAAASAWWATQGLLPLFPPPIAFPFVPAPSAPFSTADVQRA    and 12
QEKDIDCPMDNAQKELQETRKQDNFEAMKVIVSSETDESGKGEVSLHT
ELKISPADKADTKPAAGAETSDVFGNKKKQDRSSCGSNTPSSSDIEAD
NAPENQEKANDKAKQASCNSSAGDNNHRRFRSSASTSDSWKEVSE
EGRLAFDALFSRERLPQSFSPPQVEGSKEISKEEEDEVTTVTVDLNKNA
AIIDQELDTADEPRASFPNELSNLKLKSRRTGFKPYKRCSVEAKENRVP
ASDEVGTKRIRLESEAST >CDS3445 NP_565887.1 At2g38310 (Arabidopsis)    SEQ ID NO 13
MLAVHRPSSAVSDGDSVQIPMMIASFQKRFPSLSRDSTAARFHTHEVG    and 14
PNQCCSAVIQEISAPISTVWSVVRRFDNPQAYKHFLKSCSVIGGDGDNV
GSLRQVHVVSGLPAASSTERLDILDDERHVISFSWGGDHRLSNYRSVT
TLHPSPISGTVVVESYVVDVPPGNTKEETCDFVDVIVRCNLQSLAKIAEN
TAAESKKKMSL >CDS3444 NP_565703.1 At2g30590WRKY    SEQ ID NO 15
family transcription factor (Arabidopsis)    and 16
MEEIEGTNRAAVESCHRVLNLLHRSQQQDHVGFEKNLVSETREAVIRF
KRVGSLLSSSVGHARFRRAKKLQSHVSQSLLLDPCQQRTTEVPSSSSQ
KTPVLRSGFQELSLRQPSDSLTLGTRSFSLNSNAKAPLLQLNQQTMPP
SNYPTLFPVQQQQQQQQQQQQEQQQQQQQQQQFHERLQAHHL
HQQQQLQKHQAELMLRKCNGGISLSFDNSSCTPTMSSTRSFVSSLSID
GSVANIEGKNSFHFGVPSSTDQNSLHSKRKCPLKGDEHGSLKCGSSSR
CHCAKKRKHRVRRSIRVPAISNKVADIPPDDYSWRKYGQKPIKGSPYPR
GYYKCSSMRGCPARKHVERCLEDPAMLIVTYEAEHNHPKLPSQAITT >CDS3443 NP_849867.1 At1g69510 (Arabidopsis)    SEQ ID NO 17
MEDVKGKEIIDDAPIDNKVSDEMESEENAIKKKYGGLLPKKIPLISKDHE    and 18
RAFFDSADWALGKQKGQKPKGPLEALRPKLQPTPQQQPRARRMAYSS
GETEDTEIDNNEAPDDQACASAVDSTNLKDDGGAKDNIKS >CDS3442 NP_564615.3 At1g52870 (Arabidopsis)    SEQ ID NO 19
MAAASLHTSISPRSFLPLSKPSLKPHRSQILLRRNKQRNCVSCALIRDEID    and 20
LIPVQSRDRTDHEEGSVVVMSTETAVDGNESVVVGFSAATSEGQLSLE
GFPSSSSGADLGDEKRRENEEMEKMIDRTINATIVLAAGSYAITKLLTI
DHDYWHGWTLFEILRYAPQHNWIAYEEALKQNPVLAKMVISGVVYSVG
DWIAQCYEGKPLFEIDRARTLRSGLVGFTLHGSLSHFYYQFCEELFPFQ TABLE 7-continued genes (presented by their encoded proteins)
selected for rice transformation

```
DWWVVPVKVAFDQTVWSAIWNSIYFTVLGFLRFESPISIFKELKATFLPM
LTAGWKLWPFAHLITYGLVPVEQRLLWVDCVELIWVTILSTYSNEKSEA
RISESVIETSSSSTTTIDPSKE

>CDS3441 NP_849293.1 At4g02920 (Arabidopsis)         SEQ ID NO 21
MIKLCFMTSHGYSIPGLGLPQDLCNTEIIKQNSRSHLVNPGARQEIIPAS   and 22
SFNLNTELLEPWKPVSSFSQFVEIDSAMMKPLLMDVHETAPESLILSFGI
ADKFARQEKVMEFLLSQSEEFKEKGFDMSLLNELMEFESMKSSSQLRP
YDTSSVLYLNQELGKPVLDLVRDMMENPEFSVRSNGHVLFSSSSNPEL
NDLLSIASEFNLSRNSTTKWRQLSPLIPHFQRFESDVFTPAKLKAVTVLA
PLKSPEKSRLKSPRKHNTKRKAKERDLYKRNHLHAYESLLSLMIGNDH
RHKHTTVLSLQKSCGELSELLTQFSITAAGTGIAVLFSVVCSLASRRVPF
CANKFFDTGLGLSLVILSWAVNRLREVIVHVNRKANKPCSSLKDDEIINS
VERSMKEVYYRAATVIAVFALRFAC >CDS3440 AAM91100.1 At1g45200 (Arabidopsis)          SEQ ID NO 23
MSKTNMKFCNSYFLVDPTKASFLDLLLLLFSSNLTSARFIDSPPDTLKGF   and 24
RRSFASRWILALAIFLQKVLMLLSKPFAFIGQKLTYWLNLLTANGGFFNLI
LNLMSGKLVKPDKSSATYTSFIGCSDRRIELDEKINVGSIEYKSMLSIMA
SKISYESKPYITSVVKNTWKMDLVGNYDFYNAFQESKLTQAFVFKTSST
NPDLIVVSFRGTEPFEAADWCTDLDLSWYEMKNVGKVHAGFSRALGL
QKDGWPKENISLLHQYAYYTIRQMLRDKLGRNKNLKYILTGHSLGGALA
ALEPAILAIHGEDELLDKLEGIYTFGQPRVGDEDFGEFMKGVVKKHGIEY
ERFVYNNDVVPRVPFDDKYLFSYKHYGPCNSFNSLYKGKVREDAPNA
NYFNLLWLIPQLLTGLWEFIRSFILQFWKGDEYKENWLMRFVRWGIVF
PGGSNHFPFDYVNSTRLGGLVRPPPTTTPEDKLALIA
```

Transgenic plants generated by these rice transformation methods are evaluated for various growth characteristics. More particularly, the transgenic plants are evaluated and the following parameters are monitored: increased total above ground biomass, increased plant height, increased number of tillers, increased number of first panicles, increased number of second panicles, increased total number of seeds, increased number of filled seeds, increased total seed yield (weight) per plant, increased harvest index, increased thousand kernel weight, increased Tmid, increased T45 or A90, increased A42, changed cycling time or an changed growth curve, changed flowering time.

Plants with increase biomass, increased organ number and/or size (including seeds) and or any other economically attractive growth characteristics as found by the following plant evaluation protocol, are selected to transferring the transgenic traits into commercial germplasm.

Evaluation Protocol for T0, T1 and T2 Transgenic Rice Plants Transformed with an E2F Target Gene According to the Present Invention Approximately 15 to 20 independent T0 rice transformants are generated. The primary transformants are transferred from tissue culture chambers to a greenhouse for growing and harvest of T1 seed. Approximately 6 events, of which the T1 progeny segregated 3:1 for presence/absence of the transgene, are retained. For each of these events, approximately 10 T1 seedlings containing the transgene (hetero- and homozygotes), and approximately 10 T1 seedlings lacking the transgene (nullizygotes), are selected by monitoring screenable marker expression.

2 events with improved agronomical parameters in T1 are chosen for re-evaluation in T2 generation. Seed batches from the positive plants (both hetero- and homozygotes) in T1, are screened by monitoring marker expression. For each chosen event, the heterozygote seed batches are then selected for T2 evaluation. An equal number of positives and negatives within each seed batch are transplanted for evaluation in the greenhouse. The total number of 120 transformed plants is evaluated in the T2 generation. More particularly, two transformed events are selected, 60 plants per event of which 30 positives for the transgene, and 30 negative.

T1 and T2 plants are transferred to the greenhouse and evaluated for vegetative growth parameters and seed parameters, as described hereunder.

Statistical Analysis: t-test and F-test

A two factor ANOVA (analysis of variants) is used as statistical model for the overall evaluation of plant phenotypic characteristics. An F-test is carried out on all the parameters measured, for all of the plants of all of the events transformed with the gene of interest. The F-test is carried out to check for an effect of the gene over all the transformation events and to determine the overall effect of the gene or "global gene effect". Significant data, as determined by the value of the F-test, indicates a "gene" effect, meaning that the phenotype observed is caused by more than the presence or position of the gene. In the case of the F-test, the threshold for significance for a global gene effect is set at a 5% probability level.

To check for an effect of the gene within an event, i.e., for a line-specific effect, a t-test is performed within each event using data sets from the transgenic plants and the corresponding null plants. "Null plants" or "Null segregants" are the plants treated in the same way as the transgenic plant, but from which the transgene has segregated. Null plants can also be described as the homozygous negative transformants. The threshold for significance for the t-test is set at 10% probability level. Within one population of transformation events, some events can be under or above this t-test threshold. This is based on the hypothesis that a gene might only have an effect in certain positions in the genome, and that the occurrence of this position-dependent effect is not uncommon. This kind of gene effect may also be referred to as a "line effect of a gene". The p-value is obtained by comparing the t-value to the t-distribution or alternatively, by comparing the F-value to the F-distribution. The p-value stands for the probability that the null hypothesis (null hypothesis being "there is no effect of the transgene") is correct.

Vegetative Growth Measurements:

The selected transgenic plants are grown in a greenhouse. Each plant receives a unique barcode label to link unambiguously the phenotyping data to the corresponding plant. The selected transgenic plants are grown on soil in 10 cm diameter pots under the following environmental settings: photoperiod=11.5 h, daylight intensity=30,000 lux or more, daytime temperature=28° C. or higher, night time temperature=22° C., relative humidity=60-70%. Transgenic plants and the corresponding nullizygotes were grown side-by-side at random positions. From the stage of sowing until the stage of maturity each plant is passed several times through a digital imaging cabinet and imaged. At each time point digital images (2048× 1536 pixels, 16 million colours) are taken of each plant from at least 6 different angles. The parameters described below are derived in an automated way from all the digital images of all the plants, using image analysis software.

(a) Above ground plant area is determined by counting the total number of pixels from aboveground plant parts discriminated from the background. This value is averaged for the pictures taken on the same time point from the different angles and converted to a physical surface value expressed in square mm by calibration. Experiments show that the aboveground plant area measured this way correlates with the biomass of plant parts above ground.

(b) Plant height is determined by the distance between the horizontal lines going through the upper pot edge and the uppermost pixel corresponding to a plant part above ground. This value is averaged for the pictures taken on the same time point from the different angles and was converted, by calibration, to a physical distance expressed in mm. Experiments showed that plant height measured this way correlate with plant height measured manually with a ruler.

(C) Number of primary tillers is manually counted at the harvesting of the plants. The tillers are cut off at 3 cm above the pot rim. They were then counted at the cut surface. Tillers that were together in the same sheet were counted as one tiller.

(d) Number of primary panicles. The tallest panicle and all the panicles that overlap with the tallest panicles when aligned vertically are counted manually, and considered as primary panicles.

(e) Number of secondary panicles. The number of panicles that remained on the plant after the harvest of the primary panicles are counted and considered as secondary panicles.

(f) Growth curve. The plant area weekly measurements are modeled to obtain a growth curve for each plant, plotted as the value of plant area (in $mm^2$) over the time (in days). From this growth curve the following parameters are calculated.

(g) A42 is the plant area at day 42 after sowing as predicted by the growth curve model.

(h) Tmid is the time that a plant needs to grow and to reach 50% of the maximum plant area. Tmid is predicted from the growth curve model.

(i) T90 is the time that a plant needs to grow and to reach 90% of the maximum plant area. T90 is predicted from the growth curve model.

Seed-Related Parameter Measurements

The mature primary panicles of T1 and T2 plants are harvested, bagged, barcode-labelled and then dried for three days in the oven at 37° C. The panicles are then threshed and all the seeds were collected and counted. The filled husks are separated from the empty ones using an air-blowing device. The empty husks are discarded and the remaining fraction is counted again. The filled husks are weighed on an analytical balance. This procedure resulted in the set of seed-related parameters described below.

(a) Total seed number per plant is measured by counting the number of husks harvested from a plant.

(b) Number of filled seeds is determined by counting the number of filled husks that remained after the separation step.

(c) Total seed yield per plant is measured by weighing all filled husks harvested from a plant.

(d) Harvest index of plants is defined as the ratio between the total seed yield and the above ground area ($mm^2$), multiplied by a factor $10^6$.

(e) Thousand Kernel Weight (TKW) of plants is a parameter extrapolated from the number of filled seeds counted, and their total weight.

(f) Total Area Emergence Prop. is the time when plant reach 30% of their maximum total area (g) Total Area Cycle Time. is the time when plant reach 90% of their maximum total area Further molecular analysis is performed on the positive plants by techniques well known by the person skilled in the art such as for example RT-PCR.

Tables

TABLE 1

Arabidopsis Genes 2-fold or more upregulated in E2Fa/DPa plants

| Gene Identification | accession # | MIPS name | OLD REF cDNA | OLD REF PROT | SEQ ID NO cDNA | SEQ ID NO PROT | Fold induction | E2F site | Plant homologue |
|---|---|---|---|---|---|---|---|---|---|
| Unknown function (14) | | | | | | | | | |
| hypothetical protein | AI998042 | At1g57680 | 1 | 53 | 433 | 434 | 2.66 | | rice BAB90159.1, maize AY107220.1 |
| putative protein | AI994686 | At3g45730 | 2 | 54 | 231 | 232 | 5.14 | | |
| putative protein | AI994734 | At5g66580 | 4 | 56 | 489 | 490 | 3.18 | | |
| unknown protein | AI999397 | At2g38310 | 5 | 57 | 995 | 996 | 2.79 | TTTGCCCC | rice BAB68102.1 |
| unknown protein | AI995465 | At2g47440 | 7 | 59 | 931 | 932 | 2.50 | | |
| unknown protein | AI994871 | At1g76970 | 8 | 60 | 1193 | 1194 | 2.34 | | rice BAB78689.1, corn AAB00079.1 |
| hypothetical protein, kinesin | AI998366 | At1g27500 | 9 | 61 | 393 | 394 | 2.21 | | rice AAL87057.1 |
| putative protein | AI996967 | At4g33050 | 10 | 62 | 883 | 884 | 2.20 | | rice BAB90008.1 |
| putative protein | AI995917 | At3g43690 | 12 | 64 | 263 | 264 | 2.18 | | |
| unknown protein, kh domain protein | AI993084 | At2g25970 | 13 | 65 | 941 | 942 | 2.15 | | rice BAA92910.1, maize AY106526.1 |

TABLE 1-continued

Arabidopsis Genes 2-fold or more upregulated in E2Fa/DPa plants

| Gene Identification | accession # | MIPS name | OLD REF cDNA | OLD REF PROT | SEQ ID NO cDNA | SEQ ID NO PROT | Fold induction | E2F site | Plant homologue |
|---|---|---|---|---|---|---|---|---|---|
| unknown protein | AI993077 | At1g68580 | 14 | 66 | 937 | 938 | 2.13 | | rice BAC00723.1, corn AAK11516.1 |
| putative protein, copine | AI993019 | At5g14420 | 15 | 67 | 205 | 206 | 2.05 | | rice BAB92575.1 |
| hypothetical protein | AI997428 | At1g57990 | 16 | 68 | 415 | 416 | 2.02 | | rice BAB90042.1 |
| unknown protein | AI997827 | At5g53740 | 17 | 69 | 2731 | 2732 | 2.01 | | |
| DNA replication and modification (14) | | | | | | | | | |
| putative thymidine kinase | AI997851 | At3g07800 | | | | | 8.44 | | rice AAC31168.1 |
| DNA methyltransferase | AI994691 | At5g49160 | | | | | 5.37 | ATTGCCGC | rice AAL77415.1, corn AAC16389.1 |
| Msi3 | AW004204 | At4g35050 | | | | | 4.89 | TTTCCCGC | corn AAL33648.1 |
| putative linker histone protein | AI994590 | At3g18035 | | | | | 3.31 | | |
| putative replication factor c | AI997934 | At1g21690 | | | | | 3.30 | TTTCCCGC | |
| topoisomerase 6 subunit A | AI995290 | At5g02820 | | | | | 2.62 | TTTCCCGC | |
| histone H4-like protein | AI999171 | At3g46320 | | | | | 2.55 | TTTGGCGC | |
| histone acetylase HAT B | AI998229 | At5g56740 | | | | | 2.36 | TTTCCCGC | corn AAM28228.1 |
| putative histon H1 | AI996137 | At1g06760 | | | | | 2.27 | | |
| histone H2A-like protein | AI995882 | At4g27230 | | | | | 2.23 | | |
| putative DNA gyrase subunit A | AI995400 | At3g10690 | | | | | 2.20 | | rice AAD29710.1 |
| histone H2B-like protein | AI999101 | At5g59910 | | | | | 2.16 | | |
| putative mismatch binding protein | AI993280 | At3g24320 | | | | | 2.10 | | rice CAD41187.1, corn AAF35250.1 |
| adenosylhomocysteinase | AI996953 | At4g13940 | | | | | 2.07 | | corn AAL33588.1 |
| Cell Cycle (2) | | | | | | | | | |
| E2Fa | AJ294534 | At2g36010 | | | | | 94.88 | | |
| CDKB1;1 | D10851 | At3g54180 | | | | | 2.60 | TTTCCCGC | |
| Cell wall biogenesis (11) | | | | | | | | | |
| xyloglucan endo-1;4-beta-D-glucanase (meri-5) | AI994459 | At4g30270 | | | | | 3.74 | | |
| putative glycosyl transferase | AI999244 | At1g70090 | | | | | 3.38 | | |
| alpha galactosyltransferase-like protein | AI998223 | At3g62720 | | | | | 3.26 | | |
| putative xyloglucan endotransglycosylase | AI999683 | At3g23730 | | | | | 2.85 | | rice CAD41426.1, corn CAB510059.1 |
| xyloglucan endo-1,4-beta-D-glucanase-like protein | AI998301 | At4g30280 | | | | | 2.74 | | |
| putative xyloglucan endotransglycosylase | AI994477 | At1g14720 | | | | | 2.51 | | |
| putative glycosyl transferase | AI999770 | At1g24170 | | | | | 2.39 | | |
| putative UDP-glucose glucosyltransferase | AI997288 | At1g22400 | | | | | 2.34 | TTTCCCGC | |
| putative glucosyltransferase | AI998872 | At2g15480 | | | | | 2.15 | | |
| peroxidase | AI994622 | At2g38380 | | | | | 2.11 | TTTCGCCC | |
| beta-1,3-glucanase-like protein | AI994681 | At3g55430 | | | | | 2.05 | | rice AAB37697.1, corn CAB96424.1 |
| Chloroplastic genes (7) | | | | | | | | | |
| large subunit of ribulose-1,5-bisphosphate carboxylase/oxygenase | N96785 | rbcL | | | 2713 | 2714 | 4.71 | | NP_051067 |
| ribosomal protein L33 | AI994194 | rpl33 | | | 2715 | 2716 | 3.54 | | NP_051080 |
| PSII I protein | AW004203 | psbI | | | 2717 | 2718 | 2.81 | | NP_051074 |
| ribosomal protein L2 | AW004266 | rpl2 | | | 2719 | 2720 | 2.61 | | NP_051099 |
| ATP-dependent protease subunit | AI997947 | clpP | | | 2721 | 2722 | 2.60 | | NP_051083 |

TABLE 1-continued

*Arabidopsis* Genes 2-fold or more upregulated in E2Fa/DPa plants

| Gene Identification | accession # | MIPS name | OLD REF cDNA | OLD REF PROT | SEQ ID NO cDNA | SEQ ID NO PROT | Fold induction | E2F site | Plant homologue |
|---|---|---|---|---|---|---|---|---|---|
| cytochrome B6 | AI997102 | petB | | | 2723 | 2724 | 2.55 | | NP_051088 |
| ATPase epsilon subunit | AW004251 | atpE | | | 2725 | 2726 | 2.17 | | NP_051065 |
| Mitochondrial genes (1) | | | | | | | | | |
| 26S ribosomal RNA protein | AW004275 | orf107a | | | 2727 | 2728 | 2.87 | | NP_085475 |
| Transcription factors (6) | | | | | | | | | |
| LOB domain protien 41 | AI996685 | At3g02550 | 3 | 55 | 1109 | 1110 | 4.01 | | riceBAB92193.1 |
| WRKY transcription factor 21 | AI992739 | At2g30590 | | | | | 2.78 | TTTCCCCC | |
| GATA Zn-finger protein | AI995731 | At3g16870 | 6 | 58 | 2729 | 2730 | 2.75 | | maize AY072149 |
| Anthocyaninless2 | AI993655 | At4g00730 | | | | | 2.73 | TTTCCCCC | |
| leucine zipper-containing protein | AI995691 | At1g07000 | | | | | 2.43 | | |
| homeodomain transcription factor (Athb-6) | AI999190 | At2g22430 | | | | | 2.30 | | rice CAA65456.2, corn CAB96424.1 |
| Metabolism and biogenesis (11) | | | | | | | | | |
| alcohol dehydrogenase | AI998773 | At1g77120 | | | | | 5.09 | | |
| putative isocistrate lyase | AI999168 | At3g21720 | | | | | 3.08 | | |
| protochlorophyllide reductase precursor | AI993342 | At4g27440 | | | | | 2.39 | | |
| suger transpoter like protein | AI997793 | At4g36670 | | | | | 2.27 | | rice AAK13147.1, corn AAF74568.1 |
| NADH-dependent glutamate synthase (GOGAT) | AI997600 | At5g53460 | | | | | 2.25 | | |
| nitrate reductase (NIA2) | AI996208 | At1g37130 | | | | | 2.15 | | |
| pectate lyase - like protein | AJ508995 | At3g54920 | | | | | 2.13 | | |
| putative sterol dehydrogenase | AI996340 | At2g43420 | | | | | 2.10 | | |
| glutamine synthetase root isozyme 1 (GS) | 161G19T7 | At1g66200 | | | | | 2.06 | | |
| monosaccharide transporter STP3 | AI997045 | At5g61520 | | | | | 2.05 | | rice BAA83554.1, corn AAF74568.1 |
| Signal transduction (6) | | | | | | | | | |
| calcium-dependent protein kinase | AI996555 | At5g66210 | | | | | 2.96 | | rice AAF23901.2, corn BAA12715.1 |
| WD-40 repeat protein | AI993055 | At5g14530 | | | | | 2.70 | | rice AD27557.1, corn AAA50446.1 |
| receptor-protien kinase-like protein | AI994727 | At5g54380 | | | | | 2.59 | | rice AAK63934.1, corn AAB09771.1 |
| putative phytochrome A | AI998146 | At1g09570 | | | | | 2.45 | | |
| putative leucine-rich receptor-like protein kinase | AI999651 | At1g72180 | | | | | 2.13 | | rice BAC06203.1, corn CAC35411.1 |
| putative receptor-like kinase | AI993298 | At3g23750 | | | | | 2.06 | | rice CAA69028.1, corn CAC35412.1 |
| Others (13) | | | | | | | | | |
| putative pollen allergen | AI996548 | At3g45970 | | | | | 3.22 | | rice AAG13596.1, corn CAD40849.1 |
| cold-regulated protein COR6,6 | AW004198 | At5g15970 | | | | | 3.03 | | |
| phi-1-like protein | AI994601 | At5g64260 | | | | | 2.60 | | |
| lipid-transfer protein-like | AI998609 | At5g01870 | | | | | 2.33 | | rice BAB86497.1, corn AAB06443.1 |
| DnaJ homologue | AI994551 | At5g06910 | | | | | 2.32 | ATTGGCGC | |
| blue copper binding protein | AI996535 | At5g20230 | | | | | 2.30 | | |
| src-2 like protein | AI998679 | At1g09070 | 11 | 63 | 401 | 402 | 2.19 | | |
| RING finger protein | AI999491 | At3g61460 | | | | | 2.14 | | rice BAA85438.1, corn AAL59234.1 |
| putative Ticc22 | AI993361 | At3g23710 | | | | | 2.14 | | |
| nodulin-like protein | AI996322 | At1g80530 | | | | | 2.07 | | rice AAM01022.1 |

TABLE 1-continued

Arabidopsis Genes 2-fold or more upregulated in E2Fa/DPa plants

| Gene Identification | accession # | MIPS name | OLD REF cDNA | OLD REF PROT | SEQ ID NO cDNA | SEQ ID NO PROT | Fold induction | E2F site | Plant homologue |
|---|---|---|---|---|---|---|---|---|---|
| putative resistance protein | AI997549 | At1g61100 | | | | | 2.06 | | rice AAL83695.1, |
| seed imbitition protein-like | AI993446 | At5g20250 | | | | | 2.05 | | |
| putative disease resistance protein | AI998978 | At1g72900 | | | | | 2.04 | | rice AAL01163.1, corn AAC83564.1 |

TABLE 2

Arabidopsis Genes 2-fold or more repressed in E2Fa/DPa plants

| Gene Identification | accession # | MIPS | OLD REF cDNA | OLD REF PROT | SEQ ID NO cDNA | SEQ ID NO PROT | Fold repression | E2F site | plant homologue |
|---|---|---|---|---|---|---|---|---|---|
| Unknown function (35) | | | | | | | | | |
| unknown protein | AI993767 | At1g45200* | 18 | 70 | 2741 | 2742 | 3.91 | | |
| putative protein | AI993468 | At3g56290 | 19 | 71 | 1483 | 1484 | 3.38 | | maize AY106321.1, rice BAB93184.1 |
| hypothetical protein, multidrug efflux protein | AI996374 | At1g61890 | 21 | 73 | 2599 | 2600 | 2.78 | | |
| unknown protein | AI994573 | At3g15950 | 22 | 74 | 2147 | 2148 | 2.71 | | |
| putative protein | AI994726 | At3g52360 | 23 | 75 | 1619 | 1620 | 2.65 | | |
| hypothetical protein | AI997393 | At4g02920 | 24 | 76 | 1521 | 1522 | 2.60 | TTTGCCCC | Y09602. Hordeum vulgare |
| unknown protein, put protease inhibitor | AJ508997 | At5g43580 | 25 | 77 | 2743 | 2744 | 2.58 | | |
| unknown protein | AI997866 | At1g70760 | 26 | 78 | 2077 | 2078 | 2.52 | | |
| unknown protein | AI997085 | At5g43750 | 27 | 79 | 1423 | 1424 | 2.51 | | rice BAB90754.1 |
| putative protein | AI995724 | At5g50100** | 28 | 80 | 1973 | 1974 | 2.48 | | rice AL606619.2 OSJN00032 genomic |
| unknown protein | AI995337 | At1g74880 | 29 | 81 | 2699 | 2700 | 2.42 | | maize AY105515.1, rice BAB89011.1 |
| unknown protein | AI998296 | At3g19370 | 30 | 82 | 1859 | 1860 | 2.40 | | |
| unknown protein, ATPase | AI993346 | At3g10420 | 31 | 83 | 2249 | 2250 | 2.40 | | |
| putative protein | AI999485 | At3g61080 | 32 | 84 | 1863 | 1864 | 2.38 | | |
| unknown protein | AI996923 | At1g67860 | 33 | 85 | 1847 | 1848 | 2.38 | | |
| unknown protein | AI994841 | At1g52870 | 34 | 86 | 2367 | 2638 | 2.35 | ATTCCCCC | maize AY108423.1 |
| unknown protein | AI999581 | At1g64370 | 35 | 87 | 2099 | 2100 | 2.35 | | |
| unknown protein | AI997584 | At1g05870 | 36 | 88 | 1955 | 1956 | 2.25 | | rice BAB86085.1, maize Y110580.1 |
| putative protein | AI992938 | At5g03540 | 37 | 89 | 2745 | 2746 | 2.21 | | |
| hypothetical protein | AI997712 | At2g15020 | 38 | 90 | 2605 | 2606 | 2.21 | | rice BAB64794.1 |
| unknown protein | AI998338 | At1g68440 | 39 | 91 | 2625 | 2626 | 2.20 | | |
| unknown protein | AI996872 | At2g21960 | 40 | 92 | 1715 | 1716 | 2.19 | | |
| putative protein, centrin | AI996295 | At4g27280 | 41 | 93 | 2039 | 2040 | 2.18 | | |
| putative protein | AI995642 | At3g48200 | 42 | 94 | 2653 | 2654 | 2.16 | | |
| unknown protein | AI997470 | At2g32870 | 43 | 95 | 1941 | 1942 | 2.14 | | |
| hypothetical protein | AI998460 | At1g69510 | 44 | 96 | 2019 | 2020 | 2.11 | TTTGGCCC | rice BAB18340.1, maize AY110240.1 |
| putative triacylglycerol lipase | AI993356 | At5g22460 | 45 | 97 | 2349 | 2350 | 2.10 | | |
| putative protein | AI995956 | At5g52060 | 46 | 98 | 1779 | 1780 | 2.08 | | |
| unknown protein | AI996100 | At2g35830 | 47 | 99 | 2471 | 2472 | 2.06 | | |
| hypothetical protein | AI996039 | At3g27050 | 48 | 100 | 2175 | 2176 | 2.05 | | |
| unknown protein | AI996020 | At5g51720 | 49 | 101 | 2033 | 2034 | 2.04 | | |
| putative protein | AW004101 | At4g39730 | 51 | 103 | 1605 | 1606 | 2.03 | | |
| hypothetical protein | AI998372 | At2g01260 | 52 | 104 | 1979 | 1980 | 2.03 | | |
| unknown protein | AI999573 | At3g61060 | | | | | 2.00 | | |
| unknown protein | AI998562 | At2g35760 | | | | | 2.00 | | |
| No hit (2) | | | | | | | | | |
| no hit on genome | AI995690 | | | | | | 2.54 | | |
| no hit on genome | AI999010 | | | | | | 2.23 | | |
| Cell wall biogenesis (4) | | | | | | | | | |
| similar to polygalacturonase-like protein | AI993509 | At1g10640 | 50 | 102 | 1761 | 1762 | 3.62 | | maize AY106712.1, rice BAC06884.1 |

TABLE 2-continued

Arabidopsis Genes 2-fold or more repressed in E2Fa/DPa plants

| Gene Identification | accession # | MIPS | OLD REF cDNA | OLD REF PROT | SEQ ID NO cDNA | SEQ ID NO PROT | Fold repression | E2F site | plant hom ologue |
|---|---|---|---|---|---|---|---|---|---|
| putative xyloglucan endo-transglycosylase | AI997647 | At2g36870 | | | | | 2.51 | | |
| pectate lyase 1-like protein | AI994801 | At1g67750 | | | | | 2.40 | | |
| xyloglucan endo-transglycosylase | AI998832 | At3g44990 | | | | | 2.35 | | |
| Metabolism and biogenesis (24) | | | | | | | | | |
| fructose-biphosphate aldolase-like protein | AI994456 | At4g26530 | | | | | 5.99 | ATTGGCCC | |
| sucrose-phosphate synthase-like protein | AI995432 | At4g10120 | | | | | 4.64 | | |
| putative branched-chain amino acid aminotransferase | AI997263 | At3g19710 | | | | | 3.31 | | |
| vitamine c-2 | AI997404 | At4g26850 | 20 | 72 | 2511 | 2512 | 3.04 | TTTGCCGC | maize AY105327, rice BAB90526.1 |
| nicotianamine synthase | AI993200 | At5g04950 | | | | | 2.86 | | |
| beta-fructosidase | AI994670 | At1g62660 | | | | | 2.66 | TTTCCCCC | |
| neoxanthin cleavage enzyme-like protein | AI997269 | At4g19170 | | | | | 2.66 | | |
| putative starch synthase | AI997174 | At1g32900 | | | | | 2.63 | | |
| cytochrome P450 monooxygenase (CYP83A1) | AI994017 | At4g13770 | | | | | 2.57 | | |
| beta-amylase-like protein | AI999322 | At5g18670 | | | | | 2.53 | | |
| FRO1-like protein; NADPH oxidase-like | AI995987 | At5g49740 | | | | | 2.46 | | |
| putative hydrolase | AI997149 | At3g48420 | | | | | 2.39 | | |
| furamate hydratase | AI997067 | At5g50950 | | | | | 2.31 | TTTGGCCC | |
| 5'-adenylylsulfate reductase | AI992757 | At1g62180 | | | | | 2.30 | TTTCCCCC | |
| 5'-adenylylsulfate reductase | AI996614 | At4g04610 | | | | | 2.30 | | |
| UDP rhamnose-anthocyanidin-3-glucoside rhamnosyltransferase -like protein | AI996803 | At4g27560 | | | | | 2.24 | | |
| cytochrome P450-like protein | AI993171 | At5g48000 | | | | | 2.23 | | |
| lactoylglutathione lyase-like protein | AI994552 | At1g11840 | | | | | 2.20 | | |
| putative beta-glucosidase | AI995306 | At4g27820 | | | | | 2.20 | ATTGGCCC | |
| adenine phospho-ribosyltransferase-like protein | AI994567 | At4g22570 | | | | | 2.18 | | |
| catalase | AI995830 | At4g35090 | | | | | 2.17 | ATTCCCCC | |
| putative glutathione peroxidase | AW004143 | At2g25080 | | | | | 2.15 | | |
| putative adenosine phosphosulfate kinase | AW004219 | At2g14750 | | | | | 2.13 | | |
| tyrosine transaminase like protein | AI996914 | At4g23600 | | | | | 2.13 | | |
| Transcription factors (5) | | | | | | | | | |
| homeobox-leucine zipper protein ATHB-12 | AI994027 | At3g61890 | | | | | 4.20 | | |
| NAC domain protein NAC2 | AI992865 | At1g69490 | | | | | 3.68 | | |
| myb-related transcription factor | AI995298 | At1g71030 | | | | | 2.78 | | |
| dof zinc finger protein | AI994875 | At1g51700 | | | | | 2.30 | | |
| MYB-related transcription factor (CCA1) | AI992931 | At2g46830 | | | | | 2.19 | | |
| Signal transduction (9) | | | | | | | | | |
| serine/threonine protein kinase-like protein | AI995557 | At5g10930 | | | | | 3.91 | | |

TABLE 2-continued

Arabidopsis Genes 2-fold or more repressed in E2Fa/DPa plants

| Gene Identification | accession # | MIPS | OLD REF cDNA | OLD REF PROT | SEQ ID NO cDNA | SEQ ID NO PROT | Fold repression | E2F site | plant hom ologue |
|---|---|---|---|---|---|---|---|---|---|
| subtilisin proteinase-like | AI993428 | At4g21650 | | | | | 3.19 | | |
| putative oligopeptide transporter | AI996160 | At4g10770 | | | | | 2.68 | | |
| putative lectin | AI998542 | At3g16400 | | | | | 2.52 | | |
| Ca2+dependent membrane-binding protein annexin | AI998553 | At1g35720 | | | | | 2.45 | | |
| putative WD repeat protein | AI997238 | At3g15880 | | | | | 2.38 | | |
| putative lectin | AI999016 | At3g16390 | | | | | 2.35 | | |
| putative lectin | AI993358 | At3g16530 | | | | | 2.31 | | |
| SNF1 related protein kinase (ATSRPK1) | AI993111 | At3g23000 | | | | | 2.06 | | |
| Others (25) | | | | | | | | | |
| putative protease inhibitor Dr4 | AI995265 | At1g73330 | | | | | 10.30 | | |
| major latex protein homolog - like | AI998305 | At2g01520 | | | | | 4.27 | | |
| pollen allergen-like protein | AI993041 | At1g24020 | | | | | 3.56 | | |
| putative heat shock protein | AI997846 | At1g06460 | | | | | 3.55 | | |
| putative fibrillin | AI997199 | At4g04020 | | | | | 3.55 | | |
| major latex protein homolog - like | AI997255 | At1g70890 | | | | | 3.50 | | |
| putative nematode-resistance protein | AI993740 | At2g40000 | | | | | 2.95 | | |
| putative auxin-regulated protein | AJ508998 | At2g46690 | | | | | 2.86 | | |
| putative myrosinase-binding protein | AI997583 | At2g39310 | | | | | 2.61 | | |
| ubiquitin-conjugating enzyme-like protein | AI997782 | At5g56150 | | | | | 2.41 | | |
| ubiquitin-conjugating enzyme E2-17 kD 8 | AI994771 | At5g41700 | | | | | 2.40 | | |
| vegetative storage protein Vsp2 | AI999152 | At5g24770 | | | | | 2.35 | | |
| heat shock protein 70 | AI994044 | At3g12580 | | | | | 2.24 | | |
| chloroplast outer envelope membrane protein | AI997015 | At3g63160 | | | | | 2.20 | | |
| translation initiation factor-like protein | AI992786 | At5g54940 | | | | | 2.15 | | |
| pseudogene | AI995323 | At2g04110 | | | | | 2.07 | | |
| vegetative storage protein Vsp1 | AI999546 | At5g24780 | | | | | 2.06 | | |
| dehydrin ERD10 | AI997518 | At1g20450 | | | | | 2.06 | | |
| MTN3-like protein | AI997159 | At3g48740 | | | | | 2.05 | | |
| putative chlorophyll A-B binding protein | AI994859 | At3g27690 | | | | | 2.05 | | |
| photosystem I reaction centre subunit psaN | AI997939 | At5g64040 | | | | | 2.03 | | |
| AR781, similar to yeast pheromone receptor | AI998194 | At2g26530 | | | | | 2.03 | | |
| putative lipid transfer protein | AI997024 | At2g15050 | | | | | 2.03 | | |
| peroxidase ATP3a | AI998372 | At5g64100 | | | | | 2.03 | | |
| myosin heavy chain-like protein | AI999224 | At3g16000 | | | | | 2.01 | | |

*this sequence is present in the MIPs database version of 25 Jul. 2002
**this record has an updated MIPS accession number At5g50101.

TABLE 3

Number of E2F elements in the different datasets

| | All genes (4518) | Upregulated genes (88) | Downregulated genes (105) |
|---|---|---|---|
| TTTCCCCC | 62 | 2 | 3 |
| TTTCCCGC | 40 | 6 | 0 |
| TTTCGCCC | 15 | 0 | 0 |
| TTTCGCCC | 13 | 1 | 0 |
| TTTGCCCC | 37 | 1 | 1 |
| TTTGCCGC | 20 | 0 | 1 |
| TTTGGCCC | 55 | 0 | 2 |
| TTTGGCGC | 15 | 1 | 0 |
| ATTCCCCC | 10 | 0 | 2 |
| ATTCCCGC | 6 | 0 | 0 |
| ATTCGCCC | 8 | 0 | 0 |
| ATTCGCCC | 14 | 0 | 0 |
| ATTGCCCC | 13 | 0 | 0 |
| ATTGCCGC | 10 | 1 | 0 |
| ATTGGCCC | 44 | 0 | 2 |
| ATTGGCGC | 9 | 1 | 0 |
| Total | 371 | 13 | 11 |

TABLE 4

Arabidopsis genes 1.3 fold or more upregulated in E2Fa/Dpa plants

| SEQ ID NO cDNA | SEQ ID NO PROT | Gene name | e_value | MIPS accession number | ratio |
|---|---|---|---|---|---|
| 25 | 26 | putative protein | 0 | At5g51100 | 1.42 |
| 27 | 28 | endo-1,4-beta-glucanase | 9E−27 | At1g70710 | 1.85 |
| 29 | 30 | mitochondrial elongation factor Tu | 1E−125 | At4g02930 | 1.39 |
| 31 | 32 | glycine-rich protein (clone AtGRP8) | 1E−155 | At4g39260 | 1.33 |
| 33 | 34 | UTP-glucose glucosyltransferase | 0 | At5g66690 | 1.59 |
| 35 | 36 | lipid-transfer protein-like | 0 | At5g01870 | 2.33 |
| 37 | 38 | putative auxin-regulated protein | 6E−68 | At4g34760 | 1.48 |
| 39 | 40 | histone H1, putative | 0 | At1g06760 | 2.27 |
| 41 | 42 | APETALA2 protein | 0 | At4g36920 | 1.44 |
| 43 | 44 | putative histone H2A | 0 | At1g08880 | 1.84 |
| 45 | 46 | monosaccharide transporter STP3 | 2E−69 | At5g61520 | 2.05 |
| 47 | 48 | receptor-protein kinase-like protein | 8E−64 | At3g51550 | 1.33 |
| 49 | 50 | SET-domain protein-like | 1E−140 | At5g04940 | 1.38 |
| 51 | 52 | homeodomain transcription factor (ATHB-6) | 0 | At2g22430 | 2.3 |
| 53 | 54 | putative protein | 0 | At4g33700 | 1.85 |
| 55 | 56 | hypothetical protein | 1E−139 | At1g05800 | 1.34 |
| 57 | 58 | unknown protein | 0 | At1g33410 | 1.37 |
| 59 | 60 | hypothetical protein | 1E−140 | At4g17060 | 1.41 |
| 61 | 62 | putative protein | 0 | At5g19820 | 1.44 |
| 63 | 64 | putative protein | 1E+00 | At3g53670 | 1.54 |
| 65 | 66 | regulatory subunit of protein kinase CK2 | 0 | At3g60250 | 1.51 |
| 67 | 68 | delta 9 desaturase, putative | 0 | At1g06090 | 1.85 |
| 69 | 70 | putative protein | 0 | At5g06360 | 1.48 |
| 71 | 72 | acetyl-CoA carboxylase, putative, 5′ partial | 0 | At1g36170*** | 1.49 |
| 73 | 74 | hypothetical protein | 0 | At1g56150 | 1.97 |
| 75 | 76 | seed imbitition protein-like | 0 | At5g20250 | 2.05 |
| 77 | 78 | unknown protein | 1E−146 | At1g76010 | 1.64 |
| 79 | 80 | homeobox-leucine zipper protein-like | 0 | At5g47370 | 2.21 |
| 81 | 82 | kinesin-like protein | 0 | At5g54670 | 1.69 |
| 83 | 84 | putative protein | 0 | At3g48050 | 1.75 |
| 85 | 86 | putative protein | 0 | At5g03040 | 1.34 |
| 87 | 88 | xyloglucan endo-1,4-beta-D-glucanase precursor | 0 | At4g30270 | 3.74 |
| 89 | 90 | putative WD-40 repeat protein | 0 | At2g19540 | 1.75 |
| 91 | 92 | putative protein | 1E−132 | At3g54480 | 1.44 |
| 93 | 94 | hypothetical protein | 0 | At1g15750 | 1.7 |
| 95 | 96 | hypothetical protein | 0 | At1g66200 | 2.06 |
| 97 | 98 | putative protein | 0 | At3g50630 | 1.4 |
| 99 | 100 | unknown protein | 0 | At2g30930 | 1.3 |
| 101 | 102 | putative protein | 6E−91 | At5g37720 | 1.8 |
| 103 | 104 | unknown protein | 1E−146 | At5g54310 | 1.61 |
| 105 | 106 | hypothetical protein | 0 | At5g48920 | 1.98 |
| 107 | 108 | hypothetical protein | 0 | At1g17750 | 1.38 |
| 109 | 110 | nuclear RNA binding protein A-like protein | 0 | At4g17520 | 1.43 |
| 111 | 112 | unknown protein | 4E+00 | At1g10890 | 1.38 |

TABLE 4-continued

_Arabidopsis genes 1.3 fold or more upregulated in E2Fa/Dpa plants_

| SEQ ID NO | | | | | |
|---|---|---|---|---|---|
| cDNA | PROT | Gene name | e_value | MIPS accession number | ratio |
| 113 | 114 | histone H2A-like protein | 0 | At4g27230 | 2.23 |
| 115 | 116 | phytochelatin synthase (gb|AAD41794.1) | 0 | At5g44070 | 1.39 |
| 117 | 118 | RNA-binding protein cp29 protein | 1E-159 | At3g53460 | 1.54 |
| 119 | 120 | putative' RNA-binding protein | 0 | At3g25150 | 1.48 |
| 121 | 122 | alcohol dehydrogenase | 2E-01 | At5g42250 | 1.34 |
| 123 | 124 | putative 60S ribosomal protein L6 | 1E-170 | At1g74060 | 1.37 |
| 125 | 126 | calmodulin-binding protein | 1E-114 | At5g57580 | 1.4 |
| 127 | 128 | putative protein | 3E-23 | At4g20310 | 2.01 |
| 129 | 130 | putative protein kinase | 0 | At1g08720 | 1.33 |
| 131 | 132 | hypothetical protein | 0 | At3g12200 | 1.34 |
| 133 | 134 | putative phosphatidylserine decarboxylase | 0 | At4g25970 | 1.38 |
| 135 | 136 | unknown protein | 0 | At2g03120 | 1.31 |
| 137 | 138 | unknown protein | 0 | At1g14880 | 1.48 |
| 139 | 140 | histone H2A.F/Z | 0 | At3g54560 | 1.85 |
| 141 | 142 | 4-coumarate-CoA ligase - like | 0 | At4g19010 | 1.35 |
| 143 | 144 | putative protein | 0 | At3g45040 | 1.72 |
| 145 | 146 | unknown protein | 0 | At3g19540 | 1.84 |
| 147 | 148 | putative protein | 0 | At4g34410 | 1.36 |
| 149 | 150 | unknown protein | 0 | At1g61260 | 1.97 |
| 151 | 152 | putative protein | 0 | At3g61490 | 1.32 |
| 153 | 154 | lipoxygenase | 0 | At1g17420 | 1.34 |
| 155 | 156 | putative SecA-type chloroplast protein transport factor | 0 | At4g01800 | 1.38 |
| 157 | 158 | putative DNA-binding protein | 0 | At4g01250 | 1.49 |
| 159 | 160 | hypothetical protein | 0 | At1g20580 | 1.37 |
| 161 | 162 | hypothetical protein | 2E-90 | At1g47530 | 1.39 |
| 163 | 164 | unknown protein | 0 | At2g37570 | 1.84 |
| 165 | 166 | bZIP transcription factor-like protein | 0 | At3g62420 | 1.32 |
| 167 | 168 | putative protein | 1E-154 | At3g56720 | 1.39 |
| 169 | 170 | hypothetical protein | 0 | At1g76860 | 1.32 |
| 171 | 172 | 6-phosphogluconate dehydrogenase | 2E-80 | At5g41670 | 1.48 |
| 173 | 174 | ferritin 1 precursor | 0 | At5g01600 | 1.38 |
| 175 | 176 | putative ABC transporter | 0 | At1g71330 | 1.71 |
| 177 | 178 | hypothetical protein | 0 | At1g27300 | 1.3 |
| 179 | 180 | myrosinase precursor | 9E-01 | At5g26000 | 2.81 |
| 181 | 182 | unknown protein | 0E+00 | At1g10270 | 1.47 |
| 183 | 184 | putative protein | 3E-88 | At5g18650 | 1.33 |
| 185 | 186 | hypothetical protein | 6E-40 | At2g36090 | 1.32 |
| 187 | 188 | unknown protein | 0 | At1g43910 | 1.42 |
| 189 | 190 | hypothetical protein | 0 | At1g07000 | 2.43 |
| 191 | 192 | hypothetical protein | 0 | At1g18260 | 1.43 |
| 193 | 194 | putative pre-mRNA splicing factor | 0 | At4g03430 | 1.49 |
| 195 | 196 | putative protein | 0 | At5g11810 | 1.32 |
| 197 | 198 | hypothetical protein | 1E-151 | At4g30150 | 1.41 |
| 199 | 200 | S-receptor kinase - like protein | 0 | At4g32300 | 1.52 |
| 201 | 202 | disease resistance RPP5 like protein | 1E-175 | At4g16950 | 1.64 |
| 203 | 204 | unknown protein | 2E-58 | At1g76520 | 1.44 |
| 205 | 206 | putative protein | 1E-144 | At5g14420 | 2.05 |
| 207 | 208 | putative glucosyltransferase | 4E-78 | At1g23480 | 1.31 |
| 209 | 210 | putative protein | 1E-144 | At4g28470 | 1.34 |
| 211 | 212 | putative protein | 0 | At4g29830 | 1.55 |
| 213 | 214 | putative auxin-regulated protein | 0 | At2g33830 | 1.41 |
| 215 | 216 | putative protein | 8E+00 | At5g61550 | 1.38 |
| 217 | 218 | unknown protein | 0 | At1g44810 | 1.39 |
| 219 | 220 | protein phosphatase - like protein | 1E-59 | At5g02760 | 1.76 |
| 221 | 222 | hypothetical protein | 2E-21 | At4g17800 | 1.59 |
| 223 | 224 | hypothetical protein | 0 | At1g54080 | 1.58 |
| 225 | 226 | xyloglucan endo-transglycosylase, putative | 0 | At1g14720 | 2.51 |
| 227 | 228 | putative protein | 0 | At3g49320 | 1.7 |
| 229 | 230 | beta-1,3-glucanase - like protein | 0 | At3g55430 | 2.05 |
| 231 | 232 | putative protein | 0 | At3g45730 | 5.14 |
| 233 | 234 | ubiquitin-conjugating enzyme E2-21 kD 1 (ubiquitin-protein ligase) | 0 | At5g41340 | 1.32 |
| 235 | 236 | putative reticuline oxidase-like protein | 0 | At1g30720 | 1.31 |
| 237 | 238 | DNA (cytosine-5)-methyltransferase (DNA methyltransferase) (DNA | 0 | At5g49160 | 5.37 |
| 239 | 240 | putative protein | 0 | At4g32030 | 1.38 |
| 241 | 242 | unknown protein | 3E+00 | At2g32710 | 1.46 |
| 243 | 244 | E2F transcription factor-1 E2F1 | 1E-155 | At5g22220 | 1.52 |
| 245 | 246 | putative protein | 0 | At5g48820 | 1.8 |
| 247 | 248 | putative E2F5 family transcription factor | 1E-154 | At2g36010 | 94.9 |
| 249 | 250 | protein kinase cdc2 homolog B | 0 | At3g54180 | 2.6 |
| 251 | 252 | putative WRKY DNA-binding protein | 1E-164 | At2g03340 | 1.43 |
| 253 | 254 | hypothetical protein | 0 | At4g13670 | 1.56 |

TABLE 4-continued

Arabidopsis genes 1.3 fold or more upregulated in E2Fa/Dpa plants

| SEQ ID NO | | | | | |
|---|---|---|---|---|---|
| cDNA | PROT | Gene name | e_value | MIPS accession number | ratio |
| 255 | 256 | xyloglucan endo-1,4-beta-D-glucanase-like protein | 0 | At4g30280 | 2.74 |
| 257 | 258 | hypothetical protein | 1E−121 | At1g18630 | 1.41 |
| 259 | 260 | putative protein | 0 | At5g35735 | 1.52 |
| 261 | 262 | putative protein kinase | 0 | At2g47060 | 1.32 |
| 263 | 264 | putative protein | 1E−01 | At3g43690 | 2.18 |
| 265 | 266 | 70 kD heat shock protein | 0 | At2g32120 | 1.57 |
| 267 | 268 | nitrate reductase | 0 | At1g37130 | 2.15 |
| 269 | 270 | beta-amylase | 0 | At5g55700 | 1.55 |
| 271 | 272 | multicatalytic endopeptidase complex alpha chain | 0 | At3g51260 | 1.57 |
| 273 | 274 | putative protein | 3E−02 | At5g36190 | 2.55 |
| 275 | 276 | putative protein | 0 | At4g00830 | 1.39 |
| 277 | 278 | monodehydroascorbate reductase (NADH) - like protein | 0 | At5g03630 | 1.33 |
| 279 | 280 | unknown protein | 1E−107 | At3g04350 | 1.42 |
| 281 | 282 | hypothetical protein | 0 | At1g70090 | 3.38 |
| 283 | 284 | E2 ubiquitin-conjugating-like enzyme Ahus5 | 0 | At3g57870 | 1.38 |
| 285 | 286 | putative protein | 5E−25 | At3g63070 | 1.35 |
| 287 | 288 | hypothetical protein | 0 | At4g28330 | 2.23 |
| 289 | 290 | cellulose synthase catalytic subunit, putative | 1E−174 | At1g55850 | 2.07 |
| 291 | 292 | putative protein | 0 | At5g46410 | 1.54 |
| 293 | 294 | putative polynucleotide phosphorylase | 1E−136 | At3g03710 | 1.53 |
| 295 | 296 | hypothetical protein | 0 | At1g19180 | 1.32 |
| 297 | 298 | hypothetical protein | 0 | At3g12270 | 1.83 |
| 299 | 300 | sugar transporter like protein | 0 | At4g36670 | 2.27 |
| 301 | 302 | hypothetical protein | 1E−105 | At2g39910 | 1.3 |
| 303 | 304 | putative phytochrome A | 0 | At1g09570 | 2.45 |
| 305 | 306 | hypothetical protein | 0 | At1g64600 | 1.49 |
| 307 | 308 | putative protein | 0 | At5g23610 | 1.6 |
| 309 | 310 | putative protein | 1E−177 | At3g56360 | 1.39 |
| 311 | 312 | cyclophylin - like protein | 0 | At3g63400 | 1.33 |
| 313 | 314 | unknown protein | 0 | At2g37940 | 1.35 |
| 315 | 316 | zinc finger protein, putative | 1E−53 | At1g75540 | 1.46 |
| 317 | 318 | putative protein kinase | 1E+00 | At2g24360 | 1.48 |
| 319 | 320 | putative glucosyltransferase | 0 | At2g15490 | 2.15 |
| 321 | 322 | unknown protein | 0 | At1g60140 | 1.72 |
| 323 | 324 | unknown protein | 0 | At1g43850 | 1.45 |
| 325 | 326 | hypothetical protein | 0 | At3g14120 | 1.77 |
| 327 | 328 | putative AP2 domain transcription factor | 0 | At2g41710 | 1.65 |
| 329 | 330 | transcriptional regulator protein, putative | 6E−71 | At3g26640 | 1.51 |
| 331 | 332 | hypothetical protein | 3E−02 | At1g55370 | 1.35 |
| 333 | 334 | unknown protein | 0 | At3g28920 | 1.93 |
| 335 | 336 | hypothetical protein | 0 | At3g03750 | 1.43 |
| 337 | 338 | hypothetical protein | 2E+00 | At4g27610 | 1.34 |
| 339 | 340 | translation initiation factor eIF-2 beta chain - like protein | 2E+00 | At5g20920 | 1.33 |
| 341 | 342 | unknown protein | 0 | At2g26280 | 1.53 |
| 343 | 344 | unknown protein | 0 | At1g78420 | 1.39 |
| 345 | 346 | elongation factor, putative | 3E+00 | At1g56070 | 1.99 |
| 347 | 348 | anthranilate N-benzoyltransferase - like protein | 1E−120 | At5g01210 | 1.66 |
| 349 | 350 | putative protein | 1E−178 | At4g39680 | 1.43 |
| 351 | 352 | unknown protein | 0 | At3g05380 | 1.92 |
| 353 | 354 | splicing factor At-SRp40 | 0 | At4g25500 | 1.52 |
| 355 | 356 | cdc2-like protein kinase | 0 | At5g10270 | 1.77 |
| 357 | 358 | calcium-dependent protein kinase | 1E−169 | At3g57530 | 1.39 |
| 359 | 360 | phosphoprotein phosphatase, type 1 catalytic subunit | 0 | At2g29400 | 1.48 |
| 361 | 362 | putative mitochondrial translation elongation factor G | 0 | At2g45030 | 1.65 |
| 363 | 364 | long-chain-fatty-acid-CoA ligase-like protein | 0 | At5g27600 | 1.34 |
| 365 | 366 | cytochrome c, putative | 4E−26 | At3g27240 | 1.36 |
| 367 | 368 | En/Spm-like transposon protein | 0 | At2g40070 | 1.41 |
| 369 | 370 | putative phospho-ser/thr phosphatase | 0 | At4g03080 | 1.41 |
| 371 | 372 | chloroplast 50S ribosomal protein L22, putative | 6E−77 | At1g52370 | 1.4 |
| 373 | 374 | unknown protein | 0 | At2g15890 | 1.34 |
| 375 | 376 | putative protein | 0 | At4g26750 | 1.55 |
| 377 | 378 | receptor-protein kinase-like protein | 0 | At5g54380 | 2.59 |
| 379 | 380 | phosphoglycerate kinase, putative | 1E−155 | At3g12780 | 1.88 |
| 381 | 382 | putative HMG protein | 0 | At2g17560 | 1.45 |
| 383 | 384 | hypothetical protein | 0 | At1g76100 | 1.36 |
| 385 | 386 | protein kinase cdc2 homolog B | 0 | At3g54180 | 2.39 |
| 387 | 388 | T-complex protein 1, beta subunit | 0 | At5g20890 | 1.39 |
| 389 | 390 | proline oxidase, mitochondrial precursor (osmotic stress-induced) | 0 | At3g30775 | 1.45 |
| 391 | 392 | linker histone protein, putative | 1E−126 | At1g14900 | 1.33 |
| 393 | 394 | hypothetical protein | 0 | At1g27500 | 2.21 |
| 395 | 396 | ARF1-binding protein | 0 | At5g62010 | 1.58 |
| 397 | 398 | putative protein | 0 | At5g16270 | 1.37 |
| 399 | 400 | putative protein | 1E−173 | At5g13850 | 1.32 |

TABLE 4-continued

_Arabidopsis genes 1.3 fold or more upregulated in E2Fa/Dpa plants_

| SEQ ID NO | | | | | |
|---|---|---|---|---|---|
| cDNA | PROT | Gene name | e_value | MIPS accession number | ratio |
| 401 | 402 | src-2 like protein | 0 | At1g09070 | 2.19 |
| 403 | 404 | RAN2 small Ras-like GTP-binding nuclear protein (Ran-2) | 0 | At5g20020 | 1.3 |
| 405 | 406 | phosphoprotein phosphatase (PPX-1) | 0 | At4g26720 | 1.42 |
| 407 | 408 | nuclear protein-like | 0 | At5g64270 | 1.45 |
| 409 | 410 | ornithine carbamoyltransferase precursor | 0 | At1g75330 | 1.41 |
| 411 | 412 | unknown protein | 0 | At2g41650 | 1.67 |
| 413 | 414 | putative protein | 0 | At5g17640 | 1.66 |
| 415 | 416 | hypothetical protein | 0 | At1g57990 | 2.02 |
| 417 | 418 | hypothetical protein | 0 | At4g15760 | 1.64 |
| 419 | 420 | glycine-rich protein 2 (GRP2) | 0 | At4g38680 | 1.72 |
| 421 | 422 | hypothetical protein | 1E−113 | At2g41780 | 2.6 |
| 423 | 424 | RNA-binding protein, putative | 8E−95 | At3g20250 | 1.46 |
| 425 | 426 | gda-1, putative | 2E+00 | At3g27090 | 1.46 |
| 427 | 428 | beta-fructofuranosidase 1 | 0 | At3g13790 | 1.32 |
| 429 | 430 | 26S proteasome subunit 4-like protein | 0 | At4g29040 | 1.51 |
| 431 | 432 | putative protein | 1E−59 | At1g33980 | 1.42 |
| 433 | 434 | hypothetical protein | 0 | At1g57680 | 2.66 |
| 435 | 436 | unknown protein | 0 | At1g29980 | 1.98 |
| 437 | 438 | 60S ribosomal protein - like | 0 | At5g02870 | 1.39 |
| 439 | 440 | REVOLUTA or interfascicular fiberless 1 | 0 | At5g60690 | 1.34 |
| 441 | 442 | RAC-like GTP-binding protein ARAC4 | 1E−180 | At1g20090 | 1.78 |
| 443 | 444 | unknown protein | 2E−42 | At3g07390 | 1.34 |
| 445 | 446 | unknown protein | 0 | At5g65660 | 1.7 |
| 447 | 448 | unknown protein | 1E−154 | At3g05040 | 1.52 |
| 449 | 450 | putative DNA gyrase subunit A | 1E−153 | At3g10690 | 2.2 |
| 451 | 452 | putative protein | 0 | At3g49170 | 1.53 |
| 453 | 454 | eukaryotic cap-binding protein (gb|AAC17220.1) | 0 | At5g18110 | 1.41 |
| 455 | 456 | phosphoethanolamine N-methyltransferase, putative | 0 | At1g73600 | 1.62 |
| 457 | 458 | unknown protein | 0 | At2g30590 | 2.78 |
| 459 | 460 | RAN1 small Ras-like GTP-binding nuclear protein (Ran-1) | 0 | At5g20010 | 1.46 |
| 461 | 462 | putative protein | 1E−104 | At4g24290 | 1.32 |
| 463 | 464 | putative auxin-regulated protein | 0 | At2g45210 | 1.33 |
| 465 | 466 | adenylosuccinate synthetase | 0 | At3g57610 | 1.39 |
| 467 | 468 | putative protein | 0 | At5g14530 | 2.7 |
| 469 | 470 | putative ubiquitin activating enzyme E1 (ECR1) | 0 | At5g19180 | 1.63 |
| 471 | 472 | putative mitochondrial processing peptidase | 0 | At3g02090 | 1.4 |
| 473 | 474 | putative protein | 0 | At3g48530 | 1.55 |
| 475 | 476 | hypothetical protein | 0 | At1g20330 | 1.47 |
| 477 | 478 | hypothetical protein | 0 | At4g02590 | 1.36 |
| 479 | 480 | putative pyrophosphate-fructose-6-phosphate 1-phosphotransferase | 0 | At1g12000 | 1.49 |
| 481 | 482 | putative receptor-like protein kinase | 0 | At2g02220 | 1.55 |
| 483 | 484 | putative protein | 1E−104 | At4g02440 | 1.4 |
| 485 | 486 | non-phototropic hypocotyl, putative | 0 | At1g30440 | 1.57 |
| 487 | 488 | histone deacetylase | 0 | At5g63110 | 1.36 |
| 489 | 490 | putative protein | 0 | At5g66580 | 3.18 |
| 491 | 492 | multicatalytic endopeptidase complex, proteasome precursor, beta | 0 | At4g31300 | 1.42 |
| 493 | 494 | fibrillarin - like protein | 6E−77 | At4g25630 | 1.3 |
| 495 | 496 | hypothetical protein | 8E−45 | At1g54060 | 1.36 |
| 497 | 498 | histone H1, partial | 0 | At2g30620 | 1.58 |
| 499 | 500 | hypothetical protein | 0 | At3g09030 | 1.45 |
| 501 | 502 | enoyl-CoA hydratase - like protein | 0 | At4g31810 | 1.31 |
| 503 | 504 | unknown protein | 7E+00 | At2g27080 | 1.51 |
| 505 | 506 | myb-related transcription factor, putative | 0 | At3g23250 | 1.49 |
| 507 | 508 | Alcohol Dehydrogenase | 0 | At1g77120 | 5.09 |
| 509 | 510 | hypothetical protein | 1E−132 | At1g27590 | 1.38 |
| 511 | 512 | unknown protein | 0 | At1g14710 | 1.36 |
| 513 | 514 | putative receptor-like protein kinase | 0 | At2g13790 | 1.68 |
| 515 | 516 | putative protein | 0 | At5g14550 | 1.39 |
| 517 | 518 | homeobox protein knotted-1 like 4 (KNAT4) | 1E−165 | At5g11060 | 1.4 |
| 519 | 520 | putative protein | 1E−142 | At5g15540 | 1.47 |
| 521 | 522 | carbonyl reductase-like protein | 7E+00 | At5g51030 | 2.17 |
| 523 | 524 | hypothetical protein | 1E−50 | At1g53900 | 1.36 |
| 525 | 526 | aspartate-tRNA ligase - like protein | 0 | At4g31180 | 1.62 |
| 527 | 528 | unknown protein | 1E−121 | At3g06150 | 1.74 |
| 529 | 530 | amino acid transporter protein-like | 0 | At5g65990 | 1.59 |
| 531 | 532 | 12-oxophytodienoate reductase (OPR1) | 0 | At1g76680 | 1.43 |
| 533 | 534 | calnexin homolog | 6E−25 | At5g07340 | 1.39 |
| 535 | 536 | unknown protein | 0 | At1g61100 | 2.06 |
| 537 | 538 | homogentisate 1,2-dioxygenase | 1E−78 | At5g54080 | 2.01 |
| 539 | 540 | glucosyltransferase - like protein | 0 | At4g34131 | 1.33 |
| 541 | 542 | putative protein | 4E−01 | At5g54890 | 1.35 |

TABLE 4-continued

_Arabidopsis genes 1.3 fold or more upregulated in E2Fa/Dpa plants_

| SEQ ID NO | | | | | |
|---|---|---|---|---|---|
| cDNA | PROT | Gene name | e_value | MIPS accession number | ratio |
| 543 | 544 | hypothetical protein | 0 | At1g76070 | 1.31 |
| 545 | 546 | putative protein | 1E−179 | At5g18310 | 1.56 |
| 547 | 548 | DNA binding protein ACBF - like | 0 | At5g19350 | 1.36 |
| 549 | 550 | hypothetical protein | 0 | At1g17210 | 1.69 |
| 551 | 552 | putative protein | 1E−111 | At5g51220 | 1.46 |
| 553 | 554 | RING finger protein | 0 | At3g61460 | 2.14 |
| 555 | 556 | putative protein | 0 | At5g18580 | 1.32 |
| 557 | 558 | putative protein kinase | 0 | At2g31010 | 1.35 |
| 559 | 560 | chloroplast nucleoid DNA binding protein, putative | 0 | At1g01300 | 1.49 |
| 561 | 562 | unknown protein | 1E−143 | At1g31130 | 1.4 |
| 563 | 564 | splicing factor, putative | 1E+00 | At1g14650 | 1.56 |
| 565 | 566 | putative TCP3 gb|AAC24010. | 0 | At1g53230 | 1.38 |
| 567 | 568 | unknown protein | 0 | At1g72790 | 1.71 |
| 569 | 570 | ribosomal protein S6 - like | 0 | At4g31700 | 1.38 |
| 571 | 572 | auxin-resistance protein AXR1 | 0 | At1g05180 | 1.36 |
| 573 | 574 | putative protein | 0 | At5g11030 | 1.43 |
| 575 | 576 | putative 60S acidic ribosomal protein P0 | 0 | At3g09200 | 1.47 |
| 577 | 578 | mismatch binding protein, putative | 0 | At3g24320 | 2.1 |
| 579 | 580 | T-complex chaperonin protein, epsilon subunit | 0 | At1g24510 | 1.47 |
| 581 | 582 | putative protein | 0 | At4g24120 | 1.56 |
| 583 | 584 | putative protein | 4E−38 | At5g53900 | 1.79 |
| 585 | 586 | histidine transport protein (PTR2-B) | 0 | At2g02040 | 1.37 |
| 587 | 588 | unknown protein | 0 | At3g10490 | 1.43 |
| 589 | 590 | tubulin alpha-5 chain-like protein | 0 | At5g19770 | 1.6 |
| 591 | 592 | putative non-LTR retroelement reverse transcriptase | 6E+00 | At2g15510 | 4.71 |
| 593 | 594 | unknown protein | 1E−179 | At2g41010 | 1.33 |
| 595 | 596 | putative chloroplast outer envelope 86-like protein | 0 | At4g02510 | 1.45 |
| 597 | 598 | serine/threonine-specific protein kinase NAK | 0 | At5g02290 | 1.56 |
| 599 | 600 | unknown protein | 0 | At2g34680 | 1.45 |
| 601 | 602 | hypothetical protein | 0 | At1g43170 | 1.69 |
| 603 | 604 | phospholipase D, putative, 5' partial | 0 | At3g16785 | 1.5 |
| 605 | 606 | CTP synthase-like protein | 0 | At1g30820 | 1.58 |
| 607 | 608 | nitrilase 2 | 0 | At3g44300 | 1.84 |
| 609 | 610 | putative mitogen activated protein kinase kinase | 0 | At3g04910 | 1.34 |
| 611 | 612 | putative protein | 0 | At4g27450 | 1.4 |
| 613 | 614 | Phospholipase like protein | 0 | At4g38550 | 1.9 |
| 615 | 616 | endomembrane-associated protein | 3E−41 | At4g20260 | 1.83 |
| 617 | 618 | leucine-rich receptor-like protein kinase, putative | 0 | At1g72180 | 2.13 |
| 619 | 620 | putative protein | 8E−01 | At4g25930 | 1.54 |
| 621 | 622 | WD-40 repeat protein MSI1 (sp|O22467) | 0 | At5g58230 | 1.72 |
| 623 | 624 | oxysterol-binding protein - like | 1E−171 | At5g59420 | 1.31 |
| 625 | 626 | putative protein | 1E−178 | At4g21840 | 1.4 |
| 627 | 628 | blue copper binding protein | 1E−50 | At5g20230 | 2.3 |
| 629 | 630 | UV-damaged DNA-binding protein - like | 6E−9 | At4g21100 | 1.46 |
| 631 | 632 | fatty acid hydroxylase (FAH1) | 0 | At2g34770 | 1.96 |
| 633 | 634 | putative thymidine kinase | 0 | At3g07800 | 8.44 |
| 635 | 636 | hypothetical protein | 0 | At1g79380 | 1.41 |
| 637 | 638 | unknown protein | 0 | At2g15860 | 1.36 |
| 639 | 640 | flower pigmentation protein ATAN11 | 0 | At1g12910 | 1.41 |
| 641 | 642 | hypothetical protein | 0 | At1g56290 | 1.33 |
| 643 | 644 | putative protein | 0 | At3g62630 | 1.38 |
| 645 | 646 | SNF-2 like RING finger | 0 | At1g61140 | 1.42 |
| 647 | 648 | unknown protein | 0 | At3g16310 | 1.49 |
| 649 | 650 | putative glucosyl transferase | 0 | At2g36800 | 1.36 |
| 651 | 652 | putative protein | 0 | At4g25170 | 1.92 |
| 653 | 654 | hypothetical protein | 9E−39 | At4g00450 | 1.36 |
| 655 | 656 | glutathione S-transferase | 0 | At2g30860 | 1.49 |
| 657 | 658 | unknown protein, 3' partial | 0 | At3g15095 | 1.42 |
| 659 | 660 | unknown protein | 0 | At3g21080 | 1.31 |
| 661 | 662 | TCH4 protein (gb|AAA92363.1) | 0 | At5g57560 | 1.92 |
| 663 | 664 | putative protein | 0 | At3g61600 | 1.34 |
| 665 | 666 | receptor-like kinase, putative | 0 | At3g23750 | 2.06 |
| 667 | 668 | putative 2,3-bisphosphoglycerate-independent phosphoglycerate | 0 | At1g09780 | 1.34 |
| 669 | 670 | putative protein | 0 | At5g14250 | 1.51 |
| 671 | 672 | DnaJ homologue (gb|AAB91418.1|) | 0 | At5g06910 | 2.32 |
| 673 | 674 | hypothetical protein | 0 | At1g33250 | 1.35 |
| 675 | 676 | unknown protein | 0 | At2g19800 | 1.81 |
| 677 | 678 | aspartate carbamoyltransferase precursor (aspartate | 3E−84 | At3g20330 | 1.49 |
| 679 | 680 | hypothetical protein | 0 | At1g16520 | 1.35 |
| 681 | 682 | unknown protein | 5E+00 | At1g48620 | 1.33 |
| 683 | 684 | putative protein | 1E+00 | At4g35750 | 1.39 |
| 685 | 686 | hypothetical protein | 1E−55 | At3g13620 | 1.79 |
| 687 | 688 | RNA helicase, DRH1 | 1E−179 | At3g01540 | 1.56 |

TABLE 4-continued

*Arabidopsis* genes 1.3 fold or more upregulated in E2Fa/Dpa plants

| SEQ ID NO | | | | | |
|---|---|---|---|---|---|
| cDNA | PROT | Gene name | e_value | MIPS accession number | ratio |
| 689 | 690 | putative 3-oxoacyl [acyl-carrier protein] reductase | 0 | At1g24360 | 1.42 |
| 691 | 692 | putative cellular apoptosis susceptibility protein | 1E−142 | At2g46520 | 1.43 |
| 693 | 694 | hypothetical protein | 0 | At1g01540 | 1.31 |
| 695 | 696 | starch branching enzyme II | 2E−61 | At2g36390 | 1.36 |
| 697 | 698 | 40S ribosomal protein - like | 0 | At5g15200 | 1.32 |
| 699 | 700 | putative protein | 0 | At4g13640 | 1.33 |
| 701 | 702 | putative protein | 0 | At3g45970 | 3.22 |
| 703 | 704 | hypothetical protein | 0 | At1g66160 | 1.31 |
| 705 | 706 | AP2 domain containing protein RAP2.3 | 2E−9 | At3g16770 | 1.51 |
| 707 | 708 | putative protein | 1E−47 | At5g02880 | 1.32 |
| 709 | 710 | NADH-dependent glutamate synthase | 0 | At5g53460 | 2.25 |
| 711 | 712 | arginine/serine rich splicing factor RSP3 | 4E−59 | At3g61860 | 1.31 |
| 713 | 714 | hypothetical protein | 1E−134 | At1g55880 | 1.37 |
| 715 | 716 | translation initiation factor eIF3 - like protein | 6E−77 | At4g20980 | 1.45 |
| 717 | 718 | putative serine/threonine protein phosphatase catalytic subunit, | 0 | At2g42500 | 1.38 |
| 719 | 720 | unknown protein | 1E−105 | At1g33480 | 1.91 |
| 721 | 722 | COP1-interacting protein CIP8 | 0 | At5g64920 | 1.4 |
| 723 | 724 | nonphototropic hypocotyl 1 | 6E+00 | At3g45780 | 1.47 |
| 725 | 726 | putative protein | 1E−78 | At5g10860 | 1.32 |
| 727 | 728 | putative protein | 0 | At5g19750 | 1.37 |
| 729 | 730 | putative protein | 1E−127 | At3g52500 | 1.39 |
| 731 | 732 | putative protein | 0 | At4g10280 | 1.76 |
| 733 | 734 | cytochrome P450 monooxygenase | 0 | At4g31500 | 1.35 |
| 735 | 736 | ethylene responsive element binding factor | 1E−104 | At4g17500 | 1.33 |
| 737 | 738 | hypothetical protein | 0 | At1g17620 | 1.37 |
| 739 | 740 | unknown protein | 1E−123 | At3g07390 | 1.42 |
| 741 | 742 | putative protein kinase | 0 | At3g02880 | 1.46 |
| 743 | 744 | DNA repair protein RAD23 homolog | 0 | At5g38470 | 1.42 |
| 745 | 746 | GTP-binding protein - like | 1E−25 | At5g03520 | 1.57 |
| 747 | 748 | putative protein | 0 | At3g63500 | 1.4 |
| 749 | 750 | putative adenylate kinase | 4E+00 | At2g39270 | 1.37 |
| 751 | 752 | protein kinase - like | 6E−46 | At5g59010 | 1.42 |
| 753 | 754 | unknown protein | 0 | At3g04630 | 1.58 |
| 755 | 756 | RNA binding protein | 0 | At1g73490 | 1.32 |
| 757 | 758 | putative phospholipase D | 0 | At3g15730 | 1.51 |
| 759 | 760 | importin alpha | 1E−115 | At3g06720 | 1.45 |
| 761 | 762 | RING-H2 finger protein RHF2a | 0 | At5g22000 | 1.43 |
| 763 | 764 | putative protein | 2E−93 | At4g19160 | 1.3 |
| 765 | 766 | putative protein | 0 | At4g32440 | 1.41 |
| 767 | 768 | putative protein phosphatase type 2C | 0 | At3g15260 | 1.61 |
| 769 | 770 | putative protein | 0 | At5g39890 | 1.31 |
| 771 | 772 | ribosomal protein | 0 | At4g16720 | 1.42 |
| 773 | 774 | dormancy-associated protein | 9E+00 | At1g28330 | 2.01 |
| 775 | 776 | auxin-inducible gene (IAA2) | 0 | At3g23030 | 1.65 |
| 777 | 778 | unknown protein | 5E+00 | At1g76010 | 1.54 |
| 779 | 780 | protein kinase ADK1-like protein | 1E+00 | At4g28540 | 1.96 |
| 781 | 782 | putative protein | 0 | At4g24210 | 1.36 |
| 783 | 784 | hypothetical protein | 0 | At1g79530 | 1.4 |
| 785 | 786 | putative trehalose-6-phosphate synthase | 0 | At1g68020 | 1.45 |
| 787 | 788 | adenylate kinase | 0 | At5g63400 | 1.39 |
| 789 | 790 | putative proline-rich protein precursor | 0 | At1g73840 | 1.56 |
| 791 | 792 | putative protein | 5E−87 | At5g14370 | 1.37 |
| 793 | 794 | hypothetical protein | 0 | At4g33290 | 1.7 |
| 795 | 796 | cytochrome P450 monooxygenase (CYP71B3) | 0 | At3g26220 | 1.32 |
| 797 | 798 | TMV resistance protein N - like | 0 | At4g19530 | 1.5 |
| 799 | 800 | hypothetical protein | 9E−70 | At1g54830 | 1.33 |
| 801 | 802 | 3-ketoacyl-CoA thiolase | 0 | At2g33150 | 1.87 |
| 803 | 804 | putative protein | 0 | At3g54350 | 1.35 |
| 805 | 806 | hypothetical protein | 1E−170 | At4g02680 | 1.36 |
| 807 | 808 | putative bHLH transcription factor | 0 | At2g46510 | 1.35 |
| 809 | 810 | RNA-binding protein, putative | 5E−84 | At3g26420 | 1.55 |
| 811 | 812 | putative lectin | 3E−20 | At3g09190 | 1.67 |
| 813 | 814 | xyloglucan endotransglycosylase, putative | 0 | At3g23730 | 2.85 |
| 815 | 816 | unknown protein | 2E−33 | At2g41170 | 1.32 |
| 817 | 818 | putative protein | 3E−78 | At3g57150 | 1.67 |
| 819 | 820 | putative glucose regulated repressor protein | 0 | At2g25490 | 1.81 |
| 821 | 822 | putative AP2 domain containing protein RAP2.4 gi|2281633 | 1E−150 | At1g78080 | 1.82 |
| 823 | 824 | putative sulfate transporter | 0 | At1g80310 | 1.51 |
| 825 | 826 | G protein alpha subunit 1 (GPA1) | 0 | At2g26300 | 1.44 |
| 827 | 828 | protochlorophyllide reductase precursor | 0 | At4g27440 | 2.39 |
| 829 | 830 | Shaggy related protein kinase tetha | 0 | At4g00720 | 1.52 |
| 831 | 832 | putative protein kinase | 0 | At3g01300 | 1.49 |
| 833 | 834 | RNA-binding protein-like protein | 0 | At3g47160 | 1.31 |

TABLE 4-continued

Arabidopsis genes 1.3 fold or more upregulated in E2Fa/Dpa plants

| SEQ ID NO | | | | | |
|---|---|---|---|---|---|
| cDNA | PROT | Gene name | e_value | MIPS accession number | ratio |
| 835 | 836 | unknown protein | 1E-150 | At5g24670 | 1.47 |
| 837 | 838 | zinc finger protein ZFP8 | 1E-144 | At2g41940 | 1.42 |
| 839 | 840 | GTP binding protein beta subunit | 0 | At4g34460 | 1.54 |
| 841 | 842 | copia-like retroelement pol polyprotein | 0 | At2g22680 | 1.4 |
| 843 | 844 | CONSTANS-like B-box zinc finger protein-like | 0 | At5g57660 | 1.36 |
| 845 | 846 | unknown protein | 3E-71 | At3g10640 | 1.33 |
| 847 | 848 | putative protein | 0 | At4g24690 | 1.91 |
| 849 | 850 | NADH dehydrogenase | 1E-124 | At5g08530 | 1.42 |
| 851 | 852 | unknown protein | 0 | At1g73820 | 1.35 |
| 853 | 854 | monosaccharide transport protein, STP4 | 8E-9 | At3g19930 | 1.58 |
| 855 | 856 | globulin-like protein | 0 | At1g07750 | 1.61 |
| 857 | 858 | putative transitional endoplasmic reticulum ATPase | 2E-58 | At3g09840 | 1.51 |
| 859 | 860 | putative monodehydroascorbate reductase | 0 | At1g63940 | 1.39 |
| 861 | 862 | anthranilate phosphoribosyltransferase like protein | 0 | At3g57880 | 1.42 |
| 863 | 864 | H+-transporting ATP synthase chain 9 - like protein | 6E-25 | At4g32260 | 1.83 |
| 865 | 866 | hypothetical protein | 0 | At1g02810 | 2.31 |
| 867 | 868 | calmodulin-like protein | 3E-63 | At2g41410 | 1.52 |
| 869 | 870 | putative protein | 0 | At5g15350 | 2.75 |
| 871 | 872 | glutathione S-transferase | 0 | At2g30870 | 1.54 |
| 873 | 874 | putative SWI/SNF complex subunit SW13 | 1E-138 | At2g33610 | 1.32 |
| 875 | 876 | MAP kinase kinase 2 | 0 | At4g29810 | 1.39 |
| 877 | 878 | adenosylhomocysteinase | 1E-134 | At4g13940 | 2.07 |
| 879 | 880 | putative protein | 0 | At5g27760 | 1.4 |
| 881 | 882 | unknown protein | 0 | At2g47450 | 1.67 |
| 883 | 884 | putative protein | 0 | At4g33050 | 2.2 |
| 885 | 886 | 50S ribosomal protein L12-C | 1E-138 | At3g27850 | 1.38 |
| 887 | 888 | 26S proteasome AAA-ATPase subunit RPT4a (gb|AAF22524.1) | 0 | | 1.4 |
| 889 | 890 | unknown protein | 8E-01 | At3g01690 | 1.31 |
| 891 | 892 | lipid transfer protein; glossy1 homolog | 0 | At5g57800 | 1.39 |
| 893 | 894 | indoleacetic acid (IAA)-inducible gene (IAA7) | 1E-7 | At3g23050 | 1.52 |
| 895 | 896 | histone H2B - like protein | 0 | At5g59910 | 2.16 |
| 897 | 898 | putative RNA helicase | 0 | At3g06480 | 1.47 |
| 899 | 900 | unknown protein | 8E-64 | At1g19310 | 1.44 |
| 901 | 902 | unknown protein | 4E-96 | At2g18440 | 1.38 |
| 903 | 904 | unknown protein | 0 | At1g68220 | 1.59 |
| 905 | 906 | unknown protein | 1E-142 | At2g20570 | 1.35 |
| 907 | 908 | putative replication factor | 1E-124 | At1g21690 | 3.3 |
| 909 | 910 | U2 snRNP auxiliary factor, small subunit | 0 | At5g42820 | 1.55 |
| 911 | 912 | replication factor C - like | 0 | At5g27740 | 1.45 |
| 913 | 914 | nuclear receptor binding factor-like protein | 0 | At3g45770 | 1.62 |
| 915 | 916 | putative glycosyl transferase | 0 | At1g24170 | 2.39 |
| 917 | 918 | histone H2A-like protein | 4E-53 | At5g27670 | 1.62 |
| 919 | 920 | putative protein | 1E-125 | At5g48960 | 1.43 |
| 921 | 922 | hypothetical protein | 0 | At1g53740 | 1.42 |
| 923 | 924 | splicing factor - like protein | 0 | At3g53500 | 1.39 |
| 925 | 926 | unknown protein | 0 | At1g50510 | 1.32 |
| 927 | 928 | Fe(II) transport protein | 0 | At4g19690 | 1.37 |
| 929 | 930 | hypothetical protein | 0 | At1g61730 | 1.43 |
| 931 | 932 | unknown protein | 7E-9 | At2g47440 | 2.5 |
| 933 | 934 | cold-regulated protein COR6.6 (KIN2) | 0 | At5g15970 | 3.03 |
| 935 | 936 | putative cytochrome C | 0 | At1g22840 | 1.3 |
| 937 | 938 | unknown protein | 0 | At1g68580 | 2.13 |
| 939 | 940 | putative Ser/Thr protein kinase | 0 | At1g16270 | 1.37 |
| 941 | 942 | pseudogene | 1E-138 | At2g25970 | 2.15 |
| 943 | 944 | unknown protein | 0 | At3g06380 | 1.67 |
| 945 | 946 | Tic22, putative | 3E-84 | At3g23710 | 2.14 |
| 947 | 948 | unknown protein | 0 | At1g09250 | 1.55 |
| 949 | 950 | hypothetical protein | 0 | At1g72930 | 1.91 |
| 951 | 952 | hypothetical protein | 2E+00 | At1g68820 | 1.43 |
| 953 | 954 | histone H1 | 0 | At2g18050 | 1.75 |
| 955 | 956 | unknown protein | 0 | At1g08630 | 1.45 |
| 957 | 958 | unknown protein, 5'partial | 0 | At3g18035 | 3.31 |
| 959 | 960 | unknown protein | 0 | At1g04140 | 1.37 |
| 961 | 962 | HAL3A protein | 0 | At3g18030 | 1.43 |
| 963 | 964 | phi-1-like protein | 0 | At5g64260 | 3.38 |
| 965 | 966 | hypothetical protein | 0 | At1g12770 | 1.35 |
| 967 | 968 | pollen specific protein SF21 | 0 | At5g56750 | 1.45 |
| 969 | 970 | cysteine proteinase inhibitor like protein | 1E-159 | At4g16500 | 1.33 |
| 971 | 972 | 20S proteasome subunit C8 (PAG1/PRC8 ARATH) | 1E-130 | At2g27020 | 1.36 |
| 973 | 974 | nodulin-like protein | 1E-99 | At1g75500 | 1.34 |
| 975 | 976 | hypothetical protein | 0 | At1g72900 | 2.04 |
| 977 | 978 | hypothetical protein | 0 | At2g35230 | 1.42 |
| 979 | 980 | arm repeat containing protein homolog | 0 | At3g46510 | 1.4 |

TABLE 4-continued

_Arabidopsis genes 1.3 fold or more upregulated in E2Fa/Dpa plants_

| SEQ ID NO | | | | | |
|---|---|---|---|---|---|
| cDNA | PROT | Gene name | e_value | MIPS accession number | ratio |
| 981 | 982 | putative protein | 0 | At5g67480 | 1.76 |
| 983 | 984 | putative leucyl-tRNA synthetase | 1E−118 | At1g09620 | 1.52 |
| 985 | 986 | Putative UDP-glucose glucosyltransferase | 1E−164 | At1g22400 | 2.34 |
| 987 | 988 | alanine aminotransferase, putative | 0 | At1g17290 | 1.66 |
| 989 | 990 | 26S proteasome AAA-ATPase subunit RPT6a | 0 | At5g19990 | 1.36 |
| 991 | 992 | Ruv DNA-helicase-like protein | 0 | At5g22330 | 1.59 |
| 993 | 994 | small nuclear ribonucleoprotein, putative | 0 | At1g65700 | 1.33 |
| 995 | 996 | unknown protein | 0 | At2g38310 | 2.79 |
| 997 | 998 | protein phosphatase type 1 PP1BG | 3E−91 | At4g11240 | 1.51 |
| 999 | 1000 | hypothetical protein | 3E−41 | At2g43410 | 2.1 |
| 1001 | 1002 | putative protein | 0 | At5g58600 | 1.42 |
| 1003 | 1004 | nodulin-like protein | 0 | At1g80530 | 2.07 |
| 1005 | 1006 | putative protein | 0 | At5g56170 | 1.65 |
| 1007 | 1008 | dihydroxyacetone kinase, putative | 1E−167 | At3g17770 | 1.67 |
| 1009 | 1010 | ribsomal protein - like | 1E−155 | At5g09770 | 1.44 |
| 1011 | 1012 | 101 kDa heat shock protein; HSP101-like protein | 0 | At5g57710 | 1.34 |
| 1013 | 1014 | unknown protein | 0 | At5g51340 | 1.48 |
| 1015 | 1016 | unknown protein | 0 | At3g05730 | 1.46 |
| 1017 | 1018 | putative protein | 2E+00 | At5g67570 | 2.6 |
| 1019 | 1020 | mitochondrial chaperonin (HSP60) | 0 | At2g33210 | 1.75 |
| 1021 | 1022 | putative protein | 1E−177 | At3g63270 | 1.34 |
| 1023 | 1024 | growth factor like protein | 0 | At4g12720 | 1.78 |
| 1025 | 1026 | RNA helicase, putative | 0 | At3g19760 | 1.54 |
| 1027 | 1028 | pseudogene | 1E−142 | At2g34760 | 1.81 |
| 1029 | 1030 | hypothetical protein | 0 | At3g21740 | 1.52 |
| 1031 | 1032 | shaggy-like kinase beta | 0 | At3g61160 | 1.36 |
| 1033 | 1034 | unknown protein | 1E−165 | At1g20100 | 1.35 |
| 1035 | 1036 | 24-sterol C-methyltransferase | 1E−143 | At5g13710 | 1.41 |
| 1037 | 1038 | WD-40 repeat protein (MSI3) | 0 | At4g35050 | 4.89 |
| 1039 | 1040 | hypothetical protein | 0 | At1g67120 | 1.51 |
| 1041 | 1042 | putative protein (fragment) | 0 | At5g14930 | 1.46 |
| 1043 | 1044 | putative protein | 1E−6 | At5g54180 | 1.78 |
| 1045 | 1046 | hypothetical protein | 1E−126 | At1g20570 | 1.43 |
| 1047 | 1048 | calcium-dependent protein kinase | 0 | At5g66210 | 2.96 |
| 1049 | 1050 | nitrilase 2 | 1E−127 | At3g44300 | 1.88 |
| 1051 | 1052 | methionyl-tRNA synthetase - like protein | 1E−173 | At4g13780 | 1.33 |
| 1053 | 1054 | putative protein | 0 | At4g24230 | 1.58 |
| 1055 | 1056 | putative protein | 2E−76 | At5g19330 | 1.33 |
| 1057 | 1058 | caffeoyl-CoA O-methyltransferase - like protein | 1E−166 | At4g34050 | 1.41 |
| 1059 | 1060 | putative DNA binding protein | 0 | At4g27000 | 1.43 |
| 1061 | 1062 | unknown protein | 0 | At1g55270 | 1.4 |
| 1063 | 1064 | carbamoyl phosphate synthetase large chain (carB) | 0 | At1g29900 | 1.5 |
| 1065 | 1066 | hypothetical protein | 6E+00 | At4g02680 | 2.73 |
| 1067 | 1068 | putative RNA helicase | 0 | At3g22310 | 1.53 |
| 1069 | 1070 | molybdopterin synthase sulphurylase (gb|AAD18050.1) | 0 | At5g55130 | 1.77 |
| 1071 | 1072 | inner mitochondrial membrane protein, putative | 0 | At1g17530 | 1.55 |
| 1073 | 1074 | putative protein kinase | 0 | At3g08760 | 1.9 |
| 1075 | 1076 | putative JUN kinase activator protein | 0 | At1g22920 | 1.42 |
| 1077 | 1078 | thaumatin, putative | 0 | At1g75800 | 1.56 |
| 1079 | 1080 | DNA-binding protein | 0 | At3g14230 | 1.54 |
| 1081 | 1082 | unknown protein | 0 | At2g01710 | 1.34 |
| 1083 | 1084 | putative calcium binding protein | 0 | At2g43290 | 1.57 |
| 1085 | 1086 | class 1 non-symbiotic hemoglobin (AHB1) | 5E−93 | At2g16060 | 1.86 |
| 1087 | 1088 | glycine-rich RNA binding protein, putative | 2E−52 | At3g23830 | 1.38 |
| 1089 | 1090 | unknown protein | 2E−37 | At2g01190 | 1.3 |
| 1091 | 1092 | hydoxyethylthiazole kinase, putative | 2E−71 | At3g24030 | 1.35 |
| 1093 | 1094 | putative protein translocase | 0E+00 | At2g37410 | 1.51 |
| 1095 | 1096 | putative protein | 5E−02 | At5g61560 | 1.31 |
| 1097 | 1098 | hypothetical protein | 7E−02 | At1g35600 | 1.56 |
| 1099 | 1100 | ethylene-insensitive 3 | 0 | At3g20770 | 1.5 |
| 1101 | 1102 | lipoxygenase AtLOX2 | 0 | At3g45140 | 1.57 |
| 1103 | 1104 | putative phosphatidic acid phosphatase | 0 | At2g01180 | 1.85 |
| 1105 | 1106 | unknown protein | 5E−5 | At1g80860 | 1.3 |
| 1107 | 1108 | unknown protein | 2E−15 | At3g28180 | 1.64 |
| 1109 | 1110 | LOB domain protien 41 | 0 | At3g02550 | 4.01 |
| 1111 | 1112 | putative protein | 2E−02 | At5g22260 | 1.95 |
| 1113 | 1114 | actin - like protein | 1E−180 | At3g60830 | 1.36 |
| 1115 | 1116 | DEAD-box protein abstrakt | 0 | At5g51280 | 1.53 |
| 1117 | 1118 | putative DNA polymerase epsilon catalytic subunit | 2E+00 | At2g27120 | 2.87 |
| 1119 | 1120 | unknown protein | 6E−59 | At5g48020 | 1.4 |
| 1121 | 1122 | protein kinase C inhibitor-like protein | 0 | At3g56490 | 1.58 |
| 1123 | 1124 | putative PRP19-like spliceosomal protein | 0 | At2g33340 | 1.7 |
| 1125 | 1126 | germin-like protein | 0 | At1g72610 | 1.67 |

TABLE 4-continued

Arabidopsis genes 1.3 fold or more upregulated in E2Fa/Dpa plants

| SEQ ID NO | | | | | |
|---|---|---|---|---|---|
| cDNA | PROT | Gene name | e_value | MIPS accession number | ratio |
| 1127 | 1128 | putative protein | 1E-5 | At5g10050 | 1.32 |
| 1129 | 1130 | putative protein | 0 | At4g34950 | 1.96 |
| 1131 | 1132 | zinc finger protein | 0 | At5g66730 | 1.37 |
| 1133 | 1134 | chaperonin gamma chain - like protein | 1E-176 | At5g26360 | 1.67 |
| 1135 | 1136 | WD-40 protein | 7E+00 | At4g07410 | 1.42 |
| 1137 | 1138 | putative DNA-binding protein | 0 | At4g12080 | 1.4 |
| 1139 | 1140 | beta-glucosidase, putative | 0 | At1g52400 | 1.66 |
| 1141 | 1142 | hypothetical protein | 1E-44 | At2g23140 | 1.66 |
| 1143 | 1144 | homeobox protein | 1E-43 | At3g61150 | 1.63 |
| 1145 | 1146 | glycine-rich protein | 0 | At4g36020 | 1.82 |
| 1147 | 1148 | unknown protein | 0 | At3g01460 | 1.37 |
| 1149 | 1150 | hypothetical protein | 1E-134 | At4g28190 | 1.4 |
| 1151 | 1152 | predicted protein | 5E-37 | At4g32010 | 1.34 |
| 1153 | 1154 | N-myristoyl transferase | 1E-157 | At5g57020 | 1.37 |
| 1155 | 1156 | putative protein | 0 | At4g36780 | 1.61 |
| 1157 | 1158 | unknown protein | 2E-01 | At5g48240 | 1.64 |
| 1159 | 1160 | unknown protein | 0 | At1g21630 | 1.55 |
| 1161 | 1162 | unknown protein | 1E-102 | At1g07360 | 1.74 |
| 1163 | 1164 | lysyl-tRNA synthetase | 1E-96 | At3g11710 | 1.38 |
| 1165 | 1166 | unknown protein | 0 | At3g07780 | 1.51 |
| 1167 | 1168 | tryptophan synthase beta chain 1 precursor (sp|P14671) | 1E-102 | At5g54810 | 1.55 |
| 1169 | 1170 | putative protein | 8E-98 | At4g25620 | 1.81 |
| 1171 | 1172 | RuvB DNA helicase-like protein | 0 | At5g67630 | 1.32 |
| 1173 | 1174 | putative pectin methylesterase | 0 | At3g14310 | 1.43 |
| 1175 | 1176 | putative cytidine deaminase | 0 | At2g19570 | 1.41 |
| 1177 | 1178 | hypothetical protein | 0 | At3g12400 | 1.42 |
| 1179 | 1180 | 1-aminocyclopropane-1-carboxylate synthase - like protein | 0 | At4g26200 | 1.54 |
| 1181 | 1182 | peroxidase | 3E-88 | At2g38380 | 2.11 |
| 1183 | 1184 | 2-oxoglutarate dehydrogenase, E1 component | 0 | At5g65750 | 1.44 |
| 1185 | 1186 | xylosidase | 0 | At5g49360 | 1.93 |
| 1187 | 1188 | ethylene responsive element binding factor 4 | 0 | At3g15210 | 1.7 |
| 1189 | 1190 | putative protein | 2E+00 | At5g46650 | 3.54 |
| 1191 | 1192 | eukaryotic protein synthesis initiation factor 4A | 0 | At3g13920 | 1.35 |
| 1193 | 1194 | Unknown protein | 0 | At1g76970 | 2.34 |
| 1195 | 1196 | hypothetical protein | 0 | At1g19380 | 1.54 |
| 1197 | 1198 | unknown protein | 0 | At5g49640 | 1.78 |
| 1199 | 1200 | putative xyloglucan-specific glucanase | 0 | At2g01850 | 1.58 |
| 1201 | 1202 | similar to nucellin gb|AAB96882.1 | 1E-106 | At1g49050 | 1.5 |
| 1203 | 1204 | unknown protein | 0 | At3g29390 | 1.33 |
| 1205 | 1206 | putative protein | 0 | At3g62190 | 1.58 |
| 1207 | 1208 | putative malate dehydrogenase | 0 | At1g04410 | 1.34 |
| 1209 | 1210 | putative isocitrate lyase | 1E-153 | At3g21720 | 3.08 |
| 1211 | 1212 | DNA-binding protein | 1E-160 | At3g14230 | 1.48 |
| 1213 | 1214 | histone H4-like protein | 0 | At3g46320 | 2.55 |
| 1215 | 1216 | putative dehydrogenase | 0 | At1g71170 | 1.47 |
| 1217 | 1218 | alanine - tRNA ligase, putative | 0 | At1g50200 | 1.38 |
| 1219 | 1220 | oligopeptidase A - like protein | 1E-172 | At5g10540 | 1.43 |
| 1221 | 1222 | putative protein | 0 | At5g62620 | 1.32 |
| 1223 | 1224 | permease | 0 | At5g49990 | 1.3 |
| 1225 | 1226 | DEAD BOX RNA helicase RH15 | 1E-129 | At5g11200 | 1.4 |
| 1227 | 1228 | lipoamide dehydrogenase precursor | 1E-128 | At3g17240 | 1.38 |
| 1229 | 1230 | hypothetical protein | 0 | At1g15170 | 1.75 |
| 1231 | 1232 | xyloglucan endo-1,4-beta-D-glucanase (XTR-6) | 0 | At4g25810 | 1.95 |
| 1233 | 1234 | histone H2B like protein (emb|CAA69025.1) | 7E-34 | At5g22880 | 1.91 |
| 1235 | 1236 | S-receptor kinase homolog 2 precursor | 1E+00 | At5g60900 | 2.61 |
| 1237 | 1238 | 60S ribosomal protein L2 | 7E-48 | At2g18020 | 1.58 |
| 1239 | 1240 | unknown protein | 0 | At1g23030 | 1.98 |
| 1241 | 1242 | zinc finger protein, putative | 0 | At1g34370 | 1.51 |
| 1243 | 1244 | putative protein | 3E-8 | At4g05150 | 1.38 |
| 1245 | 1246 | aldose 1-epimerase - like protein | 5E-25 | At3g47800 | 1.88 |
| 1247 | 1248 | cinnamoyl-CoA reductase - like protein | 0 | At5g58490 | 1.35 |
| 1249 | 1250 | putative NADP-dependent glyceraldehyde-3-phosphate dehydrogenase | 0 | At2g24270 | 1.43 |
| 1251 | 1252 | isp4 like protein | 0 | At4g16370 | 1.77 |
| 1253 | 1254 | putative protein | 0 | At4g08350 | 1.32 |
| 1255 | 1256 | calmodulin-related protein 2, touch-induced (TCH2) | 0 | At5g37770 | 1.55 |
| 1257 | 1258 | 20S proteasome subunit PAD2 (gb|AAC32059.1) | 0 | At5g66140 | 1.5 |
| 1259 | 1260 | glucosidase II alpha subunit | 0 | At5g63840 | 1.35 |
| 1261 | 1262 | putative GAR1 protein | 0 | At3g03920 | 1.74 |
| 1263 | 1264 | putative protein | 3E-45 | At5g08450 | 1.79 |
| 1265 | 1266 | glutamate dehydrogenase (EC 1.4.1.—) 1 (pir||S71217) | 0 | At5g18170 | 1.47 |
| 1267 | 1268 | putative protein | 0 | At5g06660 | 1.32 |
| 1269 | 1270 | Nonclathrin coat protein gamma - like protein | 1E-143 | At4g34450 | 1.43 |

TABLE 4-continued

Arabidopsis genes 1.3 fold or more upregulated in E2Fa/Dpa plants

| SEQ ID NO cDNA | SEQ ID NO PROT | Gene name | e_value | MIPS accession number | ratio |
|---|---|---|---|---|---|
| 1271 | 1272 | unknown protein | 0 | At3g17860 | 1.6 |
| 1273 | 1274 | similar to senescence-associated protein | 0 | At2g23810 | 1.59 |
| 1275 | 1276 | putative protein | 0 | At5g60420 | 1.31 |
| 1277 | 1278 | unknown protein | 0 | At1g28260 | 1.36 |
| 1279 | 1280 | shaggy-like protein kinase etha (EC 2.7.1.—) | 0 | At4g18710 | 1.37 |
| 1281 | 1282 | putative 26S protease regulatory subunit 6A | 0 | At1g09100 | 1.47 |
| 1283 | 1284 | unknown protein | 0 | At3g21140 | 1.49 |
| 1285 | 1286 | dynamin-like protein | 0 | At2g14120 | 1.4 |
| 1287 | 1288 | scarecrow-like 1 | 2E−47 | At1g21450 | 1.75 |
| 1289 | 1290 | unknown protein | 7E−40 | At3g02710 | 1.3 |
| 1291 | 1292 | putative protein | 0 | At5g50670 | 1.41 |
| 1293 | 1294 | helicase-like protein | 1E−108 | At5g44800 | 1.5 |
| 1295 | 1296 | dynamin-like protein 4 (ADL4) | 1E−100 | At3g60190 | 1.32 |
| 1297 | 1298 | unknown protein | 0 | At3g12790 | 1.31 |
| 1299 | 1300 | putative Tub family protein | 0 | At2g47900 | 1.37 |
| 1301 | 1302 | putative protein | 1E−119 | At5g13020 | 1.33 |
| 1303 | 1304 | alanine aminotransferase, putative | 1E−147 | At1g17290 | 1.36 |
| 1305 | 1306 | SCARECROW-like protein | 0 | At4g36710 | 1.49 |
| 1307 | 1308 | alpha galactosyltransferase-like protein | 0 | At3g62720 | 3.26 |
| 1309 | 1310 | putative protein | 0 | At4g31980 | 1.32 |
| 1311 | 1312 | putative protein | 1E−124 | At3g56480 | 1.34 |
| 1313 | 1314 | histone acetyltransferase HAT B | 0 | At5g56740 | 2.36 |
| 1315 | 1316 | putative phosphoribosyl pyrophosphate synthetase | 3E−97 | At2g44530 | 1.45 |
| 1317 | 1318 | AIG1 | 1E−130 | At1g33960 | 1.45 |
| 1319 | 1320 | hypothetical protein | 0 | At4g22190 | 1.69 |
| 1321 | 1322 | hypothetical protein | 0 | At1g26180 | 1.33 |
| 1323 | 1324 | putative protein | 4E−84 | At5g59000 | 1.61 |
| 1325 | 1326 | hypothetical protein | 0 | At2g27660 | 1.66 |
| 1327 | 1328 | unknown protein | 0 | At1g33400 | 1.38 |
| 1329 | 1330 | helicase-like protein | 0 | At5g44800 | 1.63 |
| 1331 | 1332 | putative protein | 0 | At5g44920 | 1.43 |
| 1333 | 1334 | putative RNA-binding protein | 0 | At1g22910 | 2.13 |
| 1335 | 1336 | meiosis specific - like protein | 0 | At5g02820 | 2.62 |
| 1337 | 1338 | isocitrate dehydrogenase - like protein | 0 | At5g14590 | 1.43 |
| 1339 | 1340 | hypothetical protein | 1E−139 | At1g15500 | 1.63 |
| 1341 | 1342 | putative protein | 3E−01 | At5g52270 | 1.38 |
| 1343 | 1344 | ABC transporter-like protein | 0 | At5g06530 | 1.63 |
| 1345 | 1346 | heat-shock protein 90, putative | 0 | At1g27640 | 1.48 |
| 1347 | 1348 | unknown protein | 0 | At3g07220 | 1.33 |
| 2713 | 2714 | large subunit of ribulose-1,5-bisphosphate carboxylase/oxygenase | | NP_051067 | 4.71 |
| 2715 | 2716 | ribosomal protein L33 | | NP_051080 | 3.54 |
| 2717 | 2718 | PSII I protein | | NP_051074 | 2.81 |
| 2719 | 2720 | ribosomal protein L2 | | NP_051099 | 2.61 |
| 2721 | 2722 | ATP-dependent protease subunit | | NP_051083 | 2.60 |
| 2723 | 2724 | cytochrome B6 | | NP_051088 | 2.55 |
| 2725 | 2726 | ATPase epsilon subunit | | NP_051065 | 2.17 |
| 2728 | 2729 | 26S ribosomal RNA protein | | NP_085475 | 2.87 |
| 2729 | 2730 | GATA Zn-finger protein | | At3g16870 | 2.75 |
| 2731 | 2732 | unknown protein | | At5g53740 | 2.01 |
| 2733 | 2734 | putative glucosyltransferase | | At2g15480 | 2.15 |
| 2735 | 2736 | Anthocyaninless2 | | At4g00730 | 2.73 |
| 2737 | 2738 | pectate lyase-like protein | | At3g54920 | 2.13 |
| 2739 | 2740 | putative sterol dehydrogenase | | At2g43420 | 2.10 |

***This accession number was replaced by a new annotation and called At1g36160

TABLE 5

Arabidopsis genes 1.3 times (1/ratio) or more repressed in E2Fa/Dpa plants

| SEQ ID NO cDNA | SEQ ID NO PROT | Gene name | E-value | MIPS accession Number | Ratio |
|---|---|---|---|---|---|
| 1349 | 1350 | putative glutathione peroxidase | 0 | At2g31570 | 0.51 |
| 1351 | 1352 | phenylalanine ammonia lyase (PAL1) | 0 | At2g37040 | 0.65 |
| 1353 | 1354 | unknown protein | 0 | At1g04040 | 0.62 |
| 1355 | 1356 | putative protein | 0 | At4g25340 | 0.52 |
| 1357 | 1358 | water channel - like protein | 1E−129 | At4g23400 | 0.7 |
| 1359 | 1360 | catalase | 0 | At4g35090 | 0.46 |

TABLE 5-continued

*Arabidopsis* genes 1.3 times (1/ratio) or more repressed in E2Fa/Dpa plants

| SEQ ID NO | | | | | |
|---|---|---|---|---|---|
| cDNA | PROT | Gene name | E-value | MIPS accession Number | Ratio |
| 1361 | 1362 | stearoyl-ACP desaturase | 2E−11 | At2g43710 | 0.54 |
| 1363 | 1364 | putative oligopeptide transporter | 0 | At4g10770 | 0.37 |
| 1365 | 1366 | putative chloroplast 50S ribosomal protein L28 | 0 | At2g33450 | 0.73 |
| 1367 | 1368 | ferredoxin - NADP reductase precursor, putative | 0 | At1g20020 | 0.64 |
| 1369 | 1370 | 3-beta-hydroxysteroid dehydrogenase | 1E−44 | At2g26260 | 0.73 |
| 1371 | 1372 | putative alanine aminotransferase | 1E−127 | At1g70580 | 0.51 |
| 1373 | 1374 | hypothetical protein | 4E−99 | At1g56500 | 0.66 |
| 1375 | 1376 | putative protein | 0 | At5g21940 | 0.64 |
| 1377 | 1378 | putative protein | 1E−158 | At5g26970 | 0.7 |
| 1379 | 1380 | actin depolymerizing factor 4 - like protein | 0 | At5g59890 | 0.66 |
| 1381 | 1382 | hypothetical protein | 7E−72 | At3g45160 | 0.5 |
| 1383 | 1384 | transporter-like protein | 1E−07 | At3g53960 | 0.68 |
| 1385 | 1386 | nicotianamine synthase (dbj|BAA74589.1) | 0 | At5g04950 | 0.35 |
| 1387 | 1388 | cytochrome P450 monooxygenase (CYP83A1) | 0 | At4g13770 | 0.39 |
| 1389 | 1390 | unknown protein | 0 | At2g29660 | 0.77 |
| 1391 | 1392 | hypothetical protein | 0 | At3g12580 | 0.56 |
| 1393 | 1394 | unknown protein | 0 | At5g64130 | 0.52 |
| 1395 | 1396 | putative protein | 0 | At3g61870 | 0.73 |
| 1397 | 1398 | fructose-bisphosphate aldolase - like protein | 0 | At4g26530 | 0.17 |
| 1399 | 1400 | lectin like protein | 1E−124 | At4g19840 | 0.74 |
| 1401 | 1402 | unknown protein | 0 | At1g28140 | 0.72 |
| 1403 | 1404 | feebly-like protein | 0 | At3g01420 | 0.73 |
| 1405 | 1406 | beta-fructosidase | 1E−105 | At1g62660 | 0.38 |
| 1407 | 1408 | unknown protein | 1E−06 | At1g15350 | 0.77 |
| 1409 | 1410 | peptidylprolyl isomerase ROC1 | 0 | At4g38740 | 0.76 |
| 1411 | 1412 | hypothetical protein | 1E−36 | At2g06010 | 0.74 |
| 1413 | 1414 | putative protein | 1E−114 | At4g30490 | 0.5 |
| 1415 | 1416 | 3-isopropylmalate dehydrogenase | 0 | At5g14200 | 0.61 |
| 1417 | 1418 | putative copper/zinc superoxide dismutase | 1E−93 | At2g28190 | 0.77 |
| 1419 | 1420 | putative myo-inositol 1-phosphate synthase | 0 | At2g22240 | 0.68 |
| 1421 | 1422 | putative enolase (2-phospho-D-glycerate hydroylase) | 0 | At2g29560 | 0.7 |
| 1423 | 1424 | unknown protein | 0 | At5g43750 | 0.4 |
| 1425 | 1426 | putative protein | 1E−22 | At4g32330 | 0.68 |
| 1427 | 1428 | putative ferredoxin-thioredoxin reductase | 0 | At2g04700 | 0.75 |
| 1429 | 1430 | hypothetical protein | 1E+00 | At3g23290 | 0.59 |
| 1431 | 1432 | putative cellulose synthase | 0 | At2g32530 | 0.58 |
| 1433 | 1434 | putative protein | 0 | At5g43650 | 0.54 |
| 1435 | 1436 | putative protein | 0 | At5g03010 | 0.58 |
| 1437 | 1438 | hypothetical protein | 0 | At1g78140 | 0.61 |
| 1439 | 1440 | unknown protein | 0 | At1g72590 | 0.35 |
| 1441 | 1442 | hypothetical protein | 0 | At1g54450 | 0.59 |
| 1443 | 1444 | hypothetical protein | 0 | At1g19110 | 0.73 |
| 1445 | 1446 | endo-beta-1,4-glucanase, putative | 0 | At1g75680 | 0.7 |
| 1447 | 1448 | unknown protein | 0 | At1g63010 | 0.76 |
| 1449 | 1450 | hypothetical protein | 2E−58 | At4g24700 | 0.57 |
| 1451 | 1452 | glyoxalase II | 0 | At1g53580 | 0.65 |
| 1453 | 1454 | putative protein | 0 | At3g52370 | 0.53 |
| 1455 | 1456 | unknown protein | 0 | At1g80280 | 0.57 |
| 1457 | 1458 | protein phosphatase ABI1 | 0 | At4g26080 | 0.71 |
| 1459 | 1460 | 33 kDa polypeptide of oxygen-evolving complex (OEC) in photosystem | 1E−115 | At5g66570 | 0.65 |
| 1461 | 1462 | beta-xylosidase | 1E−163 | At5g64570 | 0.55 |
| 1463 | 1464 | GDP-mannose pyrophosphorylase | 0 | At2g39770 | 0.62 |
| 1465 | 1466 | peroxidase ATP20a (emb|CAA67338.1) | 0 | At5g14130 | 0.67 |
| 1467 | 1468 | putative glutathione transferase | 0 | At1g17190 | 0.71 |
| 1469 | 1470 | putative protein | 0 | At4g38080 | 0.75 |
| 1471 | 1472 | unknown protein | 1E−179 | At1g61190 | 0.7 |
| 1473 | 1474 | 50S ribosomal protein L24, chloroplast precursor | 0 | At5g54600 | 0.76 |
| 1475 | 1476 | unknown protein | 1E−179 | At1g68260 | 0.55 |
| 1477 | 1478 | subtilisin-like serine proteinase, putative, 3' partial | 0 | At3g14067 | 0.62 |
| 1479 | 1480 | putative protein | 0 | At4g23890 | 0.59 |
| 1481 | 1482 | unknown protein | 0 | At3g01690 | 0.7 |
| 1483 | 1484 | putative protein | 0 | At3g56290 | 0.3 |
| 1485 | 1486 | unknown protein | 0 | At2g39450 | 0.67 |
| 1487 | 1488 | unknown protein | 0 | At5g64130 | 0.66 |
| 1489 | 1490 | putative protein | 0 | At4g30140 | 0.54 |
| 1491 | 1492 | ribulose bisphosphate carboxylase small chain 3b precursor (RuBisCO | 1E−145 | At5g38410 | 0.54 |
| 1493 | 1494 | Myb DNA binding protein - like | 0 | At3g46130 | 0.75 |
| 1495 | 1496 | putative 2-cys peroxiredoxin | 0 | At3g11630 | 0.64 |
| 1497 | 1498 | putative trypsin inhibitor | 0 | At1g73260 | 0.59 |
| 1499 | 1500 | O-methyltransferase | 1E−127 | At5g54160 | 0.62 |
| 1501 | 1502 | hypothetical protein | 2E−30 | At1g29270 | 0.73 |

TABLE 5-continued

*Arabidopsis* genes 1.3 times (1/ratio) or more repressed in E2Fa/Dpa plants

| SEQ ID NO | | | | | |
|---|---|---|---|---|---|
| cDNA | PROT | Gene name | E-value | MIPS accession Number | Ratio |
| 1503 | 1504 | RP19 gene for chloroplast ribosomal protein CL9 | 9E−67 | At3g44890 | 0.68 |
| 1505 | 1506 | putative phosphoglyceride transfer protein | 1E−178 | At4g08690 | 0.57 |
| 1507 | 1508 | putative protein | 0 | At5g63530 | 0.53 |
| 1509 | 1510 | putative protein | 0 | At5g38720 | 0.68 |
| 1511 | 1512 | hypothetical protein | 0 | At1g72030 | 0.68 |
| 1513 | 1514 | unknown protein | 9E−21 | At5g09990 | 0.67 |
| 1515 | 1516 | zinc finger protein ZAT7 | 0 | At3g46090 | 0.73 |
| 1517 | 1518 | putative nodulin | 0 | At3g05180 | 0.64 |
| 1619 | 1520 | putative wound-induced basic protein | 1E−160 | At3g07230 | 0.75 |
| 1521 | 1S22 | hypothetical protein | 0 | At4g02920 | 0.38 |
| 1523 | 1524 | putative protein | 1E−154 | At5g62220 | 0.73 |
| 1525 | 1526 | myosin heavy chain-like protein | 0 | At3g16000 | 0.5 |
| 1527 | 1528 | unknown protein | 0 | At1g09610 | 0.76 |
| 1529 | 1530 | arabinogalactan protein - like | 0 | At5g03170 | 0.71 |
| 1531 | 1532 | biotin carboxyl carrier protein of acetyl-CoA carboxylase precursor | 0 | At5g16390 | 0.69 |
| 1533 | 1534 | centrin | 0 | At3g50360 | 0.74 |
| 1535 | 1536 | vegetative storage protein Vsp1 | 0 | At5g24780 | 0.48 |
| 1537 | 1538 | protein kinase, putative | 1E−61 | At1g52310 | 0.63 |
| 1539 | 1540 | unknown protein | 1E−132 | At2g42760 | 0.63 |
| 1541 | 1542 | phenylalanine ammonia lyase (PAL1) | 0 | At2g37040 | 0.72 |
| 1543 | 1544 | UDP rhamnose-anthocyanidin-3-glucoside rhamnosyltransferase - like | 0 | At4g27560 | 0.45 |
| 1545 | 1546 | unknown protein | 0 | At2g17500 | 0.54 |
| 1547 | 1548 | NAC domain protein, putative | 0 | At1g01720 | 0.72 |
| 1549 | 1550 | ubiquitin-conjugating enzyme-like protein | 2E−24 | At5g56150 | 0.41 |
| 1551 | 1552 | putative RNA-binding protein | 1E−136 | At2g37220 | 0.72 |
| 1553 | 1554 | Overlap with bases 87, 142-90, 425 of 'IGF' BAC clone F9K20, accession | 0 | At1g78570 | 0.52 |
| 1555 | 1556 | hypothetical protein | 1E−105 | At2g04040 | 0.52 |
| 1557 | 1558 | lsp4-like protein | 4E−01 | At5g64410 | 0.39 |
| 1559 | 1560 | ids4-like protein | 0 | At5g20150 | 0.58 |
| 1561 | 1562 | unknown protein | 3E−98 | At1g44000 | 0.67 |
| 1563 | 1564 | R2R3-MYB transcription factor | 0 | At3g50060 | 0.66 |
| 1565 | 1566 | putative hexose transporter | 0 | At4g02050 | 0.68 |
| 1567 | 1568 | one helix protein (OHP) | 0 | At5g02120 | 0.57 |
| 1569 | 1570 | UDP-glucose dehydrogenase-like protein | 0 | At5g15490 | 0.74 |
| 1571 | 1572 | putative protein | 0 | At3g54260 | 0.63 |
| 1573 | 1574 | putative L5 ribosomal protein | 0 | At4g01310 | 0.75 |
| 1575 | 1576 | putative myosin heavy chain | 0 | At2g37080 | 0.61 |
| 1577 | 1578 | clpB heat shock protein-like | 0 | At5g15450 | 0.57 |
| 1579 | 1580 | unknown protein | 4E−71 | At1g52510 | 0.66 |
| 1581 | 1582 | beta-fructosidase, putative | 0 | At1g12240 | 0.55 |
| 1583 | 1584 | hypothetical protein | 0 | At1g47670 | 0.69 |
| 1585 | 1586 | putative protein | 3E−36 | At5g25890 | 0.75 |
| 1587 | 1588 | predicted protein | 1E−108 | At4g31390 | 0.73 |
| 1589 | 1590 | putative phospholipase | 0 | At2g39420 | 0.66 |
| 1591 | 1592 | ATP-dependent transmembrane transporter, putative | 0 | At1g51460 | 0.74 |
| 1593 | 1594 | H+-transporting ATP synthase-like protein | 0 | At4g09650 | 0.64 |
| 1595 | 1596 | putative protein | 0 | At4g29590 | 0.77 |
| 1597 | 1598 | unknown protein | 0 | At3g02640 | 0.49 |
| 1599 | 1600 | phosphoenolpyruvate carboxylase (PPC) | 0 | At3g14940 | 0.77 |
| 1601 | 1602 | pollen allergen-like protein | 0 | At1g24020 | 0.28 |
| 1603 | 1604 | putative AUX1-like permease | 0 | At1g77690 | 0.73 |
| 1605 | 1606 | putative protein | 1E−127 | At4g39730 | 0.49 |
| 1607 | 1608 | homeobox-leucine zipper protein ATHB-12 | 0 | At3g61890 | 0.24 |
| 1609 | 1610 | putative protein | 0 | At5g10160 | 0.53 |
| 1611 | 1612 | unknown protein | 0 | At1g71480 | 0.56 |
| 1613 | 1614 | putative violaxanthin de-epoxidase precursor (U44133) | 0 | At1g08550 | 0.7 |
| 1615 | 1616 | nClpP5, putative | 0 | At1g49970 | 0.68 |
| 1617 | 1618 | hypothetical protein | 0 | At1g65260 | 0.57 |
| 1619 | 1620 | putative protein | 1E−135 | At3g52360 | 0.38 |
| 1621 | 1622 | putative protein | 0 | At5g26260 | 0.5 |
| 1623 | 1624 | unknown protein | 0 | At1g25170 | 0.66 |
| 1625 | 1626 | hypothetical protein | 0 | At1g79550 | 0.65 |
| 1627 | 1628 | tubulin beta-2/beta-3 chain (sp|P29512) | 2E−21 | At5g62700 | 0.61 |
| 1629 | 1630 | eukaryotic translation initiation factor 4E, putative | 0 | At1g29550 | 0.64 |
| 1631 | 1632 | transport inhibitor response 1, putative | 1E−175 | At1g12820 | 0.77 |
| 1633 | 1634 | osmotin precursor | 1E−110 | At4g11650 | 0.74 |
| 1635 | 1636 | putative glutathione S-transferase TSI-1 | 0 | At1g10360 | 0.72 |
| 1637 | 1638 | protein ch-42 precursor, chloroplast | 0 | At4g18480 | 0.76 |
| 1639 | 1640 | omega-3 fatty acid desaturase | 2E−06 | At2g29980 | 0.73 |
| 1641 | 1642 | unknown protein | 0 | At2g44670 | 0.57 |

TABLE 5-continued

*Arabidopsis* genes 1.3 times (1/ratio) or more repressed in E2Fa/Dpa plants

| SEQ ID NO | | | | | |
|---|---|---|---|---|---|
| cDNA | PROT | Gene name | E-value | MIPS accession Number | Ratio |
| 1643 | 1644 | putative protein | 0 | At3g55330 | 0.51 |
| 1645 | 1646 | putative calmodulin | 0 | At3g51920 | 0.55 |
| 1647 | 1648 | plastid ribosomal protein L34 precursor, putative | 1E−140 | At1g29070 | 0.69 |
| 1649 | 1650 | putative protein | 0 | At5g67070 | 0.66 |
| 1651 | 1652 | putative 2Fe-2S iron-sulfur cluster protein | 0 | At3g16250 | 0.69 |
| 1653 | 1654 | hypothetical protein | 0 | At1g42970 | 0.69 |
| 1655 | 1656 | hypothetical protein | 3E−69 | At3g14190 | 0.6 |
| 1657 | 1658 | thylakoid luminal protein | 1E−122 | At1g77090 | 0.7 |
| 1659 | 1660 | putative protein | 0 | At3g48420 | 0.42 |
| 1661 | 1662 | actin 3 | 0 | At2g37620 | 0.64 |
| 1663 | 1664 | OEP8 like protein | 4E−38 | At4g15800 | 0.73 |
| 1665 | 1666 | putative Ras-like GTP-binding protein | 0 | At3g09910 | 0.71 |
| 1667 | 1668 | sulfolipid biosynthesis protein SQD1 | 0 | At4g33030 | 0.68 |
| 1669 | 1670 | oleosin isoform | 0 | At3g27660 | 0.61 |
| 1671 | 1672 | acyl-CoA synthetase, putative | 0 | At1g64400 | 0.59 |
| 1673 | 1674 | putative protein | 1E−147 | At3g61060 | 0.5 |
| 1675 | 1676 | hypothetical protein | 1E−117 | At1g56200 | 0.64 |
| 1677 | 1678 | putative protein | 0 | At4g13500 | 0.53 |
| 1679 | 1680 | cinnamoyl CoA reductase, putative | 0 | At1g80820 | 0.72 |
| 1681 | 1682 | hypothetical protein | 1E−157 | At4g28410 | 0.1 |
| 1683 | 1684 | hypothetical protein | 0 | At1g54030 | 0.68 |
| 1685 | 1686 | putative DNA-binding protein, GT-1 | 0 | At3g25990 | 0.1 |
| 1687 | 1688 | germin-like protein | 3E−04 | At3g05950 | 0.49 |
| 1689 | 1690 | putative glutathione S-transferase | 0E+00 | At2g29480 | 0.7 |
| 1691 | 1692 | arabinogalactan-protein (gb\|AAC77823.1) | 1E−06 | At5g64310 | 0.61 |
| 1693 | 1694 | periaxin - like protein | 1E−151 | At5g09530 | 0.71 |
| 1695 | 1696 | zeaxanthin epoxidase precursor | 0 | At5g67030 | 0.52 |
| 1697 | 1698 | putative photosystem I reaction center subunit IV | 0 | At2g20260 | 0.7 |
| 1699 | 1700 | putative 60S ribosomal protein L18A | 0 | At3g14600 | 0.74 |
| 1701 | 1702 | putative ethylene response element binding protein (EREBP) | 0 | At2g44840 | 0.72 |
| 1703 | 1704 | unknown protein | 0 | At2g21970 | 0.5 |
| 1705 | 1706 | RNA-binding protein cp33 precursor | 0 | At3g52380 | 0.73 |
| 1707 | 1708 | unknown protein | 1E−152 | At2g34460 | 0.62 |
| 1709 | 1710 | CONSTANS-like 1 | 1E−179 | At5g15850 | 0.6 |
| 1711 | 1712 | unknown protein | 0 | At1g75100 | 0.77 |
| 1713 | 1714 | ion channel | 9E−66 | At1g15990 | 0.57 |
| 1715 | 1716 | unknown protein | 0 | At2g21960 | 0.46 |
| 1717 | 1718 | unknown protein | 0 | At1g66330 | 0.69 |
| 1719 | 1720 | putative protein | 0 | At4g26630 | 0.68 |
| 1721 | 1722 | unknown protein | 1E−99 | At3g28230 | 0.72 |
| 1723 | 1724 | hypothetical protein | 1E−65 | At1g55910 | 0.65 |
| 1725 | 1726 | putative Na+-dependent inorganic phosphate cotransporter | 0 | At2g29650 | 0.52 |
| 1727 | 1728 | hypothetical protein | 4E−23 | At1g02330 | 0.71 |
| 1729 | 1730 | hypothetical protein | 0 | At1g29700 | 0.55 |
| 1731 | 1732 | putative flavonol 3-O-glucosyltransferase | 0 | At2g18560 | 0.62 |
| 1733 | 1734 | lycopene epsilon cyclase | 0 | At5g57030 | 0.6 |
| 1735 | 1736 | hypothetical protein | 0 | At3g09150 | 0.75 |
| 1737 | 1738 | putative protein | 1E−150 | At1g31710 | 0.5 |
| 1739 | 1740 | hypothetical protein | 0 | At1g78850 | 0.69 |
| 1741 | 1742 | putative protein | 0 | At4g32770 | 0.75 |
| 1743 | 1744 | putative protein | 2E−77 | At4g22890 | 0.75 |
| 1745 | 1746 | ripening-related protein - like | 0 | At5g20740 | 0.59 |
| 1747 | 1748 | putative peroxidase ATP12a | 0 | At1g05240 | 0.65 |
| 1749 | 1750 | hypothetical protein | 7E−18 | At4g01050 | 0.77 |
| 1751 | 1752 | V-ATPase subunit G (vag2 gene) | 4E−04 | At4g23710 | 0.61 |
| 1753 | 1754 | hypothetical protein | 0 | At1g58080 | 0.75 |
| 1755 | 1756 | putative protein | 2E−94 | At5g19190 | 0.51 |
| 1757 | 1758 | hypothetical protein | 0 | At1g48850 | 0.69 |
| 1759 | 1760 | putative protein | 0 | At4g38800 | 0.75 |
| 1761 | 1762 | similar to polygalacturonase-like protein | 0 | At1g10640 | 0.28 |
| 1763 | 1764 | putative glutathione S-transferase | 0 | At2g02390 | 0.73 |
| 1765 | 1766 | putative calcium-binding EF-hand protein | 3E−78 | At2g33380 | 0.69 |
| 1767 | 1768 | unknown protein | 1E−113 | At1g64680 | 0.57 |
| 1769 | 1770 | unknown protein | 0 | At3g15660 | 0.58 |
| 1771 | 1772 | putative protein | 0 | At5g22080 | 0.74 |
| 1773 | 1774 | high mobility group protein 2-like | 2E−24 | At3g51880 | 0.71 |
| 1775 | 1776 | similar to late embryogenesis abundant proteins | 4E−50 | At2g44060 | 0.61 |
| 1777 | 1778 | putative protein | 0 | At4g34600 | 0.74 |
| 1779 | 1780 | putative protein | 2E−31 | At5g52060 | 0.48 |
| 1781 | 1782 | NADPH oxidoreductase, putative | 0 | At1g75280 | 0.53 |
| 1783 | 1784 | hypothetical protein | 0 | At1g16720 | 0.62 |
| 1785 | 1786 | unknown protein | 0 | At3g28130 | 0.75 |
| 1787 | 1788 | glutaredoxin | 0 | At4g15690 | 0.73 |

TABLE 5-continued

*Arabidopsis* genes 1.3 times (1/ratio) or more repressed in E2Fa/Dpa plants

| SEQ ID NO | | | | | |
|---|---|---|---|---|---|
| cDNA | PROT | Gene name | E-value | MIPS accession Number | Ratio |
| 1789 | 1790 | putative protein | 4E−01 | At3g47590 | 0.66 |
| 1791 | 1792 | putative protein | 0 | At4g26630 | 0.7 |
| 1793 | 1794 | putative polyprotein | 1E−139 | At4g04410 | 0.76 |
| 1795 | 1796 | MTN3-like protein | 0 | At3g48740 | 0.49 |
| 1797 | 1798 | hypothetical protein | 0 | At1g32900 | 0.38 |
| 1799 | 1800 | unknown protein | 0 | At2g33180 | 0.77 |
| 1801 | 1802 | hypothetical protein | 0 | At1g66890 | 0.69 |
| 1803 | 1804 | unknown protein | 0 | At1g74730 | 0.74 |
| 1805 | 1806 | putative ribosomal protein S9 | 1E−122 | At1g74970 | 0.7 |
| 1807 | 1808 | phenylalanine ammonia-lyase | 3E−51 | At3g53260 | 0.53 |
| 1809 | 1810 | unknown protein | 2E−27 | At1g78110 | 0.76 |
| 1811 | 1812 | unknown protein | 0 | At1g18300 | 0.75 |
| 1813 | 1814 | putative prolylcarboxypeptidase | 1E−174 | At2g24280 | 0.64 |
| 1815 | 1816 | unknown protein | 1E−12 | At3g24100 | 0.76 |
| 1817 | 1818 | unknown protein | 0 | At3g18990 | 0.39 |
| 1819 | 1820 | hypothetical protein | 1E−127 | At1g78890 | 0.75 |
| 1821 | 1822 | unknown protein | 5E−87 | At2g21530 | 0.71 |
| 1823 | 1824 | hypothetical protein | 1E−172 | At1g20340 | 0.71 |
| 1825 | 1826 | putative glucosyltransferase | 0 | At2g31790 | 0.63 |
| 1827 | 1828 | allergen like protein | 1E−129 | At4g17030 | 0.74 |
| 1829 | 1830 | unknown protein | 0 | At1g73750 | 0.72 |
| 1831 | 1832 | APG5 (autophagy 5)-like protein | 0 | At5g17290 | 0.7 |
| 1833 | 1834 | putative protochlorophyllide reductase | 0 | At1g03630 | 0.57 |
| 1835 | 1836 | zinc finger protein, putative | 0 | At3g19580 | 0.61 |
| 1837 | 1838 | unknown protein | 0 | At2g35190 | 0.65 |
| 1839 | 1840 | phosphate/triose-phosphate translocator precursor (gb|AAC83815.1) | 4E−33 | At5g46110 | 0.73 |
| 1841 | 1842 | unknown protein | 0 | At5g50840 | 0.77 |
| 1843 | 1844 | hypothetical protein | 0 | At4g34090 | 0.69 |
| 1845 | 1846 | hypothetical protein | 0 | At1g14340 | 0.64 |
| 1847 | 1848 | unknown protein | 0 | At1g67860 | 0.42 |
| 1849 | 1850 | tyrosine transaminase like protein | 1E−180 | At4g23600 | 0.47 |
| 1851 | 1852 | unknown protein | 1E−173 | At1g53890 | 0.53 |
| 1853 | 1854 | pectinesterase, putative | 0 | At1g41830 | 0.76 |
| 1855 | 1856 | putative protein | 4E−72 | At5g45550 | 0.69 |
| 1857 | 1858 | putative ligand-gated ion channel subunit | 2E+00 | At2g32400 | 0.45 |
| 1859 | 1860 | unknown protein | 0 | At3g19370 | 0.42 |
| 1861 | 1862 | putative protein | 5E−13 | At5g62580 | 0.59 |
| 1863 | 1864 | putative protein | 0 | At3g61080 | 0.42 |
| 1865 | 1866 | putative squamosa-promoter binding protein 2 | 1E−162 | At1g27360 | 0.74 |
| 1867 | 1868 | sucrose-phosphate synthase - like protein | 0 | At4g10120 | 0.22 |
| 1869 | 1870 | hypothetical protein | 4E−23 | At1g62180 | 0.43 |
| 1871 | 1872 | ribosomal protein | 0 | At4g15000 | 0.75 |
| 1873 | 1874 | MYB-related transcription factor (CCA1) | 0 | At2g46830 | 0.46 |
| 1875 | 1876 | pinoresinol-lariciresinol reductase, putative | 1E−124 | At1g32100 | 0.72 |
| 1877 | 1878 | putative protein | 0 | At3g52230 | 0.71 |
| 1879 | 1880 | 3-keto-acyl-CoA thiolase 2 (gb|AAC17877.1) | 0 | At5g48880 | 0.57 |
| 1881 | 1882 | putative protein | 0 | At3g46780 | 0.63 |
| 1883 | 1884 | DNA-binding protein, putative | 0 | At1g01060 | 0.62 |
| 1885 | 1886 | putative protein | 3E−20 | At4g30990 | 0.6 |
| 1887 | 1888 | putative protein | 0 | At3g46780 | 0.59 |
| 1889 | 1890 | hypothetical protein | 1E−174 | At1g28400 | 0.58 |
| 1891 | 1892 | DNA binding protein - like | 0 | At5g61600 | 0.55 |
| 1893 | 1894 | putative protein | 0 | At3g62260 | 0.72 |
| 1895 | 1896 | putative CCCH-type zinc finger protein | 0 | At2g25900 | 0.63 |
| 1897 | 1898 | ubiquitin-conjugating enzyme E2-17 kD 8 (ubiquitin-protein ligase | 3E−16 | At5g41700 | 0.42 |
| 1899 | 1900 | microbody NAD-dependent malate dehydrogenase | 0 | At5g09660 | 0.63 |
| 1901 | 1902 | glyceraldehyde 3-phosphate dehydrogenase A subunit (GapA) | 0 | At3g26650 | 0.63 |
| 1903 | 1904 | microbody NAD-dependent malate dehydrogenase | 0 | At5g09660 | 0.66 |
| 1905 | 1906 | sedoheptulose-bisphosphatase precursor | 0 | At3g55800 | 0.54 |
| 1907 | 1908 | putative Fe(II) transporter | 1E−175 | At2g32270 | 0.74 |
| 1909 | 1910 | germin - like protein | 0 | At5g38940 | 0.75 |
| 1911 | 1912 | putative malonyl-CoA: Acyl carrier protein transacylase | 0 | At2g30200 | 0.7 |
| 1913 | 1914 | hypothetical protein | 0 | At1g19000 | 0.61 |
| 1915 | 1916 | FRO1-like protein; NADPH oxidase-like | 0 | At5g49740 | 0.41 |
| 1917 | 1918 | J8-like protein | 0 | At1g80920 | 0.51 |
| 1919 | 1920 | putative protein | 0 | At4g34190 | 0.63 |
| 1921 | 1922 | photosystem II stability/assembly factor HCF136 (sp|O82660) | 0 | At5g23120 | 0.66 |
| 1923 | 1924 | hypothetical protein | 0 | At4g24930 | 0.63 |
| 1925 | 1926 | 2-cys peroxiredoxin-like protein | 0 | At5g06290 | 0.69 |
| 1927 | 1928 | putative protein | 0 | At3g53470 | 0.54 |
| 1929 | 1930 | unknown protein | 3E−96 | At3g02180 | 0.71 |
| 1931 | 1932 | F12P19.7 | 0 | At1g65900 | 0.69 |

TABLE 5-continued

*Arabidopsis* genes 1.3 times (1/ratio) or more repressed in E2Fa/Dpa plants

| SEQ ID NO | | | | | |
|---|---|---|---|---|---|
| cDNA | PROT | Gene name | E-value | MIPS accession Number | Ratio |
| 1933 | 1934 | putative fibrillin | 0 | At4g04020 | 0.28 |
| 1935 | 1936 | putative protein | 1E−01 | At4g18810 | 0.72 |
| 1937 | 1938 | hypothetical protein | 1E−171 | At1g50240 | 0.67 |
| 1939 | 1940 | putative protein | 0 | At3g63210 | 0.76 |
| 1941 | 1942 | unknown protein | 0 | At2g32870 | 0.47 |
| 1943 | 1944 | Glucose-1-phosphate adenylyltransferase (ApL1/adg2) | 0 | At5g19220 | 0.64 |
| 1945 | 1946 | unknown protein | 1E−66 | At2g46100 | 0.67 |
| 1947 | 1948 | farnesyl diphosphate synthase precursor (gb|AAB49290.1) | 0 | At5g47770 | 0.71 |
| 1949 | 1950 | pyridoxine biosynthesis protein - like | 0 | At5g01410 | 0.47 |
| 1951 | 1952 | hypothetical protein | 0 | At4g03820 | 0.71 |
| 1953 | 1954 | putative myrosinase-binding protein | 1E−47 | At2g39310 | 0.38 |
| 1955 | 1956 | unknown protein | 0 | At1g05870 | 0.44 |
| 1957 | 1958 | heat shock protein, putative | 0 | At1g06460 | 0.28 |
| 1959 | 1960 | RIBOSOMAL PROTEIN, putative | 1E−175 | At1g71720 | 0.76 |
| 1961 | 1962 | elongation factor G, putative | 0 | At1g62750 | 0.65 |
| 1963 | 1964 | mitochondrial Lon protease homolog 1 precursor (sp|O64948) | 0 | At5g47040 | 0.76 |
| 1965 | 1966 | cytochrome c | 2E−37 | At4g10040 | 0.72 |
| 1967 | 1968 | hypothetical protein | 1E−102 | At4g03420 | 0.69 |
| 1969 | 1970 | putative DnaJ protein | 1E−160 | At2g41000 | 0.73 |
| 1971 | 1972 | hypothetical protein | 0 | At2g27290 | 0.61 |
| 1973 | 1974 | putative protein | 1E−117 | At5g50100 | 0.4 |
| 1975 | 1976 | phytoene synthase (gb|AAB65697.1) | 0 | At5g17230 | 0.64 |
| 1977 | 1978 | putative protein | 0 | At4g28230 | 0.73 |
| 1979 | 1980 | hypothetical protein | 0 | At2g01260 | 0.49 |
| 1981 | 1982 | unknown protein | 0 | At3g17520 | 0.71 |
| 1983 | 1984 | Ran binding protein (AtRanBP1b) | 0 | At2g30060 | 0.73 |
| 1985 | 1986 | putative protein | 0 | At4g32190 | 0.63 |
| 1987 | 1988 | unknown protein | 0 | At1g19400 | 0.64 |
| 1989 | 1990 | sucrose-phosphate synthase-like protein | 0 | At5g20280 | 0.67 |
| 1991 | 1992 | putative protein | 1E−136 | At5g03545 | 0.45 |
| 1993 | 1994 | biotin carboxyl carrier protein precursor-like protein | 1E−124 | At5g15530 | 0.54 |
| 1995 | 1996 | unknown protein | 4E−85 | At1g16320 | 0.53 |
| 1997 | 1998 | unknown protein | 5E−16 | At3g32930 | 0.68 |
| 1999 | 2000 | putative protein | 1E−142 | At4g35290 | 0.74 |
| 2001 | 2002 | glutathione S-transferase-like protein | 0 | At5g17220 | 0.66 |
| 2003 | 2004 | fructose 1,6-bisphosphatase, putative | 0 | At1g43670 | 0.63 |
| 2005 | 2006 | peptidylprolyl isomerase-like protein | 2E−34 | At5g13120 | 0.72 |
| 2007 | 2008 | teosinte branched1 - like protein | 0 | At4g18390 | 0.63 |
| 2009 | 2010 | putative protein | 0 | At3g51520 | 0.71 |
| 2011 | 2012 | lactoylglutathione lyase-like protein | 0 | At1g11840 | 0.45 |
| 2013 | 2014 | late embryogenesis abundant protein LEA like | 0 | At5g06760 | 0.55 |
| 2015 | 2016 | putative protein | 1E−177 | At5g19590 | 0.71 |
| 2017 | 2018 | putative protein | 0 | At3g63190 | 0.72 |
| 2019 | 2020 | hypothetical protein | 0 | At1g69510 | 0.47 |
| 2021 | 2022 | putative protein kinase | 0 | At2g30040 | 0.69 |
| 2023 | 2024 | xyloglucan endo-transglycosylase | 0 | At3g44990 | 0.43 |
| 2025 | 2026 | phospholipid hydroperoxide glutathione peroxidase | 0 | At4g11600 | 0.71 |
| 2027 | 2028 | sedoheptulose-bisphosphatase precursor | 0 | At3g55800 | 0.51 |
| 2029 | 2030 | Clp proteinase like protein | 2E−55 | At4g17040 | 0.75 |
| 2031 | 2032 | unknown protein | 0 | At5g07020 | 0.68 |
| 2033 | 2034 | unknown protein | 2E−32 | At5g51720 | 0.49 |
| 2035 | 2036 | endomembrane protein, putative | 1E−117 | At1g14670 | 0.75 |
| 2037 | 2038 | putative phosphomannomutase | 0 | At2g45790 | 0.66 |
| 2039 | 2040 | putative protein | 1E−95 | At4g27280 | 0.46 |
| 2041 | 2042 | mrp protein, putative | 0 | At3g24430 | 0.75 |
| 2043 | 2044 | putative vacuolar ATPase | 0 | At4g02620 | 0.74 |
| 2045 | 2046 | phosphate transporter, putative | 0 | At3g26570 | 0.61 |
| 2047 | 2048 | similar to Trp Asp repeat protein emb|CAB39845.1; similar to EST | 0 | At1g78070 | 0.74 |
| 2049 | 2050 | putative MAP kinase | 2E−18 | At2g01450 | 0.51 |
| 2051 | 2052 | ethylene-responsive transcriptional coactivator, putative | 0 | At3g24500 | 0.51 |
| 2053 | 2054 | 6-phosphogluconolactonase-like protein | 0 | At5g24420 | 0.52 |
| 2055 | 2056 | beta-amylase-like proten | 1E−175 | At5g18670 | 0.4 |
| 2057 | 2058 | hypothetical protein | 3E−53 | At1g20970 | 0.72 |
| 2059 | 2060 | chloroplast 50S ribosomal protein L31, putative | 0 | At1g75350 | 0.74 |
| 2061 | 2062 | cytochrome P450-like protein | 0 | At4g37320 | 0.67 |
| 2063 | 2064 | putative potassium transporter AtKT5p (AtKT5) | 0 | At4g33530 | 0.76 |
| 2065 | 2666 | putative ribosomal-protein S6 kinase (ATPK6) | 0 | At3g08730 | 0.63 |
| 2067 | 2068 | hypothetical protein | 0 | At1g04770 | 0.68 |
| 2069 | 2070 | transcription factor Hap5a | 6E−74 | At3g48590 | 0.6 |
| 2071 | 2072 | putative protein | 0 | At5g20070 | 0.69 |
| 2073 | 2074 | beta-expansin | 0 | At2g20750 | 0.72 |
| 2075 | 2076 | SOUL-like protein | 4E−82 | At1g17100 | 0.71 |
| 2077 | 2078 | unknown protein | 0 | At1g70760 | 0.4 |

TABLE 5-continued

*Arabidopsis* genes 1.3 times (1/ratio) or more repressed in E2Fa/Dpa plants

| SEQ ID NO | | | | | |
|---|---|---|---|---|---|
| cDNA | PROT | Gene name | E-value | MIPS accession Number | Ratio |
| 2079 | 2080 | unknown protein | 1E−124 | At2g20890 | 0.73 |
| 2081 | 2082 | unknown protein | 1E−160 | At1g07280 | 0.72 |
| 2083 | 2084 | unknown protein | 0 | At1g64680 | 0.65 |
| 2085 | 2086 | ADPG pyrophosphorylase small subunit (gb|AAC39441.1) | 0 | At5g48300 | 0.68 |
| 2087 | 2088 | unknown protein | 0 | At2g17340 | 0.61 |
| 2089 | 2090 | hypothetical protein | 0 | At1g26800 | 0.74 |
| 2091 | 2092 | unknown protein | 0 | At1g22930 | 0.67 |
| 2093 | 2094 | polyphosphoinositide binding protein, putative | 0 | At1g01630 | 0.72 |
| 2095 | 2096 | caffeoyl-CoA O-methyltransferase - like protein | 0 | At4g34050 | 0.67 |
| 2097 | 2098 | pectinesterase | 0 | At5g53370 | 0.56 |
| 2099 | 2100 | unknown protein | 7E−75 | At1g64370 | 0.43 |
| 2101 | 2102 | p-nitrophenylphosphatase-like protein | 0 | At5g36790 | 0.52 |
| 2103 | 2104 | putative protein | 1E−172 | At5g55960 | 0.64 |
| 2105 | 2106 | serine/threonine protein kinase - like protein | 0 | At5g10930 | 0.26 |
| 2107 | 2108 | cytosolic factor, putative | 0 | At1g72160 | 0.67 |
| 2109 | 2110 | S-adenosylmethionine: 2-demethylmenaquinone methyltransferase-like | 1E−159 | At5g56260 | 0.76 |
| 2111 | 2112 | pactate lyase | 0 | At5g63180 | 0.67 |
| 2113 | 2114 | vacuolar sorting receptor-like protein | 0 | At4g20110 | 0.7 |
| 2115 | 2116 | putative membrane channel protein | 0 | At2g28900 | 0.76 |
| 2117 | 2118 | putative thylakoid lumen rotamase | 0 | At3g01480 | 0.56 |
| 2119 | 2120 | putative chloroplast prephenate dehydratase | 0 | At3g44720 | 0.73 |
| 2121 | 2122 | 3-oxoacyl-[acyl-carrier-protein] synthase I precursor | 0 | At5g46290 | 0.76 |
| 2123 | 2124 | P-Protein - like protein | 1E−108 | At4g33010 | 0.73 |
| 2125 | 2126 | NHE1 Na+/H+ exchanger | 1E−122 | At5g27150 | 0.73 |
| 2127 | 2128 | receptor kinase-like protein | 0 | At3g47580 | 0.72 |
| 2129 | 2130 | raffinose synthase - like protein | 0 | At5g40390 | 0.59 |
| 2131 | 2132 | thylakoid luminal protein | 0 | At1g54780 | 0.63 |
| 2133 | 2134 | unknown protein | 0 | At2g46170 | 0.73 |
| 2135 | 2136 | beta-xylan endohydrolase - like protein | 9E−02 | At4g33810 | 0.26 |
| 2137 | 2138 | putative protein | 1E−137 | At4g12700 | 0.6 |
| 2139 | 2140 | putative ribose 5-phosphate isomerase | 0 | At3g04790 | 0.76 |
| 2141 | 2142 | putative protein | 0 | At5g47840 | 0.7 |
| 2143 | 2144 | putative RNA-binding protein | 0 | At1g09340 | 0.57 |
| 2145 | 2146 | adenine phosphoribosyltransferase (EC 2.4.2.7) - like protein | 0 | At4g22570 | 0.46 |
| 2147 | 2148 | unknown protein | 0 | At3g15950 | 0.37 |
| 2149 | 2150 | putative glutathione peroxidase | 7E−12 | At2g25080 | 0.46 |
| 2151 | 2152 | putative protein | 0 | At5g23060 | 0.63 |
| 2153 | 2154 | pectate lyase 1-like protein | 0 | At1g67750 | 0.42 |
| 2155 | 2156 | putative triosephosphate isomerase | 9E−61 | At2g21170 | 0.66 |
| 2157 | 2158 | carbonate dehydratase - like protein | 0 | At4g33580 | 0.72 |
| 2159 | 2160 | putative protein | 0 | At5g37300 | 0.56 |
| 2161 | 2162 | putative protein | 1E−143 | At3g60080 | 0.77 |
| 2163 | 2164 | cystatin (emb|CAA03929.1) | 2E−83 | At5g12140 | 0.74 |
| 2165 | 2166 | putative cytochrome b5 | 0 | At2g46650 | 0.46 |
| 2167 | 2168 | putaive DNA-binding protein | 2E−08 | At4g31550 | 0.63 |
| 2169 | 2170 | hypothetical protein | 1E−143 | At3g21050 | 0.5 |
| 2171 | 2172 | putative beta-hydroxyacyl-ACP dehydratase | 0 | At2g22230 | 0.59 |
| 2173 | 2174 | 2-oxoglutarate/malate translocator | 0 | At5g64290 | 0.77 |
| 2175 | 2176 | hypothetical protein | 1E−123 | At3g27050 | 0.49 |
| 2177 | 2178 | putative alcohol dehydrogenase | 9E−64 | At2g37770 | 0.64 |
| 2179 | 2180 | hypothetical protein | 1E−107 | At1g18730 | 0.67 |
| 2181 | 2182 | putative pectinacetylesterase | 0 | At4g19420 | 0.71 |
| 2183 | 2184 | similar to ADP-ribosylation factor gb|AAD17207; similar to ESTs | 2E−80 | At1g10630 | 0.67 |
| 2185 | 2186 | hypothetical protein | 0 | At1g04420 | 0.67 |
| 2187 | 2188 | putative protein | 0 | At4g26710 | 0.62 |
| 2189 | 2190 | putative protein | 0 | At4g34630 | 0.72 |
| 2191 | 2192 | latex protein | 0 | At1g70890 | 0.29 |
| 2193 | 2194 | RCc3 - like protein | 0 | At4g22490 | 0.57 |
| 2195 | 2196 | hypothetical protein | 5E−53 | At1g20450 | 0.49 |
| 2197 | 2198 | glucosyltransferase-like protein | 3E−31 | At5g22740 | 0.65 |
| 2199 | 2200 | glutathione S-transferase | 0 | At2g29450 | 0.52 |
| 2201 | 2202 | putative protein | 0 | At3g44450 | 0.59 |
| 2203 | 2204 | cysteine synthase | 0 | At5g28020 | 0.6 |
| 2205 | 2206 | ATP synthase | 0 | At4g04640 | 0.57 |
| 2207 | 2208 | 40S ribosomal protein S14 | 1E−25 | At2g36160 | 0.67 |
| 2209 | 2210 | putative protein | 0 | At4g19100 | 0.76 |
| 2211 | 2212 | K Efflux antiporter KEA1 | 0 | At1g01790 | 0.65 |
| 2213 | 2214 | hypothetical protein | 1E−169 | At2g42980 | 0.66 |
| 2215 | 2216 | cytochrome P450 like protein | 1E−01 | At4g36380 | 0.48 |
| 2217 | 2218 | unknown protein | 8E−64 | At2g01520 | 0.23 |
| 2219 | 2220 | hypothetical protein | 1E−157 | At1g07130 | 0.66 |
| 2221 | 2222 | putative protein | 5E−04 | At5g09620 | 0.62 |

TABLE 5-continued

Arabidopsis genes 1.3 times (1/ratio) or more repressed in E2Fa/Dpa plants

| SEQ ID NO | | | | | |
|---|---|---|---|---|---|
| cDNA | PROT | Gene name | E-value | MIPS accession Number | Ratio |
| 2223 | 2224 | unknown protein | 0 | At1g08470 | 0.66 |
| 2225 | 2226 | putative protein | 6E−37 | At3g54600 | 0.7 |
| 2227 | 2228 | DnaJ - like protein | 1E−68 | At4g39960 | 0.52 |
| 2229 | 2230 | putative protein phosphatase 2C | 1E−161 | At1g78200 | 0.72 |
| 2231 | 2232 | biotin synthase (Bio B) | 0 | At2g43360 | 0.67 |
| 2233 | 2234 | unknown protein | 3E−69 | At3g17510 | 0.55 |
| 2235 | 2236 | high mobility group protein 2-like | 1E−107 | At3g51880 | 0.66 |
| 2237 | 2238 | putative proline-rich protein | 0 | At2g21140 | 0.57 |
| 2239 | 2240 | cyclin delta-3 | 0 | At4g34160 | 0.74 |
| 2241 | 2242 | serine carboxypeptidase II - like protein | 0 | At4g30810 | 0.77 |
| 2243 | 2244 | unknown protein | 0 | At1g67330 | 0.7 |
| 2245 | 2246 | putative protein | 7E−93 | At3g56010 | 0.7 |
| 2247 | 2248 | GTP-binding protein LepA homolog | 0 | At5g08650 | 0.76 |
| 2249 | 2250 | unknown protein | 0 | At3g10420 | 0.42 |
| 2251 | 2252 | putative protein | 0 | At3g51510 | 0.58 |
| 2253 | 2254 | putative protein | 0 | At3g45870 | 0.73 |
| 2255 | 2256 | putative enolase | 0 | At1g74030 | 0.65 |
| 2257 | 2258 | putative protein | 3E−05 | At5g11680 | 0.71 |
| 2259 | 2260 | putative protein | 0 | At5g26280 | 0.58 |
| 2261 | 2262 | O-methyltransferase, putative | 0 | At1g21100 | 0.63 |
| 2263 | 2264 | beta-1,3-glucanase class I precursor | 0 | At4g16260 | 0.51 |
| 2265 | 2266 | protein phosphatase 2C (PP2C) | 2E−27 | At3g11410 | 0.67 |
| 2267 | 2268 | root cap protein 2-like protein | 1E−174 | At5g54370 | 0.75 |
| 2269 | 2270 | putative adenosine phosphosulfate kinase | 0 | At2g14750 | 0.47 |
| 2271 | 2272 | putative protein | 0 | At4g30010 | 0.73 |
| 2273 | 2274 | putative uroporphyrinogen decarboxylase | 2E−9 | At2g40490 | 0.75 |
| 2275 | 2276 | putative protein | 1E−151 | At3g57400 | 0.71 |
| 2277 | 2278 | branched-chain amino acid aminotransferase, putative | 1E−56 | At3g19710 | 0.3 |
| 2279 | 2280 | copia-like retroelement pol polyprotein | 0 | At2g19830 | 0.72 |
| 2281 | 2282 | neoxanthin cleavage enzyme-like protein | 0 | At4g19170 | 0.38 |
| 2283 | 2284 | hypothetical protein | 0 | At1g31860 | 0.7 |
| 2285 | 2286 | unknown protein | 0 | At2g26570 | 0.61 |
| 2287 | 2288 | asparagine synthetase ASN3 | 0 | At5g10240 | 0.72 |
| 2289 | 2290 | hypothetical protein | 1E−80 | At1g64770 | 0.56 |
| 2291 | 2292 | expansin S2 precursor, putative | 1E−114 | At1g20190 | 0.51 |
| 2293 | 2294 | 5'-adenylylsulfate reductase | 0 | At4g04610 | 0.43 |
| 2295 | 2296 | putative protein | 9E−02 | At3g59680 | 0.71 |
| 2297 | 2298 | putative MYB family transcription factor | 4E−31 | At2g37630 | 0.73 |
| 2299 | 2300 | Putative protein kinase | 3E−23 | At1g51850 | 0.6 |
| 2301 | 2302 | putative protein | 0 | At5g15910 | 0.76 |
| 2303 | 2304 | AALP protein | 0 | At5g60360 | 0.63 |
| 2305 | 2306 | putative galactinol synthase | 0 | At2g47180 | 0.69 |
| 2307 | 2308 | cyanohydrin lyase like protein | 0 | At4g16690 | 0.56 |
| 2309 | 2310 | putative protein | 0 | At5g03880 | 0.57 |
| 2311 | 2312 | putative glucosyltransferase | 0 | At2g30150 | 0.73 |
| 2313 | 2314 | cysteine endopeptidase precursor - like protein | 0 | At3g48350 | 0.65 |
| 2315 | 2316 | unknown protein | 1E−122 | At3g07700 | 0.7 |
| 2317 | 2318 | putative peroxiredoxin | 2E−86 | At3g26060 | 0.76 |
| 2319 | 2320 | MAPKK | 0 | At1g73500 | 0.58 |
| 2321 | 2322 | hypothetical protein | 7E−74 | At1g64780 | 0.52 |
| 2323 | 2324 | UDP glucose: flavonoid 3-o-glucosyltransferase, putative | 2E−90 | At1g30530 | 0.59 |
| 2325 | 2326 | hypothetical protein | 0 | At4g02800 | 0.55 |
| 2327 | 2328 | oxidoreductase - like protein | 0 | At3g55290 | 0.65 |
| 2329 | 2330 | hypothetical protein | 0 | At1g50670 | 0.73 |
| 2331 | 2332 | carnitine/acylcarnitine translocase-like protein | 0 | At5g46800 | 0.58 |
| 2333 | 2334 | MATH protein | 1E−169 | At4g00780 | 0.57 |
| 2335 | 2336 | unknown protein | 0 | At1g22630 | 0.76 |
| 2337 | 2338 | cytochrome P450-like protein | 0 | At4g37330 | 0.72 |
| 2339 | 2340 | putative endo-1,4-beta glucanase | 8E−36 | At4g02290 | 0.62 |
| 2341 | 2342 | hevein-like protein precursor | 0E+00 | At3g04720 | 0.75 |
| 2343 | 2344 | leucine zipper-containing protein AT103 | 1E−139 | At3g56940 | 0.63 |
| 2345 | 2346 | delta-1-pyrroline-5-carboxylate synthetase | 0 | At3g55610 | 0.69 |
| 2347 | 2348 | remorin | 0 | At2g45820 | 0.76 |
| 2349 | 2350 | putative protein | 0 | At5g22460 | 0.48 |
| 2351 | 2352 | putative lectin | 0 | At3g16530 | 0.43 |
| 2353 | 2354 | putative protein | 9E−29 | At5g26260 | 0.52 |
| 2355 | 2356 | peptidylprolyl isomerase ROC4 | 0 | At3g62030 | 0.61 |
| 2357 | 2358 | O-methyltransferase, putative | 0 | At1g21130 | 0.63 |
| 2359 | 2360 | putative zinc finger protein | 0 | At4g38960 | 0.72 |
| 2361 | 2362 | putative hydroxyproline-rich glycoprotein | 1E−173 | At1g13930 | 0.58 |
| 2363 | 2364 | putative protein 1 photosystem II oxygen-evolving complex | 0 | At3g50820 | 0.65 |
| 2365 | 2366 | hypothetical protein | 0 | At1g66700 | 0.63 |
| 2367 | 2368 | unknown protein | 0 | At1g52870 | 0.43 |

TABLE 5-continued

*Arabidopsis* genes 1.3 times (1/ratio) or more repressed in E2Fa/Dpa plants

| SEQ ID NO | | | | | |
|---|---|---|---|---|---|
| cDNA | PROT | Gene name | E-value | MIPS accession Number | Ratio |
| 2369 | 2370 | heat shock protein 90 | 0 | At5g56010 | 0.75 |
| 2371 | 2372 | Overlap with bases 87, 142-90, 425 of 'IGF' BAC clone F9K20, accession | 1E−115 | At1g78570 | 0.63 |
| 2373 | 2374 | phosphoglycerate kinase, putative | 1E−120 | At3g12780 | 0.73 |
| 2375 | 2376 | putative lectin | 1E−25 | At3g16400 | 0.4 |
| 2377 | 2378 | profilin 2 | 0 | At4g29350 | 0.77 |
| 2379 | 2380 | HSP associated protein like | 5E−16 | At4g22670 | 0.75 |
| 2381 | 2382 | putative cell division control protein, cdc2 kinase | 1E−75 | At1g20930 | 0.72 |
| 2383 | 2384 | putative protein | 1E−107 | At5g08050 | 0.65 |
| 2385 | 2386 | ribosomal protein S27 | 0 | At5g47930 | 0.77 |
| 2387 | 2388 | vacuolar H+-transporting ATPase 16K chain | 0 | At4g34720 | 0.76 |
| 2389 | 2390 | expansin At-EXP5 | 3E−82 | At3g29030 | 0.52 |
| 2391 | 2392 | similar to cold acclimation protein WCOR413 [*Triticum aestivum*] | 0 | At2g15970 | 0.74 |
| 2393 | 2394 | chloroplast membrane protein (ALBINO3) | 1E−159 | At2g28800 | 0.72 |
| 2395 | 2396 | putative thioredoxin | 1E−102 | At1g08570 | 0.55 |
| 2397 | 2398 | unknown protein | 0 | At1g08380 | 0.65 |
| 2399 | 2400 | hypothetical protein | 0 | At1g07180 | 0.53 |
| 2401 | 2402 | putative flavonol sulfotransferase | 0 | At1g74090 | 0.69 |
| 2403 | 2404 | possible apospory-associated like protein | 0 | At4g25900 | 0.71 |
| 2405 | 2406 | glycolate oxidase, putative | 0 | At3g14420 | 0.71 |
| 2407 | 2408 | putative peroxidase ATP2a | 0 | At2g37130 | 0.75 |
| 2409 | 2410 | putative protein | 1E−154 | At4g21860 | 0.75 |
| 2411 | 2412 | hydroxypyruvate reductase (HPR) | 0 | At1g68010 | 0.74 |
| 2413 | 2414 | photosystem I reaction centre subunit psaN precursor (PSI-N) | 0 | At5g64040 | 0.49 |
| 2415 | 2416 | plastid ribosomal protein S6, putative | 0 | At1g64510 | 0.6 |
| 2417 | 2418 | methylenetetrahydrofolate reductase MTHFR1 | 0 | At3g59970 | 0.72 |
| 2419 | 2420 | putative photosystem I reaction center subunit II precursor | 0 | At1g03130 | 0.55 |
| 2421 | 2422 | unknown protein | 0 | At3g10940 | 0.64 |
| 2423 | 2424 | fumarate hydratase | 0 | At5g50950 | 0.43 |
| 2425 | 2426 | Lil3 protein | 0 | At5g47110 | 0.73 |
| 2427 | 2428 | homeobox gene ATH1 | 0 | At4g32980 | 0.76 |
| 2429 | 2430 | putative lectin | 3E−20 | At3g16390 | 0.43 |
| 2431 | 2432 | COP1-interacting protein 7 (CIP7) | 1E−07 | At4g27430 | 0.67 |
| 2433 | 2434 | putative acyl-CoA synthetase | 0 | At2g47240 | 0.51 |
| 2435 | 2436 | unknown protein | 0 | At2g01590 | 0.68 |
| 2437 | 2438 | hydroxymethyltransferase | 0 | At4g13930 | 0.72 |
| 2439 | 2440 | hypothetical protein | 1E−164 | At1g69490 | 0.27 |
| 2441 | 2442 | SNF1 related protein kinase (ATSRPK1) | 1E−170 | At3g23000 | 0.49 |
| 2443 | 2444 | mevalonate diphosphate decarboxylase | 6E−68 | At2g38700 | 0.71 |
| 2445 | 2446 | putative flavonol sulfotransferase | 0 | At1g74090 | 0.69 |
| 2447 | 2448 | protein phosphatase 2C (AtP2C-HA) | 0 | At1g72770 | 0.59 |
| 2449 | 2450 | cinnamoyl-CoA reductase - like protein | 0 | At4g30470 | 0.72 |
| 2451 | 2452 | O-methyltransferase - like protein | 0 | At4g35160 | 0.5 |
| 2453 | 2454 | pyruvate dehydrogenase E1 alpha subunit | 0 | At1g01090 | 0.77 |
| 2455 | 2456 | putative chlorophyll A-B binding protein | 0 | At3g27690 | 0.49 |
| 2457 | 2458 | putative UDP-N-acetylglucosamine pyrophosphorylase | 0 | At2g35020 | 0.69 |
| 2459 | 2460 | putative protein | 1E−121 | At4g05590 | 0.75 |
| 2461 | 2462 | Ca2+-dependent membrane-binding protein annexin | 0 | At1g35720 | 0.41 |
| 2463 | 2464 | hypothetical protein | 0 | At2g35760 | 0.51 |
| 2465 | 2466 | hypothetical protein | 2E−15 | At1g18840 | 0.71 |
| 2467 | 2468 | hypothetical protein | 0 | At1g51140 | 0.53 |
| 2469 | 2470 | aromatic amino-acid decarboxylase - like protein | 0 | At4g28680 | 0.73 |
| 2471 | 2472 | unknown protein | 3E−72 | At2g35830 | 0.49 |
| 2473 | 2474 | hypothetical protein | 0 | At1g78690 | 0.66 |
| 2475 | 2476 | putative elongation factor P (EF-P) | 0 | At3g08740 | 0.74 |
| 2477 | 2478 | unknown protein | 0 | At1g22750 | 0.76 |
| 2479 | 2480 | putative protein | 0 | At3g63160 | 0.45 |
| 2481 | 2482 | unknown protein | 1E−150 | At3g26510 | 0.55 |
| 2483 | 2484 | aldo/keto reductase-like protein | 0 | At5g53580 | 0.69 |
| 2485 | 2486 | glycine decarboxylase complex H-protein | 0 | At2g35370 | 0.53 |
| 2487 | 2488 | thioredoxin (clone GIF1) (pir\|\|S58118) | 3E−14 | At5g42980 | 0.53 |
| 2489 | 2490 | putative protein | 1E−93 | At4g28020 | 0.52 |
| 2491 | 2492 | hypothetical protein | 0 | At1g18870 | 0.71 |
| 2493 | 2494 | vegetative storage protein Vsp2 | 0 | At5g24770 | 0.43 |
| 2495 | 2496 | putative protein | 3E−75 | At4g17560 | 0.66 |
| 2497 | 2498 | NBD-like protein (gb\|AAD20643.1) | 0E+00 | At5g44110 | 0.58 |
| 2499 | 2500 | photosystem I subunit V precursor, putative | 1E−119 | At1g55670 | 0.56 |
| 2501 | 2502 | putative thaumatin | 2E−36 | At2g28790 | 0.64 |
| 2503 | 2504 | hyoscyamine 6-dioxygenase hydroxylase, putative | 0 | At1g35190 | 0.71 |
| 2505 | 2506 | H-protein promoter binding factor-like protein | 0 | At5g62430 | 0.51 |
| 2507 | 2508 | putative protein | 0 | At4g04840 | 0.52 |
| 2509 | 2510 | endo-xyloglucan transferase - like protein | 0 | At4g37800 | 0.68 |
| 2511 | 2512 | vitamine c-2 | 0 | At4g26850 | 0.33 |

TABLE 5-continued

*Arabidopsis* genes 1.3 times (1/ratio) or more repressed in E2Fa/Dpa plants

| SEQ ID NO | | | | | |
|---|---|---|---|---|---|
| cDNA | PROT | Gene name | E-value | MIPS accession Number | Ratio |
| 2513 | 2514 | hypothetical protein | 0 | At3g12340 | 0.69 |
| 2515 | 2516 | putative acetone-cyanohydrin lyase | 0 | At2g23610 | 0.68 |
| 2517 | 2518 | putative transcription factor | 0 | At1g71030 | 0.36 |
| 2519 | 2520 | hypothetical protein | 1E−128 | At1g19000 | 0.74 |
| 2521 | 2522 | putative xyloglucan endo-transglycosylase | 7E−27 | At2g36870 | 0.4 |
| 2523 | 2524 | hypothetical protein | 3E−51 | At1g58080 | 0.77 |
| 2525 | 2526 | putative protein | 1E−167 | At5g36800 | 0.65 |
| 2527 | 2528 | putative protein | 1E−157 | At4g30530 | 0.65 |
| 2529 | 2530 | cinnamyl-alcohol dehydrogenase ELI3-1 | 0 | At4g37980 | 0.54 |
| 2531 | 2532 | putative CONSTANS-like B-box zinc finger protein | 0 | At2g47890 | 0.72 |
| 2533 | 2534 | unknown protein | 1E−123 | At1g53480 | 0.6 |
| 2535 | 2536 | protein phosphatase 2C-like protein | 2E−55 | At4g28400 | 0.72 |
| 2537 | 2538 | putative protein | 0 | At5g60680 | 0.57 |
| 2539 | 2540 | farnesyl-pyrophosphate synthetase FPS2 | 0 | At4g17190 | 0.76 |
| 2541 | 2542 | soluble inorganic pyrophosphatase, putative | 0 | At1g01050 | 0.59 |
| 2543 | 2544 | putative nematode-resistance protein | 1E−117 | At2g40000 | 0.34 |
| 2545 | 2546 | putative AP2 domain transcription factor | 0 | At2g23340 | 0.74 |
| 2547 | 2548 | putative myo-inositol monophosphatase | 3E−17 | At3g02870 | 0.6 |
| 2549 | 2550 | putative isoamylase | 0 | At1g03310 | 0.74 |
| 2551 | 2552 | phosphate transporter (AtPT2) | 0 | At2g38940 | 0.76 |
| 2553 | 2554 | putative disease resistance response protein | 0 | At4g11190 | 0.68 |
| 2555 | 2556 | unknown protein | 0 | At2g45600 | 0.55 |
| 2557 | 2558 | peroxidase ATP13a | 0 | At5g17820 | 0.7 |
| 2559 | 2560 | unknown protein | 0 | At1g26920 | 0.74 |
| 2561 | 2562 | putative mitochondrial carrier protein | 0 | At2g47490 | 0.69 |
| 2563 | 2564 | actin depolymerizing factor 3 - like protein | 1E−136 | At5g59880 | 0.64 |
| 2565 | 2566 | putative protein transport protein SEC23 | 1E−149 | At2g21630 | 0.73 |
| 2567 | 2568 | unknown protein | 2E−30 | At2g44310 | 0.74 |
| 2569 | 2570 | putative protein | 0 | At4g21570 | 0.69 |
| 2571 | 2572 | putative steroid binding protein | 0 | At2g24940 | 0.57 |
| 2573 | 2574 | putative lipid transfer protein | 0 | At2g15050 | 0.49 |
| 2575 | 2576 | hypothetical protein | 0 | At4g15510 | 0.75 |
| 2577 | 2578 | unknown protein | 3E−47 | At3g25690 | 0.56 |
| 2579 | 2580 | 40S ribosomal protein S19 - like | 0 | At5g28060 | 0.73 |
| 2581 | 2582 | putative auxin-regulated protein | 0 | At2g21210 | 0.56 |
| 2583 | 2584 | unknown protein | 0 | At1g19350 | 0.71 |
| 2585 | 2586 | unknown protein | 1E−136 | At1g07700 | 0.71 |
| 2587 | 2588 | 50S ribosomal protein L27 | 0E+00 | At5g40950 | 0.7 |
| 2589 | 2590 | unknown protein | 1E−105 | At2g46540 | 0.69 |
| 2591 | 2592 | ATP-sulfurylase | 0 | At4g14680 | 0.72 |
| 2593 | 2594 | hypothetical protein | 1E−107 | At3g18890 | 0.64 |
| 2595 | 2596 | putative protein | 0 | At3g59780 | 0.62 |
| 2597 | 2598 | cytochrome P450 monooxygenase - like protein | 0 | At4g37410 | 0.56 |
| 2599 | 2600 | hypothetical protein | 2E−86 | At1g61890 | 0.36 |
| 2601 | 2602 | ubiquitin-conjugating enzyme, putative | 0 | At3g20060 | 0.66 |
| 2603 | 2604 | hypothetical protein | 0 | At1g20810 | 0.74 |
| 2605 | 2606 | hypothetical protein | 0 | At2g15020 | 0.45 |
| 2607 | 2608 | unknown protein | 0 | At1g55480 | 0.52 |
| 2609 | 2610 | UDP glucose: flavonoid 3-o-glucosyltransferase - like protein | 0 | At5g17050 | 0.56 |
| 2611 | 2612 | hypothetical protein | 0 | At3g23670 | 0.69 |
| 2613 | 2614 | putative protein | 0 | At4g34920 | 0.69 |
| 2615 | 2616 | unknown protein | 1E−100 | At2g36630 | 0.71 |
| 2617 | 2618 | unknown protein | 6E−94 | At1g56580 | 0.63 |
| 2619 | 2620 | HSR201 like protein | 0 | At4g15390 | 0.75 |
| 2621 | 2622 | heme oxygenase 1 (HO1) | 0 | At2g26670 | 0.74 |
| 2623 | 2624 | putative beta-glucosidase | 0 | At4g27820 | 0.46 |
| 2625 | 2626 | unknown protein | 1E−122 | At1g68440 | 0.45 |
| 2627 | 2628 | predicted protein | 0 | At4g22820 | 0.54 |
| 2629 | 2630 | putative kinesin heavy chain | 0 | At2g22610 | 0.72 |
| 2631 | 2632 | putative protein | 0 | At4g27860 | 0.61 |
| 2633 | 2634 | unknown protein | 0 | At2g37240 | 0.76 |
| 2635 | 2636 | unknown protein | 0 | At1g30070 | 0.76 |
| 2637 | 2638 | WD-repeat protein - like protein | 0 | At4g33270 | 0.57 |
| 2639 | 2640 | unknown protein | 0 | At1g32220 | 0.6 |
| 2641 | 2642 | hypothetical protein | 0 | At4g22920 | 0.73 |
| 2643 | 2644 | putative amino acid transporter protein | 0 | At3g11900 | 0.67 |
| 2645 | 2646 | endo-beta-1,4-glucanase, putative | 0 | At1g64390 | 0.5 |
| 2647 | 2648 | hypothetical protein | 0 | At1g18060 | 0.6 |
| 2649 | 2650 | hypothetical protein | 1E−114 | At4g39820 | 0.7 |
| 2651 | 2652 | putative protein | 1E−62 | At5g27290 | 0.6 |
| 2653 | 2654 | putative protein | 1E−133 | At3g48200 | 0.46 |
| 2655 | 2656 | hypothetical protein | 1E−173 | At1g64500 | 0.51 |
| 2657 | 2658 | putative ribonuclease, RNS2 | 0 | At2g39780 | 0.6 |

TABLE 5-continued

Arabidopsis genes 1.3 times (1/ratio) or more repressed in E2Fa/Dpa plants

| SEQ ID NO | | | | | |
|---|---|---|---|---|---|
| cDNA | PROT | Gene name | E-value | MIPS accession Number | Ratio |
| 2659 | 2660 | thioredoxin f1 | 0 | At3g02730 | 0.59 |
| 2661 | 2662 | unknown protein | 0 | At2g20670 | 0.67 |
| 2663 | 2664 | cytochrome P450-like protein | 0 | At5g48000 | 0.45 |
| 2665 | 2666 | subtilisin proteinase - like | 1E−105 | At4g21650 | 0.31 |
| 2667 | 2668 | photoassimilate-responsive protein PAR-1b - like protein | 0E+00 | At3g54040 | 0.76 |
| 2669 | 2670 | putative dTDP-glucose 4-6-dehydratase | 0 | At2g27860 | 0.45 |
| 2671 | 2672 | hypothetical protein | 0 | At1g51700 | 0.43 |
| 2673 | 2674 | early light-induced protein | 0 | At3g22840 | 0.65 |
| 2675 | 2676 | hypothetical protein | 0 | At1g32060 | 0.42 |
| 2677 | 2678 | unknown protein | 0 | At2g34860 | 0.69 |
| 2679 | 2680 | peroxidase ATP3a (emb|CAA67340.1) | 4E−10 | At5g64100 | 0.49 |
| 2681 | 2682 | putative protein | 0 | At5g06770 | 0.67 |
| 2683 | 2684 | hypothetical protein | 0 | At2g16860 | 0.57 |
| 2685 | 2686 | annexin | 0 | At5g65020 | 0.61 |
| 2687 | 2688 | thioredoxin, putative | 0 | At1g50320 | 0.63 |
| 2689 | 2690 | putative protein | 0 | At5g17360 | 0.66 |
| 2691 | 2692 | nucleoside diphosphate kinase 3 (ndpk3) | 0 | At4g11010 | 0.76 |
| 2693 | 2694 | unknown protein | 0 | At5g62550 | 0.64 |
| 2695 | 2696 | putative protein | 0 | At4g12000 | 0.62 |
| 2697 | 2698 | cell division protease FtsH, putative | 0 | At1g06430 | 0.65 |
| 2699 | 2700 | unknown protein | 0 | At1g74880 | 0.41 |
| 2701 | 2702 | putative protein | 0 | At5g56540 | 0.61 |
| 2703 | 2704 | unknown protein | 0 | At1g68780 | 0.61 |
| 2705 | 2706 | mipC protein - like (aquaporin) | 0 | At5g60660 | 0.64 |
| 2707 | 2708 | Oxygen-evolving enhancer protein 3 precursor - like protein | 0 | At4g05180 | 0.64 |
| 2709 | 2710 | cytochrome P450, putative | 0 | At3g26180 | 0.74 |
| 2711 | 2712 | putative protein | 1E−126 | At5g22210 | 0.74 |
| 2741 | 2742 | unknown protein | | At1g45200 | 3.91 |
| 2743 | 2744 | unknown protein, putative protease inhibitor | | At5g43580 | 2.58 |
| 2745 | 2746 | putative protein | | At5g03540 | 2.21 |
| 2747 | 2748 | putative WD repeat protein | | At3g15880 | 2.38 |
| 2749 | 2750 | putative protease inhibitor Dr4 | | At1g73330 | 10.30 |
| 2751 | 2752 | putative auxin regulated protein | | At2g46690 | 2.86 |
| 2753 | 2754 | translation initiation factor like protein | | At5g54940 | 2.15 |
| 2755 | | pseudogene | | At2g04110 | 2.07 |

REFERENCES

Aapola, U., Liiv, I., and Peterson, P. (2002). Imprinting regulator DNMT3L is a transcriptional repressor associated with histone deacetylase activity. *Nucleic Acids Res.* 30 3602-3608.

Ach, R. A., Taranto, P., and Gruissem, W. (1997). A conserved family of WD-40 proteins binds to the retinoblastoma protein in both plants and animals. *Plant Cell* 9 1595-1606.

Ait-Si-Ali, S., Polesskaya, A., Filleur, S., Ferreira, R., Duquet, A., Robin, P., Vervish, A., Trouche, D., Cabon, F., and Harel-Bellan, A. (2000). CBP/p300 histone acetyltransferase activity is important for the G1/S transition. *Oncogene* 19 2430-2437.

Aldemita, R. R. and Hodges, T. K. (1996). *Agrobacterium tumefaciens*-mediated transformation of *japonica* and *indica* rice varieties. *Planta* 199 612-617.

Anderson, L. A. and Perkins, N. D. (2002). The large subunit of replication factor C interacts with the histone deacetylase, HDAC1. *J. Biol. Chem.* 277 29550-29554.

Bartee, L. and Bender, J. (2001). Two *Arabidopsis* methylation-deficiency mutations confer only partial effects on a methylated endogenous gene family. *Nucleic Acids Res.* 29 2127-2134.

Bechtold, N. and Pelletier, G. (1998). In planta *Agrobacterium*-mediated transformation of adult *Arabidopsis thaliana* plants by vacuum infiltration. Methods Mol. Biol. 82 259-266.

Beemster, G. T. and Baskin, T. I. (1998). Analysis of cell division and elongation underlying the developmental acceleration of root growth in *Arabidopsis thaliana* Plant Physiol 116 (4) 1515-1526.

Campbell, P. and Braam, J. (1999). In vitro activities of four xyloglucan endotransglycosylases from *Arabidopsis*. *Plant J.* 18 371-382.

Cannons, A. C. and Shiflett, S. D. (2001). Transcriptional regulation of the nitrate reductase gene in *Chlorella vulgaris*: identification of regulatory elements controlling expression. *Curr Genet* 40 (2) 128-135.

Carre, I. A. and Kim, J. Y. (2002). MYB transcription factors in the *Arabidopsis* circadian clock. *J Exp Bot.* 53 (374) 1551-1557.

Chaboute, M. E., Clement, B., Sekine, M., Philipps, G., and Chaubet-Gigot, N. (2000). Cell cycle regulation of the tobacco ribonucleotide reductase small subunit gene is mediated by E2F-like elements. *Plant Cell* 12 1987-2000.

Chan, M. T., Chang, H. H., Ho, S. L., Tong, W. F., and Yu, S. M. (1993). *Agrobacterium*-mediated production of transgenic rice plants expressing a chimeric alpha-amylase promoter/beta-glucuronidase gene. *Plant Mol. Biol.* 22 491-506.

Chen, T., Ueda, Y., Xie, S., and Li, E. (2002). A novel dnmt3a isoform produced from an alternative promoter localizes to euchromatin and its expression correlates with active de novo methylation. *J. Biol. Chem.* 277 38746-38754.

Cheng, S. H., Willmann, M. R., Chen, H. C., and Sheen, J. (2002). Calcium signaling through protein kinases. The

*Arabidopsis* calcium-dependent protein kinase gene family. *Plant Physiol* 129 469-485.

Cho, H. S. and Pai, H. S. (2000). Cloning and characterization of ntTMK1 gene encoding a TMK1-homologous receptor-like kinase in tobacco. *Mol. Cells* 10 317-324.

Clark, A. M. and Bohnert, H. J. (1999). Cell-specific expression of genes of the lipid transfer protein family from *Arabidopsis thaliana*. *Plant Cell Physiol* 40 69-76.

Creighton (1984) Proteins. W.H. Freeman and Company.

Creutz, C. E., Tomsig, J. L., Snyder, S. L., Gautier, M. C., Skouri, F., Beisson, J., and Cohen, J. (1998). The copines, a novel class of C2 domain-containing, calcium-dependent, phospholipid-binding proteins conserved from Paramecium to humans. *J. Biol. Chem.* 273 1393-1402.

Crossway, A., Oakes, J. V., Irvine, J. M., Ward, B., Knauf, V. C. and Shewmaker, C. K. (1986). Integration of foreign DNA following microinjection of tobacco mesophyllprotoplasts. *Mol. Gen. Genet.* 202 179-185.

Daimon, Y., Takabe, K. and Tasaka, M. (2003). The CUP-SHAPED COTYLEDON genes promote adventitious shoot formation on calli. *Plant Cell Physiol.* 44 (2) 113-121.

De Veylder, L., Beeckman, T., Beemster, G. T., Krols, L., Terras, F., Landrieu, I., van der Schueren, E., Maes, S., Naudts, M. and Inze, D. (2001a). Functional analysis of cyclin-dependent kinase inhibitors of *Arabidopsis*. *Plant Cell* 13 (7) 1653-1668.

De Veylder, L., Beemster, G. T., Beeckman, T., and Inze, D. (2001b). CKS1At overexpression in *Arabidopsis thaliana* inhibits growth by reducing meristem size and inhibiting cell-cycle progression. *Plant J.* 25 (6) 617-626.

De Veylder, L., Beeckman, T., Beemster, G. T., de Almeida, Engler J., Ormenese, S., Maes, S., Naudts, M., Van Der, Schueren E., Jacqmard, A., Engler, G., and Inze, D. (2002). Control of proliferation, endoreduplication and differentiation by the *Arabidopsis* E2Fa-DPa transcription factor. *EMBO J.* 21 1360-1368.

Dean, R. M., Rivers, R. L., Zeidel, M. L., and Roberts, D. M. (1999). Purification and functional reconstitution of soybean nodulin 26. An aquaporin with water and glycerol transport properties. *Biochemistry* 38 347-353.

Dolan, L., Janmaat, K., Willemsen, V., Linstead, P., Poethig, S., Roberts, K. and Scheres, B. (1993). Cellular organisation of the *Arabidopsis thaliana* root. *Development* 119 (1) 71-84.

Dong, J., Chen, C. and Chen, Z. (2003). Expression profiles of the *Arabidopsis* WRKY gene superfamily during plant defense response. *Plant Mol. Biol.* 51 (1) 21-37.

Egelkrout, E. M., Robertson, D., and Hanley-Bowdoin, L. (2001). Proliferating cell nuclear antigen transcription is repressed through an E2F consensus element and activated by geminivirus infection in mature leaves. *Plant Cell* 13 1437-1452.

Fanutti, C., Gidley, M. J., and Reid, J. S. (1993). Action of a pure xyloglucan endotransglycosylase (formerly called xyloglucan-specific endo-(1→4)-beta-D-glucanase) from the cotyledons of germinated nasturtium seeds. *Plant J.* 3 691-700.

Farkas, V., Sulova, Z., Stratilova, E., Hanna, R., and Maclachlan, G. (1 Nov. 1992). Cleavage of xyloglucan by nasturtium seed xyloglucanase and transglycosylation to xyloglucan subunit oligosaccharides. *Arch. Biochem. Biophys.* 298 365-370.

Finkelstein, R. R. and Gibson, S. I. (2002). ABA and sugar interactions regulating development: cross-talk or voices in a crowd? *Curr. Opin. Plant Biol.* 5 26-32.

Finnegan, E. J. and Kovac, K. A. (2000). Plant DNA methyltransferases. *Plant Mol. Biol.* 43 189-201.

Frame, B. R., Shou, H., Chikwamba, R. K., Zhang Z., Xiang, C., Fonger, T. M., Pegg. S. E., Li, B., Nettleton, D. S., Pei, D., Wang, K. (2002). *Agrobacterium tumefaciens*-mediated transformation of maize embryos using a standard binary vector system. *Plant Physiol.* 129 (1) 13-22.

Freitag, M., Williams, R. L., Kothe, G. O., and Selker, E. U. (2002). A cytosine methyltransferase homologue is essential for repeat-induced point mutation in *Neurospora crassa*. *Proc. Natl. Acad. Sci. U.S.A* 99 8802-8807.

Furukawa, T., Kimura, S., Ishibashi, T., Hashimoto, J. and Sakaguchi, K. (2001). A plant homologue of 36 kDa subunit of replication factor C: molecular cloning and characterization. *Plant Sci.* 161, 99-106.

Grelon, M., Vezon, D., Gendrot, G., and Pelletier, G. (2001). AtSPO11-1 is necessary for efficient meiotic recombination in plants. *EMBO J.* 20 589-600.

Gualberti, G., Papi, M., Bellucci, L., Ricci, I., Bouchez, D., Camilleri, C., Costantino, P., and Vittorioso, P. (2002). Mutations in the Dof zinc finger genes DAG2 and DAG1 influence with opposite effects the germination of *Arabidopsis* seeds. *Plant Cell* 14 1253-1263.

Hajdukiewicz, P., Svab, Z. and Maliga, P. (1994). The small, versatile pPZP family of *Agrobacterium* binary vectors for plant transformation. *Plant Mol. Biol.* 25 (6) 989-994.

Harrington, G. N., Nussbaumer, Y., Wang, X.-D., Tegeder, M., Franceschi, V. R., Frommer, W. B., Patrick J. W., Offler, C. E. (1997). Spatial and temporal expression of sucrose transport-related genes in developing cotyledons of *Vicia faba* L. *Protoplasma* 200 35-50.

Hartung, F. and Puchta, H. (13 Jun. 2001). Molecular characterization of homologues of both subunits A (SPO11) and B of the archaebacterial topoisomerase 6 in plants. *Gene* 271 81-86.

Hatzfeld, M. (1999). The armadillo family of structural proteins. *Int. Rev. Cytol.* 186 179-224.

Hehl, R., Faurie, E., Hesselbach, J., Salamini, F., Baker, B., Gebhardt, C. and Whitham, S. (1998). TMV resistance gene N homologues are linked to *Synchytrium* resistance in potato *Theor. Appl. Genet.* 98, 379-386.

Helin, K. (1998). Regulation of cell proliferation by the E2F transcription factors. *Curr. Opin. Genet. Dev.* 8 28-35.

Hiei, Y., Ohta, S., Komari, T., and Kumashiro, T. (1994). Efficient transformation of rice (*Oryza sativa* L.) mediated by *Agrobacterium* and sequence analysis of the boundaries of the T-DNA. *Plant J.* 6 271-282.

Hua, J., Grisafi, P., Cheng, S. H., and Fink, G. R. (2001). Plant growth homeostasis is controlled by the *Arabidopsis* BON1 and BAP1 genes. *Genes Dev.* 15 2263-2272.

Ingram, G. C., Boisnard-Lorig, C., Dumas, C., and Rogowsky, P. M. (2000). Expression patterns of genes encoding HD-ZipIV homeo domain proteins define specific domains in maize embryos and meristems [In Process Citation]. *Plant J.* 22 401-414.

Ishida, Y., Saito, H., Ohta, S., Hiei, Y., Komari, T. and Kumashiro, T. (1996). High efficiency transformation of maize (*Zea mays* L.) mediated by *Agrobacterium tumefaciens*. *Nat Biotechnol.* 14 (6) 745-750.

Jambunathan, N., Siani, J. M., and McNellis, T. W. (2001). A humidity-sensitive *Arabidopsis* copine mutant exhibits precocious cell death and increased disease resistance. *Plant Cell* 13 2225-2240.

Jiang, J. and Clouse, S. D. (2001). Expression of a plant gene with sequence similarity to animal TGF-beta receptor interacting protein is regulated by brassinosteroids and required for normal plant development. *Plant J.* 26 35-45.

Kachroo, P., Shanklin, J., Shah, J., Whittle, E. J., and Klessig, D. F. (2001). A fatty acid desaturase modulates the activation of defense signaling pathways in plants. *Proc. Natl. Acad. Sci. U.S.A* 98 9448-9453.

Kahn, R. A., Le Bouquin, R., Pinot, F., Benveniste, I., and Durst, F. (2001). A conservative amino acid substitution alters the regiospecificity of CYP94A2, a fatty acid hydroxylase from the plant *Vicia sativa*. *Arch. Biochem. Biophys.* 391 180-187.

Kee, K. and Keeney, S. (2002). Functional interactions between SPO11 and REC102 during initiation of meiotic recombination in *Saccharomyces cerevisiae*. *Genetics* 160 111-122.

Kel, A. E., Kel-Margoulis, O. V., Farnham, P. J., Bartley, S. M., Wingender, E., and Zhang, M. Q. (25 May 2001). Computer-assisted identification of cell cycle-related genes: new targets for E2F transcription factors. *J. Mol. Biol.* 309 99-120.

Kikuchi, K., Ueguchi-Tanaka, M., Yoshida, K. T., Nagato, Y., Matsusoka, M. and Hirano, H. Y. (2000). Molecular analysis of the NAC gene family in rice. *Mol Gen Genet.* 262 (6) 1047-1051.

Kiyosue, T., Yamaguchi-Shinozaki, K., and Shinozaki, K. (1994). Cloning of cDNAs for genes that are early-responsive to dehydration stress (ERDs) in *Arabidopsis thaliana* L.: identification of three ERDs as HSP cognate genes. *Plant Mol. Biol.* 25 791-798.

Kiyosue, T., Abe, H., Yamaguchi-Shinozaki, K., and Shinozaki, K. (1998). ERD6, a cDNA clone for an early dehydration-induced gene of *Arabidopsis*, encodes a putative sugar transporter. *Biochim. Biophys. Acta* 1370 187-191.

Klein, T. M., Wolf, E. D., Wu, R. and Sanford, J. C. (1987) High-velocity microprojectiles for delivering nucleic acids into living cells. *Nature* 327 70.

Koprivova, A., Suter, M., den Camp, R. O., Brunold, C., Kopriva, S. (2000). Regulation of sulfate assimilation by nitrogen in *Arabidopsis*. *Plant Physiol.* 122 (3) 737-746.

Krens, F. A., Molendijk, L., Wullems, G. J. and Schilperoort, R. A. (1982). In vitro transformation of plant protoplasts with Ti-plasmid DNA. *Nature* 296 72-74.

Kroczynska, B., Ciesielski, A. and Stachnik, K (1999). The Nucleotide Sequence of a cDNA Encoding. The AtTIR, a TIR-Like Resistance Protein in *Arabidopsis thaliana* (Genbank Accession No AF188334). *Plant Physiol.* 121 (3), 1055.

Kubo, H., Peeters, A. J., Aarts, M. G., Pereira, A., and Koornneef, M. (1999). ANTHOCYANINLESS2, a homeobox gene affecting anthocyanin distribution and root development in *Arabidopsis*. *Plant Cell* 11 1217-1226.

Lancien, M., Gadal P. and Hodges, M. (2000). Enzyme redundancy and the importance of 2-oxoglutarate in higher plant ammonium assimilation. *Plant Physiol.* 123 817-24.

Lauvergeat, V., Lacomme, C., Lacombe, E., Lasserre, E., Roby, D., and Grima-Pettenati, J. (2001). Two cinnamoyl-CoA reductase (CCR) genes from *Arabidopsis thaliana* are differentially expressed during development and in response to infection with pathogenic bacteria. *Phytochemistry* 57 1187-1195.

Lee, Y. H., Oh, H. S., Cheon, C. I., Hwang, I. T., Kim Y. J. and Chun, J. Y. (2001). Structure and expression of the *Arabidopsis thaliana* homeobox gene Athb-12. *Biochem Biophys Res Commun.* 284 (1) 133-141.

Lescot, M., Déhais, P., Thijs, G., Marchal, K., Moreau, Y., Van de Peer, Y., Rouzé P., and Rombauts, S. (2002) PlantCARE, a database of plant cis-acting regulatory elements and a portal to tools for in silico analysis of promoter sequences. *Nucleic Acids Res.* 30 325-327.

Lorkovic, Z. J. and Barta, A. (1 Feb. 2002). Genome analysis: RNA recognition motif (RRM) and K homology (KH) domain RNA-binding proteins from the flowering plant *Arabidopsis thaliana*. *Nucleic Acids Res.* 30 623-635.

Lusser, A., Eberharter, A., Loidl, A., Goralik-Schramel, M., Horngacher, M., Haas, H., Loidl, P. (1999). Analysis of the histone acetyltransferase B complex of maize embryos. *Nucleic Acids Res.* 27 (22) 4427-4435.

Martin, T., Oswald, O., and Graham, I. A. (2002). *Arabidopsis* seedling growth, storage lipid mobilization, and photosynthetic gene expression are regulated by carbon:nitrogen availability. *Plant Physiol* 128 472-481.

Matsuda, O., Watanabe, C., and Iba, K. (2001). Hormonal regulation of tissue-specific ectopic expression of an *Arabidopsis* endoplasmic reticulum-type omega-3 fatty acid desaturase (FAD3) gene. *Planta* 213 833-840.

Medford, J. I., Elmer, J. S. and Klee H. J. (1991) Molecular cloning and characterization of genes expressed in shoot apical meristems. *Plant Cell.* 3 359-70.

Menges, M. and Murray, J. A. (2002) Synchronous *Arabidopsis* suspension cultures for analysis of cell-cycle gene activity. *Plant J.* 30 203-12.

Meijer, A. H., de Kam, R. J., d'Erfurth, I., Shen, W. and Hoge, J. H. (2000). HD-Zip proteins of families I and II from rice: interactions and functional properties *Mol. Gen. Genet.* 263 (1), 12-21.

Molina, A. and Garcia-Olmedo, F. (1997). Enhanced tolerance to bacterial pathogens caused by the transgenic expression of barley lipid transfer protein LTP2. *Plant J.* 12 669-675.

Morgan, D. O. (1997). Cyclin-dependent kinases: engines, clocks, and microprocessors. *Annu. Rev. Cell Dev. Biol.* 13 261-291.

Muller, H. and Helin, K. (2000). The E2F transcription factors: key regulators of cell proliferation. *Biochim. Biophys. Acta* 1470 M1-M12.

Muller, H., Bracken, A. P., Vernell, R., Moroni, M. C., Christians, F., Grassilli, E., Prosperini, E., Vigo, E., Oliner, J. D., and Helin, K. (2001). E2Fs regulate the expression of genes involved in differentiation, development, proliferation, and apoptosis. *Genes Dev.* 15 267-285.

Nagl, W. (1976). DNA endoreduplication and polyteny understood as evolutionary strategies *Nature.* 261 (5561) 614-615.

Negrutiu, I., Shillito, R. D., Potrykus, I., Biasini, G. and Sala, F. (1987). Hybrid genes in the analysis of transformation conditions I. Setting up a simple method for direct gene transfer in plant protoplasts. *Plant Mol. Biol.* 8 363-373.

Nicholson, J. K., Connelly, J., Lindon, J. C. and Holmes E. (2002) Metabonomics: a platform for studying drug toxicity and gene function. *Nat Rev Drug Discov.* 1 (2) 153-161.

Patrick, J. W. and Offler, C. E. (2001). Compartmentation of transport and transfer events in developing seeds. *J. Exp. Bot.* 52 551-564.

Porceddu, A., Stals, H., Reichheld, J. P., Segers, G., De Veylder, L., Barroco, R. P., Casteels, P., Van Montagu, M., Inze, D., and Mironov, V. (2001). A plant-specific cyclin-dependent kinase is involved in the control of G2/M progression in plants. *J. Biol. Chem.* 276 36354-36360.

Puskás, L. G., Zvara, A., Hackler, L. Jr. and Van Hummelen, P. (2002). RNA amplification results in reproducible microarray data with slight ratio biases. *Biotechniques* 32 (6) 1330-1341.

Reddy, P. M., Kouchi, H., and Ladha, J. K. (1998). Isolation, analysis and expression of homologues of the soybean early nodulin gene GmENOD93 (GmN93) from rice. *Biochim. Biophys. Acta* 1443 386-392.

Ren, B., Cam, H., Takahashi, Y., Volkert, T., Terragni, J., Young, R. A., and Dynlacht, B. D. (2002). E2F integrates cell cycle progression with DNA repair, replication, and G(2)/M checkpoints. *Genes Dev.* 16 245-256.

Rossi, V., Varotto, S., Locatelli, S., Lanzanova, C., Lauria, M., Zanotti, E., Hartings, H., and Motto, M. (2001). The maize WD-repeat gene ZmRbAp1 encodes a member of the MSI/RbAp sub-family and is differentially expressed during endosperm development. *Mol. Genet Genomics* 265 576-584.

Sakamoto, A., Ueda, M., and Morikawa, H. (2002). *Arabidopsis* glutathione-dependent formaldehyde dehydrogenase is an S-nitrosoglutathione reductase. *FEBS Lett.* 515 20-24.

Sambrook, J., Fritsch, E. F., and Maniatis, T. (2001). Molecular Cloning: A Laboratory Manual; 3rd edition.

Sawa, S., Ohgishi, M., Goda, H., Higuchi, K., Shimada, Y., Yoshida, S. and Koshiba, T. (2002). The HAT2 gene, a member of the HD-Zip gene family, isolated as an auxin inducible gene by DNA microarray screening, affects auxin response in *Arabidopsis*. *Plant J.* 32 (6) 1011-1022.

Scarpella, E., Rueb, S., Boot, K. J., Hoge, J. H., Meijer, A. H. (2000). A role for the rice homeobox gene Oshox1 in provascular cell fate commitment. *Development.* 127 (17) 3655-3669.

Schoof, H., Zaccaria, P., Gundlach, H., Lemcke, K., Rudd, S., Kolesov, G., Arnold, R., Mewes, H. W., and Mayer, K. F. (1 Jan. 2002). MIPS *Arabidopsis thaliana* Database (MAtDB): an integrated biological knowledge resource based on the first complete plant genome. *Nucleic Acids Res.* 30 91-93.

Shillito, R. D., Saul, M. W., Paszkowski, J., Müller, M. and Potrykus, I. (1985). High Efficiency Direct Gene Transfer to Plants. *Biotechnology* 3 1099-1103.

Siddique, H., Zou, J. P., Rao, V. N., and Reddy, E. S. (1998). The BRCA2 is a histone acetyltransferase. *Oncogene* 16 2283-2285.

Smeekens, S. (2000). Sugar-induced signal transduction in plants. *Annual Review of Plant Physiology andd Plant Molecular Biology* 51 49-81.

Smith, M., Moon, H., and Kunst, L. (2000). Production of hydroxy fatty acids in the seeds of *Arabidopsis thaliana*. *Biochem. Soc. Trans.* 28 947-950.

Soderman, E., Hjellstrom, M., Fahleson, J., and Engstrom, P. (1999). The HD-Zip gene ATHB6 in *Arabidopsis* is expressed in developing leaves, roots and carpels and up-regulated by water deficit conditions. *Plant Mol. Biol.* 40 1073-1083.

Soustelle, C., Vedel, M., Kolodner, R., and Nicolas, A. (2002). Replication Protein A Is Required for Meiotic Recombination in *Saccharomyces cerevisiae*. *Genetics* 161 535-547.

Suzuki, A., Suzuki, T., Tanabe, F., Toki, S., Washida, H., Wu, C. Y. and Takaiwa. F. (1997). Cloning and expression of five myb-related genes from rice seed. *Gene.* 198 (1-2) 393-398.

Takahashi, R. and Shimosaka, E. (1997). cDNA sequence analysis and expression of two cold-regulated genes in soybean. *Plant Sci.* 123, 93-104.

Tegeder, M., Wang, X. D., Frommer, W. B., Offler, C. E., and Patrick, J. W. (1999). Sucrose transport into developing seeds of *Pisum sativum* L. *Plant J.* 18 151-161.

Tegeder, M., Offler, C. E., Frommer, W. B., and Patrick, J. W. (2000). Amino acid transporters are localized to transfer cells of developing pea seeds. *Plant Physiol* 122 319-326.

Thoma, S., Hecht, U., Kippers, A., Botella, J., De Vries, S., and Somerville, C. (1994). Tissue-specific expression of a gene encoding a cell wall-localized lipid transfer protein from *Arabidopsis*. *Plant Physiol* 105 3545.

Toonen, M. A., Verhees, J. A., Schmidt, E. D., van Kammen, A., and de Vries, S. C. (1997). AtLTP1 luciferase expression during carrot somatic embryogenesis. *Plant J.* 12 1213-1221.

Valvekens, D., Van Montagu, M., and Van Lijsebettens, M. (1988). *Agrobacterium* tumefaciens-mediated transformation of *Arabidopsis thaliana* root explants by using kanamycin selection. *Proc. Natl. Acad. Sci. USA* 85 5536_5540.

Vandepoele, K., Raes, J., De Veyider, L., Rouze, P., Rombauts, S., and Inze, D. (2002). Genome-wide analysis of core cell cycle genes in *Arabidopsis*. *Plant Cell* 14 903-916.

Wang, Y. X., Kauffman, E. J., Duex, J. E., and Weisman, L. S. (2001). Fusion of docked membranes requires the armadillo repeat protein Vac8p. *J. Biol. Chem.* 276 35133-35140.

Weber, H., Borisjuk, L., Heim, U., Sauer, N. And Wobus, U. (1997a). A role for sugar transporters during seed development: Molecular characterization of a hexose and a sucrose carrier in fava bean seeds. *Plant Cell* 9 (6) 895-908.

Weber, H., Borisjuk, L. And Wobus U. (1997b). Sugar import and metabolism during seed development. *Trends in Plant Science* 2 (5) 169-174.

Weinmann, A. S., Bartley, S. M., Zhang, T., Zhang, M. Q., and Farnham, P. J. (2001). Use of chromatin immunoprecipitation to clone novel E2F target promoters. *Mol. Cell Biol.* 21 6820-6832.

Wellesen, K., Durst, F., Pinot, F., Benveniste, I., Nettesheim, K., Wisman, E., Steiner-Lange, S., Saedler, H., and Yephremov, A. (2001). Functional analysis of the LACERATA gene of *Arabidopsis* provides evidence for different roles of fatty acid omega-hydroxylation in development. *Proc. Natl. Acad. Sci. U.S.A* 98 9694-9699.

Wesley, S. V., Helliwell, C. A., Smith N. A., Wang, M. B., Rouse, D. T., Liu, Q., Gooding, P. S., Singh, S. P., Abbott, D., Stoutjesdijk, P. A., Robinson, S. P., Gleave, A. P., Green, A. G. and Waterhouse, P. M. (2001) Construct design for efficient, effective and high-throughput gene silencing in plants. *Plant J.* 27 (6) 581-590.

Wittstock, U. and Halkier, B. A. (2002). Glucosinolate research in the *Arabidopsis* era. *Trends Plant Sci.* 7 263-270.

Wolfinger, R. D., Gibson, G., Wolfinger, E. D., Bennett, L., Hamadeh, H., Bushel, P., Afshari, C., and Paules, R. S. (2001). Assessing gene significance from cDNA microarray expression data via mixed models. *J. Comput. Biol.* 8 625-637.

Yahalom, A., Kim, T. H., Winter, E., Karniol, B., von Arnim, A. G., and Chamovitz, D. A. (2001). *Arabidopsis* eIF3e (INT-6) associates with both eIF3c and the COP9 signalosome subunit CSN7. *J. Biol. Chem.* 276 334-340.

Yang, Y. H., Dudoit, S., Luu, P., Lin, D. M., Peng V., Ngai, J. and Speed, T. P. (2002) Normalization for cDNA microarray data: a robust composite method addressing single and multiple slide systematic variation. *Nucleic Acids Res* 30 4-15.

Yin, Y., Cheong, H., Friedrichsen, D., Zhao, Y., Hu, J., Mora-Garcia, S., and Chory, J. (2002). A crucial role for the putative *Arabidopsis* topoisomerase VI in plant growth and development. *Proc. Natl. Acad. Sci. U.S.A* 99 10191-10196.

SEQUENCE LISTING (2776 sequences)

SEQ ID NO: 1 - DNA, 1768 bp, Arabidopsis thaliana
atctctccttttccttcttcttcttccttctcctttctctgtttatttgcttcgtttcctcttctctttctccgattctttatccatcttcgctcagatcttccccgtttcaactctttggatccagattctcctcctttttatgtaggtaacacgcatatcaagtgttaaagagtcaagatcacaaaaagttctatcgggtgatctgggctgctttcttttgtaatctaattgcagaaactttgctctgacttggatagcttcgtaaaaggttcaatctttctccgtttttcatcaatgagtagtaactaatctggaaatttgttgggagagaaagggcacattgcactgctattgctagagaacgtttctgcatccatgctggtagagagcatgcgtggatactgtgttttgggtgatgcccctgacaaaattagttcccgatgcattcggcgttgtgacgatatgtctagtcgctctgctagttcttttgggtctcctttgcatcgcttactcgttctatttccagtctcacgttcgtaagcaaggctatattcaacttggttacttcagtggtccctggattatccgaatcactttcattctctttgctatctggtgggctgttggtgagatttttcgattgagtttgttgaggcgtcacagaaggttgttgagtgggttggatctgagatggcaagaaaacgtttgcaagtggtacatcgtttccaatctaggatttgcggagccttgtctctttctgactctcatgtttcttctgcgtgctcccttgaagatggaatcaggggctttgagcggaaaatggaacagggacacagcaggttatattattctttattgtctcccgatgcttgctcttcaacttgcggttgtgttgtccgagtcacgcctaaatggtggtagtggctcttatgtaaagctgccacacgacttcacaagaacgtattcccgagttattattgatcacgacgaggtggccttatgcacatatcctctactgagtaccatccttcttggtgtgtttgcagccgtcctaacagcttacttgttctggcttggaaggcagatactgaaacttgtcattaacaagcgtttacagaagagagtatacactttgatattctcggtctcgagtttccttccattaaggattgttatgctctgtttgtcggttctcacagcagcagacaagattatattcgaagccctttctttcttggccttcctctccctcttctgcttttgcgtggtatccatctgcttgcttgtctacttcccggtttcagattccatggccctgagaggtctaagagacacagatgatgaggatacggctgtgaccgaagaacgcagtggtgctctgttacttgcaccaaactcttcacaaactgatgagggattgagcttaagaggtcggagagactcgggatcgtctacacaggagaggtatgtggaactcagcctatttctggaagctgagaactaaaatcgccaaaggctgtttctatttggcttttggcaatgtacagattcctggtgaaacaagcagagagagagggataaagagtttaagtatgagaatatgtttgcgcaaaaaaaggcataatttcagttttgtggcaaagacactttgactgtaaaggagggtttaagggggtttactcttgtgagggtttgttgtttgaaatgttttctgcttgatggatcatatttttgtacctttattatgtgatcaattttgatttag

SEQ ID NO: 2 - protein, 362 aa, Arabidopsis thaliana
MPLTKLVPDAFGVVTICLVALLVLLGLLCIAYSFYFQSHVRKQGYIQLGYFSGPWIIRITFILFAIWWAVGEIFRLSLLRRHRRLLSGLDLRWQENVCKWYIVSNLGFAEPCLFLTLMFLLRAPLKMESGALSGKWNRDTAGYIILYCLPMLALQLAVVLSESRLNGGSGSYVKLPHDFTRTYSRVIIDHDEVALCTYPLLSTILLGVFAAVLTAYLFWLGRQILKLVINKRLQKRVYTLIFSVSSFLPLRIVMLCLSVLTAADKIIFEALSFLAFLSLFCFCVVSICLLVYFPVSDSMALRGLRDTDDEDTAVTEERSGALLLAPNSSQTDEGLSLRGRRDSGSSTQERYVELSLFLEAEN

SEQ ID NO: 3 - DNA, 626 bp, Arabidopsis thaliana
catcgcggtctggaacagcgatgactcgcatttaaatttgtttctctgcttcactcttttgatttctttctacttctttttttcacacagatcttaagatactacaactgcgaccatggagcttccatctccttacagctcaagaaaggaggaatcaactgttcctccgaagagaggccgagtcaagatcatgatctttcgtgatctagtcagatcggaaacctcgatggcaccgactccgaggagaggccgaatcaagaaaatgatcgcgggtgatctagtcggatcagggaaacagaacaactacgacggagacggtaagagaggaggctagttaagcagactctccgactacatacactttatctccatgccagcttccagacaatccctttctctgagaagatgatcggattttcatattcatttgaaaatcttgtatgaaatgtaatatagttgttggctttggcttcttctttcgaatatgttatacaaaaagtttattatttttgttggggtaaattaaagatttaaaggtaagttactctgtttcatacaaagtttgggcctctgggctaatattttggtatctatgtaaaaatgtaaatattatgtttctttagaag

SEQ ID NO: 4 - protein, 72 aa, Arabidopsis thaliana
MELPSPYSSRKEESTVPPKRGRVKIMIFRDLVRSETSMAPTPRRGRIKKMIAGDLVGSGKQNNYDGDGKRGG

SEQ ID NO: 5 - DNA, 1176 bp, Oryza sativa
ccgccgcggctcacctggaaactgggcagattggacaatcgctcgagcgagctagcgagagagagcgcgagagagcgaggcggcgcgcgcggtggttgcggatttgtagcttagagcgcggggccatggggaggtcgccgtgctgcgagaaggcgcacacgaacaagggggcgtggacgaaggaggaggaccagcggctcatcgcgtacatcagggcgcatggcgaaggctgctggcgctcgctgcccaaggcggcgggcctccttcgctgcggcaagagctgccgcctccggtggatgaactacctccgccccgacctcaagcgcggcaacttcaccgacgacgaggacgagctcatcatccgcctccacagcctcctcggcaacaagtggtctctgatcgccgggcagctgccggggaggacggacaacgagatcaagaactactggaacacgcacatcaagcgcaagctcctcgcccgcggcatcgacccgcagacgcaccgcccgctgctcagcggcggtgacggcatcgcggcgagcaacaagcggcaccaccgccgccgcatcccatatccgtcccggcgaaggcggcggccgcggcgatcttcgccgtgcgaagccgccgccgccgccgcgcccggtcgactcctcggacgacggctgccgcagcagcagcggcacaacgagcacgggggagccgcggtgccccgacctcaacctcgagctctcggtcgggccgacgccgagctcgccgccggcggagacgcccaccagcgcgcggccggtctgcctctgctaccacctcggcttccgcggcggggaggcgtgcagctgtcaggctgacagcaagggcccacacgagtttagatatttcaggccgttggaacaaggccagtacatatgagatatgaccatgagatgtgagatggcttaattagcttcaattcccaacatgtgtaacacagggagtttttctagtggacgacaatactgtttaatttcagaaaaaaaagggaaagaaaaaggttctaatctgttcatatttcttactattatccaatcttcatgatctcaatctctctctctctttattatttttctttgtagtaattaacttcatgttggttcctctaaaaaagattggtcgatgttattcagtgataaatattcctag

SEQ ID NO: 6 - protein, 239 aa, Oryza sativa
MGRSPCCEKAHTNKGAWTKEEDQRLIAYIRAHGEGCWRSLPKAAGLLRCGKSCRLRWMNYLRPDLKRGNFTDDEDELIIRLHSLLGNKWSLIAGQLPGRTDNEIKNYWNTHIKRKLLARGIDPQTHRPLLSGGDGIAASNKRHHRRRIPYPSRRRRRPRRSSPCEAAAAAAPGRLLGRRLPQQQRHNEHGGAAVPRPQPRALGRADAELAAGGDAHQRAAGLPLLPPRLPRRGGVQLSG

SEQ ID NO: 7 - DNA, 1264 bp, Oryza sativa
gcagcatcaacaaaggcagcagcagcagcagcagcagcagcagcgttggtggtggtggtgtgtcatcaccaacattttcacgagaggagaaggatggaaatggcggcggcggttgggggcagcgggaggagggacgcggaggcggagctgaacctgccgccgggcttccgtttccacccgaccgacgaggagctcgtggtgcactacctctgccgcaaggttgcccggcagccgctccccgtcccaatcatcgccgaggtcgacctctacaagctcgacccctgggatctccctgagaaggcgttgttcgggaggaaagagtggtacttcttcacgccgagggaccggaagtacccgaacgggtcgaggccgaaccgcgcagcggggagagggtactggaaggcgacgggagccgacaagccggtggcgcccaaggggagcgcgaggacggtggggatcaagaaggcgctcgtgttctactccgggaaggcgccgaggggggtcaagacggactggatcatgcacgagtaccgcctcgccgacgccgaccgcgccccgggcggcaagaagggctcacagaagctggacgagtgggtgctgtgccggctgtacaacaagaagaacaactgggagaaggtgaagctggagcagcaggacgtggcctccgtggcggcggcggcgccgcgcaaccaccaccatcagaacggcgaggtcatggacgcggcggcggctgacaccatgtccgacagcttccagacgcacgactccgacatcgacaacgcctccgccggcctgcggcacggtggctgcggcggcggcggcttcggcgacgtggcgccgccgaggaatgggttcgtgacggtgaaggaggacaacgactggttcaccggcctcaacttcgacgagctgcagccgccgtacatgatgaacctgcagcacatgcagatgcagatggtgaatccggcggcgccagggcacgacggcggctacttgcagtccatcagctcgccgcagatgaagatgtggcagacaatcctgccaccattctgagatggatggagcaagaaaaaggttgctgtagataaagggcggaaataggagtgatggctagaaaattattagatttactagaacgaaaatgattagaaatctggcaagcatgattctgcaaatgtggtggtagatgcttgcagtatgtaattcatttgttcagtatatgcatttggtaatctgcaaaacaaaaaaaaaaaaaaaaaaaaaaaaa

SEQ ID NO: 8 - protein, 316 aa, Oryza sativa
MAAAVGGSGRRDAEAELNLPPGFRFHPTDEELVVHYLCRKVARQPLPVPIIAEVDLYKLDPWDLPEKALFGRKEWYFFTPRDRKYPNGSRPNRAAGRGYWKATGADKPVAPKGSARTVGIKKALVFYSGKAPRGVKTDWIMHEYRLADADRAPGGKKGSQKLDEWVLCRLYNKKNNWEKVKLEQQDVASVAAAAPRNHHHQNGEVMDAAAADTMSDSFQTHDSDIDNASAGLRHGGCGGGGFGDVAPPRNGFVTVKEDNDWFTGLNFDELQPPYMMNLQHMQMQMVNPAAPGHDGGYLQSISSPQMKMWQTILPPF

SEQ ID NO: 9 - DNA, 1057 bp, Oryza sativa
tttcctcctcttcttcctccatatcacacggttttcgtccatcgatcatcagagctcgatcgggcgccatggatggggaggaggacagcgagtggatgatgatggacgttggagggaagggcgggaagggcggcggcggcggcggcgcggcggacaggaagaagcggttcagcgaggagcagatcaagtcgctggagtccatgttcgcgacgcagaccaagctggagccgaggcagaagctgcagctcgccagggagctcggcctgcagcctcgccaggtcgccatctggttccagaacaagcgcgcgcggtggaagtccaagcagctcgagcgcgagtactccgccctccgcgacgactacgacgccctcctctgcagctacgagtccctcaagaaggagaagctcgccctcatcaagcagctggagaagctggcggagatgctgcaggagccacgggggaagtacggcgataatgccggggacgacgcgcggtcgggcggcgtcgccggcatgaagaaggaggagttcgtcggcgcgggcggcgccgccacgctctactcgtcggccgagggtggcgggacgtcgtccacggagcagacctgcagcagcacgccatggtgggaattcgagagcgagtgagcatccacactgttactactaggctactcatggatgatccatcgatcgccacagatcatgcatgccacgatcagaatttcaattcgccgcgaggacggatcaaacctgtactagatcggatcagagcaaacatagcagagaagatgatcaaaccaacagtgatgtgtacatagatttctgtagatcaaaaccccaggcagtctcctctccatccagccatcagcatgcgaaaattctctctcttttttttcccctccaagtcttactcgacttcgatgttgttatcacaacaccacatcatgtaatccagcaacacgccgagatgaaaaaaaggttaaaaagcttatagagttcgttcatttgatggatccaaaaaaaaaaaaaaaaaaaaaaaaaaaaaaaaaaaaaaaaaaaaa

SEQ ID NO: 10 - protein, 190 aa, Oryza sativa
MDGEEDSEWMMMDVGGKGGKGGGGGGAADRKKRFSEEQIKSLESMFATQTKLEPRQKLQLARELGLQPRQVAIWFQNKRARWKSKQLEREYSALRDDYDALLCSYESLKKEKLALIKQLEKLAEMLQEPRGKYGDNAGDDARSGGVAGMKKEEFVGAGGAATLYSSAEGGGTSSTEQTCSSTPWWEFESE

SEQ ID NO: 11 - DNA, 1275 bp, Oryza sativa
cagtagacggcaatactcctgatccaaatcaagaaaatctttctgagagtgctcaaggaagccacgctggctctcctcccaacatggcatctattgtcacagctacagttgctgcagcatcagcatggtgggcaacacaaggtcttctccctctttttcctccacctatagcttttccatttgttccagctcctagtgctcccttttccacagcagatgttcagcgagctcaagagaaagatatagactgcccaatggataatgcacagaaggaattgcaagaaactcggaaacaagataattttgaagctatgaaggtcatagtgtcttcagagactgatgagagtggaaaaggagaagtgtcgctccacactgagttaaagatatctccagcagataaggccgacaccaaacctgccgcaggagctgaaacaagtgacgtttttggaaataagaaaaagcaggatcgctcttcatgtggttccaacacaccgtcaagtagtgatatagaagcagataatgctcctgagaatcaagaaaaggctaacgacaaggcaaagcaagcatcttgcagtaactcttcagccggtgacaataaccaccgtagatttaggagcagtgcaagcacaagtgattcatggaaggaagtttctgaagagggtcgtctggcttttgatgcactgttcagtagagaaaggcttccccaaagcttttctcctccgcaagtagaaggatcaaaggagattagcaaggaggaagaagatgaagtaaccacggtgacggttgacctcaacaagaatgccgctattattgatcaagaactcgacacagcggatgagccaagagcttcctttcctaatgaattgtcaaacctgaagctgaaatctcgcaggaccggtttcaaaccatacaagaggtgctcagtggaagcgaaggagaacagggtaccggctagcgatgaggttggtaccaagaggattcgtcttgagagcgaagcatcgacatgatttgctttccacctggttgctggcctctaccaagtcagaagttaaatttacatccgagctaccataggacttcagaccttccaatgcattacctcacaaactcaatttattgtgtgttgtatcttaatgcttgccaagcagctcctatagactgcttttaaaccgtatctcatagacttttgattagcatttaagcgactgctaaactttcttcataaaagggtattatccttattatgcattatagtctggggaaggaaataagtgg

SEQ ID NO: 12 - protein, 307 aa, Oryza sativa
MASIVTATVAAASAWWATQGLLPLFPPPIAFPFVPAPSAPFSTADVQRAQEKDIDCPMDNAQKELQETRKQDNFEAMKVIVSSETDESGKGEVSLHTELKISPADKADTKPAAGAETSDVFGNKKKQDRSSCGSNTPSSSDIEADNAPENQEKANDKAKQASCSNSSAGDNNHRRFRSSASTSDSWKEVSEEGRLAFDALFSRERLPQSFSPPQVEGSKEISKEEEDEVTTVTVDLNKNAAIIDQELDTADEPRASFPNELSNLKLKSRRTGFKPYKRCSVEAKENRVPASDEVGTKRIRLESEAST

SEQ ID NO: 13 - DNA, 1106 bp, Arabidopsis thaliana
aaatcgaaaggcacagcccaacttttcgcaagtcgctgtaaagtttgatttgcttctttttatatacacacatacttctcctccatacactttcctcttcaatcctcagttttttttctaagccctaataccatctcaaagaagagatcaagatttgaaatcaagaagacaccattactcagatcaacatgcttgccgttcaccgtccttcttccgccgtatcagacggagattccgttcagattccgatgatgatcgcgtcgtttcaaaaacgttttccttctctctcacgcgactccacggccgctcgttttcacacacacgaggttggtcctaatcagtgttgctccgccgttattcaagagatctccgctccaatctccaccgtttggtccgtcgtacgccgctttgataacccacaagcttacaaacactttctcaaaagctgtagcgtcatcggcggagacggcgataacgttggtagcctccgtcaagtccacgtcgtctctggtctccccgccgctagctccaccgagagactcgatatcctcgacgacgaacgccacgtcatcagcttcagcgttgttggtggtgaccaccggctctctaactaccgatccgtaacgacccttcacccttctccgatctccgggaccgtcgttgtcgagtcttacgtcgttgatgttcctccaggcaacacaaaggaagagacttgtgacttcgttgacgttatcgtacgatgcaatcttcaatctcttgcgaaaatagccgagaatactgcggctgagagcaagaagaagatgtctctgtgatgagtctttgtcgttgtcgggtagtttcgttagatccgacgtcgttttctagatttttagccgtcgtgtgatctatgttttttcggcttatgtgtgaaaaaaaagttacattagtgaattaatctctcatgcatatcataatccttcttttaatttttgtattttacatatcccataaagaaccgatttggatagccctattccggctttcaccacccaaagataataatattcaaactgaaagaatgtggttgtgttgtccgctaattaaaagtgtgattttcaagtttaatt

SEQ ID NO: 14 - protein, 207 aa, Arabidopsis thaliana
MLAVHRPSSAVSDGDSVQIPMMIASFQKRFPSLSRDSTAARFHTHEVGPNQCCSAVIQEISAPISTVWSVVRRFDNPQAYKHFLKSCSVIGGDGDNVGSLRQVHVVSGLPAASSTERLDILDDERHVISFSVVGGDHRLSNYRSVTTLHPSPISGTVVVESYVVDVPPGNTKEETCDFVDVIVRCNLQSLAKIAENTAAESKKKMSL

SEQ ID NO: 15 - DNA, 1848 bp, Arabidopsis thaliana
ggttgagtgattgctgaagccaacttaaaagagagagaagagaagagtgactctgtgtgtgtgtgcaagaaagtcttctctttcacacctttcgttttctcgaacctctcctttaaagatggtggaggaatcttgggtttgacaactcattaacactgaccctctttttagctctacaagcatccaaggaacccctcttacttttccctcttcttcattccctctctctctatatctcccaattccttctctttttttaaccttgatcttcttcttataagagactcagagctgttcttcaagatgggattgtgtaagcttgaaacttgactatctgggtctctcccattttctgttctcttttgtattctgagtgaaagttttgttttctgggggaaaaaattagggttcttagatggaggagatagaaggaacaaacagagcagctgttgagagttgtcatagagttcttaatcttttacatagatcacagcaacaagatcatgttggttttgaaaagaatttagtatctgaaactagagaagctgtgattaggttcaagagagttgggagtttgttaagcagtagtgttggtcatgctaggtttagaagagctaagaaacttcagagtcatgtctctcaaagtctcttacttgatccatgtcaacaaaggacaacagaagttccatcatcatcttctcagaaaacaccggtactccggtctggtttccaggaattgagcttgagacaaccttcagattcactcactttagggactcgctcttttagtttaaactcaaatgctaaagctcctctccttcagcttaatcagcagacaatgcctccttcgaattatcctactttgtttccagtacaacaacaacaacaacaacaacaacaacaacaacagcaggagcagcagcagcagcagcagcagcaacagcaacagtttcatgaacggttacaagctcaccatcttcatcagcaacagcagctacagaaacatcaagctgagcttatgcttaggaaatgcaatggtgggataagtttgagtttcgataactctagttgtactccaactatgtcatccactaggtcctttgtttcttcacttagcatagatggtagtgttgctaatatagagggaaagaactccttccattttggggttcctagttcaactgatcagaattcactacattctaagaggaaatgccccttgaaaggagatgaacatggaagcttaaaatgcgggagctctagccgatgccactgcgctaagaagaggaaacatcgggttaggagatcgattagagtaccggctataagtaacaaggttgcagatatccctcctgatgattattcatggcgaaaatatggtcagaagcccatcaagggctctccttatcccagaggatattacaaatgtagtagcatgagaggttgtccagcgaggaagcatgttgagagatgtttggaagatccggcaatgcttattgttacttatgaagcagagcataaccacccgaaattgccatctcaagctataacaacttaactctcgtttatctttgcggtccagcataaaccttctcatgtatgttgttctcttttgtgcgcgatgatcggctttggggttgctgcaatgttgtgatatatggatcggggtaagtgcttttgttggggtggatttgcttgtgagagtttgctgcaattgttggattttgagctatatatggggtaaatgtaggattggtcaagactctttttctgtttctcaagtttattggtcttaatgattaaaagtttaatggtttgtttctggctatgtatcttttttttcttctc

SEQ ID NO: 16 - protein, 380 aa, Arabidopsis thaliana
MEEIEGTNRAAVESCHRVLNLLHRSQQQDHVGFEKNLVSETREAVIRFKRVGSLLSSSVGHARFRRAKKLQSHVSQSLLLDPCQQRTTEVPSSSSQKTPVLRSGFQELSLRQPSDSLTLGTRSFSLNSNAKAPLLQLNQQTMPPSNYPTLFPVQQQQQQQQQQQQQEQQQQQQQQQQQFHERLQAHHLHQQQQLQKHQAELMLRKCNGGISLSFDNSSCTPTMSSTRSFVSSLSIDGSVANIEGKNSFHFGVPSSTDQNSLHSKRKCPLKGDEHGSLKCGSSSRCHCAKKRKHRVRRSIRVPAISNKVADIPPDDYSWRKYGQKPIKGSPYPRGYYKCSSMRGCPARKHVERCLEDPAMLIVTYEAEHNHPKLPSQAITT

SEQ ID NO: 17 - DNA, 846 bp, Arabidopsis thaliana
gatcattcatgttcgagtaaacgataaaactgttgcttgaagttttttaatggcgatttctaatgtgatgttagagtctatgtctagatctctattaagattcgaatactgaattcgcgggaagtggacttttttgtttctaatgattgatttagtactgataagtgataacgatgtatatagtttttgttctggacttgaatttgaaaacatacttttgttaaagctcagttatggaagacgtgaaagggaaggagattattgatgatgctcctattgacaacaaggtttcagatgaaatggagagtgaggaaaatgcgatcaagaaaaagtatggaggattgttgcctaagaagattcctttgatatctaaggaccatgaacgtgcgttttttgactcagctgattgggctttaggcaagcaaaaaggacagaagccgaaagggcctttggaagctctccgcccaaaactgcagccaaccccgcaacagcaaccaagagcaagacgaatggcttattcttcaggcgaaactgaagacactgagattgataacaacgaagctccggatgaccaagcctgcgcatcagctgtggatagtaccaatttaaaggacgatggaggcgcaaaagacaacatcaaatcatgaacaacatatagagatctcttgaggagcgcaaacaaacaacatcacaagtcaatttacagaagaataagcgaccaggtttgctttgcaacggttgtaatatcaagtctcttaccttatcatacttgggactgcaaatctgtatcacttacaaacctcctggcttgaaacgtctattggacgattgcaaatgatttgcttt

SEQ ID NO: 18 - protein, 137 aa, Arabidopsis thaliana
MEDVKGKEIIDDAPIDNKVSDEMESEENAIKKKYGGLLPKKIPLISKDHERAFFDSADWALGKQKGQKPKGPLEALRPKLQPTPQQQPRARRMAYSSGETEDTEIDNNEAPDDQACASAVDSTNLKDDGGAKDNIKS

SEQ ID NO: 19 - DNA, 1395 bp, Arabidopsis thaliana
ggctcacacaaatataagataacgtccgtttcaaattcccccaactcggagaaaccgaagcgagtctgactctctgagtcgtcaccaccgagtcaactctgtctccgccatggctgctgcttcactccacacttcaatctcaccacgtagcttccttcctctctccaaaccatctctaaaacctcaccgttcccaaattctactgagaaacaaacagaggaattgcgtttcgtgcgcattgatccgtgacgaaatcgacctgattccggttcagagccgagatcggaccgaccatgaggaaggttcggtggtagtgatgagcactgagacggcggttgatggtaatgaatcggttgttgtaggttttagtgctgcgacgagtgaaggtcagctttcgttagaagggtttccttcttcttcttcttcgggagctgatttaggagatgaaaagagaagagagaacgaagaaatggagaagatgatcgatcgaaccattaacgctacgattgttttagctgctggttcttacgctattaccaaattgcttaccatcgatcatgattattggcatggatggactctgtttgagatactaagatatgctcctcaacataactggattgcttacgaagaagcgctaaagcaaaacccggttctagcaaaaatggtcattagtggagttgtctactctgtaggagattggatagctcagtgttacgaaggcaaaccgttgtttgaaattgatagagcaagaacattgagatcaggactagtaggtttcactctccatggctcgttatcgcatttctattaccagttctgtgaagagcttttcccgtttcaagattggtgggtggttcctgtgaaagttgcctttgatcaaacagtctggtcagctatatggaacagtatttacttcacggttcttggtttcctgcgtttcgaatcgcctatcagcatcttcaaagaactaaaagctacgttcttgcctatgctaacagcaggttggaagctttggccatttgctcatttgatcacatacggtttggtcccagtagaacaacgacttctctgggtagattgcgtggagcttatttgggtcactatactttcgacttactcgaacgagaaatcagaagctagaatctcggaatctgtcattgagacctcttcgagttctactacaaccattgatccctctaaggaatgagaaagcagaaaagccaaatcgggtcttatcagcatcatattgtatatatacagagtttagccaataaagtggccagagatttgagattgatacagaggagatggagatattcaaatggatgtatctattaatgtgtaagaaaaataaccagaatcttgaatacacaatagaaacaattttatttg

SEQ ID NO: 20 - protein, 366 aa, Arabidopsis thaliana
MAAASLHTSISPRSFLPLSKPSLKPHRSQILLRNKQRNCVSCALIRDEIDLIPVQSRDRTDHEEGSVVVMSTETAVDGNESVVVGFSAATSEGQLSLEGFPSSSSSGADLGDEKRRENEEMEKMIDRTINATIVLAAGSYAITKLLTIDHDYWHGWTLFEILRYAPQHNWIAYEEALKQNPVLAKMVISGVVYSVGDWIAQCYEGKPLFEIDRARTLRSGLVGFTLHGSLSHFYYQFCEELFPFQDWWVVPVKVAFDQTVWSAIWNSIYFTVLGFLRFESPISIFKELKATFLPMLTAGWKLWPFAHLITYGLVPVEQRLLWVDCVELIWVTILSTYSNEKSEARISESVIETSSSSTTTIDPSKE

SEQ ID NO: 21 - DNA, 1627 bp, Arabidopsis thaliana
agaagattcttaaatctcatttctgcggcgtaggtgaagtcttagcgataagctttgtttcttcttcttcttcttctttacccatggatttttaacgaacaagagaagagaagaaccaagttttcttcgaaaggattgaactttgtttctttctcttcagctacaacaaccaaaaaatgatcaagctttgcttcatgacttctcatggttattcaatccctggccttggtcttcctcaagacctctgcaacaccgaaatcatcaagcagaatagccggtctcatctggtgaatcccggagcaagacaagagatcatacctgcaagctccttcaatctgaatacagaactcttggaaccatggaaaccggtttcttcatttagccaattcgtggagattgattcagccatgatgaaacctctgctcatggatgttcatgagacggcaccagaatctctgattttgagctttggaatcgctgataagtttgcaagacaagaaaaggtgatggagtttcttctgtctcagtcagaggagttcaaggaaaaaggattcgatatgtcgctgttaaatgaattgatggagtttgagtctatgaaatccagttctcagctacgaccgtatgatacttcctctgttctttacttgaatcaagaattagggaaaccggttttggatctcgttagggatatgatggagaatccagagttctctgtgcgatcgaatggtcatgttctgttctcttcaagtagcaatcctgagttgaatgatctactttctattgcttccgagttcaatttgtcaaggaattcaacaacaaaatggagacagctctcaccgcttatcccacactttcagaggtttgaaagtgacgtatttacaccggctaagctgaaagcagttacagtgctagcacctttgaagagtcctgagaaaagcaggctcaagtcaccaaggaaacacaacacgaagcgaaaagctaaagagagggacctatacaaaagaaatcatctccacgcttacgagagccttctctctttaatgataggcaatgatcatcgacacaaacacacaacagtactctctttacagaaatcatgtggagagctctcagagcttctgactcagttctctatcactgctgctggaactggaatcgctgtgctcttttctgtcgtatgtagccttgcttcaaggcgtgtacccttttgcgcaaataagttcttcgacactgggcttggtttgagtttggtaatactgtcatgggctgtgaatagactcagggaggtgattgttcatgtcaataggaaagcgaacaagccatgttcaagtttgaaagatgacgaaatcataaacagtgtggagagaagtatgaaggaggtttactacagagctgcaacggtaatcgcggtgtttgcgcttaggtttgcatgttgaaaaatcggggtgagaggtaaaaatcttgatttactactccatggaaagcttctaaaaggtcgtttgtaaatgactaaaacttgtttagtagctgtaaatgtgaaagatgatattatgtggtagaacctaagattaagaggtgaagaattttgaagagaataaatgttttgcaagaatgcgtttgttccatc

SEQ ID NO: 22 - protein, 419 aa, Arabidopsis thaliana
MIKLCFMTSHGYSIPGLGLPQDLCNTEIIKQNSRSHLVNPGARQEIIPASSFNLNTELLEPWKPVSSFSQFVEIDSAMMKPLLMDVHETAPESLILSFGIADKFARQEKVMEFLLSQSEEFKEKGFDMSLLNELMEFESMKSSSQLRPYDTSSVLYLNQELGKPVLDLVRDMMENPEFSVRSNGHVLFSSSSNPELNDLLSIASEFNLSRNSTTKWRQLSPLIPHFQRFESDVFTPAKLKAVTVLAPLKSPEKSRLKSPRKHNTKRKAKERDLYKRNHLHAYESLLSLMIGNDHRHKHTTVLSLQKSCGELSELLTQFSITAAGTGIAVLFSVVCSLASRRVPFCANKFFDTGLGLSLVILSWAVNRLREVIVHVNRKANKPCSSLKDDEIINSVERSMKEVYYRAATVIAVFALRFAC

SEQ ID NO: 23 - DNA, 1647 bp, Arabidopsis thaliana
acaaatcaaccatttctcctttcttcttatttctgagcaaagttttttcttcctttcatattgtgaggatgtccaaaaccaatatgaaattttgcaatagttattttctggtcgatccgaccaaagcaagttttcttgatctccttttgcttttgttttcctccaacctgaccagtgcaagattcatcgattctcctccggatacgcttaaaggcttccggagaagtttcgcgagtcgatggatccttgcgttggccatcttccttcaaaaagtattaatgctcttaagtaaaccttttgcattcattggtcaaaagctcacatattggctcaaccttcttacggcaaatggaggcttcttcaacttgatacttaaccttatgtcaggaaagctggtcaagcctgacaaatcttcggcgacgtatacttcttttataggatgctcagatcgacgaatagagcttgacgagaagataaatgttggtagcatcgaatacaaatcgatgttgtcaataatggcttctaagatctcttatgagagcaaaccttacatcacttccgtcgtcaaaaacacttggaagatggacttggtgggtaactacgacttttacaacgctttccaagaaagtaaattgacgcaagccttcgtgttcaagacttcgagcaccaatccagacctcatcgtcgttagcttcagaggaaccgaacctttcgaggctgccgattggtgcactgatctcgacctctcttggtacgagatgaagaacgttggcaaagtccacgccgggttctcaagagctttaggtctccaaaaagatggatggcccaaggaaaatattagtctactacaccaatatgcttactacaccatcagacagatgcttagagacaagcttggcagaaacaagaaccttaaatatattctaacaggtcacagccttggcggagcactagctgctcttttcccggcgattctggccattcacggtgaggatgagctgctagataagctagagggaatctatacgtttggacagccacgtgtaggagatgaggactttggtgagtttatgaagggtgtggtgaaaaagcatggaatagagtatgagagattcgtctataacaatgatgttgtgcctagagtgccctttgatgacaagtacttattctcatacaagcactatggaccttgcaattccttcaacagtctctacaaaggaaaggtaagagaagatgcaccaaatgcgaactacttcaacttgttgtggttaataccgcagctgttgactggtttgtgggagtttataaggagtttcatattacagttttggaaaggcgacgagtacaaagagaattggttaatgagatttgttagggttgtgggaatagtgttccctggtggctctaaccatttcccatttgattacgtcaactctactcgcctaggaggcttggttcgacctcctcctactactactcctgaggataaacttgccctcattgcttgaactctcattatttaataatcatatccactttatctgccctaatgacggttaaataattgcacttgagctttaatgtattctctgtgttatgtgtttttgtatgtgagtttttatgttggtaacaatatctaccttttcc

SEQ ID NO: 24 - protein, 479 aa, Arabidopsis thaliana
MSKTNMKFCNSYFLVDPTKASFLDLLLLLFSSNLTSARFIDSPPDTLKGFRRSFASRWILALAIFLQKVLMLLSKPFAFIGQKLTYWLNLLTANGGFFNLILNLMSGKLVKPDKSSATYTSFIGCSDRRIELDEKINVGSIEYKSMLSIMASKISYESKPYITSVVKNTWKMDLVGNYDFYNAFQESKLTQAFVFKTSSTNPDLIVVSFRGTEPFEAADWCTDLDLSWYEMKNVGKVHAGFSRALGLQKDGWPKENISLLHQYAYYTIRQMLRDKLGRNKNLKYILTGHSLGGALAALFPAILAIHGEDELLDKLEGIYTFGQPRVGDEDFGEFMKGVVKKHGIEYERFVYNNDVVPRVPFDDKYLFSYKHYGPCNSFNSLYKGKVREDAPNANYFNLLWLIPQLLTGLWEFIRSFILQFWKGDEYKENWLMRFVRVVGIVFPGGSNHFPFDYVNSTRLGGLVRPPPTTTPEDKLALIA

SEQ ID NO: 25 - DNA, 918 bp, Arabidopsis thaliana
atgatgaatgttgcagtgacagccactccctcgtctctcttgtactctcctctgcttcttccttctcaagggccaaaccggcgaatgcaatggaaaagaaacggaaagagacggttagggacaaaggtggctgtttccggtgttatcacagctggatttgagctgaagccacctccatatcctcttgatgctctggaaccgcatatgagccgggaaaccttggattatcactggggcaaacatcacaaaacttatgtagagaacctgaacaagcaaatcttaggcacggatctagatgcattatccttggaagaagttgtgcttctttcatacaacaaaggcaatatgcttcctgctttcaacaacgctgcacaggcttggaaccacgagttcttctgggagtctatccaacctggaggtggaggaaagccaactggagagctcctcagattaatagaaagagattttgggtctttcgaagagtttttggaaaggttcaagtcggctgcagcttcgaattttggttcgggttggacatggcttgcatataaggcgaatagacttgacgttgcaaatgccgttaatcctctcccaaaggaggaagacaagaaacttgttatagtgaagacgcccaatgcagtaaatccgctcgtatgggattattctccacttctcaccattgatacctgggagcacgcttactatctggattttgagaaccgaagagctgaatacataaatacattcatggaaaagcttgtgtcatgggaaactgtaagcacaaggttggaatccgcaattgctcgagcagtgcaaagagaacaagaaggaacagagacagaagatgaagagaatccagatgatgaagtaccagaggtctatttagatagtgacatcgatgtatctgaggttgactaa

SEQ ID NO: 26 - protein, 305 aa, Arabidopsis thaliana
MMNVAVTATPSSLLYSPLLLPSQGPNRRMQWKRNGKRRLGTKVAVSGVITAGFELKPPPYPLDALEPHMSRETLDYHWGKHHKTYVENLNKQILGTDLDALSLEEVVLLSYNKGNMLPAFNNAAQAWNHEFFWESIQPGGGGKPTGELLRLIERDFGSFEEFLERFKSAAASNFGSGWTWLAYKANRLDVANAVNPLPKEEDKKLVIVKTPNAVNPLVWDYSPLLTIDTWEHAYYLDFENRRAEYINTFMEKLVSWETVSTRLESAIARAVQREQEGTETEDEENPDDEVPEVYLDSDIDVSEVD

SEQ ID NO: 27 - DNA, 1479 bp, Arabidopsis thaliana
atggcgcgaaaatccctaattttcccggtgattttgctcgccgttcttctcttctctccgccgatttactccgccggtcacgattaccgcgacgctctccgtaaaagcattctcttcttcgaaggtcaacgttccggtaaactccctccagatcaacgcttaaaatggcgccgtgactcagcattacgcgacggttcctccgccggcgttgacttatccggtggttactacgacgccggagacaacatcaagttcggttttccgatggcgttcacaacaacgatgctttcatggagtataatcgatttcggtaaaaccatgggacctgagcttagaaacgccgtgaaagctgttaaatggggaacagattacctccttaaagcgacggcgattcccggagtagtcttcgtccaagtcggagacgcttactccgatcataactgttgggaaaggcctgaagatatggacactctccgtactgtttacaaaatcgatagagctcatcctggttctgacgtcgctggtgaaaccgcagccgctttagccgccgcttcaatcgtttttagaaaacgcgatcctgcttattccagacttctacttgaccgtgccactagggtattcgcgtttgctaacagatatcgcggcgcgtatagtaacagtctctaccacgcggtttgtcctttttactgtgatttcaacggttaccaggatgagttactgtggggagcggcatggctacacaaagcctcgaggaaacgagcgtacagagaattcattgtgaagaacgaggtcattcttaaggctggagataccattaatgagtttggttgggacaataagcatgctgggattaatgtcttaatctccaaggaagtgttaatgggaaaagcagagtattttgagtctttcaagcagaacgcagatgggtttatctgttctatattgcctggaatttctcacccccaagtccaatactctcgaggagggctactagtgaagactggagggagtaacatgcaacatgtaacatcactatctttcctcctattggcttactctaattatctgagccatgccaaaaaggttgtgccttgtggcgaattaactgcttccccatctctcctccgtcaaatcgccaagcgtcaggtggattacattctcggagacaacccgatgggactgtcttacatggttggatacggtcaaaagtttccacgtaggattcatcaccgtggtagctcggttccttcggtttcagcccatccaagccacatagggtgcaaagaaggctctcgctatttcctaagcccaaatcctaacccaaaccttttggttggtgctgtagtcggtggacctaatgtcactgatgcttttccggattcaagaccttactttcagcagtctgagcccacgacttatatcaatgcaccactagtgggccttctcggttacttctccgcccattctacttggcgatga

SEQ ID NO: 28 - protein, 492 aa, Arabidopsis thaliana
MARKSLIFPVILLAVLLFSPPIYSAGHDYRDALRKSILFFEGQRSGKLPPDQRLKWRRDSALRDGSSAGVDLSGGYYDAGDNIKFGFPMAFTTTMLSWSIIDFGKTMGPELRNAVKAVKWGTDYLLKATAIPGVVFVQVGDAYSDHNCWERPEDMDTLRTVYKIDRAHPGSDVAGETAAALAAASIVFRKRDPAYSRLLLDRATRVFAFANRYRGAYSNSLYHAVCPFYCDFNGYQDELLWGAAWLHKASRKRAYREFIVKNEVILKAGDTINEFGWDNKHAGINVLISKEVLMGKAEYFESFKQNADGFICSILPGISHPQVQYSRGGLLVKTGGSNMQHVTSLSFLLLAYSNYLSHAKKVVPCGELTASPSLLRQIAKRQVDYILGDNPMGLSYMVGYGQKFPRRIHHRGSSVPSVSAHPSHIGCKEGSRYFLSPNPNPNLLVGAVVGGPNVTDAFPDSRPYFQQSEPTTYINAPLVGLLGYFSAHSTWR

SEQ ID NO: 29 - DNA, 1365 bp, Arabidopsis thaliana
atggcgtccgttgttcttcgaaaccctagctcgaagcgccttgttccattctcttcccagatctactctcgctgtggtgcttccgttacttcctcttactcgatctctcattctatcggtggagatgatctctcttcctctaccttcggaacctcctccttctggagatccatggccacttttactcgaaataaacctcatgtaaatgttggaactattgggcatgttgatcatggcaagaccactttaactgctgcaatcacaaaggttcttgctgaggagggcaaagctaaagctattgcctttgatgaaattgataaagctcctgaagagaagaagagaggaattactattgccacggctcatgtggagtatgaaactgcaaagcgtcactatgctcatgtggattgccctggacacgcagattatgttaaaaatatgattactggagctgcgcaaatggatggcggaattcttgtggtttcaggaccagatggacccatgccgcagacaaaggaacatattctacttgcacgccaggttggtgttccctcacttgtgtgcttcttgaacaaagttgatgtggtggatgaccctgagctcttggagcttgtcgagatggaactacgtgagctcctcagcttctacaagtttcctggggatgatattcccatcatccgaggatctgctctgtccgcattacagggcaccaatgatgaaattggaaggcaagctatattaaagctgatggatgctgttgatgaatatatacctgaccctgttcgcgtccttgacaagcctttcttgatgccaattgaagatgttttctcaattcaaggacgtggaactgttgcaaccggtcgtatcgaacagggagtcattaaagtgggtgaagaagttgagatattgggtttacgtgaggggggtgttccactgaaatcgactgtaactggggttgagatgttcaagaagattttggataatggacaggctggtgataatgtaggacttcttctgcgtgggctaaagagagaagacattcagcgtggaatggtgattgctaagcctggttcatgcaagacatacaagaagtttgaagcagagatttacgtgctcacaaaggatgaaggtggacgtcacactgcatttttctctaactacaggcctcagttttacttgaggactgcagatatcactggcaaagtggaattacccgaaaacgtgaagatggttatgcctggtgacaatgtcacagctgttttcgagttaatcatgcctgtcccactcgaaacaggtcaaagatttgccttaagggaaggaggtagaacagttggagctggtgttgtatcaaaagtgatgacctaa

SEQ ID NO: 30 - protein, 454 aa, Arabidopsis thaliana
MASVVLRNPSSKRLVPFSSQIYSRCGASVTSSYSISHSIGGDDLSSSTFGTSSFWRSMATFTRNKPHVNVGTIGHVDHGKTTLTAAITKVLAEEGKAKAIAFDEIDKAPEEKKRGITIATAHVEYETAKRHYAHVDCPGHADYVKNMITGAAQMDGGILVVSGPDGPMPQTKEHILLARQVGVPSLVCFLNKVDVVDDPELLELVEMELRELLSFYKFPGDDIPIIRGSALSALQGTNDEIGRQAILKLMDAVDEYIPDPVRVLDKPFLMPIEDVFSIQGRGTVATGRIEQGVIKVGEEVEILGLREGGVPLKSTVTGVEMFKKILDNGQAGDNVGLLLRGLKREDIQRGMVIAKPGSCKTYKKFEAEIYVLTKDEGGRHTAFFSNYRPQFYLRTADITGKVELPENVKMVMPGDNVTAVFELIMPVPLETGQRFALREGGRTVGAGVVSKVMT

SEQ ID NO: 31 - DNA, 510 bp, Arabidopsis thaliana
atgtctgaagttgagtaccggtgctttgtcggcggccttgcctgggccaccaatgatgaagatcttcaaaggacgttctcacagttcggcgacgttatcgattctaagatcattaacgaccgcgagagtggaagatcaaggggattcggattcgtcaccttcaaggacgagaaagccatgagggatgcgattgaagagatgaacggtaaagagctcgatggacgtgtcatcaccgtgaacgaggctcagtcgagaggtagcggcggtggcggaggaggccgtggtggaagcggtggtggttaccgcagcggaggcggtggtggatactcaggaggcggtggcggcggatactcaggaggaggcggtggtggttacgagagacgtagcggaggttacggatctggtggaggcggtggtggccgaggatacggtggtggtggacgccgtgagggaggtggctacggaggcggtgatggtggaagttacggaggcggtggtggcggctggtaa

SEQ ID NO: 32 - protein, 169 aa, Arabidopsis thaliana
MSEVEYRCFVGGLAWATNDEDLQRTFSQFGDVIDSKIINDRESGRSRGFGFVTFKDEKAMRDAIEEMNGKELDGRVITVNEAQSRGSGGGGGGRGGSGGGYRSGGGGGYSGGGGGGYSGGGGGGYERRSGGYGSGGGGGGRGYGGGGRREGGGYGGGDGGSYGGGGGGW

SEQ ID NO: 33 - DNA, 1446 bp, Arabidopsis thaliana
atgcatatcacaaaaccacacgccgccatgttttccagtcccggaatgggccatgtcatcccggtgatcgagcttggaaagcgtctctccgctaacaacggcttccacgtcaccgtcttcgtcctcgaaaccgacgcagcctccgctcaatccaagttcctaaactcaaccggcgtcgacatcgtcaaacttccatcgccggacatttatggtttagtggaccccgacgaccatgtagtgaccaagatcggagtcattatgcgtgcagcagttccagccctccgatccaagatcgctgccatgcatcaaaagccaacggctctgatcgttgacttgtttggcacagatgcgttatgtctcgcaaaggaatttaacatgttgagttatgtgtttatccctaccaacgcacgttttctcggagtttcgatttattatccaaatttggacaaagatatcaaggaagagcacacagtgcaaagaaacccactcgctataccggggtgtgaaccggttaggttcgaagatactctggatgcatatctggttcccgacgaaccggtgtaccgggattttgttcgtcatggtctggcttacccaaaagccgatggaattttggtaaatacatgggaagagatggagcccaaatcattgaagtcccttctaaacccaaagctcttgggccgggttgctcgtgtaccggtctatccaatcggtcccttatgcagaccgatacaatcatccgaaaccgatcacccggttttggattggttaaacgaacaaccgaacgagtcggttctctatatctccttcgggagtggtggttgtctatcggcgaaacagttaactgaattggcgtggggactcgagcagagccagcaacggttcgtatgggtggttcgaccaccggtcgacggttcgtgttgtagcgagtatgtctcggctaacggtggtggaaccgaagacaacacgccagagtatctaccggaagggttcgtgagtcgtactagtgatagaggtttcgtggtcccctcatgggccccacaagctgaaatcctgtcccatcgggccgttggtgggtttttgacccattgcggttggagctcgacgttggaaagcgtcgttggcggcgttccgatgatcgcatggccactttttgccgagcagaatatgaatgcggcgttgctcagcgacgaactgggaatcgcagtcagattggatgatccaaaggaggatatttctaggtggaagattgaggcgttggtgaggaaggttatgactgagaaggaaggtgaagcgatgagaaggaaagtgaagaagttgagagactcggcggagatgtcactgagcattgacggtggtggtttggcgcacgagtcgctttgcagagtcaccaaggagtgtcaacggtttttggaacgtgtcgtggacttgtcacgtggtgcttag

SEQ ID NO: 34 - protein, 481 aa, Arabidopsis thaliana
MHITKPHAAMFSSPGMGHVIPVIELGKRLSANNGFHVTVFVLETDAASAQSKFLNSTGVDIVKLPSPDIYGLVDPDDHVVTKIGVIMRAAVPALRSKIAAMHQKPTALIVDLFGTDALCLAKEFNMLSYVFIPTNARFLGVSIYYPNLDKDIKEEHTVQRNPLAIPGCEPVRFEDTLDAYLVPDEPVYRDFVRHGLAYPKADGILVNTWEEMEPKSLKSLLNPKLLGRVARVPVYPIGPLCRPIQSSETDHPVLDWLNEQPNESVLYISFGSGGCLSAKQLTELAWGLEQSQQRFVWVVRPPVDGSCCSEYVSANGGGTEDNTPEYLPEGFVSRTSDRGFVVPSWAPQAEILSHRAVGGFLTHCGWSSTLESVVGGVPMIAWPLFAEQNMNAALLSDELGIAVRLDDPKEDISRWKIEALVRKVMTEKEGEAMRRKVKKLRDSAEMSLSIDGGGLAHESLCRVTKECQRFLERVVDLSRGA

SEQ ID NO: 35 - DNA, 351 bp, Arabidopsis thaliana
atgatgagagttgtgttaccactatgcctgcttcttgcttccatatttgcatggggttctgaagcagccatatcttgcaacgccgtacaggccaacctttacccgtgcgttgtgtacgtggtgcagggaggagccattccgtatagctgttgcaatggcatcaggatgctcagcaaacaggcaactagcgcatcagacaaacaaggtgtgtgtcgctgcatcaagtctgtggtgggaagagtgtcttactcgtcaatctatctcaagaaagctgctgctttgccaggcaagtgcggtgtcaaacttccttacaagatcgacccttccaccaactgcaacagcattaagtga

SEQ ID NO: 36 - protein, 116 aa, Arabidopsis thaliana
MMRVVLPLCLLLASIFAWGSEAAISCNAVQANLYPCVVYVVQGGAIPYSCCNGIRMLSKQATSASDKQGVCRCIKSVVGRVSYSSIYLKKAAALPGKCGVKLPYKIDPSTNCNSIK

SEQ ID NO: 37 - DNA, 324 bp, Arabidopsis thaliana
atggctataatgaagaaaacttcaaaactcactcaaacagcaatgctgaagcagattctgaagagatgctcgagcttagggaagaagaatggaggagggtacgatgaagattgccttccgcttgacgtaccaaagggacacttccctgtctatgtcggagagaacagaagcagatacattgtcccaatctccttcttgacacatcctgagttccaatctctcttacaacgagccgaggaagaatttggattcgatcacgacatgggtctcaccattccttgtgatgaactcgtttttcaaaccctaacatccatgatccgatga

SEQ ID NO: 38 - protein, 107 aa, Arabidopsis thaliana
MAIMKKTSKLTQTAMLKQILKRCSSLGKKNGGGYDEDCLPLDVPKGHFPVYVGENRSRYIVPISFLTHPEFQSLLQRAEEEFGFDHDMGLTIPCDELVFQTLTSMIR

SEQ ID NO: 39 - DNA, 825 bp, Arabidopsis thaliana
atgtcagaggtggaaatagagaacgctgctacgatcgaaggaaacaccgctgcggatgcgccggtgacggatgcggccgttgagaagaagcctgcagcgaaaggacgaaagacgaagaatgttaaggaagtgaaggagaagaagactgttgctgccgctccgaagaagagaactgtttcatctcatcctacttacgaagagatgattaaggatgcgattgttacgttgaaagagagaactggatctagccaatacgcgattcagaagttcatcgaggagaagcgtaaggagcttcctccaacattcagaaagctgttgcttctcaatctgaagagactcgttgcttctgggaagcttgtgaaggtcaaagcctcgtttaaactcccatcggcgtcggctaaagcatcatcccctaaggcggcagcggagaaatctgctcctgcgaagaagaaaccggcgactgtggcggttaccaaggcgaagagaaaggtcgctgcggcttccaaggctaagaaaacaatcgccgttaaacctaagactgctgctgctaagaaagtgaccgcgaaggctaaggctaagcccgttcctcgtgccactgctgctgcaactaagaggaaagctgttgatgcgaagcccaaggctaaggctagaccagccaaggcagccaaaacggccaaggttacatctccggctaagaaagctgttgctgccacgaagaaagttgctacggtggccacaaagaagaagactccggttaagaaggttgtgaagccaaagacggttaagtctccagcaaagagggcttcttctagggttaagaagtga

SEQ ID NO: 40 - protein, 274 aa, Arabidopsis thaliana
MSEVEIENAATIEGNTAADAPVTDAAVEKKPAAKGRKTKNVKEVKEKKTVAAAPKKRTVSSHPTYEEMIKDAIVTLKERTGSSQYAIQKFIEEKRKELPPTFRKLLLLNLKRLVASGKLVKVKASFKLPSASAKASSPKAAAEKSAPAKKKPATVAVTKAKRKVAAASKAKKTIAVKPKTAAAKKVTAKAKAKPVPRATAAATKRKAVDAKPKAKARPAKAAKTAKVTSPAKKAVAATKKVATVATKKKTPVKKVVKPKTVKSPAKRASSRVKK

SEQ ID NO: 41 - DNA, 1299 bp, Arabidopsis thaliana
atgtgggatctaaacgacgcaccacaccaaacacaaagagaagaagaatctgaagagttttgttattcttcaccaagtaaacgggttggatctttctctaattcaagctcttcagctgttgttatcgaagatggatccgatgacgatgaacttaaccgggtcagacccaataacccacttgtcacccatcagttcttccctgagatggattctaacggcggtggtgttgcttctggctttcctcgggctcactggtttggtgttaagttttgtcagtcggatctagccaccggatcgtccgcgggtaaagctaccaacgttgccgctgccgtagtggagccggcacagccgttgaaaaagagtcggcgtggaccaagatcaagaagttctcagtatagaggtgttacgttttaccggcgtaccggaagatgggaatctcatatttgggactgtgggaaacaagtttacttaggtggatttgacactgctcatgcagcagctcgagcatatgatagagctgctattaaattccgtggagtagaagcggatatcaatttcaacatcgacgattatgatgatgacttgaaacagatgactaatttaaccaaggaagagttcgtacacgtacttcgccgacaaagcacaggcttccctcgaggaagttcgaagtatagaggtgtcactttgcataagtgtggtcgttgggaagctcgaatgggtcaattcttaggcaaaaagtatgtttatttgggtttgttcgacaccgaggtcgaagctgctagagcttacgataaagctgcaatcaaatgtaacggcaaagacgccgtgaccaactttgatccgagtatttacgatgaggaactcaatgccgagtcatcagggaatcctactactccacaagatcacaacctcgatttgagcttgggaaattcggctaattcgaagcataaaagtcaagatatgcggctcaggatgaaccaacaacaacaagattctctccactctaatgaagttcttggattaggtcaaaccggaatgcttaaccatactcccaattcaaaccaccaatttccgggcagcagcaacattggtagcggaggcggattctcactgtttccggcggctgagaaccaccggtttgatggtcgggcctcgacgaaccaagtgttgacaaatgctgcagcatcatcaggattctctcctcatcatcacaatcagatttttaattctacttctactcctcatcaaaattggctgcagacaaatggcttccaacctcctctcatgagaccttcttga

SEQ ID NO: 42 - protein, 432 aa, Arabidopsis thaliana
MWDLNDAPHQTQREEESEEFCYSSPSKRVGSFSNSSSSAVVIEDGSDDDELNRVRPNNPLVTHQFFPEMDSNGGGVASGFPRAHWFGVKFCQSDLATGSSAGKATNVAAAVVEPAQPLKKSRRGPRSRSSQYRGVTFYRRTGRWESHIWDCGKQVYLGGFDTAHAAARAYDRAAIKFRGVEADINFNIDDYDDDLKQMTNLTKEEFVHVLRRQSTGFPRGSSKYRGVTLHKCGRWEARMGQFLGKKYVYLGLFDTEVEAARAYDKAAIKCNGKDAVTNFDPSIYDEELNAESSGNPTTPQDHNLDLSLGNSANSKHKSQDMRLRMNQQQQDSLHSNEVLGLGQTGMLNHTPNSNHQFPGSSNIGSGGGFSLFPAAENHRFDGRASTNQVLTNAAASSGFSPHHHNQIFNSTSTPHQNWLQTNGFQPPLMRPS

SEQ ID NO: 43 - DNA, 429 bp, Arabidopsis thaliana
atgagtacaggcgcaggaagcggaacaaccaaaggtggcagaggaaagccaaaggccaccaaatccgtctctcgatcatctaaagccggtcttcaattccccgtcggaagaatcgctagattcctcaaatccggtaaatacgccgagcgtgtcggtgccggagctccggtctatctctccgctgttctcgagtacctcgccgccgaggtgttggagctggcgggaaacgcagcaagggataacaagaagacacgtatagtaccaagacacattcagcttgcagtgaggaacgatgaagagttaagcaaacttctgggaagtgtgacgattgcgaatggaggagttttgccaaatattcatcagactcttttgccatccaaggttggcaagaacaaaggagatattggatctgcttctcaggagttctga

SEQ ID NO: 44 - protein, 142 aa, Arabidopsis thaliana
MSTGAGSGTTKGGRGKPKATKSVSRSSKAGLQFPVGRIARFLKSGKYAERVGAGAPVYLSAVLEYLAAEVLELAGNAARDNKKTRIVPRHIQLAVRNDEELSKLLGSVTIANGGVLPNIHQTLLPSKVGKNKGDIGSASQEF

SEQ ID NO: 45 - DNA, 1545 bp, Arabidopsis thaliana
atggtagcagaagaagcaagaaaagaagccatggctaaatcagtatctggcgggaagattacttattttgtggtggcttcatgtgtcatggccgccatgggcggtgtcatcttcggctacgacatcggggtttcaggtggagtgatgtcaatggggccatttctaaaaagatttttcccaaaagtgtataagctccaagaagaagatagaagaagaagaggcaatagcaataaccactactgccttttcaatagccaacttcttacatccttcacatcttctctatacgtttccggtctcatcgctactctgttagcttcgtccgtgactcgttcatggggtcgcaagccctctatatttcttggcggtgtgtcctttctcgccggcgctgctcttggtggctctgctcaaaacgttgctatgctcattattgcgcgtctcttgctcggcgtaggagttggattcgctaaccagtcggttcctctgtatctctccgagatggcgccggcaaaatacagaggagcaatcagcaatggtttccagctctgtatcggaattggatttctatctgcaaatgtaataaactacgaaacccaaaatatcaaacatggttggagaatctctttagccacagctgcaatacctgcttcaatcctcactttaggatcactgtttctcccggaaacgccgaatagtatcatccagaccaccggagatgttcacaagaccgagcttatgcttcgccgtgtccgtggaactaacgacgttcaagatgagcttactgatctcgttgaagcgagttctggttctgatacagattcaaacgcgtttttgaaactgcttcaaagaaaatataggcctgagttagtgatggctttggtgatacctttctttcagcaagttactggaatcaatgttgttgctttctacgcaccggttttgtatagaaccgttgggtttggagagagtggttcgttgatgtcgaccctcgtgactggaatcgtgggaacctcgtcgacgttgttgtcgatgcttgtcgttgacagaatcggtagaaagactctgtttttgattggagggttacagatgctcgtgtcgcaagttaccattggtgtgatcgttatggtggctgatgttcacgacggtgtgatcaaggaagggtatggttacgcggttgtggttttggtgtgtgtctacgtggccgggtttggttggtcttggggtccattaggatggcttgtaccgagtgagatttttccgttggagataagatcggtggcgcagagtgtaactgtggcagtgagttttgtgtttacttttgcggtggctcaaagtgcaccaccgatgttgtgtaagtttcgagctgggattttcttcttttatggagggtggttggtggtaatgacggtagcggtgcagctgtttttgccggagactaagaatgttccaatcgagaaggtggttggactttgggagaagcattggttttggaggagaatgacgagcaagcgtgatatccaagaaaccaccattcttagccattga

SEQ ID NO: 46 - protein, 514 aa, Arabidopsis thaliana
MVAEEARKEAMAKSVSGGKITYFVVASCVMAAMGGVIFGYDIGVSGGVMSMGPFLKRFFPKVYKLQEEDRRRRGNSNNHYCLFNSQLLTSFTSSLYVSGLIATLLASSVTRSWGRKPSIFLGGVSFLAGAALGGSAQNVAMLIIARLLLGVGVGFANQSVPLYLSEMAPAKYRGAISNGFQLCIGIGFLSANVINYETQNIKHGWRISLATAAIPASILTLGSLFLPETPNSIIQTTGDVHKTELMLRRVRGTNDVQDELTDLVEASSGSDTDSNAFLKLLQRKYRPELVMALVIPFFQQVTGINVVAFYAPVLYRTVGFGESGSLMSTLVTGIVGTSSTLLSMLVVDRIGRKTLFLIGGLQMLVSQVTIGVIVMVADVHDGVIKEGYGYAVVVLVCVYVAGFGWSWGPLGWLVPSEIFPLEIRSVAQSVTVAVSFVFTFAVAQSAPPMLCKFRAGIFFFYGGWLVVMTVAVQLFLPETKNVPIEKVVGLWEKHWFWRRMTSKRDIQETTILSH

SEQ ID NO: 47 - DNA, 2688 bp, Arabidopsis thaliana
atgaagatcacagagggacgattccgtctctctcttcttcttcttcttcttctcatatctgcagcaactttaatctcagctgctgattactctccaacagagaaaatcctattgaattgcggtggtggtgcttctaatctaaccgacacagataaccgtatatggatctccgatgtcaaatcaaaattcttatcatcttcctctgaagactctaaaacatcaccagcgttaacacaagatccttccgttcccgaagttccttacatgacggcgagagttttccgatctcctttcacttacactttccctgtagcatcaggtcgtaaattcgtgcgtctctacttctacccaaactcgtacgacggtctcaacgctaccaactcgttattctccgtctcctttggtccttacactcttctcaagaatttcagtgcttctcagacggcggaggcgttgacttacgctttcatcatcaaagagtttgttgtcaacgttgaaggtggaacgttgaacatgacgtttacaccggaatcagctccgtctaatgcgtatgcgtttgttaatgggattgaggttacttcaatgcctgatatgtatagtagtactgatgggactttgactatggttggatcatctggctctgttactattgataacagtactgctcttgagaatgtgtataggctcaatgttggagggaatgatatctcgccttccgcggatacgggtttgtataggtcgtggtatgatgatcagccttatatatttggtgcaggacttggtattccagagactgctgatcccaacatgacgattaagtatcctacggggactcctacttatgttgctcctgtggatgtttattcaaccgcgaggtctatgggtccaacagctcagatcaatctcaactacaatcttacttggattttcagcattgactctggtttcacttaccttgttagacttcatttctgtgaggtttcttcgaatatcactaagatcaaccaacgggtgtttacaatctacctcaacaatcaaactgctgagcctgaagctgatgtgattgcttggactagttcaaacggggttccgtttcacaaggattacgtggtgaatcctccagagggaaatggacagcaagatttgtggcttgctcttcatcctaacccagttaacaagccggagtattatgattctcttcttaatggagtggagatattcaagatgaatacttctgatggtaatctggctggtaccaatcctatacctggtccacaggtgactgctgatccatctaaagtcctacgcccgactactaggaaatcgaaaagcaatacggctattattgcaggcgcagccagtggtgcagttgttctggcccttatcattgggttttgtgtgtttggtgcttaccgcagacgtaagcgtggtgattaccagcctgctagtgatgcaacatcagggtggcttccactatctctgtatggaaactcacattctgctggctcggcgaagacaaacacaacaggaagttatgcctcgtcccttccgtcaaatctttgccgtcacttctcgtttgctgagatcaaagctgccactaaaaactttgatgagtcccgggtgcttggtgttggtggtttcggcaaggtttacagaggagagattgatggcggaactacaaaggtagccatcaagagaggcaacccaatgtccgagcaaggtgtacatgagttccagactgagattgaaatgctttcaaagcttagacatcgtcatcttgtgtccttgattggatactgtgaagagaactgcgaaatgatcttagtctatgattacatggctcatggtacaatgagggagcatctctacaaaacccagaatccttctcttccatggaagcaacgtcttgagatatgcattggagcagcccgaggtttacactatctacacactggtgcaaaacacacaatcatccatagagatgtgaagacaacaaacattctattggatgagaaatgggtggccaaggtctctgattttggtctatcgaagactggtcctacactagaccacacacacgtaagcacagttgtgaaaggaagtttcggttatcttgacccagagtatttcagacggcagcaactgactgagaaatccgatgtctactcctttggcgttgttctattcgaagctctatgcgctcgtccagccttgaacccaacacttgcaaaggaacaagtgagcttagctgagtgggcaccatactgctacaagaaaggcatgctagatcaaatcgttgatccctacctcaagggcaagatcacaccagaatgcttcaaaaagtttgctgaaaccgcgatgaagtgtgttctagaccagggcattgagagaccatcaatgggagatgttctgtggaacttagaatttgcgttgcagctccaggaaagcgcagaagagaacggaaaaggagtatgcggtgacatggacatggatgagattaagtacgatgatggaaactgtaaaggaaagaacgacaagagttctgatgtgtatgaagggaatgtgacggactcgaggagcagtggaatagatatgagcatcggtggtaggagtttggccagcgaagattcagatggactcactccaagtgctgtgttttctcagatcatgaatccaaagggacgttag

SEQ ID NO: 48 - protein, 895 aa, Arabidopsis thaliana
MKITEGRFRLSLLLLLLLISAATLISAADYSPTEKILLNCGGGASNLTDTDNRIWISDVKSKFLSSSSEDSKTSPALTQDPSVPEVPYMTARVFRSPFTYTFPVASGRKFVRLYFYPNSYDGLNATNSLFSVSFGPYTLLKNFSASQTAEALTYAFIIKEFVVNVEGGTLNMTFTPESAPSNAYAFVNGIEVTSMPDMYSSTDGTLTMVGSSGSVTIDNSTALENVYRLNVGGNDISPSADTGLYRSWYDDQPYIFGAGLGIPETADPNMTIKYPTGTPTYVAPVDVYSTARSMGPTAQINLNYNLTWIFSIDSGFTYLVRLHFCEVSSNITKINQRVFTIYLNNQTAEPEADVIAWTSSNGVPFHKDYVVNPPEGNGQQDLWLALHPNPVNKPEYYDSLLNGVEIFKMNTSDGNLAGTNPIPGPQVTADPSKVLRPTTRKSKSNTAIIAGAASGAVVLALIIGFCVFGAYRRRKRGDYQPASDATSGWLPLSLYGNSHSAGSAKTNTTGSYASSLPSNLCRHFSFAEIKAATKNFDESRVLGVGGFGKVYRGEIDGGTTKVAIKRGNPMSEQGVHEFQTEIEMLSKLRHRHLVSLIGYCEENCEMILVYDYMAHGTMREHLYKTQNPSLPWKQRLEICIGAARGLHYLHTGAKHTIIHRDVKTTNILLDEKWVAKVSDFGLSKTGPTLDHTHVSTVVKGSFGYLDPEYFRRQQLTEKSDVYSFGVVLFEALCARPALNPTLAKEQVSLAEWAPYCYKKGMLDQIVDPYLKGKITPECFKKFAETAMKCVLDQGIERPSMGDVLWNLEFALQLQESAEENGKGVCGDMDMDEIKYDDGNCKGKNDKSSDVYEGNVTDSRSSGIDMSIGGRSLASEDSDGLTPSAVFSQIMNPKGR

SEQ ID NO: 49 - DNA, 2013 bp, Arabidopsis thaliana
atggaaagaaatggtggtcactacactgataagacgagagtgttggatattaaaccattgcgtactctaagacctgtgtttcccagtggaaatcaagctccgccttttgtgtgtgctcctccttttggaccatttcctcctgggttctcatcgttttatccgtttagttcgtctcaagcgaatcagcacacaccagatcttaaccaagctcagtatccaccgcaacatcagcagcctcagaatccaccaccggtatatcagcagcagcctcctcagcatgcatctgagccttcgttggttactcctttaaggtcatttagatctcctgatgtgtctaatggcaacgcggaacttgaggggtcaactgtgaaaagaaggatccctaaaaagcgtcccatttctcggcctgagaatatgaatttcgagagtgggattaatgtggctgatagagagaatggcaatagggagttggtgttgagtgttcttatgcggtttgatgcgttaagaagaaggtttgcacaacttgaggatgctaaggaagcagttagtgggattatcaaacgccctgatttgaaatcaggatctacttgtatgggcagaggggtgcggacaaacaccaaaaaaagacctggtattgttcctggtgttgagattggggacgtattcttcttcaggtttgagatgtgtttggtggggttgcattctccatcaatggctgggattgactatctggttgtcaagggagaaacggaagaagaacctatcgccactagcattgtctcatctggatattatgataatgacgaaggtaatcctgatgttttgatttatactggtcagggtggtaatgctgataaagataagcaatcttctgaccaaaagctcgaaaggggtaatcttgccttggagaagagcttgcgtagagatagtgcagttagggtaataaggggcttgaaagaggcttctcataatgctaagatctatatttatgatggactctatgagattaaagagtcatgggtagagaaaggaaaatctggacacaacaccttcaagtataaactagttagagctcctggtcaaccgcctgcatttgcttcatggactgcaatccagaaatggaagacgggtgtgccttcaaggcaaggactcattcttcccgatatgacttccggggttgaaagcatacctgtttcacttgttaacgaagttgataccgacaatgggcctgcttatttcacctactccacaactgtgaaatactcagagtcgtttaagctgatgcagccttcttttggatgtgattgtgccaacttatgcaaaccagggaacttggattgtcactgcataaggaaaaatggaggtgacttcccctacaccggtaatggaattctagttagccgaaagcctatgatatatgaatgcagtccatcttgcccgtgctcgacttgcaaaaacaaggtgactcaaatgggagtaaaagtgaggctggaagttttcaagacagcgaatagaggatggggattgcggtcatgggatgctattcgtgctggttcttttatatgtatctatgtaggtgaggccaaagacaaatcaaaggtgcagcaaactatggctaatgatgattatacttttgatacaaccaatgtgtataaccctttcaagtggaactacgaacctggcttagcagacgaagatgcttgtgaagagatgtctgaagaatctgaaatcccgctgccactgataatcagtgctaagaatgttgggaacgttgcccgattcatgaatcatagttgctcacctaatgttttctggcagccggttagttatgaaaataacagtcaactctttgtgcatgtggccttctttgccatttctcacatccctccaatgactgagttaacttacgactatggagtatctagaccaagtgggactcaaaatggcaatcctttatatggcaaaaggaaatgcttctgtggatcagcgtattgccgtggctcatttggatga

SEQ ID NO: 50 - protein, 670 aa, Arabidopsis thaliana
MERNGGHYTDKTRVLDIKPLRTLRPVFPSGNQAPPFVCAPPFGPFPPGFSSFYPFSSSQANQHTPDLNQAQYPPQHQQPQNPPPVYQQQPPQHASEPSLVTPLRSFRSPDVSNGNAELEGSTVKRRIPKKRPISRPENMNFESGINVADRENGNRELVLSVLMRFDALRRRFAQLEDAKEAVSGIIKRPDLKSGSTCMGRGVRTNTKKRPGIVPGVEIGDVFFFRFEMCLVGLHSPSMAGIDYLVVKGETEEEPIATSIVSSGYYDNDEGNPDVLIYTGQGGNADKDKQSSDQKLERGNLALEKSLRRDSAVRVIRGLKEASHNAKIYIYDGLYEIKESWVEKGKSGHNTFKYKLVRAPGQPPAFASWTAIQKWKTGVPSRQGLILPDMTSGVESIPVSLVNEVDTDNGPAYFTYSTTVKYSESFKLMQPSFGCDCANLCKPGNLDCHCIRKNGGDFPYTGNGILVSRKPMIYECSPSCPCSTCKNKVTQMGVKVRLEVFKTANRGWGLRSWDAIRAGSFICIYVGEAKDKSKVQQTMANDDYTFDTTNVYNPFKWNYEPGLADEDACEEMSEESEIPLPLIISAKNVGNVARFMNHSCSPNVFWQPVSYENNSQLFVHVAFFAISHIPPMTELTYDYGVSRPSGTQNGNPLYGKRKCFCGSAYCRGSFG

SEQ ID NO: 51 - DNA, 936 bp, Arabidopsis thaliana
atgatgaagagattaagtagttcagattcagtgggtggtctcatctctttatgtcctacaacttccacagatgagcagagtccgaggagatacggtgggagagagtttcagtcgatgcttgaaggatacgaggaagaagaagaagctatagtagaagaaagaggacacgtgggcttgtcggagaagaagagaaggttaagcattaaccaagttaaagctttggagaagaattttgagttagagaataagcttgagcctgagaggaaagttaagttagctcaagaacttggtcttcaacctcgtcaagttgctgtttggtttcaaaaccgtcgtgctcggtggaagacaaaacagcttgagaaagattacggtgttcttaaaacccagtacgattctctccgtcataactttgattccctccgccgtgacaatgaatctctccttcaagagattagtaaactgaaaacgaagcttaatggaggaggaggagaagaagaagaagaagagaacaacgcggcggtgacaacggagagtgatatttcggtcaaggaggaagaagtttcgttgccggagaagattacagaggcaccgtcgtctcctccacagtttcttgaacattctgatggtcttaattaccggagtttcacagatctacgtgatcttcttccattaaaggcggcggcttcttcattcgccgccgcagctggatcttcagacagtagcgattcaagcgctctgctgaatgaagaaagcagctctaatgtcactgtggcggctccggtgacggttccaggaggtaatttcttccagtttgtgaaaatggagcagacggaggatcatgaggactttctgagtggagaagaagcttgtgaattcttttccgatgaacaaccgccgtctctacactggtactccaccgttgatcattggaattga

SEQ ID NO: 52 - protein, 311 aa, Arabidopsis thaliana
MMKRLSSSDSVGGLISLCPTTSTDEQSPRRYGGREFQSMLEGYEEEEEAIVEERGHVGLSEKKRRLSINQVKALEKNFELENKLEPERKVKLAQELGLQPRQVAVWFQNRRARWKTKQLEKDYGVLKTQYDSLRHNFDSLRRDNESLLQEISKLKTKLNGGGGEEEEEENNAAVTTESDISVKEEEVSLPEKITEAPSSPPQFLEHSDGLNYRSFTDLRDLLPLKAAASSFAAAAGSSDSSDSSALLNEESSSNVTVAAPVTVPGGNFFQFVKMEQTEDHEDFLSGEEACEFFSDEQPPSLHWYSTVDHWN

SEQ ID NO: 53 - DNA, 1275 bp, Arabidopsis thaliana
atggcggtggagtatgtatgttgcagcccaaacttctttatacatatagctgtgattgtgtttcttgtcttgttcgctggactcatgtctggcttaacattgggtcttatgtctttgagtctcgttgatcttgaagttctcgctaaatccggtacacctgaacatcgtaaatatgcagcaaagatattgccagtggtaaagaatcagcacttgttgcttgtcactttacttatatgcaatgcagctgctatggagacgcttcctatttttcttgatggccttgtgacggcatggggtgccattttgatttcagttacattgattcttctctttggtgagattatacctcagtcgatttgttcacgttatggtttagcgattggtgcaacagtggctccgtttgtccgtgtcctagtctttatctgcttacctgttgcatggccaataagcaagttgctggactttctattgggtcatcgtcgtgcagcgctttttcgaagagctgagctgaaaacacttgtggattttcatggaaatgaggctggaaagggtggggagttgactcatgacgaaacgacaatcattgcaggagctcttgaactctctgagaaaatggtcaaagatgcaatgacaccaatatcggatatctttgtgattgatatcaatgccaaactagacagagacttgatgaacttgattcttgagaaagggcatagcagagttccagtatactatgagcagccaactaacataatcggccttgttctggtgaagaacttattaactatcaacccagatgaagaaatacctgtcaagaatgtcacgataagaaggattccaagagttccagaaatcttgcctttatatgacatattgaacgaattccagaaaggactcagccacatggctgttgttgtaagacagtgtgacaaaatccacccattaccttctaaaaatgggagtgttaaggaagcccgagtggatgtggatagtgagggaactcctactcctcaggagagaatgttaaggacaaaaagatcgcttcaaaagtggaagagctttccgaatcgagcaagttcgtttaaaggagggtcaaagagcaagaagtggtcaaaagacaatgatgcagacatcctgcaattgaatggcaatccgctgcctaaacttgctgaggaagaagaagcagtcggaatcattacgatggaggatgtcattgaagaacttctgcaggaggagatctttgacgaaactgatcaccattttgaagactcctaa

SEQ ID NO: 54 - protein, 424 aa, Arabidopsis thaliana
MAVEYVCCSPNFFIHIAVIVFLVLFAGLMSGLTLGLMSLSLVDLEVLAKSGTPEHRKYAAKILPVVKNQHLLLVTLLICNAAAMETLPIFLDGLVTAWGAILISVTLILLFGEIIPQSICSRYGLAIGATVAPFVRVLVFICLPVAWPISKLLDFLLGHRRAALFRRAELKTLVDFHGNEAGKGGELTHDETTIIAGALELSEKMVKDAMTPISDIFVIDINAKLDRDLMNLILEKGHSRVPVYYEQPTNIIGLVLVKNLLTINPDEEIPVKNVTIRRIPRVPEILPLYDILNEFQKGLSHMAVVVRQCDKIHPLPSKNGSVKEARVDVDSEGTPTPQERMLRTKRSLQKWKSFPNRASSFKGGSKSKKWSKDNDADILQLNGNPLPKLAEEEEAVGIITMEDVIEELLQEEIFDETDHHFEDS

SEQ ID NO: 55 - DNA, 1416 bp, Arabidopsis thaliana
atggcggccaaagtcttcactcagaaccctatctattctcaatctctagttagagacaaaactcctcaacagaaacacaatcttgaccatttctctatatcccagcacacctctaaaagactcgttgtctcttcttctacaatgtcccctccgatttcatcttctccactctctcttccttcttcttcttcttctcaggccattcctccttctcgagcacctgcagtgactctaccgttgtctcgggtttggagagagatacaagggagcaataactgggaaaatctcattgaacctctaagccctattctccaacaagagatcactcgctacgggaacttactctccgcttcttacaaagggtttgatctaaaccctaactccaaacgttacttgagttgcaagtatggaaaaaagaacttgcttaaagaatccggaatccatgaccctgatggctaccaagtcaccaagtatatctacgccacaccagacatcaacctcaaccctatcaagaacgagcctaaccgtgcacgttggatcggttatgtagcggtttcttctgatgaatcggtgaaacgtttgggaaggagggatattttggtgacgtttcgtggcactgtcaccaaccatgagtggttagctaacctaaagagctctttgactccggctaggcttgatcctcataaccctcgtcctgatgtcaaggtcgaatccgggttcttaggtttatacacatccggtgagagcgagagcaaattcgggctagaaagctgccgtgagcagcttctctccgagatctcgaggcttatgaacaagcacaaaggcgaggaaataagcataacacttgcgggacatagtatggggagttctctagctcagcttctagcttacgacatagcggaactcggtatgaaccagagaagggacgaaaaacctgttccggtgaccgtgttttcgtttgctggtcctagagttggtaacttggggttcaaaaaacggtgtgaggagctaggagttaaagtcttgaggatcacgaatgtaaacgatccgatcaccaaacttccaggtttcttatttaatgagaatttcagatctttaggtggtgtttacgagcttccttggagctgttcttgctacactcacgtgggagtcgaactcaccctcgatttcttcgatgttcaaaacatttcttgtgtccatgacctcgagacttacatcactctagtaaaccgtccgagatgctcgaaattggcggttaatgaagacaattttggcggcgagtttttgaacagaacaagtgaactgatgttcagtaagggacgacgtcaagcgttgcattttacaaacgcagcgaccaatgcggcatatctactttgttctatatccaaccatatgttgtattataatatattttag

SEQ ID NO: 56 - protein, 471 aa, Arabidopsis thaliana
MAAKVFTQNPIYSQSLVRDKTPQQKHNLDHFSISQHTSKRLVVSSSTMSPPISSSPLSLPSSSSSQAIPPSRAPAVTLPLSRVWREIQGSNNWENLIEPLSPILQQEITRYGNLLSASYKGFDLNPNSKRYLSCKYGKKNLLKESGIHDPDGYQVTKYIYATPDINLNPIKNEPNRARWIGYVAVSSDESVKRLGRRDILVTFRGTVTNHEWLANLKSSLTPARLDPHNPRPDVKVESGFLGLYTSGESESKFGLESCREQLLSEISRLMNKHKGEEISITLAGHSMGSSLAQLLAYDIAELGMNQRRDEKPVPVTVFSFAGPRVGNLGFKKRCEELGVKVLRITNVNDPITKLPGFLFNENFRSLGGVYELPWSCSCYTHVGVELTLDFFDVQNISCVHDLETYITLVNRPRCSKLAVNEDNFGGEFLNRTSELMFSKGRRQALHFTNAATNAAYLLCSISNHMLYYNIF

SEQ ID NO: 57 - DNA, 4380 bp, Arabidopsis thaliana
atggaggagaatcgtcggaatccgtcggccggtatggaagttccagttgccggcggcggaaatgtcgtcaaatggattgagatatctgttccttcaccttctgtttcatcttctagtatcggtgctaattcaagtgaggacaatgagtgtgttcagcttcctttgtctgaagactacgcttctagctctgtaattggggaaccttcgatctctttcgtttggagaatcaacaagacgagtccaaatgctctcgagcttcttcagctctcagctaagtctggatttccaataacaggactgcgtttcgtctttgctcagactctttctccttttgcttttgtatacgccgatgagggtggtgatagtggtcgtcttgtctactttctttactctctcacgccgtctggtgttgtctacgttcttaaactctcgaatacgttagcatataagtctggttcagtcttcccgcttgatcatttgattcacttggatgttcgaccttacttgaacgagagtcgtgttactagtgttgctgcatcgcctggtttcatttttctcgggaggtccgatggttgtgtctcttgcttccaacctattgtgtattttcagaaatcttcaggtttccaccaggagctgcgtgatgatacaggatttggtcgtctggggacagttgttgcagccgtgcaagatttatttatatcagaagttcatggaagaaattatctatgtgtgcttcatgctgacggggcattacgtgtctgggatattttgacttatagcagggttttatgtcagagtatagctgctaagaaccttgagggggttatgtgtgtgaggttatggttgggcaaagctgattacgattctggcatcattccattagctgtcttgtatagaaagagtatgaatgacagcatggacgtgatcactgtatatggcctgcactttagttctgcggaggggatagctttgtctctagattctggattacagaatataccactggaagagggggaattgcgggatgtcagatttacatccgacaagatctggactctaaaggccaatgaattaacatcttacatgttgtgccagaaatctagcaccatggaagcgcagtcttacacgttgcaggaagactacatttctgaacagctatttctgagttctaggagctcttcacatgatcttcttttgactactcattcactgttttcatccgcaaaggatcaaattatgggattcatttcgtcaatcttcttacgcaggcttctttgtcctggaatttttcacaatgttgccttacgtctaactttactggaccacaacaaaaactggactgattccgagtttcaatctttaagtcttgatgagcttacaagcgagattcttttactggttgagcatgagtcagatgttattggtttagttagaaataattctgtatcactgttttttagattggagaacgctgagcacagccttggaggttcttcctccgaacacagcaacctgacgagcttagacttgggcgtgtctcacagcgaccatgaaattctggcagaggtactaagatgtacttcgaagatcagtaaacagtggggtggtgctccttatgccatgtattatgaatcaattaccggaaggccaattatctcatcggatgaaatcgttcctcgcttagttaacatccttgagtcgggatattctacgaccataggtcaacgtacttggtcagatcttggtgctgatagagcatgggaaaaagagctagaagctcataaaaatcttagaacattctccattgacatgctgctgtctctctctgctctatgtcaaagggctggatcttgggaaaaagtctttactatcatggagcactatttgcagtatttggtccctaaaaaatctatgcagaaaaatgatggtgaggcattatctgatatctgtagttctatcctcgtccaagccacttctcagtttgtaaaggtgatgtttgagtcggcatttgacatcttcctactcatcagctatctgcttaacatcgctgggcaggttaatatgtcacagcaagacatatgcaagctacggcttgagttgcttccaatgatccaagatattgtctcagagtggctcatcatccttttctttgttaccactccagctgagtcaacttctatggaagatttcagcttgaaactttcatctctacagattgatagcagcattgacaaaagatcatggaacgcaatgctagggaaatgtggtttctcactggcgtttattcttctctttagtgaccgaagttgcattgtggatggccgctttaacttgagatatcttccgagttcacaaatcattacaagtttggtgcaaaactttatcagctggattcggtatagtaaaacaggagatgactcttcttcactgctaagacgctccacggaacttagtcttaggttgattcggaatggacaatctgatgctgttgagcgaatccttgtggttgtggaggcaagtttacgtggggagaaaacatttggatgttctcaagatactagtggagattggtgtcttcttcaacatctccgtggttgttgccttcttgatcaagtacaacgtggtgcaagtggcatattaagagagagaaagattattgatgccatccgctgcttcttcagagcttcatcaggtgaaggatcttggaaggctttgcacagcttgtctaaagaagcaggattttcacctgccacaacgggtccaagtattttagatggttctacgtcttctgcagcatggaaacttcattactatgagtgggctatgcaaatttttgaacggtacaatataagtgaaggagcttgtcagtttgcctatgcagcccttgagcaagtagatgatgcctataatttcatagagatgactgaggaattcgatccaactaaagcagccacctacactagaggacgactgtgggcaaatgttttcaagttcaccttagatctcaatctcttgaatgatgcctactgtgctataatttcaaaccctgatgaggagattaagcgcatctgtttgaggcgcttcataatagttctatttgaatgtggcaaaacgaagatcctcagtgatggacatctacctttcatcggcttaacagagaagatcacccaagagcttttttggaaggccggacgttctgatataatgatgaagccaaatccatacaagctgctttatgcttatgagatgagacgacacaattggcgaatggcggcaagttacatgtatcagttttctgcccgtttgagaagcgagggagcatgcaaggattacaaacacatgtccctagttttgcaagagaggcttaatggactttctgctgctatgaatgcattagcccttgttcatcctgggtatgcttggattgatccagtaccagaagaaaccacacgttatccggttaaaaaggctagaagagcagaagaagaacaattaaggagtaatgaccagcccaaaggggagaagagttgcattgatatcgagaaactccaaaacgagtttgtttttactactgctgaatatatgctttctctgaaaaatttcgggtggacatattcaggactcgaaaagccaccatcagatttggttgaccttcttgtccaggcaaacttgtatgacatggcattcactgttgttttgaaattttggaggggctccgctttgaaaagggagctggaaaagatatttgagaatatggcaattaaatgttgccctgctaaaggaactctgtggtcatcgcctaatcttatgttaacatctaacgatgaagaagttactcattcgcctgatagaagccctgctgatcagggctctaagttggctggtgattgggaaattcttgaggtttatctgaagaggtacatagacatacacgctagactaccggtttctgttgcttcaacccttcttcaagcagattcttgtatcgaattgcctctctggctgattcaaatgttcaaggatggtcagaaggaaaaagctttgggaatggctgggcaagaagcaagtcctgcttccttgtttcagttatatgttgattatgggcgtcttacagaggcaactaatttgctacttgagtacatggaatcatttgcttcatcgaaaccagcagaggtattgaagaggaaaaaggtatccggagtttggtttccgtacacaacagtagaaagactatggtgggagctagagaaaacaatgaactcaggacgaatggtggagcaatgccataagctgaaggaacaacttcatcatgcattactcaatcacttaaaactgcttaaggtggactcaaatgatgctgtatcctctgcaaccggttaa

SEQ ID NO: 58 - protein, 1459 aa, Arabidopsis thaliana
MEENRRNPSAGMEVPVAGGGNVVKWIEISVPSPSVSSSSIGANSSEDNECVQLPLSEDYASSSVIGEPSISFVWRINKTSPNALELLQLSAKSGFPITGLRFVFAQTLSPFAFVYADEGGDSGRLVYFLYSLTPSGVVYVLKLSNTLAYKSGSVFPLDHLIHLDVRPYLNESRVTSVAASPGFIFLGRSDGCVSCFQPIVYFQKSSGFHQELRDDTGFGRLGTVVAAVQDLFISEVHGRNYLCVLHADGALRVWDILTYSRVLCQSIAAKNLEGVMCVRLWLGKADYDSGIIPLAVLYRKSMNDSMDVITVYGLHFSSAEGIALSLDSGLQNIPLEEGELRDVRFTSDKIWTLKANELTSYMLCQKSSTMEAQSYTLQEDYISEQLFLSSRSSSHDLLLTTHSLFSSAKDQIMGFISSIFLRRLLCPGIFHNVALRLTLLDHNKNWTDSEFQSLSLDELTSEILLLVEHESDVIGLVRNNSVSLFFRLENAEHSLGGSSSEHSNLTSLDLGVSHSDHEILAEVLRCTSKISKQWGGAPYAMYYESITGRPIISSDEIVPRLVNILESGYSTTIGQRTWSDLGADRAWEKELEAHKNLRTFSIDMLLSLSALCQRAGSWEKVFTIMEHYLQYLVPKKSMQKNDGEALSDICSSILVQATSQFVKVMFESAFDIFLLISYLLNIAGQVNMSQQDICKLRLELLPMIQDIVSEWLIILFFVTTPAESTSMEDFSLKLSSLQIDSSIDKRSWNAMLGKCGFSLAFILLFSDRSCIVDGRFNLRYLPSSQIITSLVQNFISWIRYSKTGDDSSSLLRRSTELSLRLIRNGQSDAVERILVVVEASLRGEKTFGCSQDTSGDWCLLQHLRGCCLLDQVQRGASGILRERKIIDAIRCFFRASSGEGSWKALHSLSKEAGFSPATTGPSILDGSTSSAAWKLHYYEWAMQIFERYNISEGACQFAYAALEQVDDAYNFIEMTEEFDPTKAATYTRGRLWANVFKFTLDLNLLNDAYCAIISNPDEEIKRICLRRFIIVLFECGKTKILSDGHLPFIGLTEKITQELFWKAGRSDIMMKPNPYKLLYAYEMRRHNWRMAASYMYQFSARLRSEGACKDYKHMSLVLQERLNGLSAAMNALALVHPGYAWIDPVPEETTRYPVKKARRAEEEQLRSNDQPKGEKSCIDIEKLQNEFVFTTAEYMLSLKNFGWTYSGLEKPPSDLVDLLVQANLYDMAFTVVLKFWRGSALKRELEKIFENMAIKCCPAKGTLWSSPNLMLTSNDEEVTHSPDRSPADQGSKLAGDWEILEVYLKRYIDIHARLPVSVASTLLQADSCIELPLWLIQMFKDGQKEKALGMAGQEASPASLFQLYVDYGRLTEATNLLLEYMESFASSKPAEVLKRKKVSGVWFPYTTVERLWWELEKTMNSGRMVEQCHKLKEQLHHALLNHLKLLKVDSNDAVSSATG

SEQ ID NO: 59 - DNA, 933 bp, Arabidopsis thaliana
atgggattcgctccggtgactccggcagccgtagaaacttacgatcccgatgtggatcatgatgatgagagtaacggtttggatggatttagggttagatcgaagaggtctgggaagtttagcggtggttactctgattcacctcgagaagtaggagatggatatggggttagatctagggcaaggagtaacatgaaaatgtatggtggtttcaagtctgagtttgattcagatcacgattcaggaagtggatttggattgaaaaggaaatacaatgggaatccaaaggttagtgctgatttcgatgctgattctgatgatgagattgtgttagtccccaaggcaactaggcttaggactcatggcaagccttcctctggtgattttagccatggcagtggtggtgggtttccgttgaagtcgtttggtgatcggaattttgcttctcatgggtttaaacctaagaatttcagtaagcctgaacccaatttctctcaggatctggattatgatgatgagtttgatgatgatagagcagagagggaaggattcaacccgaggattcaaagttctaggagctcttcgcgggtgaatggctacagcaggaaggatgggagctatcctcgaaacactggtgcttccaatggctatggatcgtcttctaggttcaagcatgagcaaatgaatgcagcagcagaagttgagtctgacccgatcgatgaagttgtttcttctgttaagatgttgacagaaatgtttgtgagggtggagaattcgaagatggagatgatgagagagatggagaagtcgagaatggagatggagctgaagcattgccagatgatgcttgagtcacagcagcagatcataggcgcgtttgctgaagcgttgagcgagaaaaagagcacaaatgcaaggaggccggtttcgtag

SEQ ID NO: 60 - protein, 310 aa, Arabidopsis thaliana
MGFAPVTPAAVETYDPDVDHDDESNGLDGFRVRSKRSGKFSGGYSDSPREVGDGYGVRSRARSNMKMYGGFKSEFDSDHDSGSGFGLKRKYNGNPKVSADFDADSDDEIVLVPKATRLRTHGKPSSGDFSHGSGGGFPLKSFGDRNFASHGFKPKNFSKPEPNFSQDLDYDDEFDDDRAEREGFNPRIQSSRSSSRVNGYSRKDGSYPRNTGASNGYGSSSRFKHEQMNAAAEVESDPIDEVVSSVKMLTEMFVRVENSKMEMMREMEKSRMEMELKHCQMMLESQQQIIGAFAEALSEKKSTNARRPVS

SEQ ID NO: 61 - DNA, 3351 bp, Arabidopsis thaliana
atggcttccgaggcgaatcagcttcagcaagcgcaactcgcgatggttctcggctccgattccgcgcccttcgagacgctaatctctcacctcatgtcttcttccaacgagcaacgttcctccgccgagtctcttttcaatctcgctaaacaaagcaatcccgataccctctctttgaagcttgctcatcttcttcagctttctcctcatcccgaaggtcgtgctatggccgccgtccttctccggaagttgttaacacgcgacgatgcttatctatggcctcgtctctccctctccactcaatcttccctcaaatcttcgatgttgtattgtattcaacatgaggaggctaaatcgatctctaagaagatttgcgatacagtctctgaacttgcatccgggattttaccggagaatggatggccggagttgcttccgtttgttttccagtgtgttacttctgttacccctaaattgcaggaatcggcgtttttaatcttggctcaattgtcgcagtacgttggggagactcttacccctcacatcaaggaactccatggcgtgtttcttcagtgcttgagtagtaattctgctagctccgatgttaaaatcgccgctctcaacgccgtgattagtttcgttcagtgtctggccaactcaacggagagagatagattccaagatgttttgcctgcgatgatcaggacgttgaccgaatctctgaacaatgggaatgaagcaactgcacaggaggcacttgagcttttgattgaattggctggtaccgagccacggttccttagacggcaacttgttgacatagttggttcgatgcttcagattgcagaggctgattccctcgaggagagtacacgtcatcttgcgattgagtttttggttactctggctgaggcgcgtgagcgtgcccctggtatggtcaggaagcttcctcagtttattgacaggttgtttgctgttcttatgaagatgctcgaggatattgaggacgatcctgcttggtacagcgctgagactgaggatgaagatgctggcgagacaagcaactacagcatgggtcaagagtgtttggatcggttagcaatttctctgggaggaaacaccattgttccggttgcatatcagcagttttctgcttacttggctgcctctgagtggcagaaacatcatgcttctttgattgcacttgctcagattgctgaaggttgttcaaaggtgatgataaaaaatctagaccaagtggtgtcaatggttttgagccagtttcaaagtcctcatcctcgcgtaaggtgggctgctataaatgcgattggacagttgtctacagatttgggtccagatttgcaaaaccaacatcatgagagagtgctccccgcacttgctgctgctatggatgatttccagaatccacgagtgcaggctcatgctgcttcagcagtactcaacttcagtgaaaattgtactcctgaaatattgtcaccttatttagacggagtagtgagcaagttacttgtgctactacaaaatggtaaacaaatggtgcaagaaggagctttaactgctcttgcttcagtggctgattcatcacaggaacactttcaaaagtactatgatactgtcatgccttatctcaaaactattttgatgaatgcaactgacaagtctaagcggatgcttcgtgccaaatccatggagtgcatcagtcttgttggaatggcagttggaaaggacagattcaaggaagatgctagacaggtcatggaagtgctaatgtcattgcaaggttctcagatggaggcagacgatccaataacaagttacatgttacaggcatgggctaggctttgcaagtgtctaggtcaagatttcctcccatacatgaaggttgtgatgcctcctttgcttcagtcagctcaacttaagccagatgtaacaattacatctgctgattcagaagatgaagcagaggattctgatgatgaaagcatggagaccattatcctgggcgacaaaagaatagggatcaaaacaagtgttctagaggaaaaggccacggcttgtaacatgctttgttgctatgctgatgagttaaaagaaggattttttccttggattgatcaggttgcacctacattggttcctttactgaaattctattttcacgaagaagttagaagagcagctgtttcagccatgccggaactaatgcgctcagccaagctggcaatagagaaaggggaatctcaagggcgagatctatcatatttgaagcagctttctgactacattattccagccatgctggaagctttgcataaagaacctgatacagagatctgtgtgagtatgttggaagctatcaatgaatgcttgcagatctctggaaatcttttggatgaagggaaaattagatccatagttgatgagataaagcaagttatgaccgcaagctctagtaggaagcgagagaggggagagagggcccatgctgaagactttgacgctgaagagggagagcttattaaagaggaaaatgagcaagaggaagaaatttttgatcaagtcggtgaaatattgggaacattggttaagacattcaaggcctcatttctacctttcttcgatgaactgtcctcttacttaactcctatgtggggaagagataaaacagcggaagagagaaggattgctatatgcatttttgatgatgtagcagaacaatgccgtgaagctgcctttaaatattatgatacctatcttccatttgtactggaagcttgcaatgacgagagcccagaggttcgacaggctgctgtttatgggcttggcgtttgtgctgagtttggcggctctgtattcaagcctcttattggagaggctctgtcaagattaaatgttgtgatacagctgccaaatgctcggcaatctgaaaatgccatggcatatgataatgctgtatcagccgtgggaaagatctgccaatttcaccgtgatagtattgattcttctcaggtacttcctgcgtggttgaactgtttgcctataagcaatgatgtccttgaagccaaagtggttcatgatcagctctgctcaatggttgaaaggcaagatgtagaccttttaggccccaataaccagcatcttccgaaaatcttaatagtttttgccgaggtacttacagggaaagatgtggtgacacaagagacagcaggtcgtatgataaatatattaaggcaacttcaacagacactgccaccatcggcgttggcctcaacatggtcaacgctgaaacccgaacagcagctcgctctccaatccatgctttcctcctaa

SEQ ID NO: 62 - protein, 1116 aa, Arabidopsis thaliana
MASEANQLQQAQLAMVLGSDSAPFETLISHLMSSSNEQRSSAESLFNLAKQSNPDTLSLKLAHLLQLSPHPEGRAMAAVLLRKLLTRDDAYLWPRLSLSTQSSLKSSMLYCIQHEEAKSISKKICDTVSELASGILPENGWPELLPFVFQCVTSVTPKLQESAFLILAQLSQYVGETLTPHIKELHGVFLQCLSSNSASSDVKIAALNAVISFVQCLANSTERDRFQDVLPAMIRTLTESLNNGNEATAQEALELLIELAGTEPRFLRRQLVDIVGSMLQIAEADSLEESTRHLAIEFLVTLAEARERAPGMVRKLPQFIDRLFAVLMKMLEDIEDDPAWYSAETEDEDAGETSNYSMGQECLDRLAISLGGNTIVPVAYQQFSAYLAASEWQKHHASLIALAQIAEGCSKVMIKNLDQVVSMVLSQFQSPHPRVRWAAINAIGQLSTDLGPDLQNQHHERVLPALAAAMDDFQNPRVQAHAASAVLNFSENCTPEILSPYLDGVVSKLLVLLQNGKQMVQEGALTALASVADSSQEHFQKYYDTVMPYLKTILMNATDKSKRMLRAKSMECISLVGMAVGKDRFKEDARQVMEVLMSLQGSQMEADDPITSYMLQAWARLCKCLGQDFLPYMKVVMPPLLQSAQLKPDVTITSADSEDEAEDSDDESMETIILGDKRIGIKTSVLEEKATACNMLCCYADELKEGFFPWIDQVAPTLVPLLKFYFHEEVRRAAVSAMPELMRSAKLAIEKGESQGRDLSYLKQLSDYIIPAMLEALHKEPDTEICVSMLEAINECLQISGNLLDEGKIRSIVDEIKQVMTASSSRKRERGERAHAEDFDAEEGELIKEENEQEEEIFDQVGEILGTLVKTFKASFLPFFDELSSYLTPMWGRDKTAEERRIAICIFDDVAEQCREAAFKYYDTYLPFVLEACNDESPEVRQAAVYGLGVCAEFGGSVFKPLIGEALSRLNVVIQLPNARQSENAMAYDNAVSAVGKICQFHRDSIDSSQVLPAWLNCLPISNDVLEAKVVHDQLCSMVERQDVDLLGPNNQHLPKILIVFAEVLTGKDVVTQETAGRMINILRQLQQTLPPSALASTWSTLKPEQQLALQSMLSS

SEQ ID NO: 63 - DNA, 612 bp, Arabidopsis thaliana
atgagctctgtctgtggtgggttggatttcaaagatgcagagagcagctctgcttccagtcccattatatgttctactggcgtaaagcatatctcttgtgttggatctgatgatgctcaagagtctgatggtgatgatagtggttatatacaccaaactgtgattgaagaatccaaagacaaggcgatcagcgaacccatccctgagtctttacctctcaattctttggatgatgaaagtgaagataagaaccttgctactgcattgcaagacatgttctctgagagtatgagtgtggttactctgattcctgccattaaaggtggtcgagagaagcatggcaagtcactcgagaagctcagtgtgtcatgggctgaagatgtgtatgatcctcctccctccattgtctctcacacaagaagcaagaaacagcaaccgcagaaatcaaagagcaaagacaacctgaagaagaatggaaagaaaggacaaaagggaagcagcaattcccgcagcagcaaagacaagaagcagatttcttcacgcagcagcaaatacagtcgtgataagtttgattggacaacacaaatgtctgttctagctgcatcttcttga

SEQ ID NO: 64 - protein, 203 aa, Arabidopsis thaliana
MSSVCGGLDFKDAESSSASSPIICSTGVKHISCVGSDDAQESDGDDSGYIHQTVIEESKDKAISEPIPESLPLNSLDDESEDKNLATALQDMFSESMSVVTLIPAIKGGREKHGKSLEKLSVSWAEDVYDPPPSIVSHTRSKKQQPQKSKSKDNLKKNGKKGQKGSSNSRSSKDKKQISSRSSKYSRDKFDWTTQMSVLAASS

SEQ ID NO: 65 - DNA, 831 bp, Arabidopsis thaliana
atgtacaaggaacgtagtggaggaggtggtggtgggtcatcgagatcagagatcctcggtggagctattgatcggaaacgaatcaacgatgcactcaataagaaactagagaaatcttcaacttccaccaccacatctagggttttctcttctaaagacaaagatcccttttccttcacatctactaaaactcagcttcctgatgtggaatcggaaactgatagtgaagggtctgatgtgagtggatcggagggtgatgatacgtcgtggatctcttggttttgtaatttgagagggaatgatttcttctgtgaagtcgatgaagattatattcaagatgatttcaatctttgtggtttaagtggtcaagtcccttactatgattatgcacttgatctcattttagatgttgatgcttccaacagtgagatgtttactgatgaacagcatgaaatggtggaatcagctgctgagatgctatatggtcttattcatgttcgttacattttgactactaaaggaatggctgcaatgactgagaagtacaagaactgtgatttcgggagatgcccgagagttttctgttgcggtcagtcttgtcttccagttggacaatccgatatcccgagatcgagtactgtgaagatatactgccctaaatgcgaggatatatcttacccgcgatctaaattccaaggcaatattgatggagcgtactttggaaccacattccctcacttgttcttgatgacttacgggaacttaaagccgcagaagcctactcaaagctatgtcccaaaaatctttggcttcaaggtacacaaaccatga

SEQ ID NO: 66 - protein, 276 aa, Arabidopsis thaliana
MYKERSGGGGGGSSRSEILGGAIDRKRINDALNKKLEKSSTSTTTSRVFSSKDKDPFSFTSTKTQLPDVESETDSEGSDVSGSEGDDTSWISWFCNLRGNDFFCEVDEDYIQDDFNLCGLSGQVPYYDYALDLILDVDASNSEMFTDEQHEMVESAAEMLYGLIHVRYILTTKGMAAMTEKYKNCDFGRCPRVFCCGQSCLPVGQSDIPRSSTVKIYCPKCEDISYPRSKFQGNIDGAYFGTTFPHLFLMTYGNLKPQKPTQSYVPKIFGFKVHKP

SEQ ID NO: 67 - DNA, 900 bp, Arabidopsis thaliana
atgggggacaccacaaaggacgatgggtctagccaaagtaaagcggtgcgtggggaaaaaagagcattctttttcaggaaatggacccggatcgatatagcgagagcttcggctgttggggctgtgcatctattgtgtctgttggctccgtttaactataaatgggaagctctccggttcggtgtgattctcgctatagtgactagtcttagcattacattttcataccataggaacttgactcacaagagctttaagcttcctaaatggcttgaatatccattcgcttactctgcccttttcgcgcttcagggtcatccaatagattgggtgagtacacataggttccatcaccagttcacagattcagaccgtgacccacatagtcctatcgaaggattctggttcagtcacgtcttttggatattcgacaccagttacatcagagaaaagtgcggaggacgtgacaacgtgatggacttgaagcaacaatggttctataggtttcttcgaaacacaattggtctccacatcttaacattttggaccctcgtctatttatggggtggtctaccttacctaacttgcggcgtgggtgttggaggaacaatcggttacaatgggacttggctcataaactcggcatgccatatttggggttcgcgagcatggaacactaaggacacctctcgtaacatttggtggctagggccattcacgatgggagagagctggcacaacaaccaccatgcctttgaggcctcggccaggcacggactggaatggtatcaggtagacttaacttggtacctcatttgtttcttccaagctctcggtttagccacggatgtcaaattgcctaccgatgctcaaaagcgaaaattggctttcgctcgttag

SEQ ID NO: 68 - protein, 299 aa, Arabidopsis thaliana
MGDTTKDDGSSQSKAVRGEKRAFFFRKWTRIDIARASAVGAVHLLCLLAPFNYKWEALRFGVILAIVTSLSITFSYHRNLTHKSFKLPKWLEYPFAYSALFALQGHPIDWVSTHRFHHQFTDSDRDPHSPIEGFWFSHVFWIFDTSYIREKCGGRDNVMDLKQQWFYRFLRNTIGLHILTFWTLVYLWGGLPYLTCGVGVGGTIGYNGTWLINSACHIWGSRAWNTKDTSRNIWWLGPFTMGESWHNNHHAFEASARHGLEWYQVDLTWYLICFFQALGLATDVKLPTDAQKRKLAFAR

SEQ ID NO: 69 - DNA, 783 bp, Arabidopsis thaliana
atgcctcagggagattacatagatttgcacaggaagaggaatggatatcgcctcgaccacttcgagagaaagcgcaagaaggaggcgcgtgaagttcacaagcactccaccatggctcaaaagtctctaggtatcaagggtaagatgattgctaagaaaaactatgctgagaaagctctcatgaagaaaacattgaaaatgcatgaagagtcatcatcaaggcgtaaggctgatgagaatgttcaggaaggagctgttcctgcttatcttcttgatcgtgaagacaccactcgtgccaaggttcttagcaacaccattaaacaaaagaggaaagagaaagctggcaaatgggaggtccctcttccaaaggtccgtccagttgctgaagatgaaatgtttagagtgatccgatctggaaaaaggaaaactaaacaatggaagcggatggttacaaaagctacatttgttggacctgctttcacaaggaagcctccaaagtacgagcgtttcatccgtccatctggtcttcgtttcaccaaggcccacgtcactcaccctgaactaaaatgcactttctgtctcgagatcatcgggattaagaagaatcctaacggtcccatgtatacatcactcggtgtgatgaccaggggaacaatcatcgaggtcaatgtgagtgagcttggtcttgttacaccagctggaaaggttgtctggggaaaatacgctcaagtgacaaacaatccagagaacgacggatgtataaatgctgttttacttgtgtaa

SEQ ID NO: 70 - protein, 260 aa, Arabidopsis thaliana
MPQGDYIDLHRKRNGYRLDHFERKRKKEAREVHKHSTMAQKSLGIKGKMIAKKNYAEKALMKKTLKMHEESSSRRKADENVQEGAVPAYLLDREDTTRAKVLSNTIKQKRKEKAGKWEVPLPKVRPVAEDEMFRVIRSGKRKTKQWKRMVTKATFVGPAFTRKPPKYERFIRPSGLRFTKAHVTHPELKCTFCLEIIGIKKNPNGPMYTSLGVMTRGTIIEVNVSELGLVTPAGKVVWGKYAQVTNNPENDGCINAVLLV

SEQ ID NO: 71 - DNA, 6744 bp, Arabidopsis thaliana
atggctggctcggttaacgggaatcatagtgctgtaggacctggtataaattatgagacggtgtctcaagtggatgagttctgtaaagcacttagagggaaaaggccgatccatagtattttgatagctaacaatggaatggcggctgtgaagtttatacgtagtgtcagaacatgggcttatgaaacatttggtacggaaaaagccatattgttggtggggatggcaacccctgaagacatgcggatcaatgcggagcatatcagaatcgctgatcagtttgttgaggttcccggaggaaccaacaataacaattatgctaacgttcagctgattgtggagatggctgaagtaacacgcgtggatgcagtttggcctggttggggtcatgcatctgaaaaccccgaattacctgatgccctagatgcaaaaggaatcatatttcttggtcctccagcatcttcaatggcagcactgggagataagattggttcttcgttgattgcacaagctgctgatgtacccactctgccatggagtggttcccatgttaaaatacctcctaatagcaacttggtaaccatcccagaggagatctaccggcaagcatgtgtctacacaactgaagaagcgattgctagctgtcaagttgtcggttacccagcaatgatcaaagcatcgtggggtggtggtggtaaaggaatcaggaaggttcataatgatgatgaggttagggctctattcaagcaagttcagggtgaggtcccaggctcaccaatattcataatgaaggttgcgtcacagagtcggcatctagaggtccagctgctctgtgacaagcatggaaatgtttcagctctgcatagccgtgattgtagcgtccagagaagacatcaaaagatcatagaggagggtccaattactgtggctccgccagaaactgtcaagaaacttgaacaagcagctagaaggttggctaagagtgttaactatgttggagctgctactgttgagtatctctacagtatggacactggggagtactacttcttagagcttaaccctcgcttacaggttgagcatcctgtcactgagtggattgccgagataaatcttcctgctgcccaagttgctgtggggatgggaattcctctctggcaaatccctgagataagacggttctatggaatagaacatggtggaggttatgattcttggcgaaaaacatctgttgtagccttcccttttgattttgataaagctcaatctataaggccaaaaggtcattgtgtggctgtacgtgtgacaagtgaggatcctgatgacgggttcaaaccaaccagcggtagagttcaggagttgagttttaagagcaagccaaatgtgtgggcgtacttctctgtcaagtctggtggaggcatccacgagttctcggattcccagtttggacatgtttttgcatttggggaatccagagccctggcgatagcgaatatggttcttgggctaaaagaaattcagatccgtggagaaattaggactaacgttgactacacgatcgaccttttacatgcttctgattaccgtgataacaaaattcacactggttggttggatagtaggattgctatgcgggtcagagctgagaggcctccatggtatctctctgttgtcggcggagctctctataaagcatcagcgaccagtgctgctgtggtttcagattacgttggttatctggagaaggggcaaatccctccaaagcatatatctcttgtacattctcaagtgtctctgaatattgaaggaagtaaatatacgattgatgtagtccggggtggatcaggaacctacaggctaagaatgaacaagtcagaagtggtagcagaaatacacactctacgtgatggaggtctgttgatgcagttggatggcaaaagccatgtgatatatgcagaggaagaagctgcaggaactcgtcttctcattgatggaagaacttgtttgctacagaatgaccacgatccatcaaagttaatggctgagacaccgtgcaagttgatgaggtatttgatttccgacaacagcaatattgacgctgatacgccttatgccgaagttgaggtcatgaagatgtgcatgccacttctttcacctgcttcaggagttatccattttaaaatgtctgaaggacaagccatgcaggctggtgaacttatagccaatcttgatcttgatgatccttctgctgtaagaaaggccgaacccttccatggaagtttcccaagattagggcttccaactgcaatatccggtagagttcatcagagatgtgccgcaacattaaatgctgcacgcatgattcttgctggctatgagcataaagtagatgaggttgttcaagacttacttaattgccttgatagccctgaactcccatttcttcagtggcaagagtgctttgcagttctggcgacacgactacctaaaaatctcaggaacatgctagaatcaaagtatagggaatttgagagtatttccagaaactctttgaccaccgatttccctgccaaacttttaaaaggcattcttgaggcacatttatcttcttgtgatgagaaagagagaggtgcccttgaaaggctcattgaaccattgatgagccttgcaaaatcttatgaaggtggtagagaaagtcatgcccgtgttattgttcattctctctttgaagaatatctatcagtagaagaattattcaatgataacatgctggctgatgttatagaacgcatgcgtcagctatacaagaaagatctgttgaaaattgtggatatagtgctctcacaccagggcataaaaaacaaaaacaaactcgttctccggctcatggagcagcttgtttaccctaatcctgctgcttacagagataaacttattcgattctcaacacttaaccatactaactactctgagttggcgctcaaggcgagtcaattacttgaacagaccaaactaagtgagcttcgttcaaacattgctagaagcctttcagagttagaaatgtttacagaggacggagaaaatatggatactcccaagaggaaaagtgccattaatgaaagaatagaagatcttgtaagcgcatctttagctgttgaagacgctctcgtgggactatttgaccatagcgatcacacacttcaaagacgggttgttgagacttatattcgcagattataccagccctacgtcgttaaagatagcgtgaggatgcagtggcaccgttctggtcttcttgcttcctgggagttcctagaggagcatatggaaagaaaaaacattggcttagacgatcccgacacatctgaaaaaggattggttgagaagcgtagtaagagaaaatggggggctatgtttcttccaagtataataagtgcagcattgagagaaacaaagcacaacgactatgaaactgccggagctcctttatctggcaatatgatgcacattgctattgtgggcatcaacaaccagatgagtctgcttcaggacagtggggatgaagaccaagctcaggaaagagtaaacaagttggccaaaattcttaaagaggaagaagtgagttcaagcctctgttctgccggtgttggtgtaatcagctgtataattcagcgagatgaaggacgaacacccatgagacattctttccattggtcgttggagaaacagtattatgtagaagagccgttgctgcgtcatcttgaacctcctctgtccatttaccttgagttggataagctgaaaggatactcaaatatacaatatacgccttctcgagatcgtcaatggcatctgtatactgttacagacaagccagtgccaatcaagaggatgttcctgagatctcttgttcgacaggctacaatgaacgatggatttatattgcagcaagggcaggataagcagcttagccaaacactgatctccatggcgtttacgtcgaaatgtgttctgaggtctttgatggatgccatggaggaactggaactgaatgcccataatgctgcaatgaaaccagatcacgcacatatgtttctttgcatattgcgtgagcagcagatagatgatcttgtgcctttccccaggagagttgaagtgaatgcggaggatgaagaaactacagttgaaatgatcttagaagaagcagcacgagagatacatagatctgttggagtgagaatgcataggttgggcgtgtgcgagtgggaagtgcggctgtggttggtgtcctctggactggcatgtggtgcttggagggttgtggttgcaaacgtgacaggccgtacatgcactgtccacatataccgagaagttgaaactcctggaagaaacagtttaatctaccactcaataaccaagaagggacctttgcatgaaacaccaatcagtgatcaatataagcccctgggatatctcgacaggcaacgtttagcagcaaggaggagtaacactacttattgctatgacttcccgttggcatttgggacagccttggaactgttgtgggcatcacaacacccaggagttaagaaaccatataaggatactctgatcaatgttaaagagcttgtattctcaaaaccagaaggttcttcgggtacatctctagatctggttgaaagaccacccggtctcaacgactttggaatggttgcctggtgcctagatatgtcgaccccagagtttcctatggggcggaaacttctcgtgattgcgaatgatgtcaccttcaaagctggttcttttggtcctagagaggacgcgtttttccttgctgttactgaactcgcttgtgccaagaagcttcccttgatttacttggcagcaaattctggtgcccgacttggggttgctgaagaagtcaaagcctgcttcaaagttggatggtcggatgaaatttcccctgagaatggttttcagtatatatacctaagccctgaagaccacgaaaggattggatcatctgtcattgcccatgaagtaaagctctctagtggggaaactaggtgggtgattgatacgatcgttggcaaagaagatggtattggtgtagagaacttaacaggaagtggggccatagcgggtgcttactcaaaggcatacaatgaaacttttactttaacctttgttagtggaagaacggttggaattggtgcttatcttgcccgcctaggtatgcggtgcatacagagacttgatcagccgatcatcttgactggcttctctacactcaacaagttacttgggcgtgaggtctatagctctcacatgcaactgggtggcccgaaaatcatgggcacaaatggtgttgttcatcttacagtctcagatgatcttgaaggcgtatcagcaattctcaactggctcagctacattcctgcttacgtgggtggtcctcttcctgttcttgcccctttagatccaccggagagaattgtggagtatgtcccagagaactcttgcgacccacgagcggctatagctggggtcaaagacaataccggtaaatggcttggaggtatctttgataaaaatagtttcattgagactcttgaaggctgggcaaggacggtagtgactggtagagccaagctcgggggaatacccgttggagttgttgcagttgagacacagactgtcatgcagatcatcccagccgatcctggacagcttgactctcatgaaagagtggttccgcaagcagggcaagtctggtttcctgattcagcggccaagactgctcaagcgcttatggatttcaaccgggaagagcttccattgtttatcctagcgaactggagagggttttcaggtgggcagagagatcttttcgaaggaatacttcaggcaggttcaactatagtagaaaatctgagaacctatcgtcagccagtgtttgtgtacatcccaatgatgggagagctgcgcggtggagcgtgggttgttgttgacagccagataaattcggattatgttgaaatgtatgctgatgaaacagctcgtggaaatgtgcttgagccagaagggacaatagagataaaatttagaacaaaagagctattagagtgcatgggaaggttggaccagaagctaatcagtctgaaagcaaaactgcaagatgccaagcaaagcgaggcctatgcaaacatcgagcttctccagcaacagattaaagcccgagagaaacagcttttaccagtttatatccaaatcgccaccaaatttgcagaacttcatgacacttccatgagaatggctgcaaagggagtgatcaaaagtgttgtggaatggagcggctcgcggtccttcttctacaaaaagctcaataggagaatcgctgagagctctcttgtgaaaaacgtaagagaagcatctggagacaacttagcatataaatcttcaatgcgtctgattcaggattggttctgcaactctgatattgcaaaggggaaagaagaagcttggacagacgaccaagtgttctttacatggaaggacaatgttagtaactacgagttgaagctgagcgagttgagagcgcagaaactactgaaccaacttgcagagattgggaattcctcagatttgcaagctctgccacaaggacttgctaatcttctaaacaaggtggagccgtcgaaaagagaagagctggtggctgctattcgaaaggtcttgggttga

SEQ ID NO: 72 - protein, 2243 aa, Arabidopsis thaliana
MAGSVNGNHSAVGPGINYETVSQVDEFCKALRGKRPIHSILIANNGMAAVKFIRSVRTWAYETFGTEKAILLVGMATPEDMRINAEHIRIADQFVEVPGGTNNNNYANVQLIVEMAEVTRVDAVWPGWGHASENPELPDALDAKGIIFLGPPASSMAALGDKIGSSLIAQAADVPTLPWSGSHVKIPPNSNLVTIPEEIYRQACVYTTEEAIASCQVVGYPAMIKASWGGGGKGIRKVHNDDEVRALFKQVQGEVPGSPIFIMKVASQSRHLEVQLLCDKHGNVSALHSRDCSVQRRHQKIIEEGPITVAPPETVKKLEQAARRLAKSVNYVGAATVEYLYSMDTGEYYFLELNPRLQVEHPVTEWIAEINLPAAQVAVGMGIPLWQIPEIRRFYGIEHGGGYDSWRKTSVVAFPFDFDKAQSIRPKGHCVAVRVTSEDPDDGFKPTSGRVQELSFKSKPNVWAYFSVKSGGGIHEFSDSQFGHVFAFGESRALAIANMVLGLKEIQIRGEIRTNVDYTIDLLHASDYRDNKIHTGWLDSRIAMRVRAERPPWYLSVVGGALYKASATSAAVVSDYVGYLEKGQIPPKHISLVHSQVSLNIEGSKYTIDVVRGGSGTYRLRMNKSEVVAEIHTLRDGGLLMQLDGKSHVIYAEEEAAGTRLLIDGRTCLLQNDHDPSKLMAETPCKLMRYLISDNSNIDADTPYAEVEVMKMCMPLLSPASGVIHFKMSEGQAMQAGELIANLDLDDPSAVRKAEPFHGSFPRLGLPTAISGRVHQRCAATLNAARMILAGYEHKVDEVVQDLLNCLDSPELPFLQWQECFAVLATRLPKNLRNMLESKYREFESISRNSLTTDFPAKLLKGILEAHLSSCDEKERGALERLIEPLMSLAKSYEGGRESHARVIVHSLFEEYLSVEELFNDNMLADVIERMRQLYKKDLLKIVDIVLSHQGIKNKNKLVLRLMEQLVYPNPAAYRDKLIRFSTLNHTNYSELALKASQLLEQTKLSELRSNIARSLSELEMFTEDGENMDTPKRKSAINERIEDLVSASLAVEDALVGLFDHSDHTLQRRVVETYIRRLYQPYVVKDSVRMQWHRSGLLASWEFLEEHMERKNIGLDDPDTSEKGLVEKRSKRKWGAMFLPSIISAALRETKHNDYETAGAPLSGNMMHIAIVGINNQMSLLQDSGDEDQAQERVNKLAKILKEEEVSSSLCSAGVGVISCIIQRDEGRTPMRHSFHWSLEKQYYVEEPLLRHLEPPLSIYLELDKLKGYSNIQYTPSRDRQWHLYTVTDKPVPIKRMFLRSLVRQATMNDGFILQQGQDKQLSQTLISMAFTSKCVLRSLMDAMEELELNAHNAAMKPDHAHMFLCILREQQIDDLVPFPRRVEVNAEDEETTVEMILEEAAREIHRSVGVRMHRLGVCEWEVRLWLVSSGLACGAWRVVVANVTGRTCTVHIYREVETPGRNSLIYHSITKKGPLHETPISDQYKPLGYLDRQRLAARRSNTTYCYDFPLAFGTALELLWASQHPGVKKPYKDTLINVKELVFSKPEGSSGTSLDLVERPPGLNDFGMVAWCLDMSTPEFPMGRKLLVIANDVTFKAGSFGPREDAFFLAVTELACAKKLPLIYLAANSGARLGVAEEVKACFKVGWSDEISPENGFQYIYLSPEDHERIGSSVIAHEVKLSSGETRWVIDTIVGKEDGIGVENLTGSGAIAGAYSKAYNETFTLTFVSGRTVGIGAYLARLGMRCIQRLDQPIILTGFSTLNKLLGREVYSSHMQLGGPKIMGTNGVVHLTVSDDLEGVSAILNWLSYIPAYVGGPLPVLAPLDPPERIVEYVPENSCDPRAAIAGVKDNTGKWLGGIFDKNSFIETLEGWARTVVTGRAKLGGIPVGVVAVETQTVMQIIPADPGQLDSHERVVPQAGQVWFPDSAAKTAQALMDFNREELPLFILANWRGFSGGQRDLFEGILQAGSTIVENLRTYRQPVFVYIPMMGELRGGAWVVVDSQINSDYVEMYADETARGNVLEPEGTIEIKFRTKELLECMGRLDQKLISLKAKLQDAKQSEAYANIELLQQQIKAREKQLLPVYIQIATKFAELHDTSMRMAAKGVIKSVVEWSGSRSFFYKKLNRRIAESSLVKNVREASGDNLAYKSSMRLIQDWFCNSDIAKGKEEAWTDDQVFFTWKDNVSNYELKLSELRAQKLLNQLAEIGNSSDLQALPQGLANLLNKVEPSKREELVAAIR

SEQ ID NO: 73 - DNA, 333 bp, Arabidopsis thaliana
atgaaacaactaatccgccgtttatcgcgtgtcgcggactcaacacagtatagcctcctccggtctgaatcccagcgtggccgcaccaagaaggagaaacacaaatcttgggttcccgaggggcacgtgcctgtttacgtaggccacgagatggagcggttcgtggtgaatgcggagctgctcaaccaccccgttttcgtagcgttgctgaagcagtcggctcaagagtatggatacgagcaacaaggagtgcttcgcatcccttgccacgtgcttgtgttcgaacgcatcttggagtctctccgtctcggactcgccgatcgagtcacatga

SEQ ID NO: 74 - protein, 110 aa, Arabidopsis thaliana
MKQLIRRLSRVADSTQYSLLRSESQRGRTKKEKHKSWVPEGHVPVYVGHEMERFVVNAELLNHPVFVALLKQSAQEYGYEQQGVLRIPCHVLVFERILESLRLGLADRVT

SEQ ID NO: 75 - DNA, 2535 bp, Arabidopsis thaliana
atggcgtcacagagttgctacaatggaatccatcgtataaaaagggttcatcctctgattcactctctcacatttcatcgattctcctcatcttctcttccattcaaatctcacattccctcttcacaacaacagcttcgtattcgctcatcttcttcgctttctgatcttggaaatcgcaggcattgttcgtctactcgaggatttcaattttggtcatacaagagaagcgaagcagcgtcgccgttcaagacgaggtacagagaaaacgaagaagaagaagatatgacgattaaaccggcggttcgtatttccgacgggaatctaatcatcaaaaaccggacgattctaaccggtgtaccagataatgtcatcacgacgtcagcatcggaagctggaccggtagaaggagtcttcgtcggagctgtatttaacaaggaagagagtaaacacatcgtaccgatcggtacgcttcgcaattcccggtttatgtcttgtttccggtttaagctctggtggatggcccagagaatgggagaaatgggccgagatattccctacgagacgcagttcttattggtcgagagcaacgatgggtcccaccttgagtctgacggagctaacggcgtcgagtgtaaccagaaagtttacaccgttttcttgccgttaatcgaaggatctttccgttcgtgtctccaaggaaacgttaacgatgaggttgagctctgtttggagagtggtgacgtggacactaaacggtcgtcgtttactcactctctgtatattcacgccggtacagatccgtttcagacaataacggacgctattcgcaccgttaagttgcatctgaatagtttccgtcaacgtcacgaaaagaagcttccagggatcgttgactacttcggatggtgcacttgggacgcgttttatcaagaagtgactcaggaaggcgtcgaagctggtcttaagtctctcgccgccggtggtacgccgccgaagtttgttatcatagacgacggttggcaatcagttgagagagatgccacggtggaggccggagatgagaagaaagagtcaccgatttttcgactgacggggatcaaggagaacgaaaagtttaagaagaaggatgatccaaacgttgggattaagaacattgtcaagattgctaaggagaaacacggtttgaaatatgtttacgtgtggcacgcgataacgggttattggggcggagttagacccggggaagaatacggatctgttatgaaatatcctaatatgtcaaagggtgtggtggagaatgatccgacgtggaagactgatgtaatgacgctgcaagggttgggtttggttagccccaagaaagtgtataagttttacaatgagcttcatagttacttggctgatgctggcgtggacggtgtgaaagtggatgtgcagtgtgtattggagactttgggtggtggtttaggcggtcgggttgagctgactcgtcagtttcatcaagctcttgactcctctgttgctaagaacttcccggataatggctgcattgcttgtatgagccataatacggatgctctttactgctcgaagcaagcagctgtgattagagcatcagatgatttctatccacgggatccggtgtctcataccatccatatagcctccgttgcttataacagtgtgttcttgggagagtttatgcagcctgactgggatatgttccattccgtgcaccctgctgcagagtatcatgcctctgctagggccatcagtggtgggcctctctatgtcagtgattctcctggaaagcacaactttgagcttctaagaaagcttgtattgcctgatggatcgattcttcgtgctcgactccctggtagaccaactcgcgattgtttgttcgctgatcctgcccgtgatggtgtcagcttgctaaagatatggaacatgaacaagtacactggagttcttggcgtgtataactgccaaggagcagcttggagcagcacagagagaaaaaacattttccaccagactaaaactgatagcctcactggctccattcgtggtcgtgatgtgcattcaatatcggaggcctccactgatccaacaacctggaatggagactgtgctgtttactcccagagcagaggcgaacttattgttatgccatacaatgtgtctcttccagtctcactcaaaatccgtgagcacgagatcttcacggtgagccccattagtcatcttgttgatggtgtatcttttgccccaattggtctagtaaacatgtacaattcgggaggagctatcgaaggacttagatatgaagccgagaagatgaaagtggtaatggaagttaaaggatgtggcaaattcggatcttactcttctgtgaagcctaagagatgcgttgttgagtcaaatgagattgcattcgagtacgattcctcctctggattggtcacctttgagttagacaaaatgcctatagagaacaaacgatttcatctgatccaagttgagttatga

SEQ ID NO: 76 - protein, 844 aa, Arabidopsis thaliana
MASQSCYNGIHRIKRVHPLIHSLTFHRFSSSSLPFKSHIPSSQQQLRIRSSSSLSDLGNRRHCSSTRGFQFWSYKRSEAASPFKTRYRENEEEEDMTIKPAVRISDGNLIIKNRTILTGVPDNVITTSASEAGPVEGVFVGAVFNKEESKHIVPIGTLRNSRFMSCFRFKLWWMAQRMGEMGRDIPYETQFLLVESNDGSHLESDGANGVECNQKVYTVFLPLIEGSFRSCLQGNVNDEVELCLESGDVDTKRSSFTHSLYIHAGTDPFQTITDAIRTVKLHLNSFRQRHEKKLPGIVDYFGWCTWDAFYQEVTQEGVEAGLKSLAAGGTPPKFVIIDDGWQSVERDATVEAGDEKKESPIFRLTGIKENEKFKKKDDPNVGIKNIVKIAKEKHGLKYVYVWHAITGYWGGVRPGEEYGSVMKYPNMSKGVVENDPTWKTDVMTLQGLGLVSPKKVYKFYNELHSYLADAGVDGVKVDVQCVLETLGGGLGGRVELTRQFHQALDSSVAKNFPDNGCIACMSHNTDALYCSKQAAVIRASDDFYPRDPVSHTIHIASVAYNSVFLGEFMQPDWDMFHSVHPAAEYHASARAISGGPLYVSDSPGKHNFELLRKLVLPDGSILRARLPGRPTRDCLFADPARDGVSLLKIWNMNKYTGVLGVYNCQGAAWSSTERKNIFHQTKTDSLTGSIRGRDVHSISEASTDPTTWNGDCAVYSQSRGELIVMPYNVSLPVSLKIREHEIFTVSPISHLVDGVSFAPIGLVNMYNSGGAIEGLRYEAEKMKVVMEVKGCGKFGSYSSVKPKRCVVESNEIAFEYDSSSGLVTFELDKMPIENKRFHLIQVEL

SEQ ID NO: 77 - DNA, 1053 bp, Arabidopsis thaliana
atggataagtatcaacgagtggtgaagccgaaagcggatacgccgattgatgcgaatgagattcgtatcactagtcaaggcagggcacgaaactacatcacctatgcgatgactcttcttcaggataaagggtcaactgaagttgtattcaaggcaatgggaagagctatcaacaagactgtgaccattgtagagctgattaagagaaggatccctgatcttcatcagaacacatctattggatccacagacatcacagacacatgggaaccaacagaggaaggccttctacctttggagactacaaggcatgtgtcaatgataaccattaccctatccaagattgagcttaatacctcctctgttgggtaccagtgcccaattcctattgagttggtgaagccaatgggcgatattgattatgaaggacgagagggttcacctggtggcagagggaggggaagaggaagaggaaggggaagaggaagggggcgaggtggcagaggaaatgcttatgtgaacgttgagcatgaagatggaggttgggaacgtgagcagtcctatggtagaggaagaggacgtggcagaggacgcagcagtcgtggtcgtggaagaggaggatacaatggtcctccgaatgagtatgatgcaccacaagatggaggttacggttacgatgctcctcatgaacaccgtggatatgatgaccgtggtggttatgatgcccctcctcagggccgtggtggttacgatggtcctcagggtcgcggtggttacgatggtcctcagggtcgccgtggttatgatggtcctcctcagggccgtggtggttatgatggtccttctcaaggccgtggtggttatgatggtccttctcagggccgtggtggttatgatggtccttctcagggccgtggtggttatgatggtcctcagggtcgtgggcgtggacgtggacgtggaaggggaggacgtggaagaggaggaggacgtggtggtgatggtggtttcaacaacagatcagatggaccaccagtccaggcagctgcttga

SEQ ID NO: 78 - protein, 350 aa, Arabidopsis thaliana
MDKYQRVVKPKADTPIDANEIRITSQGRARNYITYAMTLLQDKGSTEVVFKAMGRAINKTVTIVELIKRRIPDLHQNTSIGSTDITDTWEPTEEGLLPLETTRHVSMITITLSKIELNTSSVGYQCPIPIELVKPMGDIDYEGREGSPGGRGRGRGRGRGRGRGRGGRGNAYVNVEHEDGGWEREQSYGRGRGRGRGRSSRGRGRGGYNGPPNEYDAPQDGGYGYDAPHEHRGYDDRGGYDAPPQGRGGYDGPQGRGGYDGPQGRRGYDGPPQGRGGYDGPSQGRGGYDGPSQGRGGYDGPSQGRGGYDGPQGRGRGRGRGRGGRGRGGGRGGDGGFNNRSDGPPVQAAA

SEQ ID NO: 79 - DNA, 852 bp, Arabidopsis thaliana
atgatgatgggcaaagaagatctaggtttgagcctaagcttagggttttcacaaaatcacaatcctcttcagatgaatctgaatcctaactcttcattatcaaacaatctccagagactcccatggaaccaaacattcgatcctacatcagatcttcgcaagatagacgtgaacagttttccatcaacggttaactgcgaggaagacacaggagtttcgtcaccaaacagtacgatctcaagcaccattagcgggaagagaagtgagagagaaggaatctccggaaccggcgttggctccggcgacgatcacgacgagatcactccggatcgagggtactcacgtggaacctcagatgaagaagaagacgggggcgaaacgtcgaggaagaagctcaggttatcaaaagatcagtctgcttttctcgaagagactttcaaagaacacaacactctcaatcccaaacagaagctagctttggctaagaagctgaacttgacggcaagacaagtggaagtgtggttccaaaacagaagagctagaaccaagttaaagcaaacggaggtagattgcgaatacttgaaacggtgcgtagagaagctaacggaagagaaccggagacttcagaaagaggctatggagcttcgaactctcaagctgtctccacaattctacggtcagatgactccaccaactacactcatcatgtgtccttcgtgcgagcgtgtgggtggcccatcatcatcgaaccatcaccacaatcacaggcccgtttctatcaatccgtgggttgcttgtgctggtcaggtggctcatgggctgaattttgaagccttgcgtccacgatcgtga

SEQ ID NO: 80 - protein, 283 aa, Arabidopsis thaliana
MMMGKEDLGLSLSLGFSQNHNPLQMNLNPNSSLSNNLQRLPWNQTFDPTSDLRKIDVNSFPSTVNCEEDTGVSSPNSTISSTISGKRSEREGISGTGVGSGDDHDEITPDRGYSRGTSDEEEDGGETSRKKLRLSKDQSAFLEETFKEHNTLNPKQKLALAKKLNLTARQVEVWFQNRRARTKLKQTEVDCEYLKRCVEKLTEENRRLQKEAMELRTLKLSPQFYGQMTPPTTLIMCPSCERVGGPSSSNHHHNHRPVSINPWVACAGQVAHGLNFEALRPRS

SEQ ID NO: 81 - DNA, 2265 bp, Arabidopsis thaliana
atggtgggggcgatggcaaacaatggaagaatccggtcagcttttccggtgactaatgggtcaaaagatctgacgccgaacagtgctccggcgagtacaaccggatctgaatatggtcctgttgagttcacaagagaagacgttgaaactcttcttaatgaacgaatcaagtacaagagcaaattcaactacaaggagagatgcgagaatatgatggattatataaaaagacttagactttgcattagatggtttcaagaacttgagttggattatgcttttgagcaagagaagttgaagaacgcattggaattgaatgagaagcattgtgttgacatggaggttagtttgaaaaacaaagaagaggagctgaatatgataattgaagagctgaggaaaaactttgaatctgttcaagttcaacttgccagggaacaaacggagaagttggcggcgaatgattctcttggaaaagagaaagaagcaagactttctgttgaaaaggcacaagctggtctcacagaagagctaggaaaagcacaaggagatcttcaaacggctaaccagaggatacaatccgtgaatgacatgtacaaactgttgcaagagtataactcaagcttgcagctgtataacagcaagctacaaggtgatcttgatgaagctcacgagactataaaacgcggtgagaaagaacggactgccattattgaaaatattggcaacttgaagggtcagttttcagcattacaggaacaacttgctgcttctaaggcttctcaagaagatatcatgaagcagaaaggtgaattggtaaatgaaattgcgagtctcaaggtagagcttcagcaagtcaaagatgaccgtgatcgccatttagtggaagttaaaaccttacaaaccgaggcaaccaagtacaatgacttcaaagacgccataaccgagcttgagactacatgttcgtcccagagtacccagatacgacagttgcaggatcgactagtaaactctgagaggagactgcaggtgtctgatctatctacctttgagaaaatgaatgagtatgaagaccagaagcaaagcattatcgatctgaaaagtcgcgtagaagaagcagaacttaaactcgttgaaggagaaaaactacggaagaagttgcacaataccattcttgaactgaaaggtaacatacgtgtgttctgtagagttagacctctattgccgggtgagaacaatggagatgagggaaaaactatttcttacccgacatccctagaagcacttggccgtggtattgacttgatgcaaaatgcgcaaaagcatgctttcacatttgataaggtttttgcgccgactgcatcacaagaagatgtcttcactgagatttctcaacttgttcaaagtgctctcgatggttacaaggtgtgcatttttgcatatggacaaactggatcgggaaaaacttacaccatgatgggtaggccaggaaacgtcgaggaaaaaggtctgatcccgcgatgtttggagcaaatatttgagacgaggcagtctcttcgatctcagggttggaaatacgaactgcaggtatccatgttagaaatatacaatgaaacgatccgagatctcctgtcaacaaacaaagaagcagtaagaacagacagtggtgtttctccacagaaacatgctattaaacatgatgctagtggaaacacgcatgtcgctgagcttactattttggatgttaaaagctctcgggaggtttcattcctcttagatcatgctgctcgtaacaggtctgtagggaagactcagatgaacgagcaatcttccagaagccattttgttttcacgctaagaatctctggtgttaacgagagcactgagcaacaagtacaaggtgtcttgaacctgattgatcttgcggggagtgagcgtttatcgaagagtggatcaaccggagatagacttaaagaaactcaagcaatcaacaaaagtttgtcgtcgctaggcgatgtcatattcgccttagcaaagaaagaagatcatgtaccattccgaaactcaaagctcacatatcttctccagccttgcttaggcggtgacgcaaagacgctaatgtttgtgaacattgcaccggaatcttcttcaaccggtgagtctctctgctctcttagattcgcagcgagagtgaatgcttgcgagattggaacaccacgtaggcagactaacatcaaaccattggaaaatcggttgagccttggatga

SEQ ID NO: 82 - protein, 754 aa, Arabidopsis thaliana
MVGAMANNGRIRSAFPVTNGSKDLTPNSAPASTTGSEYGPVEFTREDVETLLNERIKYKSKFNYKERCENMMDYIKRLRLCIRWFQELELDYAFEQEKLKNALELNEKHCVDMEVSLKNKEEELNMIIEELRKNFESVQVQLAREQTEKLAANDSLGKEKEARLSVEKAQAGLTEELGKAQGDLQTANQRIQSVNDMYKLLQEYNSSLQLYNSKLQGDLDEAHETIKRGEKERTAIIENIGNLKGQFSALQEQLAASKASQEDIMKQKGELVNEIASLKVELQQVKDDRDRHLVEVKTLQTEATKYNDFKDAITELETTCSSQSTQIRQLQDRLVNSERRLQVSDLSTFEKMNEYEDQKQSIIDLKSRVEEAELKLVEGEKLRKKLHNTILELKGNIRVFCRVRPLLPGENNGDEGKTISYPTSLEALGRGIDLMQNAQKHAFTFDKVFAPTASQEDVFTEISQLVQSALDGYKVCIFAYGQTGSGKTYTMMGRPGNVEEKGLIPRCLEQIFETRQSLRSQGWKYELQVSMLEIYNETIRDLLSTNKEAVRTDSGVSPQKHAIKHDASGNTHVAELTILDVKSSREVSFLLDHAARNRSVGKTQMNEQSSRSHFVFTLRISGVNESTEQQVQGVLNLIDLAGSERLSKSGSTGDRLKETQAINKSLSSLGDVIFALAKKEDHVPFRNSKLTYLLQPCLGGDAKTLMFVNIAPESSSTGESLCSLRFAARVNACEIGTPRRQTNIKPLENRLSLG

SEQ ID NO: 83 - DNA, 4842 bp, Arabidopsis thaliana
atgcatgggagggtttgtgagcggagacacaaaagtcgtcgtcggcacatgttgatatcttcctctcgtgtaattgcgactgtggaaggtggtggttcttcttgtttgtccttatcttcatctacctcgttttctaaggacgggcgcaaaattagtgttggtgactgtgctctgtttaagccaccacaggattgtccaccgttcattgggataattcgcttgatcattgctgaggaagaagataagttgaagttgggtgttaattggctttatcgacccactgaattaaaacttggcaaaggcatccttctagaggctgagccgaacgaactcttttactcctttcacgaggataatatacctgcagcatctttactgcatccgtgtaaagttgccttccttccaagaggtgttgaactgccatctggtatcagctcgtttgtgtgtcggcgagtttacgacgttacaaacgagcgcttatggtggctgactgatcaagactatattgatgatcgacaactagaagtagacaagttattgtgtaagactcgttcagaaatgcatacaacattacagcagggtggtcggtctcccaagtccatgaatagtccaacaacatcacaaccgaaagatggcatccagaacagtaactcttttctctctcagggtaagggaaggaaaagagagcgtatggatcatggttctgagtctgttaaaagggaacgttctagtcgagtagatgacagtggttctggtcccctcagaacagaaagcggtttaaagtctgaaattttaaaatttacagagaaaggtggtctggtggattctgaaggagttgaaaaattggttcagctcatgctgcctgagaggaatgaaaagaaaatagacttagttggccgtgcgattcttgcagggtttgtagcggcaacagacaagtttgattgccttagtcgttttgtccagctcaggggattacctgtgtttgatgagtggctgcaggaagttcataaagggaaagttggggatgggggcagtcccaaagacagtgataggttagtagacgatttcctcttagtcttacttcgggctcttgataagctacctgtgaatctcaacgcgctacagacttgtaacattggaaagtctgttaatcatctacgctcacataaaaattcagagattgggaaaaaagcaaggagcttggttgacacttggaagaaacgagttgaggcagaaatggatgcgaagtctggatccaaccagggtgtttcctggcctggaagactgagtcatgggggaaggcattcaggtggttccgcggaggcaaacaagacatcatcatcacacctacatgcttctaagtctgtctcggtcaaacaacaggtggaaaacaacctgaagtgtgtagccacgtcgccaggctccacaagatcagctccttctccgggatcaggtggtaatgtttctaaagatggacagcagcgaaatgctggggctggtggtgtatctgaagtcctagctgcagtaaaggatgagaaaagtagcagctccagtcagtcgcacaataatagtcagtcttgctcgagcgagcatgctaaaacaggcaatttatgtggaaaagaagatgcaagaagctctactgctggttcaactttgaagaagtgttccggtggctcttcaaggcatcggaagtcaaacaatgtgtttcaaggttcgtcttcgtcagcatcccctaggggagctggtttgagtagaagcttctcatcacacaggaatgtcccttctgagaaaatttctcaatcaagtttgacatctgaaaagactcttgaggttcctctgactgagggttccggtaataaattgattgtgaagctgccgaatcgtggtcgaagtcctgctcaaagtgtgagtggaggctctttggaagaccctgcaccggtgaatagcagagtttcttcacctgtgcatgcggtgaagcaggaactatgtgacaataacgggagagaaaaaaatcattcttatcgacctaatgtgagctctgtcttgaatgctgagtcttggcaaagcaatgaattaaaagatattttgacaggctcgcaagaggcagctggttcaccacttgttgctggtgatgagcgcggaggggatcttaaggattctgataaagcatctgggaatgttaaaggcacatcttcattaggaaatgagttcaaatctggagagaggcatggcggaacactcagttcgatgaatgctttgattgaaagttgtgtcagatactctgagacgaatgcctctttggctggttcggatgatgttggaatgaatcttcttgctagtgttgctgctgatgagatgtctaaatcgcctgttgcatctccctcagtatctcagcctccaaattccgtgatgaatgaaaattctactgtagggaacaatacaaagctaatggcttcggatggcttgcctcacgagcaacatcaagctgtttgtacctctgtcagtactgagcaaggtgagcaacatgttagcagtagtggcacacagttggagtcagaaataaaaaatgaatctaagaccggagatcgtgataagagctcgaattcagacactgaagatctgcaaaggttggtggatcagtgcttagagagcaatgacaattcagatggtgttgttgcttcgcctgctttacccactaaagccgttaaggaaaagattttgaatgatagtgactctggggaactgaaggatataaagactgatgttaaatcagaggctgattgcacatctgactcaacgaaaagagtagcaagctcaatgctaaccgaatgtagagatgtaagtaaaaaggtagattctgtggctgttgaacagactcccttggaaggtgttgatgatgataagaaagaagagaaacccccaacggcgttgagttctgagctagttaaaaaagtggaagaagatgtacccgtttcttctgggatttcaagggatatggatgctgtaagcattggtagacctataactgaaatggtcaataatgttgcgtttaatcatatggaccaaaaagatgtaaagaagattaagcaggattgtgatacttctgtgggagctataaaggatacctcagccggtttggactcatctgtaactaaaggtaaagttgagcctgtggaggggaatctggaaaatagtgaagtcaaggaacggtactcaggattaagagctactccaggattatcacctaaagaagctgaggatcttgagagaccgaatgggcctaaaaccagtgatgctgatggagatgaagcgggggaatgtacgtctgctgccagagatgcttcttctgtttcagctgcagcttcagctggctctgagatggatgccagagttgaatttgatctaaatgaaggttttgatggagacgatgcaaaacatggggactcaaataacttctctggatctgtatttttgacgcctactcctctacaaccagttaagaccttaccttttccggtggctcctgtatctagtggaactcgtgcatctattactgttgctgctgctgccaaaggtccgtttgttccacctgaagatctgttgagaaataaaggggctgttggttggagaggatctgctgccactagtgccttccgcccagctgagccaagaaaacctcaggatgtgttactgagcattaacaacacctctacatctgatgcatctacttctgctggcaaacagacaaggacgtttctggattttgacttgaatgtacctgacgagagagtccttgaagatttggcttcccaaagatctggaaatcccacaaattgtacatctgatatcaccaatagttttgaccaagtacgttctggggtcatgggttccgcccttgatcattcttctggaggccttgatcttgatctaaacaaagttgatgattcaactgatatgatcagctacacaatgaacagtagtcatcggctagattcatcttttcagcaggttaaattaccatcgactggtggtcgtagagattttgatttaaatgatggacctgtgggtgatgatgcagctgttgagccatctatggttctaaatcaacattcacgaagtggcttgccatcacaaccatctctctctggaattcgagtgaatggcgaaaacatggctagtttctcaacttggtttcctgctgctaacgcttattcagctgtgagcatgcctccaattatgcctgagagaggtgatcagccttttccaatgattgccactcgtggcccacagagaatgttgggtccaacaactggtgtttcctcatttacccctgaagggtacaggggtcctgttttgtcgtcgtctccagccatgccatttcagtccacaacgttccagtatcctgtctttccttttggaaacagcttccccgttacctcagcgaatttccctggtgcttctacagcacacatggattcttcttcaagcgggagagcttgcttccccggtgtcaactctcaaatattgggtcctggagttccagttccgtctaattacccaagaccttatatagttggcctcccaaacggtggtagcaatggcggtgttttggacaatggcgcgaaatggtttaggtcaggacttgacttaaattctggtcctggaggtcatgaaacagagggaagagacgaatcaacacttgtggcaaggcaattatcctcatctgcttccttacctttgaaggaggatcaagcaagaatgtatcaaatgtcaggtggtgttctgaagaggaaagaaccggaaggaggatgggatggatataggcagtcctcatggcaataa

SEQ ID NO: 84 - protein, 1613 aa, Arabidopsis thaliana
MHGRVCERRHKSRRRHMLISSSRVIATVEGGGSSCLSLSSSTSFSKDGRKISVGDCALFKPPQDCPPFIGIIRLIIAEEEDKLKLGVNWLYRPTELKLGKGILLEAEPNELFYSFHEDNIPAASLLHPCKVAFLPRGVELPSGISSFVCRRVYDVTNERLWWLTDQDYIDDRQLEVDKLLCKTRSEMHTTLQQGGRSPKSMNSPTTSQPKDGIQNSNSFLSQGKGRKRERMDHGSESVKRERSSRVDDSGSGPLRTESGLKSEILKFTEKGGLVDSEGVEKLVQLMLPERNEKKIDLVGRAILAGFVAATDKFDCLSRFVQLRGLPVFDEWLQEVHKGKVGDGGSPKDSDRLVDDFLLVLLRALDKLPVNLNALQTCNIGKSVNHLRSHKNSEIGKKARSLVDTWKKRVEAEMDAKSGSNQGVSWPGRLSHGGRHSGGSAEANKTSSSHLHASKSVSVKQQVENNLKCVATSPGSTRSAPSPGSGGNVSKDGQQRNAGAGGVSEVLAAVKDEKSSSSSQSHNNSQSCSSEHAKTGNLCGKEDARSSTAGSTLKKCSGGSSRHRKSNNVFQGSSSSASPRGAGLSRSFSSHRNVPSEKISQSSLTSEKTLEVPLTEGSGNKLIVKLPNRGRSPAQSVSGGSLEDPAPVNSRVSSPVHAVKQELCDNNGREKNHSYRPNVSSVLNAESWQSNELKDILTGSQEAAGSPLVAGDERGGDLKDSDKASGNVKGTSSLGNEFKSGERHGGTLSSMNALIESCVRYSETNASLAGSDDVGMNLLASVAADEMSKSPVASPSVSQPPNSVMNENSTVGNNTKLMASDGLPHEQHQAVCTSVSTEQGEQHVSSSGTQLESEIKNESKTGDRDKSSNSDTEDLQRLVDQCLESNDNSDGVVASPALPTKAVKEKILNDSDSGELKDIKTDVKSEADCTSDSTKRVASSMLTECRDVSKKVDSVAVEQTPLEGVDDDKKEEKPPTALSSELVKKVEEDVPVSSGISRDMDAVSIGRPITEMVNNVAFNHMDQKDVKKIKQDCDTSVGAIKDTSAGLDSSVTKGKVEPVEGNLENSEVKERYSGLRATPGLSPKEAEDLERPNGPKTSDADGDEAGECTSAARDASSVSAAASAGSEMDARVEFDLNEGFDGDDAKHGDSNNFSGSVFLTPTPLQPVKTLPFPVAPVSSGTRASITVAAAAKGPFVPPEDLLRNKGAVGWRGSAATSAFRPAEPRKPQDVLLSINNTSTSDASTSAGKQTRTFLDFDLNVPDERVLEDLASQRSGNPTNCTSDITNSFDQVRSGVMGSALDHSSGGLDLDLNKVDDSTDMISYTMNSSHRLDSSFQQVKLPSTGGRRDFDLNDGPVGDDAAVEPSMVLNQHSRSGLPSQPSLSGIRVNGENMASFSTWFPAANAYSAVSMPPIMPERGDQPFPMIATRGPQRMLGPTTGVSSFTPEGYRGPVLSSSPAMPFQSTTFQYPVFPFGNSFPVTSANFPGASTAHMDSSSSGRACFPGVNSQILGPGVPVPSNYPRPYIVGLPNGGSNGGVLDNGAKWFRSGLDLNSGPGGHETEGRDESTLVARQLSSSASLPLKEDQARMYQMSGGVLKRKEPEGGWDGYRQSSWQ

SEQ ID NO: 85 - DNA, 876 bp, Arabidopsis thaliana
atggggaaaaaagctaaatggttttcaagtgttaagaaagcattcagcccagattcaaagaagtcgaagcaaaaattggctgagggacaaaatggtgttatctctaatcctcctgttgtggataatgttagacaatcttcttcttctcctcctcctgctcttgctcctcgtgaagtgagagtagctgaagtgattgttgaacggaacagggatctttcacctccttctacagcagatgctgtgaatgttacagctactgatgttcctgtagttccatcttcatctgctcctggtgttgttcgtcgcgctacacctactcgatttgctggaaagtcaaacgaagaagccgctgctatcttgatccagactatatttagaggttatttggcaaggagagcgttgcgggcaatgaggggtttggtcagacttaagttattgatggaaggatctgttgttaagcggcaagctgcaaatactctaaaatgtatgcagactctctctcgtgtacagtcgcagatccgagctaggagaatcaggatgtcagaagagaatcaggctcgccagaaacaactccttcagaaacatgctaaagagctagctggcttgaagaacggggataactggaatgatagcattcaatcaaaggagaaagttgaagcgaatttgctaagcaagtacgaggcaacaatgagaagggaaagggcattggcttattcatactctcatcagcaaaactggaagaacaactctaaatctggaaacccgatgttcatggatccaagcaacccgacatggggttggagctggttagagagatggatggctggtaggccactagagagttccgagaaagaacaaaagcaacagcaacaatga

SEQ ID NO: 86 - protein, 291 aa, Arabidopsis thaliana
MGKKAKWFSSVKKAFSPDSKKSKQKLAEGQNGVISNPPVVDNVRQSSSSPPPALAPREVRVAEVIVERNRDLSPPSTADAVNVTATDVPVVPSSSAPGVVRRATPTRFAGKSNEEAAAILIQTIFRGYLARRALRAMRGLVRLKLLMEGSVVKRQAANTLKCMQTLSRVQSQIRARRIRMSEENQARQKQLLQKHAKELAGLKNGDNWNDSIQSKEKVEANLLSKYEATMRRERALAYSYSHQQNWKNNSKSGNPMFMDPSNPTWGWSWLERWMAGRPLESSEKEQKQQQQ

SEQ ID NO: 87 - DNA, 810 bp, Arabidopsis thaliana
atgtctcctttcaaaatattcttcttcacgactcttctcgtggcggcgttttcagtgtcggctgctgatttcaacactgacgtcaacgtagcttggggaaatggccgtgggaagatactcaacaacggccagcttcttactctctccttagacaaatcctctggttccggttttcaatccaaaacagagtatttgtttggaaagattgatatgcagattaagcttgttcctggtaactctgcaggaacagtcacaactttttacctaaaatccgaaggatccacttgggatgagattgattttgagttcttgggtaatatgagtggagatccttatactttacacactaatgtttacactcaaggtaaaggtgacaaagagcaacaattccatctctggttcgacccaaccgccaatttccacacttactcaatcctctggaaccctcaaagaatcatattgaccgtcgatgacacacccattagagagtttaaaaactatgagtctctcggtgtcttgtttccaaagaacaagccgatgaggatgtacgcgagtttatggaacgcagacgattgggcaacaagaggcggtcttgttaaaactgattggtctaaagctccattcatggcttcttacagaaacattaagattgactcgaaaccaaactccaattggtacactcaagaaatggattcaacaagccaagctagactcaaatgggttcagaagaattacatgatctacaattattgtactgaccataggaggtttccacagggagctcctaaggaatgcacaacaagctcatag

SEQ ID NO: 88 - protein, 269 aa, Arabidopsis thaliana
MSPFKIFFFTTLLVAAFSVSAADFNTDVNVAWGNGRGKILNNGQLLTLSLDKSSGSGFQSKTEYLFGKIDMQIKLVPGNSAGTVTTFYLKSEGSTWDEIDFEFLGNMSGDPYTLHTNVYTQGKGDKEQQFHLWFDPTANFHTYSILWNPQRIILTVDDTPIREFKNYESLGVLFPKNKPMRMYASLWNADDWATRGGLVKTDWSKAPFMASYRNIKIDSKPNSNWYTQEMDSTSQARLKWVQKNYMIYNYCTDHRRFPQGAPKECTTSS

SEQ ID NO: 89 - DNA, 1410 bp, Arabidopsis thaliana
atgggtcgcaacgtcaaaaccaaggcaaagaggaagaacaagaagaaagcagaggcgtcttcttccgagataccatcgataccaactagggtttggcaaccaggtgttgatacccttgaagatggagaagaacttcagtgtgacccttctgcttataattctctccatggcttccatgttggttggccctgtctgagctttgacattttaggtgataagttgggtttgaaccgaactgagtttcctcacacactttatatggtggctgggactcaggctgagaaagcagctcataactccatagggttatttaaaatcaccaacgtatctggtaagagacgtgatgttgtgcctaagacatttggcaatggtgaggatgaggatgaggatgacgaagatgacagtgacagcgatgatgatgacggagatgaagcttctaaaactccaaatattcaggttcgaagggttgctcaccatggatgtgttaaccgtatacgtgcaatgccacaaaactctcatatctgtgtctcttgggcagattctggtcatgtacaggtctgggacatgagctctcatcttaatgctttagccgaatcagaaacagagggtaaagatggaacttcaccggttcttaaccaagcacccttggttaacttttctggtcacaaagatgaaggctatgctatagactggagtcctgcaaccgctggaagacttctttccggggactgcaagagtatgattcacctgtgggagccagcttctggttcatgggctgttgatcctattccgttcgctggacacactgcaagtgttgaagatttacaatggagtccagccgaagaaaacgtgtttgcctcatgttctgtggatgggagtgttgcagtctgggatattcgacttgggaagtcccctgcactatctttcaaggcacataacgcagatgtgaatgtcatctcatggaacaggctggctagttgcatgttggcctcaggaagtgatgacgggacattctccatccgtgatcttagactgatcaaaggtggagatgctgtggtagcacattttgagtaccataagcatcctattacgtcaattgaatggagcgctcatgaagcttcgacacttgcagtcacttccggtgataaccagctcacgatatgggatctatccttagagaaggatgaagaagaagaggcagagttcaatgcacagaccaaggaactagtcaacacacctcaagacttgcctcctcagcttctctttgttcaccaaggacaaaaagatctgaaggaacttcactggcacaaccagattccggggatgatcatctcaactgctggtgatggtttcaacatcttaatgccttacaacattcagaacacgcttccgtctgagctaccagcctga

SEQ ID NO: 90 - protein, 469 aa, Arabidopsis thaliana
MGRNVKTKAKRKNKKKAEASSSEIPSIPTRVWQPGVDTLEDGEELQCDPSAYNSLHGFHVGWPCLSFDILGDKLGLNRTEFPHTLYMVAGTQAEKAAHNSIGLFKITNVSGKRRDVVPKTFGNGEDEDEDDEDDSDSDDDDGDEASKTPNIQVRRVAHHGCVNRIRAMPQNSHICVSWADSGHVQVWDMSSHLNALAESETEGKDGTSPVLNQAPLVNFSGHKDEGYAIDWSPATAGRLLSGDCKSMIHLWEPASGSWAVDPIPFAGHTASVEDLQWSPAEENVFASCSVDGSVAVWDIRLGKSPALSFKAHNADVNVISWNRLASCMLASGSDDGTFSIRDLRLIKGGDAVVAHFEYHKHPITSIEWSAHEASTLAVTSGDNQLTIWDLSLEKDEEEEAEFNAQTKELVNTPQDLPPQLLFVHQGQKDLKELHWHNQIPGMIISTAGDGFNILMPYNIQNTLPSELPA

SEQ ID NO: 91 - DNA, 825 bp, Arabidopsis thaliana
atggagttacatgagatctcaaagctcgacaataagaagcatccagagagaattgttgaatcgaagatgaagaagagaatgaaaccttattctctcacgtctcttaacaatctcgacgatggttgccttatgcatatcctcagcttcctatctccaattccagataggtataacacagcactcgtttgccacagatggagatatctggcgtgtcaccctcgcttgtggctccgtgttgaccgttttgtcaaggatttatctcagcctggagttttcctcaacattgagtcagctgtatctgcagcaagacccggcgataccattttaatagtagccggtgggaactatcgcgtttctaatattcagattaaaaagcctctttgcctggtcggtggaggcgagattcctgatgaaaccaccctcgtctgtgctcgtggttcagacagtgccctggaactgttatcaacctgcaagcttgcgaatttaacagtaaaagcagagctcgggtgctgtttgcttcataggagtggaaggctaacgattgatggatgtgtgcttcaatgtgagacaaaccctttggatcatctctcatgcccaatcgtgagcactgctggagatgaagacattgaaaatatcttaagccatgtggaagtgaaagaaactgttactggaaagattaaagcaaacagtgtaaccgttttgcagacaagaatcgagggaggtgcaaaggctgtttcaacaaggggagacttggttctgcagcgtgttcgagtcatgtattccaaggcttacctctatttctggtttgatgtagattatgaatga

SEQ ID NO: 92 - protein, 274 aa, Arabidopsis thaliana
MELHEISKLDNKKHPERIVESKMKKRMKPYSLTSLNNLDDGCLMHILSFLSPIPDRYNTALVCHRWRYLACHPRLWLRVDRFVKDLSQPGVFLNIESAVSAARPGDTILIVAGGNYRVSNIQIKKPLCLVGGGEIPDETTLVCARGSDSALELLSTCKLANLTVKAELGCCLLHRSGRLTIDGCVLQCETNPLDHLSCPIVSTAGDEDIENILSHVEVKETVTGKIKANSVTVLQTRIEGGAKAVSTRGDLVLQRVRVMYSKAYLYFWFDVDYE

SEQ ID NO: 93 - DNA, 3396 bp, Arabidopsis thaliana
atgtcttctcttagtagagagctcgttttcttgatcttacagtttctcgatgaagagaagtttaaagagactgttcacaagcttgaacaagaatctgggtttttcttcaatatgaagtattttgaggatgaggttcacaatggaaattgggatgaggttgagaagtatctctctggtttcactaaagtagatgataatagatactctatgaagatattcttcgagataagaaagcagaagtatctcgaggctttggataagcatgatcgtcccaaggctgtggatatactagtgaaggatttgaaagtgttttcaacttttaatgaggagcttttcaaggaaataacacagctcttgacattggagaacttccgggagaatgaacagttatccaagtatggggacaccaagtctgcaagagcgatcatgttggtggaactcaaaaagctgattgaggcgaatcctttattccgtgataaattgcagttccctactcttagaaattcaaggctgaggactttgatcaaccagagcttaaattggcaacaccagctttgtaaaaatccaaggccaaatccagatatcaagactctttttgtggatcactcttgtggccctccaaatggcgcacgagctccatctcctgtgaacaatccactgcttggagggataccaaaggctggaggatttcctcctttaggcgcacacgggccatttcaaccaacggcgtcacctgttccaacacctcttgctggttggatgtctagtccatcctctgtcccacatccagctgtctcagcaggagccattgcacttggtggtccatcaatcccagcggcgttgaagcacccgagaactcctccaactaatgcttctttagactacccgtcagcagattctgaacatgtctcaaaaagaacaagaccaatgggaatctctgacgaggtgaatctaggcgtgaacatgttaccgatgtcattttcagggcaggcccatggtcattctccggctttcaaagcacctgacgacttgcccaagacagttgcgagaactttgagtcagggctcatctcccatgagcatggatttccatccaattaaacagaccctgcttctagttggtacaaatgtaggtgatatcgggctgtgggaagttggttctcgcgaaagattagtacagaagacgttcaaagtctgggatttgagtaaatgttcaatgcccttgcaggctgctctggtgaaagaacctgtcgtttctgtcaaccgtgtgatatggagccctgacggttccttgtttggagttgcttactcgagacatattgtacaactatactcttatcacggaggtgaagacatgaggcaacaccttgagattgatgctcatgttggtggtgtgaatgatatttccttctcgactccaaacaagcaactatgtgtaataacttgtggtgatgacaaaaccatcaaggtttgggacgctgcaacaggtgtcaaaaggcatacttttgaaggccatgaagctcctgtttattccgtttgtcctcattacaaggaaaacattcagttcatattttcaacagctcttgatgggaaaattaaggcttggttgtatgataatatgggttcccgagttgactatgatgcacctggtcgctggtgtactacaatggcttatagtgccgatggtactaggctattctcttgtgggacgagtaaagatggagagtctttcattgttgagtggaatgaaagcgaaggagctgttaaaagaacttatcaaggattccacaagcgttctctaggtgttgtgcagtttgatacaactaaaaaccgttatctagctgcgggtgatgatttctccatcaagttctgggatatggacgctgtacagcttttaactgccattgatggcgatggaggcctccaggcaagcccgcgtatccggttcaacaaggaaggctctctcctggccgtgtctggcaacgagaatgtgatcaagattatggcaaactcagatggtctaaggctattgcacacttttgagaacatatcatctgaatcctccaagcctgcaataaacagcatagcagcggcagcggcagctgctgcaacaagtgctggtcacgcagatcgatcagccaatgtagtttccatccaaggaatgaatggagattcgcggaatatggtggatgtgaagccagtgatcacagaagaatcaaatgataagtctaagatatggaagcttactgaagtcagcgagccttctcaatgcaggtcactgagactccctgagaatctgagagtagccaagatatcaagattgattttcacgaattcgggaaatgctattttggctctggcatcaaacgcaattcatcttctatggaaatggcagcggaatgagcgcaacgcaactggaaaggcgacagcttctttaccgcctcagcagtggcaaccagctagtgggatcctcatgactaacgatgttgctgaaaccaatcccgaggaagctgtaccttgttttgctttatccaagaatgattcatatgtaatgtcagcctccggaggaaagatatccttatttaacatgatgacgtttaagacaatggcgactttcatgcccccaccaccggctgctacttttcttgcttttcatcctcaagacaacaatatcatcgctattgggatggatgatagcacgattcagatttataatgtccgtgttgatgaggtgaagagtaagcttaaaggtcattcaaagagaataactggtcttgccttctccaacgtattaaacgtgttggtttcgtctggagcagatgcacagctttgtgtttggaacacagatggatgggaaaagcagagaagcaaggttttgccacttccacagggaagaccaaacagtgcaccttcagatacgcgtgttcagttccatcaagatcaagctcacttcctcgttgtgcacgagacgcaacttgctatatacgaaactaccaagctcgaatgcatgaaacagtgggctgttcgagaatcattagctccaatcactcatgccacattctcatgcgatagccaattggtctacgcgagttttatggatgcaacagtttgtgtatttagctctgcaaatctacggctgcgttgccgggtcaacccttctgcgtatctaccagctagtctcagcaattcaaacgtacatccactagtgattgctgcacatccgcaagaaccaaacatgtttgcagttggtctctcagacgggggagtgcacatattcgaaccgctcgagtctgaaggtaaatggggagtcgctccaccggctgagaacgggtcggctagcggtgcaccaactgcaccttccgttggagcctctgcatctgatcagcctcagagatga

SEQ ID NO: 94 - protein, 1131 aa, Arabidopsis thaliana
MSSLSRELVFLILQFLDEEKFKETVHKLEQESGFFFNMKYFEDEVHNGNWDEVEKYLSGFTKVDDNRYSMKIFFEIRKQKYLEALDKHDRPKAVDILVKDLKVFSTFNEELFKEITQLLTLENFRENEQLSKYGDTKSARAIMLVELKKLIEANPLFRDKLQFPTLRNSRLRTLINQSLNWQHQLCKNPRPNPDIKTLFVDHSCGPPNGARAPSPVNNPLLGGIPKAGGFPPLGAHGPFQPTASPVPTPLAGWMSSPSSVPHPAVSAGAIALGGPSIPAALKHPRTPPTNASLDYPSADSEHVSKRTRPMGISDEVNLGVNMLPMSFSGQAHGHSPAFKAPDDLPKTVARTLSQGSSPMSMDFHPIKQTLLLVGTNVGDIGLWEVGSRERLVQKTFKVWDLSKCSMPLQAALVKEPVVSVNRVIWSPDGSLFGVAYSRHIVQLYSYHGGEDMRQHLEIDAHVGGVNDISFSTPNKQLCVITCGDDKTIKVWDAATGVKRHTFEGHEAPVYSVCPHYKENIQFIFSTALDGKIKAWLYDNMGSRVDYDAPGRWCTTMAYSADGTRLFSCGTSKDGESFIVEWNESEGAVKRTYQGFHKRSLGVVQFDTTKNRYLAAGDDFSIKFWDMDAVQLLTAIDGDGGLQASPRIRFNKEGSLLAVSGNENVIKIMANSDGLRLLHTFENISSESSKPAINSIAAAAAAAATSAGHADRSANVVSIQGMNGDSRNMVDVKPVITEESNDKSKIWKLTEVSEPSQCRSLRLPENLRVAKISRLIFTNSGNAILALASNAIHLLWKWQRNERNATGKATASLPPQQWQPASGILMTNDVAETNPEEAVPCFALSKNDSYVMSASGGKISLFNMMTFKTMATFMPPPPAATFLAFHPQDNNIIAIGMDDSTIQIYNVRVDEVKSKLKGHSKRITGLAFSNVLNVLVSSGADAQLCVWNTDGWEKQRSKVLPLPQGRPNSAPSDTRVQFHQDQAHFLVVHETQLAIYETTKLECMKQWAVRESLAPITHATFSCDSQLVYASFMDATVCVFSSANLRLRCRVNPSAYLPASLSNSNVHPLVIAAHPQEPNMFAVGLSDGGVHIFEPLESEGKWGVAPPAENGSASGAPTAPSVGASASDQPQR

SEQ ID NO: 95 - DNA, 1071 bp, Arabidopsis thaliana
atgagtcttcttgcagatcttgttaaccttgacatctcagacaacagtgaaaagatcatcgctgaatacatatgggttggtggttctggtatggacatgagaagcaaagccaggactctccctggacctgtgaccgatccatcaaaacttccaaagtggaactatgatggttcaagcactggtcaagctcctggtcaagacagtgaagtgatcttataccctcaagcaattttcaaagatccattccgtagaggcaacaacatccttgttatgtgtgatgcttacactccagcgggagagccaatccctactaacaagcgacatgctgcggctgagatctttgctaaccctgatgttattgctgaagtgccatggtatggaatcgaacaagaatacactttgttgcagaaggatgtgaactggcctcttggatggcccattggtggcttccctggccctcagggaccatactactgcagtattggagctgacaaatcttttggaagagacattgttgatgctcactacaaagcctctttgtatgctggaatcaacatcagtgggatcaatggagaagtcatgccgggacaatgggagttccaagtcggcccatcggtcggtatctcagctgctgatgaaatatggatcgctcgttacattttggagaggatcacagagattgctggtgtggttgtatcttttgacccaaaacctattcctggtgactggaatggagctggtgctcacaccaattacagtactaaatcaatgagggaagaaggaggatacgagataatcaagaaggcgatcgagaagcttggcttgagacacaaggaacacatttccgcttacggtgaaggaaacgagcgtcgtctcacgggacaccatgaaactgctgacatcaacactttcctttggggtgttgcgaaccgtggtgcatcgatccgagtaggacgtgacaccgagaaagaagggaagggatactttgaggataggaggccagcttcaaacatggacccttacgttgttacttccatgattgcagagactacactcctctggaacccttga

SEQ ID NO: 96 - protein, 356 aa, Arabidopsis thaliana
MSLLADLVNLDISDNSEKIIAEYIWVGGSGMDMRSKARTLPGPVTDPSKLPKWNYDGSSTGQAPGQDSEVILYPQAIFKDPFRRGNNILVMCDAYTPAGEPIPTNKRHAAAEIFANPDVIAEVPWYGIEQEYTLLQKDVNWPLGWPIGGFPGPQGPYYCSIGADKSFGRDIVDAHYKASLYAGINISGINGEVMPGQWEFQVGPSVGISAADEIWIARYILERITEIAGVVVSFDPKPIPGDWNGAGAHTNYSTKSMREEGGYEIIKKAIEKLGLRHKEHISAYGEGNERRLTGHHETADINTFLWGVANRGASIRVGRDTEKEGKGYFEDRRPASNMDPYVVTSMIAETTLLWNP

SEQ ID NO: 97 - DNA, 630 bp, Arabidopsis thaliana
atggcggcggttaggagaagagaacgagatgtggttgaagagaatggagttacgacgacgacggtgaaacgaaggaagatggaggaggaagtggatttagtggaatctaggataattctgtctccgtgtgtacaggcgacgaatcgcggtggaattgtggcgagaaattcagcaggagcgtcggagacgagtgttgttatagtacgacggcgagattctcctccggttgaagaacagtgtcaaatcgaagaagaagattcgtcggtttcgtgttgttctacatcggaagagaaatcgaaacggagaatcgaatttgtagatcttgaggaaaataacggtgacgatcgtgaaacagaaacgtcgtggatttacgatgatttgaataagagtgaggaatcgatgaacatggattcttcttcggtggctgttgaagatgtagagtctcgccgcaggttaaggaagagtctccatgagacggtgaaggaagctgagttagaagacttttttcaggtggcggagaaagatcttcggaataagttgttggaatgttctatgaagtataacttcgatttcgagaaagatgagccacttggtggaggaagatacgagtgggttaaattgaatccatga

SEQ ID NO: 98 - protein, 209 aa, Arabidopsis thaliana
MAAVRRRERDVVEENGVTTTTVKRRKMEEEVDLVESRIILSPCVQATNRGGIVARNSAGASETSVVIVRRRDSPPVEEQCQIEEEDSSVSCCSTSEEKSKRRIEFVDLEENNGDDRETETSWIYDDLNKSEESMNMDSSSVAVEDVESRRRLRKSLHETVKEAELEDFFQVAEKDLRNKLLECSMKYNFDFEKDEPLGGGRYEWVKLNP

SEQ ID NO: 99 - DNA, 495 bp, Arabidopsis thaliana
atggctcaattcttagagaaggcaacttcggctctcagcgaagccaaagaatccgttacaagcaccgctgaatccgtcacggcttctctcactgatgctgagaaaaccgttaaccaaaccgccaggagcactctaactgacgccgagacaaccgttgcagcatctgttgaaacggtcaagaccgaggctgcagccgcaccagacaaagcgtctggtgtgtctacacaggctaaggatgcagtggacaaagctttttctagaggtatagaaggagccaaatctttgcttcaaactttcgaagcgaagagcagcgatatttcctcaaagcttgttggaggtgttaccaatcttgtgagtggagcatcgagcagcaccgtggcaaaccgagaccttccagtatctacagacaaccagcctctgctagcgtctggtgaaaagacgccgtggtggaagaattgttgtggagttcttgatcttttcaagaaagatacttaa

SEQ ID NO: 100 - protein, 164 aa, Arabidopsis thaliana
MAQFLEKATSALSEAKESVTSTAESVTASLTDAEKTVNQTARSTLTDAETTVAASVETVKTEAAAAPDKASGVSTQAKDAVDKAFSRGIEGAKSLLQTFEAKSSDISSKLVGGVTNLVSGASSSTVANRDLPVSTDNQPLLASGEKTPWWKNCCGVLDLFKKDT

SEQ ID NO: 101 - DNA, 867 bp, Arabidopsis thaliana
atgtctggagcattgaatatgactcttgatgagattgttaagaggggtaaaactgcaaggtctgggggaagagggatttctcgtgggcgtggtcgtggacgtggtggtggtggaagaggagctggacctgctagaagaggtcctcttgctgtgaatgctcgtccatcatctttcaccattaacaagcctgtccgtagggtcaggagcttgccatggcaaagcggtttgtttgaagatggcctaagagctgccggggcatcaggagttgaagttggaaccaggctccatgttacaaatctggaccagggtgtgacaaatgaagatataagggaactcttctctgagattggggaggtagagcgttatgcgattcattatgacaaaaatgggcgtccaagtggcacagctgaagtggtgtatccaagaagaagtgatgcatttcaagctctgaagaaatataacaatgtgctattggatggaaggccaatgagacttgagattttgggtggcaacaattcttccgaggctcctttatctggtcgtgtgaatgtgaatgtcactggactcaatggaaggctgaagaggacggttgttatccaacaaggaggaggagggagaggaagagttagaggtgggagaggaggaagaggtccagctcctactgtcagtcgccgccttccaattcataaccagcagggaggagggatgagaggaggaagaggcgggtttcgtgctagagggcgtggtaatggtggccgtggtcgtggtggtggaagaggaaatggaaagaagccagtggagaagtcagctgctgatcttgacaaagatcttgagagctatcacgctgatgccatgaacacctcttaa

SEQ ID NO: 102 - protein, 288 aa, Arabidopsis thaliana
MSGALNMTLDEIVKRGKTARSGGRGISRGRGRGRGGGGRGAGPARRGPLAVNARPSSFTINKPVRRVRSLPWQSGLFEDGLRAAGASGVEVGTRLHVTNLDQGVTNEDIRELFSEIGEVERYAIHYDKNGRPSGTAEVVYPRRSDAFQALKKYNNVLLDGRPMRLEILGGNNSSEAPLSGRVNVNVTGLNGRLKRTVVIQQGGGGRGRVRGGRGGRGPAPTVSRRLPIHNQQGGGMRGGRGGFRARGRGNGGRGRGGGRGNGKKPVEKSAADLDKDLESYHADAMNTS

SEQ ID NO: 103 - DNA, 1452 bp, Arabidopsis thaliana
atgaacgagaaagccaacgtctctaaggagcttaatgcccgccatagaaagattcttgaagggcttcttaaacatccagagaacagagaatgtgctgactgcaaaacaaaaggtccaagatgggctagtgttaatttaggtatctttatctgcatgcaatgttctgggattcacaggagtctcggggtacacatatcgaaggttcgatctgccactctggacacatggctccccgagcaggttgcatttatacagtcaatgggaaatgataaagcaaatagttactgggaagcagagctacccccaaactatgatagagttggaattgagaattttatacgtgcaaagtatgaagagaagagatgggtttctagaggggaaaaggctagatcacctcctagagtcgagcaggaacggcggaaatctgtggagagaagtgggccgggatatgagcatggacatagtagtagtcctgtaaatttgtttgaggagaggaaaactattccagcatctagaacaagaaataatgttgctgcaacgagaataaatcttcccgtgcctccccaaggacccagtcaggttataaagccacagcagaaaatggagtctgcagctactccagtagagagggagaaacaagcagtaaatgttgcaccagcatcagatcctccaaaggtggattttgctactgatctgtttaacatgctatcaatggatgattcgactacaaatacctcagaggcaactcctggcgatactcctgccgatgataactcatgggctggctttcagtctgctggaagtggtcaaacggcagagaaaattgtcacagccaagcctgctgagagcagttctcctccagcttcatcttctgactttgaggatttgtttaaggacacacctaatttaacaactcaacaagcaccaaaagatgtgaaaggcgatatcatgagcctgtttgagaagacgaatatagtatcgccttttgccatgcatcagcaacaggttgctatgctcgctcagcagcaagccctttacatggctgcagcgaaagctgctggaggcactccaaacggcgtgaatcaacaagctattgctaatgctcttaacgtagcttctgcaaattggtcaaaccccggcggctaccagatccccggaatgactaaccccgtaggtggtcaagctgatctccagaaacttatgcaaaacatgaatatgaacgcaaacatgaacacgagacccgcacaaccgcaagagaacactctacaatacccatcatccagtttctacacaatgggtcaagctaatcaagtgaacggtatgaccccaaactcaaccggtaaacctcagtcatcatccgcaacccaaccaacaagcaccacaccatcttcacaatcaggcaaagactttgatttctcttccttgatggatggaatgttcacaaaacattga

SEQ ID NO: 104 - protein, 483 aa, Arabidopsis thaliana
MNEKANVSKELNARHRKILEGLLKHPENRECADCKTKGPRWASVNLGIFICMQCSGIHRSLGVHISKVRSATLDTWLPEQVAFIQSMGNDKANSYWEAELPPNYDRVGIENFIRAKYEEKRWVSRGEKARSPPRVEQERRKSVERSGPGYEHGHSSSPVNLFEERKTIPASRTRNNVAATRINLPVPPQGPSQVIKPQQKMESAATPVEREKQAVNVAPASDPPKVDFATDLFNMLSMDDSTTNTSEATPGDTPADDNSWAGFQSAGSGQTAEKIVTAKPAESSSPPASSSDFEDLFKDTPNLTTQQAPKDVKGDIMSLFEKTNIVSPFAMHQQQVAMLAQQQALYMAAAKAAGGTPNGVNQQAIANALNVASANWSNPGGYQIPGMTNPVGGQADLQKLMQNMNMNANMNTRPAQPQENTLQYPSSSFYTMGQANQVNGMTPNSTGKPQSSSATQPTSTTPSSQSGKDFDFSSLMDGMFTKH

SEQ ID NO: 105 - DNA, 1674 bp, Arabidopsis thaliana
atgggaaagtctaaatccgccaccaaagttgttgcagagattaaggccactaagcctttgaagaaaggcaagagagagcctgaagatgatattgacaccaaagtgagtcttaagaagcagaagaaagacgtgattgctgctgtccagaaggaaaaagctgtgaagaaggttcctaagaaggttgagagctctgatgattcagattctgaatctgaggaagaggagaaggctaagaaagtcccagccaagaaggctgcttcaagcagtgatgagtcatctgatgactcttcttcagatgatgaacctgcacccaagaaggccgttgctgctactaacggaactgttgcaaagaagtctaaggatgactcatcatcatctgatgatgattcttcagacgaggaagttgctgtcaccaagaagcccgcagctgctgctaaaaatggctctgtaaaggccaagaaagagagttcgtctgaagatgattcatcttctgaagacgaacctgcgaagaaacctgctgctaagattgccaagccagctgctaaggattcttcatcctctgatgatgactcagatgaggattccgaggatgagaaacctgctaccaagaaggcagctcctgctgctgccaaggctgcaagcagctcagattcatcagatgaagattctgatgaggaaagtgaagatgagaaacctgcccagaaaaaggctgacactaaggcctctaaaaaatcgagtagtgatgagtcaagcgagtctgaggaagatgagagtgaagacgaggaggaaacccctaagaaaaagagctctgatgtagaaatggttgatgctgagaaatcaagtgctaaacagccaaagacaccatccactcctgctgctggaggatcaaagacactctttgctgccaatctctcttttaacattgaaagagcagatgttgagaatttcttcaaagaagctggtgaagttgttgatgttagattctctaccaacagagacgatggttctttcaggggatttggccatgttgagttcgcatcttctgaagaagcacagaaggcgcttgaattccatggtaggccattgctcggtcgtgagattcgtcttgatattgctcaggagagaggtgagagaggcgagagacccgcattcactccacaaagcggcaacttcagaagtggtggtgatggtggtgatgaaaagaaaattttcgttaagggatttgacgcttcactttctgaggatgatatcaagaacactttgagggaacatttcagttcatgtggagagatcaaaaatgtatctgttccaattgaccgtgacactggtaactccaaaggaattgcttaccttgagttttcagaaggcaaagagaaggcgttggaactaaatggaagtgatatgggaggaggattctatcttgtagtcgatgagcctagaccgagaggagatagcagtggtggtggtggatttggaaggggcaatggtcgtttcggtagtggtggtggcagaggaagagatggaggtcgtggtcgttttggtagtggtggtggcagaggaagagatggaggtcgtggtcgttttggtagtggtggtggcaggggaagtgatcgtggtcgtggaagacctagttttactccccaaggtaagaagactaccttcggtgacgagtag

SEQ ID NO: 106 - protein, 557 aa, Arabidopsis thaliana
MGKSKSATKVVAEIKATKPLKKGKREPEDDIDTKVSLKKQKKDVIAAVQKEKAVKKVPKKVESSDDSDSESEEEEKAKKVPAKKAASSSDESSDDSSSDDEPAPKKAVAATNGTVAKKSKDDSSSSDDDSSDEEVAVTKKPAAAAKNGSVKAKKESSSEDDSSSEDEPAKKPAAKIAKPAAKDSSSSDDDSDEDSEDEKPATKKAAPAAAKAASSSDSSDEDSDEESEDEKPAQKKADTKASKKSSSDESSESEEDESEDEEETPKKKSSDVEMVDAEKSSAKQPKTPSTPAAGGSKTLFAANLSFNIERADVENFFKEAGEVVDVRFSTNRDDGSFRGFGHVEFASSEEAQKALEFHGRPLLGREIRLDIAQERGERGERPAFTPQSGNFRSGGDGGDEKKIFVKGFDASLSEDDIKNTLREHFSSCGEIKNVSVPIDRDTGNSKGIAYLEFSEGKEKALELNGSDMGGGFYLVVDEPRPRGDSSGGGGFGRGNGRFGSGGGRGRDGGRGRFGSGGGRGRDGGRGRFGSGGGRGSDRGRGRPSFTPQGKKTTFGDE

SEQ ID NO: 107 - DNA, 3267 bp, Arabidopsis thaliana
atgaggaatcttgggttactcgaaattactctgctttgctctctctttgtctatttccgtatagattctgtctctagtttaaactcagatggtttggctttactctcgcttctcaagcactttgataaagtcccacttgaagtagcttcgacgtggaaggagaacacatctgaaaccactccatgtaataataactggtttggtgtcatttgtgatctttctggtaatgtcgtcgagacccttaatttgtctgcttctgggctttcaggccaattaggttctgaaattggggagcttaagagcttggtcacattggatctcagtcttaacagtttctctggtttattgccttccactttaggaaactgtacttcacttgagtatttggatttgtctaacaatgatttttctggagaagttcctgatatttttggtagcttgcagaatttgacgtttctgtatcttgatcgcaataatcttagtggtctcattcctgcaagtgttggtgggttgatagagctcgtagatctgaggatgtcatataataacttgtctggtaccattccagagttgcttgggaactgtagtaagctggaatatctggctttgaacaacaacaagttaaatggttctttgccagcaagtctctatctactcgagaatcttggtgagctatttgtcagtaacaacagccttggagggaggcttcattttggttctagcaactgcaagaaattggtttctttagatctctcgttcaatgatttccaaggcggtgttccacctgagataggcaactgcagtagccttcactctttagtcatggtgaaatgcaacttgacaggtacaatcccatcatcaatgggtatgttgagaaaggtttcggttattgacctttccgataatcgtctctcggggaatatccctcaagagcttgggaactgcagcagcttggaaaccttgaagctgaacgacaaccagctccaaggcgagataccacctgcattgagtaagctaaagaagctacaaagcctggagcttttttttaataagctgtccggtgagattcctattggcatatggaagattcagagtctgacacagatgctcgtttataacaacactctcaccggggaactaccagttgaagtaactcagctgaagcaccttaagaagcttacactgtttaacaacggcttttatggagatataccaatgagtttaggcctgaatcgaagcttagaggaggtggaccttcttggtaaccgttttacaggggagataccaccccatctctgccatggacagaagttgagattgttcatcttgggttctaatcagcttcatggtaagataccagcgtctattcgtcagtgtaagacccttgagcgagtcagacttgaagataacaaactttcaggtgttcttccggaattccctgagagtcttagtctttcctatgtgaacctcggaagcaatagctttgaaggatccatcccgcgcagcttgggaagctgtaaaaatctcttgactattgacctttctcaaaacaaactcacgggtctgatacctccagaactgggaaatctgcaaagccttggactgttgaacctttcacataattatctggaaggtcctctgccatcccagctatcaggctgtgcgagacttctgtattttgatgttggatccaactcattgaacggttctattccatcaagcttcagaagctggaaaagcttgtccactttagttctcagtgacaataattttctaggagctattccacagttcttggcagagcttgaccgactctcagatctgcggatagctcgaaatgcttttggaggtaagattccttcctcggttggcttgttgaagagtctacgctatggcttagacctcagtgcgaacgtatttacgggtgagattccaaccacactgggggctcttatcaatcttgaacgtctcaacatatccaacaacaagttgacagggcctttatcggttcttcaaagtcttaagtcattgaatcaagttgacgtctcgtataatcagttcacgggtccaatacccgtaaatctgttatcaaattcttcaaagttttctggaaatccagacctctgcattcaagcttcttactcagtgagtgccataatccgcaaagagtttaaatcttgcaaaggtcaagtcaaacttagcacgtggaagatcgcccttatagcagctgggtcctcactatccgtattggctttgctttttgctctctttttggttttatgccggtgcaaaagaggaaccaagacagaagatgctaatatcctcgcagaggaaggtctgtccttgttgctgaacaaagttctagcagccactgacaatctagatgacaagtacatcattggaagaggagctcatggagttgtttacagagcttctttaggatcaggcgaagaatacgccgtgaagaaactcatctttgcggaacacattcgcgcaaaccaaaatatgaagcgggagatcgaaacaatcgggctagtcaggcacagaaatctcattcggttagaaagattttggatgaggaaagaagatggcttaatgctgtatcagtacatgcccaatggaagcctacacgacgttttgcacagaggtaatcaaggagaagcagttcttgactggtctgcacggttcaacatagcccttgggatttcacatggactggcgtatttacatcatgattgtcatccaccaataattcaccgcgacatcaaaccagagaacatactcatggactcggatatggagcctcacattggagatttcggattggctcggattctagatgactcaacagtttcaacggccactgttactggcacaactgggtacattgcaccagaaaatgcgtacaagacggtgaggagcaaggaatcagatgtttacagttatggagttgttttgctcgagctggtaacaggaaagagagcactggacagatctttcccggaagatatcaacattgtgagctgggtcagatctgtattaagcagctacgaggatgaagacgatactgctggtccaatcgttgatccaaaacttgtggatgagcttctggatacgaagctcagggaacaagcaatccaagtcacagacttggctcttagatgtacagacaagaggccggagaacagaccatcgatgagagatgtggtgaaagatttgactgatttggaaagttttgtaagaagcacttcgggttcagttcactag

SEQ ID NO: 108 - protein, 1088 aa, Arabidopsis thaliana
MRNLGLLEITLLCSLFVYFRIDSVSSLNSDGLALLSLLKHFDKVPLEVASTWKENTSETTPCNNNWFGVICDLSGNVVETLNLSASGLSGQLGSEIGELKSLVTLDLSLNSFSGLLPSTLGNCTSLEYLDLSNNDFSGEVPDIFGSLQNLTFLYLDRNNLSGLIPASVGGLIELVDLRMSYNNLSGTIPELLGNCSKLEYLALNNNKLNGSLPASLYLLENLGELFVSNNSLGGRLHFGSSNCKKLVSLDLSFNDFQGGVPPEIGNCSSLHSLVMVKCNLTGTIPSSMGMLRKVSVIDLSDNRLSGNIPQELGNCSSLETLKLNDNQLQGEIPPALSKLKKLQSLELFFNKLSGEIPIGIWKIQSLTQMLVYNNTLTGELPVEVTQLKHLKKLTLFNNGFYGDIPMSLGLNRSLEEVDLLGNRFTGEIPPHLCHGQKLRLFILGSNQLHGKIPASIRQCKTLERVRLEDNKLSGVLPEFPESLSLSYVNLGSNSFEGSIPRSLGSCKNLLTIDLSQNKLTGLIPPELGNLQSLGLLNLSHNYLEGPLPSQLSGCARLLYFDVGSNSLNGSIPSSFRSWKSLSTLVLSDNNFLGAIPQFLAELDRLSDLRIARNAFGGKIPSSVGLLKSLRYGLDLSANVFTGEIPTTLGALINLERLNISNNKLTGPLSVLQSLKSLNQVDVSYNQFTGPIPVNLLSNSSKFSGNPDLCIQASYSVSAIIRKEFKSCKGQVKLSTWKIALIAAGSSLSVLALLFALFLVLCRCKRGTKTEDANILAEEGLSLLLNKVLAATDNLDDKYIIGRGAHGVVYRASLGSGEEYAVKKLIFAEHIRANQNMKREIETIGLVRHRNLIRLERFWMRKEDGLMLYQYMPNGSLHDVLHRGNQGEAVLDWSARFNIALGISHGLAYLHHDCHPPIIHRDIKPENILMDSDMEPHIGDFGLARILDDSTVSTATVTGTTGYIAPENAYKTVRSKESDVYSYGVVLLELVTGKRALDRSFPEDINIVSWVRSVLSSYEDEDDTAGPIVDPKLVDELLDTKLREQAIQVTDLALRCTDKRPENRPSMRDVVKDLTDLESFVRSTSGSVH

SEQ ID NO: 109 - DNA, 1083 bp, Arabidopsis thaliana
atggcgtctgtgaaccctttcgatctcttggacgatgacgcagaggatcccagccagattgttgcgtctaagccattgaaggttgtggctccggttcagactgctaagtctggtaagatgccgactaagccgcctcctccttctcaagctgtgagggaggcaaggaacgctcctggtggaggtcgtggtgctggacgtggagggagttatggtcgtggtggacgtggtggaaacaatagggattcaaggaacaatgatggtcctgccaatgaaaacggatatggtggaggctacagacgctcagaagaaggagatggagctagacgtggtgggcctgttggtggataccgtggtgatcgccgtggaagctacagcaatggtggtgattcaggtgactctgaaagaccacgcaagaactatgaccgtcacagtagaacagcgtacgggaatgaggataaacgtgatggagctggccgtgcgaattggggaaccactcaggatgatattactccggtgactgaagaatccacagctgttgtggacaagaatttgactgttgagaagcaagatggtgaaggtgaagcaactgatgcaaagaatgaaacacctgctgagaaagcagaggaaaagcctgaggacaaggagatgactttggaagagtatgagaaggttttggaggagaagaagaaagctctgcaggcgaccaaggttgaggaaaggaaggttgacactaaagcatttgaggccatgcaacagctctcaagcaaaaagagcaacaacgatgaagtcttcatcaaactgggaacagagaaggacaagcgcattactgagagagaagagaagacaaggaagtcattgagcatcaatgagtttctgaaacctgcggatggaaagagttactacagaccaagaggtggttaccaaggtggaagggaaggacgtggaccaagagaaggaaaccagagggacggtggaagaaacctgagggaaggagggagaaaccagagggacggaggagctgcagcacaggcaccaacaccggccattggggacagtgcacagttccctactttgggtaagtaa

SEQ ID NO: 110 - protein, 360 aa, Arabidopsis thaliana
MASVNPFDLLDDDAEDPSQIVASKPLKVVAPVQTAKSGKMPTKPPPPSQAVREARNAPGGGRGAGRGGSYGRGGRGGNNRDSRNNDGPANENGYGGGYRRSEEGDGARRGGPVGGYRGDRRGSYSNGGDSGDSERPRKNYDRHSRTAYGNEDKRDGAGRANWGTTQDDITPVTEESTAVVDKNLTVEKQDGEGEATDAKNETPAEKAEEKPEDKEMTLEEYEKVLEEKKKALQATKVEERKVDTKAFEAMQQLSSKKSNNDEVFIKLGTEKDKRITEREEKTRKSLSINEFLKPADGKSYYRPRGGYQGGREGRGPREGNQRDGGRNLREGGRNQRDGGAAAQAPTPAIGDSAQFPTLGK

SEQ ID NO: 111 - DNA, 1779 bp, Arabidopsis thaliana
atgttcaggcgaaaaagtcgttctatttctcctaggcgccatcgaagtcgatctgttactcctaagagacgttctccaaccccaaaacgttacaaaagacaaaagagtaggagttcaactccatctcctgcaaaaagatctcccgccgcaacccttgagtcagccaaaaataggaatggagaaaaacttaaaagagaagaggaagaacgaaaaaggcgacagcgtgaagcagaactgaagctaatagaggaagaaactgtgaaacgggttgaagaagctattcgaaagaaggtcgaagaaagcttacagtctgagaaaatcaaaatggaaattctaacgctgttggaggaagggcgaaagagacttaatgaagaagtcgcggctcaacttgaggaggagaaagaggcttctcttattgaggctaaagaaaaagaggaaagagagcaacaagagaaagaagagagggagagaatagcagaggagaacctaaagagagtggaagaagctcagagaaaagaagcaatggagaggcaaaggaaagaggaggaacggtatcgagagctagaggagctgcaacgacagaaagaagaagcgatgcgaaggaagaaagctgaagaggaagaagaacgtctcaaacagatgaaactgttgggtaaaaacaaatcacggcctaaattatcctttgccttaagctccaaaatgacgacgatgtctgatcttgacgaaattatggtagctgagatactttgcaggactccgatgacatgtctgaaaacagtgcgatctgtttgcaaaaagtggaatgctttatccaaaaaatggtttttttttggtaaagcgaagcagtttcttggattcatgatgatggattctagggtttgttccttgagatttgatctccgcaaggacttggtggtcgagccaccatctataaagcaggtaagtatacttgatcaaatagaggtatctaaaatctttcacagcgacggtttattgttatgcataatcaaaaacgacacgacgaggctcttggtctggaatccgtatttggagcaaacgaggtggatccaacccagacacaatttccacatattagactgttatgctatcggacatgacaaaaaccgtaagcacaaaatcttgaggtttgtggatgatttcctccctgtagaaaacgtggttttcgggggaaacacttactttttcgctaaagagagatatatatttgaaggaaagggaccggaagaaatagatataacagagactgaagactttttactctgttttgattttacggctgagagatttggaccgcgtcttcctctgccttttcactcttattacgcagagactgtgactctctcttgtgttaaagaagaccagctctccgtcttgtgccagcgccagccctcggaaccatctgagatcttggagatttgggtttccactaatatccagcccaatgcagtgtcgtggagcatttttttgaaagtggatatgagaccactcactggttttcagtttaacgatatggctgggagtttcttcattgaccaggagaacaaagtcgccgtggtttttgatcttgacccatcccagatttgtcgctaccaaacagcttacatcattggacaagaatatggaggatacttcaactctgttaatatcggagaagttccaaatctctggatacctggcagcgttggatatgctgacaccacgtcttgtatcccgcctgtgtgctcctcttatgttccaagtttagtgcagataggttag

SEQ ID NO: 112 - protein, 592 aa, Arabidopsis thaliana
MFRRKSRSISPRRHRSRSVTPKRRSPTPKRYKRQKSRSSTPSPAKRSPAATLESAKNRNGEKLKREEEERKRRQREAELKLIEEETVKRVEEAIRKKVEESLQSEKIKMEILTLLEEGRKRLNEEVAAQLEEEKEASLIEAKEKEEREQQEKEERERIAEENLKRVEEAQRKEAMERQRKEEERYRELEELQRQKEEAMRRKKAEEEEERLKQMKLLGKNKSRPKLSFALSSKMTTMSDLDEIMVAEILCRTPMTCLKTVRSVCKKWNALSKKWFFFGKAKQFLGFMMMDSRVCSLRFDLRKDLVVEPPSIKQVSILDQIEVSKIFHSDGLLLCIIKNDTTRLLVWNPYLEQTRWIQPRHNFHILDCYAIGHDKNRKHKILRFVDDFLPVENVVFGGNTYFFAKERYIFEGKGPEEIDITETEDFLLCFDFTAERFGPRLPLPFHSYYAETVTLSCVKEDQLSVLCQRQPSEPSEILEIWVSTNIQPNAVSWSIFLKVDMRPLTGFQFNDMAGSFFIDQENKVAVVFDLDPSQICRYQTAYIIGQEYGGYFNSVNIGEVPNLWIPGSVGYADTTSCIPPVCSSYVPSLVQIG

SEQ ID NO: 113 - DNA, 396 bp, Arabidopsis thaliana
atggcgggtcggggaaaacaacttggatctggtgcagcgaagaagtctacttctcgtagtagcaaggctgggcttcaattccctgttggtcgtatcgctcgatttttgaaagccggtaagtacgccgagcgtgttggtgccggagctccggtctatctcgccgccgttcttgaatacctcgccgctgaggtacttgagcttgctgggaacgcagcgagagacaacaagaagacccgtatagttccacgacacattcagcttgctgtgaggaatgatgaggagctaagcaagttgcttggagatgtgacaattgctaatggaggagtgatgcctaacatccacaatctccttctccccaagaaggctggttcatctaagcctactgaagaagattag

SEQ ID NO: 114 - protein, 131 aa, Arabidopsis thaliana
MAGRGKQLGSGAAKKSTSRSSKAGLQFPVGRIARFLKAGKYAERVGAGAPVYLAAVLEYLAAEVLELAGNAARDNKKTRIVPRHIQLAVRNDEELSKLLGDVTIANGGVMPNIHNLLLPKKAGSSKPTEED

SEQ ID NO: 115 - DNA, 1458 bp, Arabidopsis thaliana
atggctatggcgagtttatatcggcgatctcttccttctcctccggccattgacttttcttccgccgaaggcaagctaatcttcaatgaagcgcttcagaaaggaactatggaaggatttttcaggttgatttcgtattttcagacacaatccgaacctgcgtattgtggtttggctagtctctcagtggtgttgaatgctctttctatcgatcctggacgtaaatggaaagggccttggaggtggtttgatgaatcaatgttggattgctgcgaacctctggaagtagtgaaggaaaaaggcatttcatttggaaaagttgtctgtttggctcattgttcaggagcaaaagttgaggctttccgtacaagtcagagcaccattgatgatttccgcaaatttgtcgtcaaatgcacgagttctgagaattgtcatatgatctcaacatatcaccgaggtgtatttaagcagactgggactggtcacttttcacctattggtggctataatgctgagagagatatggctttgattcttgatgttgctcgtttcaagtatccccctcactgggttcctcttaaacttctttgggaagccatggacagtattgatcagtcaacagggaaacgtagagggttcatgctcatatctagaccacacagagaacccggattgctctatactctgagctgcaaggatgaaagctggatcgaaatagccaagtatttgaaggaagatgttcctcgtcttgtaagttcacagcatgtagattctgtggagaaaatcatatcagttgtgttcaagtcacttccatcaaatttcaaccaattcatcagatgggtggctgagatccgaattacagaggactcaaaccaaaatctcagcgcagaggagaagtctaggctgaaactaaagcaattggtgctgaaggaagtgcacgaaactgaactgttcaaacacatcaataagttcttatccacagtgggttatgaagacagtctgacttatgctgctgcaaaggcttgttgccaaggagctgaaatcttatccggaagcccatcaaaagagttttgttgtcgggaaacttgcgtgaaatgcatcaaaggtcctgatgactctgaaggcacggtggtgactggagttgtggtgcgtgatgggaatgaacaaaaggttgatctgttagtgccatcgacgcaaactgagtgtgaatgtggtcctgaagcaacttatccagcaggaaacgatgtgttcactgcacttctattggctttacctccacagacatggtcagggatcaaagaccaagctcttatgcatgaaatgaagcagctcatttccatggcttccctcccaactttgcttcaagaagaggtattgcatcttcgacggcaacttcagctgctaaaacgatgccaagagaacaaggaagaggatgatctcgctgctcctgcctattag

SEQ ID NO: 116 - protein, 485 aa, Arabidopsis thaliana
MAMASLYRRSLPSPPAIDFSSAEGKLIFNEALQKGTMEGFFRLISYFQTQSEPAYCGLASLSVVLNALSIDPGRKWKGPWRWFDESMLDCCEPLEVVKEKGISFGKVVCLAHCSGAKVEAFRTSQSTIDDFRKFVVKCTSSENCHMISTYHRGVFKQTGTGHFSPIGGYNAERDMALILDVARFKYPPHWVPLKLLWEAMDSIDQSTGKRRGFMLISRPHREPGLLYTLSCKDESWIEIAKYLKEDVPRLVSSQHVDSVEKIISVVFKSLPSNFNQFIRWVAEIRITEDSNQNLSAEEKSRLKLKQLVLKEVHETELFKHINKFLSTVGYEDSLTYAAAKACCQGAEILSGSPSKEFCCRETCVKCIKGPDDSEGTVVTGVVVRDGNEQKVDLLVPSTQTECECGPEATYPAGNDVFTALLLALPPQTWSGIKDQALMHEMKQLISMASLPTLLQEEVLHLRRQLQLLKRCQENKEEDDLAAPAY

SEQ ID NO: 117 - DNA, 1029 bp, Arabidopsis thaliana
atgtctgcctctgcttcttccctctctgctttcaatcctaaatcccttcctctctgcgtctccagacccgcttccgtctccgtcttacctccttccctctccttcaaacttcactccgaccacctcgtctctatcttcgcttcctccgccctcaaatgctcatcccccgccgagtacccgtcgcgtttcgttagaaacgttgctgtatcttcggattttgaggtggaggaagatgatatgttcgctgacggtgacgattcagcgcctgtggagcgtaactccttctctcctgaccttaagctctttgttggtaacctttcttttaacgttgatagcgctcagcttgctcagctctttgagagcgctggaaatgttgagatggttgaggttatctatgacaaagtgactggccggagcaggggtttcggatttgtgacaatgtcaaccgcagcggaagttgaagcagcagctcaacagttcaatggctatgaatttgaaggcagacctttgagagtcaatgctggccctcctccacctaaaagagaggaatccttctccagaggaccaagaagtggaggttacggttctgagcgtggtggaggttacggttccgagcgtggtggtggttatggttccgagcgtggtggtggttatggttccgagcgtggtggtggatacggttctcaacgtagtggtggtggttacggagggtctcaacgttccagttatggttcggggtcagggtccggttcgggctcaggttcaggaaaccgtctctacgtgggcaacctttcttggggtgttgatgacatggcacttgagaacttgtttaacgagcaaggaaaggtagttgaagctagggttatctacgacagggacagcggtagatccaagggttttggatttgtgacacttagctcttcccaagaggttcagaaggcgatcaattccttgaatggagcagatttggatggaagacaaataagagtctcagaggctgaggctaggccaccaagaggccaattttga

SEQ ID NO: 118 - protein, 342 aa, Arabidopsis thaliana
MSASASSLSAFNPKSLPLCVSRPASVSVLPPSLSFKLHSDHLVSIFASSALKCSSPAEYPSRFVRNVAVSSDFEVEEDDMFADGDDSAPVERNSFSPDLKLFVGNLSFNVDSAQLAQLFESAGNVEMVEVIYDKVTGRSRGFGFVTMSTAAEVEAAAQQFNGYEFEGRPLRVNAGPPPPKREESFSRGPRSGGYGSERGGGYGSERGGGYGSERGGGYGSERGGGYGSQRSGGGYGGSQRSSYGSGSGSGSGSGSGNRLYVGNLSWGVDDMALENLFNEQGKVVEARVIYDRDSGRSKGFGFVTLSSSQEVQKAINSLNGADLDGRQIRVSEAEARPPRGQF

SEQ ID NO: 119 - DNA, 1467 bp, Arabidopsis thaliana
atggcgatgttaggtgcacagcaagttccagcagcagcttgtactccagatatggttgggaatgcttttgtgccccagtattatcacatattgcatcaatcacctgagcatgttcacagattttaccaagagattagcaagttaggtcgtcctgaagagaatggtttaatgagcatcacttctaccttgcaagctattgacaagaagataatggcgcttggttacggtgtaatcagtgcagagatagctactgtggacacacaagaatctcatggaggtggttatattgtactggtgactgggtatttgacgggaaaagacagtgtcaggaggacgtttagtcagaccttcttccttgctccacaggagacaggatactttgtcttgaatgatatgtttcgattcattgatgaaggcactgtcgtacatggaaatcagattccagtgaacaacgtccaagctcctgtcaacacttaccaggacacagctgctgcgaaggaaattccagatgactttgttcaggagaaatatgtccaagagaatcatgctgttaagcaaaccgaggtgttgtccaagagcattaatgagcctgaaaaagtgttcacgccctctgaagatgaacaagtatcagctgcagaagaagctctggtgactgaaacagttaatgaagcaccaattgaagtgcaaaaggttggagaatctgattctaggactggcgaaattccaaagagatcttatgcatcaattgtgaaggttatgaaagaaaatgctgcaccaatgtctgcttcgagaactccaacaaaggtggaaccaaagaaacaagaagatcaagccattcatatccctctaccaacaccattgtctgagaaatcagattcaggagcaaatgttgctgtaaatgagaacaatcaagagaatgaaagagctctaggtccatccatctatctaaagggtttaccccttgatgcaacacctgccttgcttgagaatgagttccagaaatttggacttattaggaccaatggaattcaagtgagaagccagaagggattctgttttggttttgttgagtttgaatccgcaagttccatgcaaagcgctatcgaggcatcacctgtcatgctcaatggacacaaagttgttgtggaggaaaagcgatctaccgcaagagggaactatagaggacgttcgacgtttggtgtaaacacaggctacagaaacgaaggaggaaggggtcgtgggagctttggaggtggaagaggaggatatggccggaccgatttcaacggatatggtaataacaggggaaacaatagaggcggatacgcaaaccgagcaaatggtgatggtggtgggttcccgagggccaatggtaacaatggacgagtaagacgtggtggcggaaatgatgctaacagagctacgaaacccgtggatgatgctccccgtgtgtctgttgctgcgtaa

SEQ ID NO: 120 - protein, 488 aa, Arabidopsis thaliana
MAMLGAQQVPAAACTPDMVGNAFVPQYYHILHQSPEHVHRFYQEISKLGRPEENGLMSITSTLQAIDKKIMALGYGVISAEIATVDTQESHGGGYIVLVTGYLTGKDSVRRTFSQTFFLAPQETGYFVLNDMFRFIDEGTVVHGNQIPVNNVQAPVNTYQDTAAAKEIPDDFVQEKYVQENHAVKQTEVLSKSINEPEKVFTPSEDEQVSAAEEALVTETVNEAPIEVQKVGESDSRTGEIPKRSYASIVKVMKENAAPMSASRTPTKVEPKKQEDQAIHIPLPTPLSEKSDSGANVAVNENNQENERALGPSIYLKGLPLDATPALLENEFQKFGLIRTNGIQVRSQKGFCFGFVEFESASSMQSAIEASPVMLNGHKVVVEEKRSTARGNYRGRSTFGVNTGYRNEGGRGRGSFGGGRGGYGRTDFNGYGNNRGNNRGGYANRANGDGGGFPRANGNNGRVRRGGGNDANRATKPVDDAPRVSVAA

SEQ ID NO: 121 - DNA, 1173 bp, Arabidopsis thaliana
atggaaaacggaaactcctccagcgacaacaaatcttcacataaaccgatccgatgcaaagcggcggttagtaggaaggctggagagccgttggtgatggaagaaatcatggtggcgccgccgcagcctttcgaggttcggattcgaatcatctgcaccgcgttatgtcacagtgacgtcactttctggaaactccaagttcctccagcctgctttccgaggatactaggccacgaggcaataggcgtagtggaaagtgttggtgaaaatgtgaaggaagtggtagaaggagacaccgtactaccaacgttcatgcctgactgtggtgactgtgttgattgcaaatctcacaaaagcaacttatgtagcaaatttcctttcaaggtatccccttggatgccaagatacgataattccagcagattcaccgacctcaatggcgaaactctctttcatttcttgaacgtctccagcttcagcgaatacacggttcttgatgtcgctaacgttgttaagattgattcttcgattcctcctagtcgtgcttgcctcctaagctgcggagtctccaccggtgttggtgctgcttgggagaccgccaaagttgaaaaaggatcaaccgttgtgattttcggacttggttctatcggattagcggttgcagagggtgcgagactttgtggtgcctctagaatcattggtgtggatataaaccctaccaaattccaagttggccagaaatttggagttaccgagtttgtaaactctatgacatgtgagaaaaaccgtgttagcgaggtgatcaatgagatgactgatgggggagcggactattgcttcgaatgtgttggaagtagttctttggttcaagaagcttatgcttgctgtagacagggatggggaaagacaataactttaggggtggacaagccgggttcacaaatatgtttagattcgtttgatgttcttcaccatgggaagattctgatgggttcgttgtttggaggtttaaaggctaaaacacacattccaattcttcttaaacgctacttgagcaatgaacttgaattggataagtttgtgacacatgagatgaaattcgaggagatcaacgacgcattccagctacttcttgaagggaaatgcatcaggtgtgtcttatggatgggctaa

SEQ ID NO: 122 - protein, 390 aa, Arabidopsis thaliana
MENGNSSSDNKSSHKPIRCKAAVSRKAGEPLVMEEIMVAPPQPFEVRIRIICTALCHSDVTFWKLQVPPACFPRILGHEAIGVVESVGENVKEVVEGDTVLPTFMPDCGDCVDCKSHKSNLCSKFPFKVSPWMPRYDNSSRFTDLNGETLFHFLNVSSFSEYTVLDVANVVKIDSSIPPSRACLLSCGVSTGVGAAWETAKVEKGSTVVIFGLGSIGLAVAEGARLCGASRIIGVDINPTKFQVGQKFGVTEFVNSMTCEKNRVSEVINEMTDGGADYCFECVGSSSLVQEAYACCRQGWGKTITLGVDKPGSQICLDSFDVLHHGKILMGSLFGGLKAKTHIPILLKRYLSNELELDKFVTHEMKFEEINDAFQLLLEGKCIRCVLWMG

SEQ ID NO: 123 - DNA, 702 bp, Arabidopsis thaliana
atgccggcgaaacagaggacagctaaggtcaacaggaatcctgatctgatcaggggagttggtaaatactcaaggtctcagatgtaccataagagaggtttgtgggcaatcaaggccaaaaatggaggcgttttcccccgccacgacgctaaatctaaggttgatgctccggtggagaagccaccgaagttctatccagctgaagacgtgaagaaacctctccccaacaggcgcacggcaaaaccagccaagctcagagctagcatcactccagggacagtgcttatcatccttgctggtagatttaagggcaagagagttgtcttccttaagcagcttgcctccggtttgcttcttgtgactggaccattcaagatcaatggtgttcctctgagacgtgttaaccaggcctatgtcattggtacttccacaaaggttgacatttctggagttaccctcgacaaattcgatgataagtacttcggcaaggttgctgagaagaaaaagaagaagactgaaggagagttcttcgaggctgagaaagaggagaagaaagagattccacagggaaagaaagatgaccagaaagccgtggacgcagctttgatcaaagctattgaagcagttccagagttgaagacttacctcggagcaaggttttcattgaaacaaggaatgaagccccatgagcttgttttctag

SEQ ID NO: 124 - protein, 233 aa, Arabidopsis thaliana [sequence omitted]

SEQ ID NO: 125 - DNA, 1944 bp, Arabidopsis thaliana
atgatggatagtggtaataataatatgaatagagccaagaggaatttggatgggaacgatgatgatcagcctgagcgaaaacgccctgcttttgctagtgtgattgttgaggctctgaaagtagatagtttgcagaagctttgctcctctttggaacctattctccgccgagttgtcagcgaggaactggaacgtgctttagcaaaactaggccctgctaggcttactggaagttcgggctcttctccaaagcgaattgaaggtccggatggtcggaagttacagttgcacttcaaatctaggttatctctcccgttattcactggggggaaagtagaaggagagcaaggtgctgtgattcatgttgtcttgattgatgcaaacactggccgtgctgtggtatatggtccagaggcttcggcaaagcttcacattgttgtgcttgagggtgactttaacactgaagatgatgaagactggacacaagaagaatttgaaagccatgttgtaaaagagcgttcaggaaagagaccgttgctgactggagaagtgtatgttacactcaaggaaggggttggaactttgggcgagctagttttcacggataattcgagttggattcgaagtcggaagttccgacttggtttacgggtggtttctgggtgttgtgatggcatgcgtatccgtgaggccaagacggaagcttttgttgttaaggatcacaggggcgaattgtacaagaagcattatccacctgctctgaatgatgatgtgtggagattggacaagatcggcaaggatggggcattccataaaaagcttactgctgaaggaataaacactgtagaagattttctgagagtaatggtcaaggattctccaaaattacgtactattcttggaagcggcatgtcaaacaaaatgtgggatgcactagtagagcacgcaaagacgtgtgtccagagcagcaagctttatatctactatgctgaggattcaaggaatgtcggtgttgtgttcaataatatctatgagctaagcggccttatttctggagatcaatacttctctgctgattcacttactgatagccaaaaggtatatgttgaggggctggtgaagaaagcatatgaaaactggaacctagtcatagagtatgatggaaaatctcttttagacttgaagcagccccagaggttgagtattactcacactaatctggaaaattactcgactgctgccattgaccatccaatgcagatggtggcagggcattcgtcttcaatgccgcctaaccagtctccagtgctttcagattttgctattggagggtatgatcaaactctggcaacaagatatcattcgcatccccagcttttaaactccaacccgcgagcacaatttgaggttgcttcatgcagtacatcgcaagaccagttcatgggaaatctacatcaaactcaaagcaccataaacaatcaacacatgaatggcctggctctcggtccttcacaatcatccacaagcggataccaaaacatcaacccttcttctgttcaccaggcagatctcaaccatttagaagactggtcaaacccccgtgagagaggaccagatgatttcttctcagaggaagagatccgactcagaagccatgaaatgctagagagtgaagacatgcaacagttcctccgcctattcagcatgggaggaggaggcaatggctctgcaacacacttgccagaagatggatatactttcccatcgtttctacacacgcctatgcaaggttatgatgaagaccgtggtcgatcaggcagagctgttgttggatggcttaagataaaagccgcaatgagatgggggttcttcatcaggaggaaagctgctgagaggcgagcacaaattgtagagcttgatgatgatgatgaagatggcgaatag

SEQ ID NO: 126 - protein, 647 aa, Arabidopsis thaliana
MMDSGNNNMNRAKRNLDGNDDDQPERKRPAFASVIVEALKVDSLQKLCSSLEPILRRVVSEELERALAKLGPARLTGSSGSSPKRIEGPDGRKLQLHFKSRLSLPLFTGGKVEGEQGAVIHVVLIDANTGRAVVYGPEASAKLHIVVLEGDFNTEDDEDWTQEEFESHVVKERSGKRPLLTGEVYVTLKEGVGTLGELVFTDNSSWIRSRKFRLGLRVVSGCCDGMRIREAKTEAFVVKDHRGELYKKHYPPALNDDVWRLDKIGKDGAFHKKLTAEGINTVEDFLRVMVKDSPKLRTILGSGMSNKMWDALVEHAKTCVQSSKLYIYYAEDSRNVGVVFNNIYELSGLISGDQYFSADSLTDSQKVYVEGLVKKAYENWNLVIEYDGKSLLDLKQPQRLSITHTNLENYSTAAIDHPMQMVAGHSSSMPPNQSPVLSDFAIGGYDQTLATRYHSHPQLLNSNPRAQFEVASCSTSQDQFMGNLHQTQSTINNQHMNGLALGPSQSSTSGYQNINPSSVHQADLNHLEDWSNPRERGPDDFFSEEEIRLRSHEMLESEDMQQFLRLFSMGGGGNGSATHLPEDGYTFPSFLHTPMQGYDEDRGRSGRAVVGWLKIKAAMRWGFFIRRKAAERRAQIVELDDDDEDGE

SEQ ID NO: 127 - DNA, 1107 bp, Arabidopsis thaliana
atggaaatttcaggacggcgaatgagaagattcaggatgagattccgaagagatcacctcaccggcggcgagaacattgaaaacgaagcctcgtgttgctattgtgacctcaaaatctcgaatttcaacgaacccatcttccgtttaggacgacgattctccggagttttgaaagtctggttctcaatcggactaggattcggcgtcgcttctctgatcctcgtcaccgtcttccttctccttcagtttcactctaaccctttattctccaatcgtctcacttccgccgtatttggattctctccttccacgcgtgtatcattatcaggcattgcctatgtacttgtctccactgtcattacagtttcagttcatgaacttggtcacgctcttgctgctgctagtgaaggaatacagatggaatacattgccgttttcattgcagctatctttccgggtggtcttgtagcttttgataatgatgtcttgcaatcacttccaagctttaatgctcttcgtatttactgtgccggtatttggcataatgcagtggttggttcctctctttcaagtttttatttctgtgcactctgtgtgttcgctttgtttctcttgcctgttatgttgtcacctttctacaaacacggtgaaagcctcacggttgtggatgtgccttctgtgtcgccattgtttggttacttgtctcctggagatgttattgtgtcgttggatggcatacaagtccacaaacctagtgaatggcttgaattggcagcaattttggataaggaaaatagtaaaacatcgaatggttccttgtaccttggaggttcaaggagatttcatcacgggaagggttactgtgtccctatctctctgattgaagaagggtacaaagggaaaatggttgagaaccaatttgtttgtcccggtgatctcactgcatttcgaacaatgccatgctcaaatgcagccataagagaggtatctgtttgtttggatgcaaaggatatcgtcaagcttcaaaaatgtggtgatggatgggtgacaacatcagacaccgataaccaaagtgactgcgtatgtccacaggtgaatattgcttga

SEQ ID NO: 128 - protein, 368 aa, Arabidopsis thaliana
MEISGRRMRRFRMRFRRDHLTGGENIENEASCCYCDLKISNFNEPIFRLGRRFSGVLKVWFSIGLGFGVASLILVTVFLLLQFHSNPLFSNRLTSAVFGFSPSTRVSLSGIAYVLVSTVITVSVHELGHALAAASEGIQMEYIAVFIAAIFPGGLVAFDNDVLQSLPSFNALRIYCAGIWHNAVVGSSLSSFYFCALCVFALFLLPVMLSPFYKHGESLTVVDVPSVSPLFGYLSPGDVIVSLDGIQVHKPSEWLELAAILDKENSKTSNGSLYLGGSRRFHHGKGYCVPISLIEEGYKGKMVENQFVCPGDLTAFRTMPCSNAAIREVSVCLDAKDIVKLQKCGDGWVTTSDTDNQSDCVCPQVNIA

SEQ ID NO: 129 - DNA, 2802 bp, Arabidopsis thaliana
atgaagcatattttcaagaagctacacagaggtgggaatcaagagcagcagaatcgaaccaacgatgcagctcctccatcggatcaaaatcggattcacgtttctgctaatcctcctcaagcaaccccttcgtcagtcactgagacgcttccggtggccggagctacttcttctatggcctctcctgctccaaccgctgcttcgaaccgtgcggattacatgtcttctgaggaggagtatcaagtgcagttagccctagcgatcagtgcttcgaattcgcagtccagtgaggatccggagaagcatcagatccgagcggcgacgcttctgagcttaggaagccatcaacggatggattcaaggagggattcatcggaggtggtagcccagaggttatcgagacagtactgggaatatggcgtgcttgactatgaggagaaagttgtcgatagtttctacgacgtatacagtctatccacagactccgcaaagcagggagaaatgccatcgctggaagatcttgaaagcaatcatggcacacctggctttgaagctgtagttgtaaatcgacctattgattcttccctgcatgagttgctagaaatcgcagagtgtattgcactgggttgttctactaccagtgttagtgtgttggtacagaggctggctgagcttgtcaccgagcatatgggtggatctgcggaagattccagtatagtattggcaaggtggactgaaaaaagcagcgagttcaaggcagcattgaatacttgcgtattccctattggatttgtaaagattggtatctcaaggcatcgtgctctgcttttcaaggttttggcagatagtgtcaggttaccttgtaggttggtaaaaggtagccactacacaggcaatgaggatgatgctgtgaacacgataagactggaagatgaaagagagtacttggttgatcttatgacagatcctgggacgcttatacccgctgattttgcaagtgctagtaataacaccgttgagccatgtaactcaaatggaaacaaatttcctacagctcagttttcaaatgacgtgccaaagctctcagaaggtgaaggaagtagtcacagttctatggccaactatagttcttctttggatagaaggacagaggctgaaaggacagattcttcatacccaaaggtgggaccacttcggaacatagactatagttctccttctagcgtaactagttctactcagttggagaacaattcctcaacagcaattggaaaggggagtcgaggagccataattgaatgttcaagaacaaacatgaatatagttccttacaatcagaacagtgaggaagacccaaaaaaccttttcgcagaccttaatccatttcaaaataagggagctgacaagctgtatatgcccactaaatcaggtttgaataacgttgatgattttcatcaacagaaaaataatcctctggttggtagatcacctgcgccaatgatgtggaagaattacagttgcaatgaagccccaaagagaaaggagaatagttatatagaaaatcttctcccgaaactccaccgtgatcctcgttatggaaacactcaatcctcatatgctacctcaagctccaatggagctatttcctcaaatgtgcatggcagagacaatgtgacatttgtgtcaccggttgctgtaccatcatccttcacatccactgaaaatcagtttagaccaagtatagtggaggatatgaacagaaacaccaacaatgaactagatcttcagcctcatactgctgctgtggtacatggacaacagaatgatgaatctcacatccatgatcacagaaagtacacaagtgatgacatatccactggctgtgatccgaggcttaaggatcacgaaagtacaagttcatctcttgattctacatcctaccggaatgatcctcaagttcttgatgatgcagatgttggtgaatgtgaaattccttggaatgatctcgttattgcggagagaataggattagggtcctatggagaggtctatcatgctgactggcatggcacggaagttgctgtcaagaaatttttggaccaggacttctcaggtgctgctttagccgagttcagaagcgaagtacggattatgcgaagattgcgtcatccaaatgttgtattcttccttggggctgttactcgtcctccaaatctttccatcgtcacagagtttctgcctagaggaagcttgtatcgaatccttcatcggcccaaatctcacattgacgagcggcgccggattaaaatggcccttgacgtggcaatggggatgaactgcttacacaccagtacaccgacaattgttcatcgtgatctcaaaacaccaaaccttttggttgataacaactggaatgttaaggtcggtgattttgggttgtctcgcttaaagcacaatacttttttatcctccaaatcaactgctggaacgcctgaatggatggctccagaagttctacgcaatgagccctcaaatgaaaagtgtgatgtgtacagtttcggggtaatactttgggaactagcaacattgagattaccatggagaggaatgaacccaatgcaagtagttggagcagttgggttccagaatcggcggcttgagatccccaaggaacttgatcctgtggtgggaaggatcatcctggaatgttggcaaacggatccgaatctgcggccgtcatttgctcagctgacggaagtgctgaagcctttgaaccggcttgtacttcctacaccacaatag

SEQ ID NO: 130 - protein, 933 aa, Arabidopsis thaliana
MKHIFKKLHRGGNQEQQNRTNDAAPPSDQNRIHVSANPPQATPSSVTETLPVAGATSSMASPAPTAASNRADYMSSEEEYQVQLALAISASNSQSSEDPEKHQIRAATLLSLGSHQRMDSRRDSSEVVAQRLSRQYWEYGVLDYEEKVVDSFYDVYSLSTDSAKQGEMPSLEDLESNHGTPGFEAVVVNRPIDSSLHELLEIAECIALGCSTTSVSVLVQRLAELVTEHMGGSAEDSSIVLARWTEKSSEFKAALNTCVFPIGFVKIGISRHRALLFKVLADSVRLPCRLVKGSHYTGNEDDAVNTIRLEDEREYLVDLMTDPGTLIPADFASASNNTVEPCNSNGNKFPTAQFSNDVPKLSEGEGSSHSSMANYSSSLDRRTEAERTDSSYPKVGPLRNIDYSSPSSVTSSTQLENNSSTAIGKGSRGAIIECSRTNMNIVPYNQNSEEDPKNLFADLNPFQNKGADKLYMPTKSGLNNVDDFHQQKNNPLVGRSPAPMMWKNYSCNEAPKRKENSYIENLLPKLHRDPRYGNTQSSYATSSSNGAISSNVHGRDNVTFVSPVAVPSSFTSTENQFRPSIVEDMNRNTNNELDLQPHTAAVVHGQQNDESHIHDHRKYTSDDISTGCDPRLKDHESTSSSLDSTSYRNDPQVLDDADVGECEIPWNDLVIAERIGLGSYGEVYHADWHGTEVAVKKFLDQDFSGAALAEFRSEVRIMRRLRHPNVVFFLGAVTRPPNLSIVTEFLPRGSLYRILHRPKSHIDERRRIKMALDVAMGMNCLHTSTPTIVHRDLKTPNLLVDNNWNVKVGDFGLSRLKHNTFLSSKSTAGTPEWMAPEVLRNEPSNEKCDVYSFGVILWELATLRLPWRGMNPMQVVGAVGFQNRRLEIPKELDPVVGRIILECWQTDPNLRPSFAQLTEVLKPLNRLVLPTPQ

SEQ ID NO: 131 - DNA, 1716 bp, Arabidopsis thaliana
atgcaaatggaggctaatgactgtcaagaggaacataagttcactctcgacaactatcatgtcgtggagcaggttagaagaggcaagtcctcttccgatttcgtggttcttcatgatattgaagacaaaaagtatgcaatgaagaagatttgcctagcgaaacacacggacaagttaaagcaaaccgctttacaagagatgaaattgctctcaagcttaaagaatccttatatcgtgcattatgaagattcttggattgacaatgacaataatgcctgcatttttactgcttactatgagggagggaacatggctaatgctattaagaaagcgagaggaaaattattcccggaggaaagaatctttaaatggttggcacaattgttactggctgttaactatttgcactcaaaccgtgtagttcacatggatctaacgtgttcaaatattttcctgccgaaagatgatcacgtccagcttggtaattatggtctggcgaaacttataaatccagaaaagcctgtttccatggtttcgggtatctctaacagcatgtgccctgaggtattagaagatcaaccatatggatataaatctgacatatggtcgctgggttgttgtatgtatgaaattacagcacaccagcctgcgtttaaagctccggatatggctggactcatcaataaaataaacagatcccttatgtctcctcttccgatcgtctactcctctaccttgaaacaaatgataaagcttatgcttaggaagaaaccagaatatcggccaacagcctgcgaattgttaagaaacccatctctacaaccataccttcttcaatgccaaaacctgtcgcctatttatcttccggttttcccgataaagccggtaaatagtccgaaggataaagcaagaagaaactcattgccaggaaagtttggaaaggaaagagtttcaagagagaagagcgaggtgtcccgcagtttggaaaatctatatccattttggacgaatacagagactggatctagcagctcatcgcaaccggcatcatctacgaatggcgcagaagacaaacttgaaacaaaaagaatcgatccaagctgtgacacattgaagatttctgagtttacaagccagaagtcggatgagagcttaattgatcctgatattgcagtttactctacagaaacgccagccgaagaaaatgctctgccaaaagaaactgaaaatatattctctgaggaatctcagttacgtgatgttgatgttggggttgtgagtgcacaagaagtagcatgttcccctccaagagccatcgaagaagctgaaactcaggaggcattacctaaaccaaaggaacagataacagtgcccatttctagtgttgcacattcatctactgaagttgcagcagcaaaagaccatttgtctggaagccttgagggcgataaagcaaagatggtgaaactaacagcgagtgaaatgtcatcggtactaagtaagctcacaaaattgggtccgccgcagagtaaagaaagggcagatgcattagagtgtttattggagaaatgtgcagggcttgtaaagcaagagaaatatgaagaacttgctggtttgcttacaccatttggggaagatggtgtctcggctagggacactgcaatttggttcgcaaagacactcttgtcgtctgacaaactcaaccaaggaacctga

SEQ ID NO: 132 - protein, 571 aa, Arabidopsis thaliana
MQMEANDCQEEHKFTLDNYHVVEQVRRGKSSSDFVVLHDIEDKKYAMKKICLAKHTDKLKQTALQEMKLLSSLKNPYIVHYEDSWIDNDNNACIFTAYYEGGNMANAIKKARGKLFPEERIFKWLAQLLLAVNYLHSNRVVHMDLTCSNIFLPKDDHVQLGNYGLAKLINPEKPVSMVSGISNSMCPEVLEDQPYGYKSDIWSLGCCMYEITAHQPAFKAPDMAGLINKINRSLMSPLPIVYSSTLKQMIKLMLRKKPEYRPTACELLRNPSLQPYLLQCQNLSPIYLPVFPIKPVNSPKDKARRNSLPGKFGKERVSREKSEVSRSLENLYPFWTNTETGSSSSSQPASSTNGAEDKLETKRIDPSCDTLKISEFTSQKSDESLIDPDIAVYSTETPAEENALPKETENIFSEESQLRDVDVGVVSAQEVACSPPRAIEEAETQEALPKPKEQITVPISSVAHSSTEVAAAKDHLSGSLEGDKAKMVKLTASEMSSVLSKLTKLGPPQSKERADALECLLEKCAGLVKQEKYEELAGLLTPFGEDGVSARDTAIWFAKTLLSSDKLNQGT

SEQ ID NO: 133 - DNA, 1908 bp, Arabidopsis thaliana
atgggaaacggaaactcaacggagacgaaagagtcgcgccgatcaaagatgcgtaagaagattcaaaactttcgcagccgccgccgtcttagtcgtccaggatccggaagcgtctctggattggctagtcagagatctgtgagcgcagatgatttcgccggcattgctcttctcactcttatcggcgcggagatgaagttcaaggacaagtggctcgcctgtgtttccttcggggaacaaactttccgttcggaaatttcagattccacagagaagccgatttggaactcggaaaagaagcttctcctggagaaaaatggaccaagtctggctagaatctctgtatttgagaccaatagactcttgaagaacaatatcgttggttattgtgagcttgatctacttgatttcgtagtacaggaacctgactctacttgcaagtcatttgacctgttagacccggcctcatctaacgttgttggcagcatgtttgtttcatgctccgttgaggatcctgttgaaaccgagacatgtttcgcgaagcgtattttgtccatagtggattatgacgaagatggaaaactctcattctcagagttctctgatctgatgaatgcttttgggaatgtagtggctgctaacaagaaagaggagttgttcaaagccgctgacctgaatggggatggtgttgttacaattgatgagttggctgcacttcttgccgttcaacaggaacaggagccaattataaatagttgtccggtttgcggtgaggctcttcaacttgacaagctcaatgcaatgatccatatgactctctgttttgacgaaggaactggtaatcaaatgaccggagggttcttgactgataggcaggcttcatatggatggatgttcaaactaagtgaatggactcatctatcaacttatgatgttggtttgaatactggttcaagtgcttcacatattgtggtgattgataggaagactaagaggctcgtggaagagttgattgattcaaagattgttatgtctatgagagctatttaccagtcaaaaataggactccggcttatggaccaaggagcaaaagagattttgcagaacctttctgagaaacaggggaaaaaaatgaactcagttgaatctgcccaaaatattcccagctttctcgagtttttcaaggatcaaataaacatggccgaagtcaagtatcctctggaccattttaagacgttcaatgaattcttcgtacgggagttaaagcctggtgcaagaccaattgcgtgcatggatcaggatgatgttgctgtatctgctgctgattgtcgattaatggcatttcaatcggttgatgatagcacacggttctggatcaagggccgtaagttttcaatcaaaggcctccttggaaatgatgtgcagtcggatgctttccttgatggatctttggtgatattccgattggcgccacaggactatcatcgttttcattctcctgtctctggtgtcattgaaaagtttgtcaatgtttctggaagcttatatacggttaatccgattgctgtcaatagcaagtactgtaatgtgttcactgagaataaacggaccatcgtaattatatcaacagcagagtttggaaaggtcgcatttgttgcgattggagcaacaatggttggtagtatcagctttgttaggcaagagggagaccatgtgaagaaaggggacgagcttggttacttttcatttggtggaagcacagttatatgcgtctttgaaaaggactcgattaagattgatgaggatctcttagctaacagtgctaggtccttggagacattagttactgttggaatgcaacttggtgtctcctttccaaagctggaaaactgtgtacttgagccctga

SEQ ID NO: 134 - protein, 635 aa, Arabidopsis thaliana
MGNGNSTETKESRRSKMRKKIQNFRSRRRLSRPGSGSVSGLASQRSVSADDFAGIALLTLIGAEMKFKDKWLACVSFGEQTFRSEISDSTEKPIWNSEKKLLLEKNGPSLARISVFETNRLLKNNIVGYCELDLLDFVVQEPDSTCKSFDLLDPASSNVVGSMFVSCSVEDPVETETCFAKRILSIVDYDEDGKLSFSEFSDLMNAFGNVVAANKKEELFKAADLNGDGVVTIDELAALLAVQQEQEPIINSCPVCGEALQLDKLNAMIHMTLCFDEGTGNQMTGGFLTDRQASYGWMFKLSEWTHLSTYDVGLNTGSSASHIVVIDRKTKRLVEELIDSKIVMSMRAIYQSKIGLRLMDQGAKEILQNLSEKQGKKMNSVESAQNIPSFLEFFKDQINMAEVKYPLDHFKTFNEFFVRELKPGARPIACMDQDDVAVSAADCRLMAFQSVDDSTRFWIKGRKFSIKGLLGNDVQSDAFLDGSLVIFRLAPQDYHRFHSPVSGVIEKFVNVSGSLYTVNPIAVNSKYCNVFTENKRTIVIISTAEFGKVAFVAIGATMVGSISFVRQEGDHVKKGDELGYFSFGGSTVICVFEKDSIKIDEDLLANSARSLETLVTVGMQLGVSFPKLENCVLEP

SEQ ID NO: 135 - DNA, 1035 bp, Arabidopsis thaliana
atgaagaattgtgagagatttgctaatctcgctctcgcaggtttgacattggcaccactcgttgtgagagtaaatccaaatttgaatgttattctcacagcatgtatcactgtttatgtgggttgctttcgttcggtcaaggatactcctccaacggagacgatgtcaaaagaacatgccatgcgtttcccattggttgggagtgctatgcttctctcacttttcttattgttcaagtttctctcaaaggacttggttaatgctgtgctaacagcttacttctttgttcttgggattgtcgctctttcagcgacattgttaccagccatcagaagatttttaccaaatccttggaatgacaatcttatcgtctggcgttttccttatttcaagtctttggaggtagagttcacaaagtcccaagttgttgcgggaatccctggaacattcttctgtgcgtggtatgcgtggaaaaaacattggctggctaacaatatcctcggcctttccttctgcattcagggaattgagatgctctctctcggatcattcaagactggtgccatccttttggcaggactatttttctatgatatcttctgggttttctttactccagttatggttagtgttgccaaatccttcgatgctccaattaagctcttattccctacgggtgatgctctaagaccctattctatgcttggtcttggtgacattgtcattccgggtattttcgttgcactagctctaagatttgatgtgtcaagacgtagacaaccacaatacttcacaagtgcatttatcggatacgctgttggtgtgatcctcacgattgtagtcatgaactggtttcaagcagcacagcctgctttgttatacattgtcccagccgtaattgggttcttggcttctcactgcatttggaacggtgacatcaaaccgttgttggcgtttgatgaatcaaagacagaggaagcaacgactgatgaatcaaagactagtgaggaggttaataaagctcatgatgaatga

SEQ ID NO: 136 - protein, 344 aa, Arabidopsis thaliana
MKNCERFANLALAGLTLAPLVVRVNPNLNVILTACITVYVGCFRSVKDTPPTETMSKEHAMRFPLVGSAMLLSLFLLFKFLSKDLVNAVLTAYFFVLGIVALSATLLPAIRRFLPNPWNDNLIVWRFPYFKSLEVEFTKSQVVAGIPGTFFCAWYAWKKHWLANNILGLSFCIQGIEMLSLGSFKTGAILLAGLFFYDIFWVFFTPVMVSVAKSFDAPIKLLFPTGDALRPYSMLGLGDIVIPGIFVALALRFDVSRRRQPQYFTSAFIGYAVGVILTIVVMNWFQAAQPALLYIVPAVIGFLASHCIWNGDIKPLLAFDESKTEEATTDESKTSEEVNKAHDE

SEQ ID NO: 137 - DNA, 456 bp, Arabidopsis thaliana
atggaagctcaacttcatgccaagcctcatgctcaaggagaatggtccacaggcttctgtgattgcttctctgactgccgaaactgttgtatcacattatgttgtccatgtatcacatttggccaagtcgctgagattgtagatcgaggatccaaatcgtgttgtgcggctggagcattatacatgttgatagacttaataacaagttgtgggcgtatgtacgcgtgtttctatagtggaaagatgagagctcaatacaatattaaaggagatggttgtactgattgccttaaacatttttgctgtaacctctgtgctttgacccaacaataccgtgaactcaagcaccgcggtttcgatatgagccttggatgggcagggaacgcagagaaacaacaaaatcaaggtggagtggcgatgggtgctccagccttccaaggcggcatgacccgctaa

SEQ ID NO: 138 - protein, 151 aa, Arabidopsis thaliana
MEAQLHAKPHAQGEWSTGFCDCFSDCRNCCITLCCPCITFGQVAEIVDRGSKSCCAAGALYMLIDLITSCGRMYACFYSGKMRAQYNIKGDGCTDCLKHFCCNLCALTQQYRELKHRGFDMSLGWAGNAEKQQNQGGVAMGAPAFQGGMTR

SEQ ID NO: 139 - DNA, 411 bp, Arabidopsis thaliana
atggcaggcaaaggtggaaaaggactcgtagctgcgaagacgatggctgctaacaaggacaaagacaaggacaagaagaaacccatctctcgctctgctcgtgctggtattcagtttccagttggacgaattcacaggcaactgaagacccgagtctcggcacatggcagagttggtgccactgcagccgtctacacagcttcaatcctggagtatctgacagcagaggttcttgagttggctgggaatgcgagcaaggatctcaaagtgaagaggataacgccaaggcatctgcagttggcgattagaggagatgaggagctggacacactcatcaagggaacgattgctggaggtggtgtgatccctcacatccacaagtctctcatcaacaaaaccaccaaggagtga

SEQ ID NO: 140 - protein, 136 aa, Arabidopsis thaliana
MAGKGGKGLVAAKTMAANKDKDKDKKKPISRSARAGIQFPVGRIHRQLKTRVSAHGRVGATAAVYTASILEYLTAEVLELAGNASKDLKVKRITPRHLQLAIRGDEELDTLIKGTIAGGGVIPHIHKSLINKTTKE

SEQ ID NO: 141 - DNA, 1701 bp, Arabidopsis thaliana
atggcggcgacacatcttcacataccgccaaatcctaaaacccaaacgtctcaccaaaaccctcccttttggttctcttctaaaacaggaatctacaccagcaaattcccttccctacacctccccgtcgacccaaatctcgacgccgtctccgctcttttctcacacaaacaccacggcgatacagcgctcatcgattccttaaccgggttctcaatatctcacactgagctacagattatggttcaatcaatggcggctgggatctatcacgttttaggtgttcgtcaaggtgacgttgtatcactcgtcttgcctaattccgtctattttccgatgattttcctctctttgatctcgcttggtgctattgttactaccatgaatccttcgagtagtttaggagagattaagaagcaagttagtgagtgtagtgttggattagcttttacttctactgaaaacgttgagaagctgagttctttgggggttagtgtgattagtgtatctgaaagttacgattttgattcgattcgtatcgaaaacccgaagttttactccattatgaaagaaagttttgggtttgtaccaaaaccgttgattaagcaagacgatgtagctgcaattatgtattcatctggaacaactggagctagtaaaggagttttgttaactcataggaatttgatagcatcaatggagctttttgtgaggtttgaagcttctcagtacgaatatccgggatcgagtaatgtttatctagcagctttgcctttgtgccatatctacgggttatcactctttgtgatgggattgttgtctctgggatcaactattgttgttatgaagaggtttgatgcttctgatgttgttaatgtaattgaaaggtttaagatcactcatttcccggttgttccacctatgttgatggcattgacaaagaaggcaaaaggagtttgtggtgaagtgtttaaaagtttgaagcaagtttcttctggagcagctcctttgagtaggaagttcattgaagatttccttcagactcttcctcatgtcgatttgattcagggatatggaatgactgaatcaactgcagttggaacacggggcttcaactcggaaaagcttagtaggtattcttctgtgggactactggctcctaatatgcaagccaaggtagtagattggagctctggttctttccttccaccaggaaaccgaggagagctctggatacaaggtcccggtgtcatgaaaggatacttgaataacccaaaagcaactcagatgagtatagttgaagatagttggctacgtactggggatattgcttattttgatgaagatggttacttgtttattgttgaccgtattaaggagattataaagtacaaaggctttcagatcgctccagcagatttggaggctgttcttgtttcacatcccttgattatcgacgctgcagtaacagctgccccaaatgaagaatgtggagagattccggtagcattcgttgtccggagacaagaaacaacactttcagaagaagatgtaataagctatgtagcttctcaggttgcaccctacaggaaggtgaggaaagtggtgatggtcaactctataccaaaatctccaactgggaagatattgagaaaggaactaaagagaattcttacaaactctgtttcttcaagactatga

SEQ ID NO: 142 - protein, 566 aa, Arabidopsis thaliana
MAATHLHIPPNPKTQTSHQNPPFWFSSKTGIYTSKFPSLHLPVDPNLDAVSALFSHKHHGDTALIDSLTGFSISHTELQIMVQSMAAGIYHVLGVRQGDVVSLVLPNSVYFPMIFLSLISLGAIVTTMNPSSSLGEIKKQVSECSVGLAFTSTENVEKLSSLGVSVISVSESYDFDSIRIENPKFYSIMKESFGFVPKPLIKQDDVAAIMYSSGTTGASKGVLLTHRNLIASMELFVRFEASQYEYPGSSNVYLAALPLCHIYGLSLFVMGLLSLGSTIVVMKRFDASDVVNVIERFKITHFPVVPPMLMALTKKAKGVCGEVFKSLKQVSSGAAPLSRKFIEDFLQTLPHVDLIQGYGMTESTAVGTRGFNSEKLSRYSSVGLLAPNMQAKVVDWSSGSFLPPGNRGELWIQGPGVMKGYLNNPKATQMSIVEDSWLRTGDIAYFDEDGYLFIVDRIKEIIKYKGFQIAPADLEAVLVSHPLIIDAAVTAAPNEECGEIPVAFVVRRQETTLSEEDVISYVASQVAPYRKVRKVVMVNSIPKSPTGKILRKELKRILTNSVSSRL

SEQ ID NO: 143 - DNA, 1710 bp, Arabidopsis thaliana
atgaagacgacggcgacgtcgtttgtaacgggagagagagttgtagttttcgtcgtggtttctcgtattctcttatctcttcctttatcacttatctcccatggcttctccctcttcctcctctctctctccgccttcctcgtcgagatccgcgtcgagacttctccgtttcttctctctcatttcagctccagacgcggtgcgtcttcagggatattactaggagctgtgacacttccttctgttatgatatctaagttagttcagctttcaagagctatttcaatccatgaagctgaacaagatgagcttgcacatgtgacaatgcagtattgggcagcatcggctagttgttgtgctatacttatatatctatcagtgattatgtcacaagtgagaaaagatgaatctttgtcgtcatcgtctatttggcttacgagagttagcttgactgggacagtgttgtatggagtagcatgttttgtttcactttccatgatttcacacactggcttgaatacgtcattgaaaatgttgtggatgttatttcatggacttgcagctgtgaagttgattcgacatttgctttgcactttcccatcgtgtgcttcgataggggaagcacttcttgtgaccagtggtcttgttctctattttggcgactttttggcatgcacaattgcaaagatttttgagaaattgatacctgtggatcttgtctcaataagctatggaataaagagaacggaaaccggcataatcgttcagggtctactgttgggccttctacttttcccgatggtgtttagatttgttctgcatatatatgaaagctctttgagaaagagagatgctcgacaaagaaactgcagtgatgctgcaaaatctgtcttattctttgtttcacttctattttttatggtcgtggctgttccttcttggatgcagtttgtacacgatttcaaccagcatcccttcttatgggtgctcacatttgtcttttctgaacctctgaagagactttcattatgtatctactggattctgttgatcgttgtgtctgtctcacgattttataacatctcgaggagtagcaaggttgagagaatcttgcttcggaagtactaccatctgatggctgttttaatgttcttgccagctcttgtcttacagcctaaatttctcgatctagcatttggtgcagcattggcagtatttgttgcattggagatcattcgaatatggagaattcagcctcttggagagcctttacatcaattcatgaatgctttcactgaccatcgtgactcagagcatctgattgtcagccacttctcactcttgcttgggtgtgcgcttccgatttggatgtcatctgggttcaatgaccgagccttatctccatttgctggaattctcagcctaggaattggagatacaatggcatcgatggttggtcacaaatatggggtgttgagatggagcaagacaggaaagaaaacggttgaaggaacagcagcgggaataacatcgatgatggcagtgtgctttgttctggtcccaatattagcatcaatgggttatatactaagtcaaggatggtggtcgcttctggtggctgtgacagccaccgggatgttggaagcttacacggcgcagttagacaatgcctttatacctcttgtcttctactcactcctctgcttgtaa

SEQ ID NO: 144 - protein, 569 aa, Arabidopsis thaliana
MKTTATSFVTGERVVVFVVVSRILLSLPLSLISHGFSLFLLSLSAFLVEIRVETSPFLLSHFSSRRGASSGILLGAVTLPSVMISKLVQLSRAISIHEAEQDELAHVTMQYWAASASCCAILIYLSVIMSQVRKDESLSSSSIWLTRVSLTGTVLYGVACFVSLSMISHTGLNTSLKMLWMLFHGLAAVKLIRHLLCTFPSCASIGEALLVTSGLVLYFGDFLACTIAKIFEKLIPVDLVSISYGIKRTETGIIVQGLLLGLLLFPMVFRFVLHIYESSLRKRDARQRNCSDAAKSVLFFVSLLFFMVVAVPSWMQFVHDFNQHPFLWVLTFVFSEPLKRLSLCIYWILLIVVSVSRFYNISRSSKVERILLRKYYHLMAVLMFLPALVLQPKFLDLAFGAALAVFVALEIIRIWRIQPLGEPLHQFMNAFTDHRDSEHLIVSHFSLLLGCALPIWMSSGFNDRALSPFAGILSLGIGDTMASMVGHKYGVLRWSKTGKKTVEGTAAGITSMMAVCFVLVPILASMGYILSQGWWSLLVAVTATGMLEAYTAQLDNAFIPLVFYSLLCL

SEQ ID NO: 145 - DNA, 1458 bp, Arabidopsis thaliana
atggagaaaaaacaaggctttttctctgctctcagacacgaagttgtgagaggtctttcgccgtcacgatccagagcaaggtctcgttccgttagtcccgctaggtctagttcacccatgtcagctctcacttggggaagaaagaacttaactggaggaggcggtggtggtggtggcggaggttactatttagcgcaaccagagcagttaattgggagatccggaagtttgagacctgtaatggaaggtcctgatccagatgaaggaggaggaggtggtaatataggagaatctaaacgactcgggtcgggtttaggtcactgggttaaagggcagctgtctcgtgctccgtctgttgctgcgacggcggcttatcggagaaatgatctgagacttcttcttggtgtaatgggagctcctcttgctcctattcatgtctcttcctctgatcctttgcctcatcttagtatcaaaaacactccaatcgaaacatcatctgctcagtatattcttcaacagtacactgcagcttctggtggtcagaagctacaaaactccattaaaaacgcttatgcgatggggaagctcaagatgattacttcagagcttgaaactgctacaagaaccgttaggaatcgaaacccatctaaggctgagactggaggttttgttctttggcagatgaatccagacatgtggtatgttgagcttgctgttgggggtagtaaggttcgtgctggctgcaatggcaagcttgtatggagacacactccttggctcggatctcatactgctaaaggacctgtcagacctctccgccgtggacttcagggactagatccgagaacaactgctgcaatgtttgcggaagcgaagtgtataggagagaagaaggtgaatggtgaagattgcttcattttgaagttatgcactgaccctgaaacactaaaagcgaggagcgaaggaccggctgagatcattaggcatgtcctctttggctacttcagtcagaaaacagggctcttggttcacattgaggattcacatttgacccggattcaatctaacggtggagagactgttttctgggagaccacatacaactcgtccctagacgattaccgtcaggtcgaaggaatcatgattgctcactcgggacattcagttgtgacactattcagatttggggaagtggcgacgagccatacgaggacaaagatggaagaaagctggacgattgaggaagttgcgtttaacgttcctggtctgtctctcgattgctttataccaccagctgatcttaagaccggttctttaaccgaatcctgcgagtacccacaagaggaaagaggcaagaacaacacactcgcattgtctgcagctcacagggccaaagttgcagccttggagaacgggagcttggaagatcaccgcccggtttggcatactgatgtctaa

SEQ ID NO: 146 - protein, 485 aa, Arabidopsis thaliana
MEKKQGFFSALRHEVVRGLSPSRSRARSRSVSPARSSSPMSALTWGRKNLTGGGGGGGGGGYYLAQPEQLIGRSGSLRPVMEGPDPDEGGGGGNIGESKRLGSGLGHWVKGQLSRAPSVAATAAYRRNDLRLLLGVMGAPLAPIHVSSSDPLPHLSIKNTPIETSSAQYILQQYTAASGGQKLQNSIKNAYAMGKLKMITSELETATRTVRNRNPSKAETGGFVLWQMNPDMWYVELAVGGSKVRAGCNGKLVWRHTPWLGSHTAKGPVRPLRRGLQGLDPRTTAAMFAEAKCIGEKKVNGEDCFILKLCTDPETLKARSEGPAEIIRHVLFGYFSQKTGLLVHIEDSHLTRIQSNGGETVFWETTYNSSLDDYRQVEGIMIAHSGHSVVTLFRFGEVATSHTRTKMEESWTIEEVAFNVPGLSLDCFIPPADLKTGSLTESCEYPQEERGKNNTLALSAAHRAKVAALENGSLEDHRPVWHTDV

SEQ ID NO: 147 - DNA, 807 bp, Arabidopsis thaliana
atgcattatcctaacaacagaaccgaattcgtcggagctccagccccaacccggtatcaaaaggagcagttgtcaccggagcaagagctttcagttattgtctctgctttgcaacacgtgatctcaggggaaaacgaaacggcgccgtgtcagggtttttccagtgacagcacagtgataagcgcgggaatgcctcggttggattcagacacttgtcaagtctgtaggatcgaaggatgtctcggctgtaactactttttcgcgccaaatcagagaattgaaaagaatcatcaacaagaagaagagattactagtagtagtaacagaagaagagagagctctcccgtggcgaagaaagcggaaggtggcgggaaaatcaggaagaggaagaacaagaagaatggttacagaggagttaggcaaagaccttggggaaaatttgcagctgagatcagagatcctaaaagagccacacgtgtttggcttggtactttcgaaaccgccgaagatgcggctcgagcttatgatcgagccgcgattggattccgtgggccaagggctaaactcaacttcccctttgtggattacacgtcttcagtttcatctcctgttgctgctgatgatataggagcaaaggcaagtgcaagcgccagtgtgagcgccacagattcagttgaagcagagcaatggaacggaggaggaggggattgcaatatggaggagtggatgaatatgatgatgatgatggattttgggaatggagattcttcagattcaggaaatacaattgctgatatgttccagtga

SEQ ID NO: 148 - protein, 268 aa, Arabidopsis thaliana
MHYPNNRTEFVGAPAPTRYQKEQLSPEQELSVIVSALQHVISGENETAPCQGFSSDSTVISAGMPRLDSDTCQVCRIEGCLGCNYFFAPNQRIEKNHQQEEEITSSSNRRRESSPVAKKAEGGGKIRKRKNKKNGYRGVRQRPWGKFAAEIRDPKRATRVWLGTFETAEDAARAYDRAAIGFRGPRAKLNFPFVDYTSSVSSPVAADDIGAKASASASVSATDSVEAEQWNGGGGDCNMEEWMNMMMMMDFGNGDSSDSGNTIADMFQ

SEQ ID NO: 149 - DNA, 1035 bp, Arabidopsis thaliana
atggtttcgtggatgatgacaaccaaggcggtgctaatctcaagcggcgtcgccaccgtggctctgttactgaaactctctgttccggtagctgttgatttctccgtgtcacgagctccgatcttgtggagctccttgttgtcatggctgaaaccaccgtatctttacgttgttaccaacggaattatcatcactatcgttgcttcttctaagtattaccgaagtcaccatgaccgtgatgaagaagatgagatcgtcgtgtacggtggtggaggttataagatccagacggaggagccgattgtgaatcaacatcaagcttctccgaggattctggaggttaaggatttggatactggtgcgcattttggtttcgttgtggcgaatctggaggctgaggaactggaatcagaggcggttacggcggttgtgtttgacgatgaggaggaggagaagaagattatagatagcgcggcgacggcggaggatgaaattgaagaggagcttaagagtgtgattatggttgagaattcagatctggttgaatccgatgtcataccgccgccgatgatgatcgaatcggagaatcttcctccgattgagaagcctctcgttacttcaaggttcggtcaccggaaattgatgaaagcaagtcaagaaggtggaagagctttgagagtgacgaagccgaagaagaacgagacgttggagaatacgtggaagatgataacggaagggaaatcaacgccgttgactagacagttataccggagatctgacacgtttggacgtggagattccgggggagttgacggtgaggtgaaaccggtttataagaagtcggatacgtttagggacaggactaattattatcagttggcggagacggcgaaggtgaggaaagagccgtcgctgagtcaggaagagttgaatcggcgagttgaggcgtttataaagaagtttaatgaggagatgaagttgcagagaatggagtctctcagacagtacaaagagataactagccgtggggtttag

SEQ ID NO: 150 - protein, 344 aa, Arabidopsis thaliana
MVSWMMTTKAVLISSGVATVALLLKLSVPVAVDFSVSRAPILWSSLLSWLKPPYLYVVTNGIIITIVASSKYYRSHHDRDEEDEIVVYGGGGYKIQTEEPIVNQHQASPRILEVKDLDTGAHFGFVVANLEAEELESEAVTAVVFDDEEEEKKIIDSAATAEDEIEEELKSVIMVENSDLVESDVIPPPMMIESENLPPIEKPLVTSRFGHRKLMKASQEGGRALRVTKPKKNETLENTWKMITEGKSTPLTRQLYRRSDTFGRGDSGGVDGEVKPVYKKSDTFRDRTNYYQLAETAKVRKEPSLSQEELNRRVEAFIKKFNEEMKLQRMESLRQYKEITSRGV

SEQ ID NO: 151 - DNA, 1431 bp, Arabidopsis thaliana
atgaagaacatactagcttgcatagttaccatcataaccctctcaaacctcataaccatttctcaaggaagaagggtatcacagtcatttgaaacatttgagtacacagcaattatttgcagatcccacagtgcctccataacagagtacggtggtgtaggagacggcaagacgctaaacacaaaggccttccagagcgccgttgatcatctcagccaatactcatctgaaggcggagcacagctctttgtacccgccgggaaatggctcaccggaagtttcaacctcacaagccatttcactctgtttcttcacaaagacgcaattcttctcgctgctcaagacttaaacgaatacccaattctaaaggctttgccttcgtacggacgaggacgtgacgccgccggtggaagattcgctagtctcatcttcggcactaatctctccgacgtaattatcaccgggaacaacggcacaatcgacggtcaaggatcgttttggtggcaaaagttccacggtggcaagctaaaatacactcgcccgtacctgattgagttaatgttctcagatacaattcagatttcaaatctaacgttccttgattctccatcgtggaacatccacccagtgtatagtagcaatatcatcgtaaaaggcgttacgatcatcgccccggtaaaatctccgaacaccgacggaatcaatccagattcttgcacgaacacgaggatcgaagactgttacatcatatccggcgacgattgcatcgccgtgaaaagcggatgggacgaatacggaatctcattcggaatgccgacgaagcacctcgtgatccgtagattaacctgtatctcaccgtacagcgccgcgatcgctctcggaagcgaaatgtccggcggaatcgaagacgtgagagcggaagatatcaccgcataccaaacagaatccggcgtacggataaaaaccgccgtaggaagaggagctttcgtgaagaacatatacgtaaaaggaatgaatctacacacgatgaaatgggttttttggatgaccggaaattacaaagctcatgctgattctcattacgatcctcacgctctaccggagataaccgggattaattacagagatattgtagctgagaatgtttctatggctggaaggttagagggaatctctggagatccttttactgggatttgtatttcgaatgcaacgatttctatggcggctaagcataagaaagcgatttggatgtgtagtgatgttgaaggagttacgagtggtgttgatcctaagccttgtgatttgcttgatggacaagaatcagagacgacgaagaagaagatgattgacggtggatgtgattttcctactgatgtgttggagattgataatgttgagcttaagacttgtagttatcaaatgagttag

SEQ ID NO: 152 - protein, 476 aa, Arabidopsis thaliana
MKNILACIVTIITLSNLITISQGRRVSQSFETFEYTAIICRSHSASITEYGGVGDGKTLNTKAFQSAVDHLSQYSSEGGAQLFVPAGKWLTGSFNLTSHFTLFLHKDAILLAAQDLNEYPILKALPSYGRGRDAAGGRFASLIFGTNLSDVIITGNNGTIDGQGSFWWQKFHGGKLKYTRPYLIELMFSDTIQISNLTFLDSPSWNIHPVYSSNIIVKGVTIIAPVKSPNTDGINPDSCTNTRIEDCYIISGDDCIAVKSGWDEYGISFGMPTKHLVIRRLTCISPYSAAIALGSEMSGGIEDVRAEDITAYQTESGVRIKTAVGRGAFVKNIYVKGMNLHTMKWVFWMTGNYKAHADSHYDPHALPEITGINYRDIVAENVSMAGRLEGISGDPFTGICISNATISMAAKHKKAIWMCSDVEGVTSGVDPKPCDLLDGQESETTKKKMIDGGCDFPTDVLEIDNVELKTCSYQMS

SEQ ID NO: 153 - DNA, 2760 bp, Arabidopsis thaliana
atggccttagctaaagagttaatgggttatcctctcatcacagaaaggtcatcacttgtctcgtcggcgtcgcatttcaagaagaggacacagtcaacacagttctcgatcaacccttttgaccggagaccaagaaaaaccaaatccggcgtcgttgcagccatcagcgaggatttggtcaaaacgctgcgtttttccacaacgaccggagacagaaagagcgaagaggaggagaaagcggcggtgaagttcaaggtgagagctgtggttactgtgaggaacaagaacaaggaggatttgaaagagactcttgttaagcatttggatgcttttgctgataaaattggtcgaaacattgtcttggagcttatcagcacccaacttgatccaaaaacgaagttgccgaagaaaagcaatgcagcagttttaaaggattggtcaaagaaatcgaaaactaaggcggagagagttcactatacggcggagttcacggtggatgcagcgtttggctcgccgggagcaatcaccgtcatgaataaacaccaaaaagagtttttcttggagagcataaccattgaaggcttcgcacttggtcctgttcactttccatgcaattcttgggttcagtctcaaaaagatcaccctgataaacgaattttcttcactaatcagccgtatttgccgaatgagacaccaagcggattaagagtattgagggagaaagagttgaagaatctacgaggagatggaagtggagtgagaaaattatcagacagaatttacgactttgatgtttacaacgaccttggaaatcccgacaaatcatccgagctctctcgccccaaactcggtggcaaagaggttccttaccctagacgttgtcgtactggtcgccaatcaacagtttctgataaagacgcggagagccgagtagagaagccattacctatgtatgtgccacgagacgagcaatttgaagagtcgaagcaggacacttttgctgcagggaggctaaaagcagtcttacaccacctaattccgtcgctcaaagccagtattgtagctgaggactttgcagacttcggcgagatcgatcgtctttataaagaaggcttgttactcaagttagggtttcaagatgacatctttaagaagtttcctctccctaaggtcgtagttgataccctccaagaatctactaaaggactcctcaaatacgacactcccaaaatattatcgaaggataaaaacgcatggttaagagatgacgaattcgcacgtcaagccatagctggaatcaatccagtgaacattgagagagtcaagacttttccaccggtcagcaatcttgaccccaagatctacggtccacaacactccgctcttactgacgaccatatcattggtcacctcgacggattctccgtacaacaagcgttggaagagaatagattgtatatgttggattaccatgacatattcttaccgttcctagaccggattaatgcgctagacggacgcaaagcctatgctactcgaactatcttcttcttgactcgtctaggcacacttaagccggtagccattgagctaagcctccctccccatggtccaaaacatcggtccaagcgtgtgcttacacctccagtcgatgcaacctctaattggatgtggcagctcgctaaagcccacgttagttctaacgatgctggtgtccatcagcttgtcaatcactggttacggacacatgcatgcttggagccatttatattagctgcacacaggcaattgagcgctatgcatcccatattcaagctactggatccacacatgagatacacgttggaaatcaatgctttggctagacaatcgttgatcagtgcagatggtgtgatcgaaggaggcttcactgctggtgcatacggcatggaaatgagtgccgccgcatacaaaagcagctggcggttcgacatggaaggcctccctgccgatctaattcgcagaggaatggcaattcctgatgcaacacaaccacatggtcttaaactcctaatcgaagactatccgtacgccaacgacggtcttttactctggtcagcaatccaaacctgggtccgaacctatgttgaacgctactatccaaacccgaaccttatcaaaacagactctgagctccaatcttggtactcagaatcaatcaacgtcggccacgctgacctccgcgacgctgattggtggccggagttatcaaccgtcgacgacctcgtgtcgattctaaccactctaatctggctcgcctctgctcaacacgccgctctaaactttggacaatacccttacggtggctacgtcccaaaccgaccaccgttgatgcggcggttaatccccgacgagtcggatccagagtacgcgagtttcatctcccatccggagaagtattacttctcgtcgatgccaagtttggcgcagacttcgaagtttatggccgtggttgatactttgtcgacgcattcgccggatgaggagtatattggagagagacaacagccgtcgatttggacaggagatgcggagattgttgaagcgttttatggatttgcggcagagatcggacggatagagaaagagattgagaaaaggaacgctgatcctgaccgtagaaataggtgtggggctggtgttttgccttatgagttgttggttccgagttctgagcctggtgttacgtgtagaggtgtacctaatagtgtatctatataa

SEQ ID NO: 154 - protein, 919 aa, Arabidopsis thaliana
MALAKELMGYPLITERSSLVSSASHFKKRTQSTQFSINPFDRRPRKTKSGVVAAISEDLVKTLRFSTTTGDRKSEEEEKAAVKFKVRAVVTVRNKNKEDLKETLVKHLDAFADKIGRNIVLELISTQLDPKTKLPKKSNAAVLKDWSKKSKTKAERVHYTAEFTVDAAFGSPGAITVMNKHQKEFFLESITIEGFALGPVHFPCNSWVQSQKDHPDKRIFFTNQPYLPNETPSGLRVLREKELKNLRGDGSGVRKLSDRIYDFDVYNDLGNPDKSSELSRPKLGGKEVPYPRRCRTGRQSTVSDKDAESRVEKPLPMYVPRDEQFEESKQDTFAAGRLKAVLHHLIPSLKASIVAEDFADFGEIDRLYKEGLLLKLGFQDDIFKKFPLPKVVVDTLQESTKGLLKYDTPKILSKDKNAWLRDDEFARQAIAGINPVNIERVKTFPPVSNLDPKIYGPQHSALTDDHIIGHLDGFSVQQALEENRLYMLDYHDIFLPFLDRINALDGRKAYATRTIFFLTRLGTLKPVAIELSLPPHGPKHRSKRVLTPPVDATSNWMWQLAKAHVSSNDAGVHQLVNHWLRTHACLEPFILAAHRQLSAMHPIFKLLDPHMRYTLEINALARQSLISADGVIEGGFTAGAYGMEMSAAAYKSSWRFDMEGLPADLIRRGMAIPDATQPHGLKLLIEDYPYANDGLLLWSAIQTWVRTYVERYYPNPNLIKTDSELQSWYSESINVGHADLRDADWWPELSTVDDLVSILTTLIWLASAQHAALNFGQYPYGGYVPNRPPLMRRLIPDESDPEYASFISHPEKYYFSSMPSLAQTSKFMAVVDTLSTHSPDEEYIGERQQPSIWTGDAEIVEAFYGFAAEIGRIEKEIEKRNADPDRRNRCGAGVLPYELLVPSSEPGVTCRGVPNSVSI

SEQ ID NO: 155 - DNA, 3069 bp, Arabidopsis thaliana
atggtgtctccactctgcgactctcagttactttaccaccgcccctcgatctcacctaccgcttctcagttcgtgatcgcggatggaatcatcctccggcaaaatcgtcttctgagctcttcgtcgttttggggcaccaaattcggaaacaccgtcaagttgggagtatctggatgtagtagctgctctcggaagagaagcacgagtgtgaatgcttcactaggtggtcttcttagcggaattttcaagggttctgataacggagagtcgactaggcaacagtacgcatccatcgtcgcatccgttaatcgcttggagactgagatttcggctctttcggattctgagttgcgagagaggactgatgcgttgaagcaacgtgctcagaaaggagaatccatggattcacttttacctgaagcatttgctgttgtgagagaagcttccaagagagttcttggactcagacctttcgatgtgcaattaattggtggtatggttcttcataaaggagaaatagctgaaatgagaactggtgaagggaaaacgcttgttgctattttaccagcttatttgaatgcattaagtgggaaaggtgttcatgtggttacagttaatgattatcttgctcgaagagattgtgaatgggttggtcaagttcctcggttccttggattgaaggttggtctaatccaacagaatatgacacctgaacaaagaaaggaaaattatttatgcgatatcacatatgtcaccaacagtgagcttggatttgattatctgagagacaatctagccacgagtgttgaggagctcgtcttgagggatttcaattattgtgtgattgatgaagttgattccatacttattgatgaagcaaggactcctctcattatctctgggcctgcagagaaacctagtgaccaatattacaaagctgcaaagattgcttcagcctttgagcgggatatacattacactgttgatgaaaagcagaagactgttttactgacggaacagggttatgaggatgcagaagaaatcctggacgtgaaagatttgtatgatccccgtgaacagtgggcatcatatgttcttaatgccattaaggcaaaagaactttttctcagagatgtgaactatatcatccgagcaaaggaggttcttatcgtggatgagtttactggtcgtgtaatgcagggaagacgttggagtgatggactacatcaagctgttgaagcaaaagaaggcttgcctattcagaatgaatctattactctggcgtcaattagttatcaaaacttctttctgcagtttccgaaactttgcgggatgacgggtacagcatcgaccgagagtgcagaatttgaaagcatatacaagcttaaagttacaattgtacccacaaataagcccatgataagaaaggatgagtcagatgtggttttcaaggcagtcaatggcaaatggcgggcagtagtagtggagatctctagaatgcacaagacaggtagggctgtgctagttggcacaaccagtgtcgagcagagtgatgaactatcgcaactgttgagggaagctggaataactcatgaggtcctcaatgccaagccagaaaatgtggagagggaagctgaaattgtagcacaaagtggccgtttaggggcagtaacaattgccacaaatatggcagggcgtgggacagacataattcttggtggaaacgcagagttcatggcacgtttgaagcttcgtgagatacttatgcccagagtggtaaagcctactgatggtgtttttgtatctgtgaagaaggcccctcccaagagaacatggaaggtgaatgagaagttatttccatgcaaactgtcaaatgagaaagcaaagctagctgaagaagctgtacaatcagctgtagaggcttggggccagaaatcgttaactgagcttgaagcagaggaacgtttatcttattcttgtgaaaagggtcctgtccaagatgaagttataggtaaactgaggactgcatttctggcgatagcgaaagaatataagggctacactgatgaagaaaggaagaaggtggtggaagctggtggacttcacgtggtggggacagagcggcatgaatcacgtcgaatagacaatcagttgcgtgggcgaagtggccggcaaggggatcctggaagttcccgattcttccttagtcttgaagataacatattccgcatttttggtggagatcggattcagggtatgatgagggcattcagggtggaagatttaccgatcgaatccaagatgcttactaaagctctagatgaagctcagagaaaagttgagaattacttctttgacatcagaaagcaattattcgaatttgacgaggttctcaatagccaaagagatcgtgtttatacagagagaaggcgtgctcttgtgtcggacagccttgagcctctgattatcgagtatgctgaattgacaatggatgacattctagaggcaaatattggcccagatactccaaaggaaagctgggattttgaaaagctcattgcgaaagttcagcagtactgttacctgttgaacgatctcactcccgatttgctgaaaagcgaaggatcaagttatgaagggttgcaagattatctccgtgcccgtggccgcgatgcatacttacagaaaagagaaatcgtggagaaacaatcaccagggctaatgaaagatgccgaacgattcttaatcttgagcaatattgataggttatggaaagaacaccttcaagcactcaagttcgtgcaacaagctgtggggctcagaggatatgcgcaacgcgatccactcatcgagtataagctcgaaggatacaatctatttctggaaatgatggctcaaatacgaagaaatgtgatatactccatatatcagtttcaaccagtgcgggtaaagaaggacgaagagaagaagtctcagaacgggaaaccgagcaaacaagtagataatgctagtgagaagcctaaacaagttggtgtcacagatgagccatcctcaattgcaagcgcctaa

SEQ ID NO: 156 - protein, 1022 aa, Arabidopsis thaliana
MVSPLCDSQLLYHRPSISPTASQFVIADGIILRQNRLLSSSSFWGTKFGNTVKLGVSGCSSCSRKRSTSVNASLGGLLSGIFKGSDNGESTRQQYASIVASVNRLETEISALSDSELRERTDALKQRAQKGESMDSLLPEAFAVVREASKRVLGLRPFDVQLIGGMVLHKGEIAEMRTGEGKTLVAILPAYLNALSGKGVHVVTVNDYLARRDCEWVGQVPRFLGLKVGLIQQNMTPEQRKENYLCDITYVTNSELGFDYLRDNLATSVEELVLRDFNYCVIDEVDSILIDEARTPLIISGPAEKPSDQYYKAAKIASAFERDIHYTVDEKQKTVLLTEQGYEDAEEILDVKDLYDPREQWASYVLNAIKAKELFLRDVNYIIRAKEVLIVDEFTGRVMQGRRWSDGLHQAVEAKEGLPIQNESITLASISYQNFFLQFPKLCGMTGTASTESAEFESIYKLKVTIVPTNKPMIRKDESDVVFKAVNGKWRAVVVEISRMHKTGRAVLVGTTSVEQSDELSQLLREAGITHEVLNAKPENVEREAEIVAQSGRLGAVTIATNMAGRGTDIILGGNAEFMARLKLREILMPRVVKPTDGVFVSVKKAPPKRTWKVNEKLFPCKLSNEKAKLAEEAVQSAVEAWGQKSLTELEAEERLSYSCEKGPVQDEVIGKLRTAFLAIAKEYKGYTDEERKKVVEAGGLHVVGTERHESRRIDNQLRGRSGRQGDPGSSRFFLSLEDNIFRIFGGDRIQGMMRAFRVEDLPIESKMLTKALDEAQRKVENYFFDIRKQLFEFDEVLNSQRDRVYTERRRALVSDSLEPLIIEYAELTMDDILEANIGPDTPKESWDFEKLIAKVQQYCYLLNDLTPDLLKSEGSSYEGLQDYLRARGRDAYLQKREIVEKQSPGLMKDAERFLILSNIDRLWKEHLQALKFVQQAVGLRGYAQRDPLIEYKLEGYNLFLEMMAQIRRNVIYSIYQFQPVRVKKDEEKKSQNGKPSKQVDNASEKPKQVGVTDEPSSIASA

SEQ ID NO: 157 - DNA, 897 bp, Arabidopsis thaliana
atggccgacgattgggatctccacgccgtagtcagaggctgctcagccgtaagctcatcagctactaccaccgtatattcccccggcgtttcatctcacacaaaccctatattcaccgtcggacgacaaagtaatgccgtctccttcggagagattcgagatctctacacaccgttcacacaagaatctgtcgtctcttcgttttcttgtataaactacccagaagaacctagaaagccacagaaccagaaacgtcctctttctctctctgcttcttccggtagcgtcactagcaaacccagtggctccaatacctctagatctaaaagaagaaagatacagcataagaaagtgtgccatgtagcagcagaagctttaaactccgatgtctgggcatggcgaaagtacggacagaaacccatcaaaggttcaccatatccaagaggatactacagatgtagtacatcaaaaggttgtttagcccgtaaacaagtggagcgaaatagatccgacccgaagatgtttatcgtcacttacacggcggagcataatcatccagctccgacacaccgtaattctctcgccggaagcacacgtcagaaaccatccgatcaacagacgagtaaatctccgacgaccactattgctacttattcatcgtctccggtgacttcagccgacgaatttgttttgcctgttgaggatcatctagcggtgggagatcttgacggagaagaagatctgttatctttgtcggatacggtggttagcgatgatttcttcgatgggttagaggaattcgcagccggagatagcttttccgggaactcggctccggcgagttttgatctctcttgggttgtgaacagtgccgccactaccaccggaggaatatga

SEQ ID NO: 158 - protein, 298 aa, Arabidopsis thaliana
MADDWDLHAVVRGCSAVSSSATTTVYSPGVSSHTNPIFTVGRQSNAVSFGEIRDLYTPFTQESVVSSFSCINYPEEPRKPQNQKRPLSLSASSGSVTSKPSGSNTSRSKRRKIQHKKVCHVAAEALNSDVWAWRKYGQKPIKGSPYPRGYYRCSTSKGCLARKQVERNRSDPKMFIVTYTAEHNHPAPTHRNSLAGSTRQKPSDQQTSKSPTTTIATYSSSPVTSADEFVLPVEDHLAVGDLDGEEDLLSLSDTVVSDDFFDGLEEFAAGDSFSGNSAPASFDLSWVVNSAATTTGGI

SEQ ID NO: 159 - DNA, 396 bp, Arabidopsis thaliana
atgagccgaagtttgggaataccggtgaagcttcttcacgaggcctcaggtcatatcgtgacggtggagctaaagagcggcgagctttacagaggaagtatgattgagtgtgaggataactggaactgtcagctcgaggatattacttataccgccaaggatggtaaggtatcacagcttgagcatgtcttcattcgaggcagtaaagtcaggtttatggtcataccagacattctcaaacatgctccaatgttcaagcggttagatgctagaatcaagggaaagagctcatcactgggtgttggcagaggtagaggtgcaatgcgagggaaaccggctgccgggcccgggcgtggaactggaggaaggggagcggtaccacctgtgaggagatga

SEQ ID NO: 160 - protein, 131 aa, Arabidopsis thaliana
MSRSLGIPVKLLHEASGHIVTVELKSGELYRGSMIECEDNWNCQLEDITYTAKDGKVSQLEHVFIRGSKVRFMVIPDILKHAPMFKRLDARIKGKSSSLGVGRGRGAMRGKPAAGPGRGTGGRGAVPPVRR

SEQ ID NO: 161 - DNA, 1455 bp, Arabidopsis thaliana
atgggaaaggataagactttgccgttgcttgaccctcgtgagccaccggaactcaccggaaccaagtcggcgtcaaaagtatgggccaaagagttcggcgaagagtcgaagcggctttgggagttagcaggaccagcgattttcactgccataagtcaatactctcttggtgctctcactcagactttctccggccgtctcggtgaacttgagctcgccgccgtctcagttgaaaactctgttatctccggtcttgccttcggtgtcatgttagggatggggagtgcattggagacgttgtgtggacaagcatatggcgcgggacagattaggatgatgggaatatatatgcaacgttcatgggtcattctctttactactgctttgtttttgcttcccgtctacatttgggctcctcctattctttccttcttcggcgaggctcctcacatctctaaagccgcggggaagttcgcattgtggatgatcccgcaactatttgcctatgcagccaacttcccgatacagaaattcttgcagtcacagaggaaagttcttgtgatggcttggatctctggagtggttttagttatacatgcagtttttagctggctcttcattctttactttaagtggggacttgtaggtgcagctatcactctcaatacctcgtggtggttgattgttattggtcagcttttgtatatcttaatcaccaaatcagacggtgcgtggactggattttctatgctagcgtttcgggacctctatggatttgtcaaactttccttagcctctgctcttatgctttgtttggagttttggtacttgatggttctggttgttgttaccggtctccttcctaacccgttgataccagtcgatgccatctccatttgcatgaatatagaagggtggactgccatgatttcgatcgggtttaacgctgcgattagtgtgagagtatcgaatgagctgggtgcaggaaacgcagcgttagccaaattctcagtgatagtcgtctccataacttcaactcttatcgggatagtgtgcatgattgttgtcttagccacaaaagacagcttcccttatcttttcacttcaagcgaagctgtggcagcagaaaccacgagaatagccgtcttgttgggcttcactgtcctcttgaacagcctccagcccgtcttgtcaggggttgcggttggagcggggtggcaggctctggttgcatacgtgaacattgcgtgttattacattatcggactacctgctggtcttgttcttggattcacactagacctcggcgttcagggaatatggggaggtatggtagctggaatatgcttgcagacacttatattgattggaatcatctacttcactaactggaacaaagaggctgagcaagcggagagtcgagttcagagatggggaggaacggcgcaggagtga

SEQ ID NO: 162 - protein, 484 aa, Arabidopsis thaliana
MGKDKTLPLLDPREPPELTGTKSASKVWAKEFGEESKRLWELAGPAIFTAISQYSLGALTQTFSGRLGELELAAVSVENSVISGLAFGVMLGMGSALETLCGQAYGAGQIRMMGIYMQRSWVILFTTALFLLPVYIWAPPILSFFGEAPHISKAAGKFALWMIPQLFAYAANFPIQKFLQSQRKVLVMAWISGVVLVIHAVFSWLFILYFKWGLVGAAITLNTSWWLIVIGQLLYILITKSDGAWTGFSMLAFRDLYGFVKLSLASALMLCLEFWYLMVLVVVTGLLPNPLIPVDAISICMNIEGWTAMISIGFNAAISVRVSNELGAGNAALAKFSVIVVSITSTLIGIVCMIVVLATKDSFPYLFTSSEAVAAETTRIAVLLGFTVLLNSLQPVLSGVAVGAGWQALVAYVNIACYYIIGLPAGLVLGFTLDLGVQGIWGGMVAGICLQTLILIGIIYFTNWNKEAEQAESRVQRWGGTAQE

SEQ ID NO: 163 - DNA, 1485 bp, Arabidopsis thaliana
atggagaatcatcatccttctactctattgtctatggattcaagtgcttcttctcatgaggagcttgatttggagatgaataacaacaggcaatctctgctctctggccctcctgatatcaatttacctctctcagctgagagaagtcctcctcctccgccgtggaatttagatgcttgtgatattttggatgttgggttaggttcacaagcttatgagactgagaattacatgagtgttgtacctaaggttgggaggaaatgtgctaaacgtgttgatagtatctggggtgcttggtttttcttcagtttctacttcaagcctgcgttaaacgagaaatcaaaggcgaaaatcgtccgggatagtaatgggatatctggttttgacaagtcggatttgaagcttgatgtgtttttagttcagcatgatatggagaatatgtatatgtgggtgtttaaggaaagacctgagaatgcactagggaagatgcagttgaggagttacatgaatggtcattctagacaaggggatcgtttgtttccatttagtgttgagaaagggtttgttaggtctcacagaatgcagaggaaacactacagaggtttgtcgaatccgcagtgcgttcatgggattgagcttgttcctttgccaaacctcacgtgtctagatgaagaagagaggaaaaggtggatggagcttacgggtcgtgatttgaatttcaccattccacctgaagctagtgactttggttcttggagaaaccttcccaacactgactttgagcttgagaggcctacaccttctttgaagaatcctactgcaaaccactctaagaaactactcaatggctcggggctcaatctctcgactcaaccatccaaccattctaatggtgaagcaaccgatttatctccttcgagccacaagaagaggaaggacttgttctcaaatgggattcatgaggaggagtgttgcttaactgtaaacccacaacctcctgttatcgaagctcaccagaatgagctacctacttggtcaaacgagtttactggggccatgaaaaacgtttatggacctgttactgctgcaaaaacgatctatgaggacgaagaaggctacttgatcataatcagccttccttttgtggatttgaacagcgttaaagtctcctggaggaacactctcacacatggaatcataaaagtttcatgcctcagcacatcgcgcgtacctttcataaagagacatgatagaacattcaagttgactgattcagcctctgagcattgcccgccaggtgaatttgtcagagagatcccattatcaaaccgaatcccggaagatgcaaacattgaagcgtattacgatggacctggatcagttcttgagatacttgtcccaaaactaagagctggcccggaagagcacgaggtgcgggtgtgtctccgtcccaacctcggtggaaacgatcttatgctgacttaa

SEQ ID NO: 164 - protein, 494 aa, Arabidopsis thaliana
MENHHPSTLLSMDSSASSHEELDLEMNNNRQSLLSGPPDINLPLSAERSPPPPPWNLDACDILDVGLGSQAYETENYMSVVPKVGRKCAKRVDSIWGAWFFFSFYFKPALNEKSKAKIVRDSNGISGFDKSDLKLDVFLVQHDMENMYMWVFKERPENALGKMQLRSYMNGHSRQGDRLFPFSVEKGFVRSHRMQRKHYRGLSNPQCVHGIELVPLPNLTCLDEEERKRWMELTGRDLNFTIPPEASDFGSWRNLPNTDFELERPTPSLKNPTANHSKKLLNGSGLNLSTQPSNHSNGEATDLSPSSHKKRKDLFSNGIHEEECCLTVNPQPPVIEAHQNELPTWSNEFTGAMKNVYGPVTAAKTIYEDEEGYLIIISLPFVDLNSVKVSWRNTLTHGIIKVSCLSTSRVPFIKRHDRTFKLTDSASEHCPPGEFVREIPLSNRIPEDANIEAYYDGPGSVLEILVPKLRAGPEEHEVRVCLRPNLGGNDLMLT

SEQ ID NO: 165 - DNA, 441 bp, Arabidopsis thaliana
atggggtcgttgcaaatgcaaacaagtcctgaatccgataatgatccgaggtacgccacggtgacggatgagaggaagaggaagagaatgatctctaacagagaatctgctcggaggtcaaggatgaggaaacagaagcaacttggtgatttgatcaacgaagtcactcttctcaagaatgataacgctaaaatcactgagcaggttgatgaagcttcaaagaaatacattgaaatggagtctaagaacaatgtcttgagggcacaggcttcggagttgacggataggttgagatcattgaactctgtgcttgagatggttgaagaaattagtggtcaggctttggatattcctgagattcctgaatctatgcagaacccttggcagatgccttgtccaatgcaaccaatcagagcttctgctgatatgtttgattgctga

SEQ ID NO: 166 - protein, 146 aa, Arabidopsis thaliana
MGSLQMQTSPESDNDPRYATVTDERKRKRMISNRESARRSRMRKQKQLGDLINEVTLLKNDNAKITEQVDEASKKYIEMESKNNVLRAQASELTDRLRSLNSVLEMVEEISGQALDIPEIPESMQNPWQMPCPMQPIRASADMFDC

SEQ ID NO: 167 - DNA, 1161 bp, Arabidopsis thaliana
atggacaccgaactgaattctcctccgcatgatgatggtggtgataccactaccgcttttcgaaagccttccaatgacgggactagcagaaaatatcgccgtcgagctttagctgacgatggctcatcttcatctgatggaagtcctgaacgtaatcagagccctaatccaaagcattctaggaaagattctgaaccagttcatgtgaggaaagaggatagatgggaatctgatcgcagtcgttatggtagaggaggtgttgattcacatagacatgataggtactctagggatgataattacggatataagcgtgatgagtataacagacatgggagggatgcgcgttctactagccgtgattcaagaggtggcagacattctgaccgtagaagagtggagactgaatatagcaggttaagaaatgactcagacagaagttcccatgataagtatagcaactctggacatagagtcaaaagtaacgagaaaggtgaagatttgtcatctggtaggagacactcagactcaagagtggaggataatgagaaaagaggttctcgctggggttttggtgaccgtcattcccgtgttgaaagaaaggaacatgaggaccctgagattagcaaggagaaggaggttcatgtcaaatcttcaagagaccgttctgatgggaaatgtttggctacagaggatcgagatactcattctaagaaactgaagggtttcatatcagacaagtttactactggcaatactaatgaagagaaacagacatcaatcttaaagccttcccccggtgatgttgatgctgcaaaagttgcagctatgcaggctgctgaattagtgaataaaaaccttgttggaacgggttacctgacaacagatcaaaagaagaagttattgtggggaaaaaagaaaagcacggcttcagaagagtctgctcatcgttgggataatgcgagtgcgctaattggtgaccctgaacggcaagaaaagttcaacaaacttatgggtgtgaaagcgaaggtagtaaaccaagagcaaaacctgggcgaagtcgaggccgagaagcagaaagagttgcagatggatctagagaagcagtacacagcagggttaaggaggagagatggacgaacagtagggttaggtctttga

SEQ ID NO: 168 - protein, 386 aa, Arabidopsis thaliana
MDTELNSPPHDDGGDTTTAFRKPSNDGTSRKYRRRALADDGSSSSDGSPERNQSPNPKHSRKDSEPVHVRKEDRWESDRSRYGRGGVDSHRHDRYSRDDNYGYKRDEYNRHGRDARSTSRDSRGGRHSDRRRVETEYSRLRNDSDRSSHDKYSNSGHRVKSNEKGEDLSSGRRHSDSRVEDNEKRGSRWGFGDRHSRVERKEHEDPEISKEKEVHVKSSRDRSDGKCLATEDRDTHSKKLKGFISDKFTTGNTNEEKQTSILKPSPGDVDAAKVAAMQAAELVNKNLVGTGYLTTDQKKKLLWGKKKSTASEESAHRWDNASALIGDPERQEKFNKLMGVKAKVVNQEQNLGEVEAEKQKELQMDLEKQYTAGLRRRDGRTVGLGL

SEQ ID NO: 169 - DNA, 297 bp, Arabidopsis thaliana
atgtccggcgaggaagaagccaccgtgagggagccactagatctgattaggctgagtctcgacgagagaatctatgtcaagctccggtcagaccgcgaacttcgcggcaagcttcacgcgtttgatcagcatttgaatatgattctgggtgatgttgaagaaactatcactacagtagaaatcgatgacgagacatatgaagagattgttcggactacaaagcggacgattgagtttctattcgtgagaggagatggagtgatattggtgtctccaccgctgaggacagcagcctga

SEQ ID NO: 170 - protein, 98 aa, Arabidopsis thaliana
MSGEEEATVREPLDLIRLSLDERIYVKLRSDRELRGKLHAFDQHLNMILGDVEETITTVEIDDETYEEIVRTTKRTIEFLFVRGDGVILVSPPLRTAA

SEQ ID NO: 171 - DNA, 1464 bp, Arabidopsis thaliana
atggagtccgtcgctctatctcgcataggtctcgccggtctcgcagtcatgggacaaaacctcgccttaaacatcgccgataaaggattcccaatctccgtctacaatcgaaccacttccaaagtcgacgaaaccttagatcgtgcctccaacgaaggaaaactcccagtcgctggtcaatactcgcctcgcgatttcgttctctcgatccaacggcctagatccgttatcatccttgtcaaagccggtgctcccgttgaccaaaccatctctgctctctctgaatacatggagcctggtgattgtatcatcgacggtggaaatgagtggtatcagaacacagagcgacgaatcgttgaagctgagaagaaaggattgctttatttaggtatgggagtctccggtggtgaagaaggagctcgtaatggtccttctcttatgcctggtggatctttcactgcgtataacaatgttaaagatattcttgagaaagttgctgctcaagtcgaagatggtccttgtgttacatacattggagaaggtggatctgggaattttgtgaaaatggttcataatgggattgaatatggtgatatgcagctgatttcggaggcgtatgacgtgttgaagaacgttggtggattgagtaatgatgaattggctgagatcttcacggagtggaatcgaggtgagcttgagagtttcttggttgagattacttcggatatatttagggttaaggatgattatggtgatggagagttagtggataagattttggataagactggtatgaaaggtacagggaaatggacggttcagcaggcggctgagctttctgttgcggcgcctacgattgctgcgtcgttggattgtagatacttgagtggattgaaggatgagagggagaatgctgctaaagttttggaagaagctggattgaaggaggatatcggttctgcgtctcgtggtgttgataagaagaggttgattgatgatgtgaggcaagctttgtatgcttctaagatctgtagttatgctcaagggatgaatttgcttagggctaagagtttagagaaaggttgggacttgaatttgggtgaaatggctaggatttggaaaggtgggtgtattatcagggcggttttcttggacaggatcaagaaagcttaccagagaaacccgaatttggcgagcttagtggttgatcctgattttgctaaagagatggttcagaggcaagctgcatggaggagagtggtgggtcttgctatatctgctgggattagcacaccaggaatgtgcgcaagtttagcgtatttcgacacttacaggcgtgctagattacctgcgaatctggttcaggcgcagagagatctctttggagctcatacatatgagagaaccgatcgtcctggtgcataccacactgaatggactaagcttgcaaggaagagtcagtaa

SEQ ID NO: 172 - protein, 487 aa, Arabidopsis thaliana
MESVALSRIGLAGLAVMGQNLALNIADKGFPISVYNRTTSKVDETLDRASNEGKLPVAGQYSPRDFVLSIQRPRSVIILVKAGAPVDQTISALSEYMEPGDCIIDGGNEWYQNTERRIVEAEKKGLLYLGMGVSGGEEGARNGPSLMPGGSFTAYNNVKDILEKVAAQVEDGPCVTYIGEGGSGNFVKMVHNGIEYGDMQLISEAYDVLKNVGGLSNDELAEIFTEWNRGELESFLVEITSDIFRVKDDYGDGELVDKILDKTGMKGTGKWTVQQAAELSVAAPTIAASLDCRYLSGLKDERENAAKVLEEAGLKEDIGSASRGVDKKRLIDDVRQALYASKICSYAQGMNLLRAKSLEKGWDLNLGEMARIWKGGCIIRAVFLDRIKKAYQRNPNLASLVVDPDFAKEMVQRQAAWRRVVGLAISAGISTPGMCASLAYFDTYRRARLPANLVQAQRDLFGAHTYERTDRPGAYHTEWTKLARKSQ

SEQ ID NO: 173 - DNA, 768 bp, Arabidopsis thaliana
atggcctcaaacgcactctcgtctttcaccgccgctaatcccgctctgtctcctaagccactactccctcacggctctgcttctccgtcggtttctctcggcttctccaggaaagttggcggcggcagagcagtggtcgttgcagcggctacggtggacacaaacaacatgccgatgaccggagtcgtgttccagcctttcgaagaggtgaagaaagccgatctggccattccaatcacatctcatgcctctctcgctcgccagaggtttgccgacgctagcgaggcagtcattaatgagcaaatcaatgtggaatacaacgtctcctatgtgtaccattcaatgtacgcatactttgacagagacaacgttgctatgaagggactagccaaatttttcaaggaatcaagtgaggaagagagagggcatgctgagaagtttatggagtaccagaaccaaagaggaggaagagtgaaactccaccctatcgtctcacctatctcagaattcgaacatgctgaaaaaggagatgctttatatgcaatggagttggctctgtctctagagaaactcactaatgagaagcttctaaacgttcacaaagtggcctcagagaacaatgatccccagttagctgatttcgttgagagtgaatttctgggagagcagattgaagcaatcaagaagatctcagactacatcacccagctaaggatgatcggcaaaggccacggagtttggcatttcgaccagatgcttctgaactag

SEQ ID NO: 174 - protein, 255 aa, Arabidopsis thaliana
MASNALSSFTAANPALSPKPLLPHGSASPSVSLGFSRKVGGGRAVVVAAATVDTNNMPMTGVVFQPFEEVKKADLAIPITSHASLARQRFADASEAVINEQINVEYNVSYVYHSMYAYFDRDNVAMKGLAKFFKESSEEERGHAEKFMEYQNQRGGRVKLHPIVSPISEFEHAEKGDALYAMELALSLEKLTNEKLLNVHKVASENNDPQLADFVESEFLGEQIEAIKKISDYITQLRMIGKGHGVWHFDQMLLN

SEQ ID NO: 175 - DNA, 975 bp, Arabidopsis thaliana
atggatagagaacgatatgataaggtgattgaagcatgttctttgagtaaagatctggagatactttcattcggtgatcagaccgtcattggagaacgcggcatcaatttgagtggtggacaaaagcaaagaatacatattgcacgcgctctctaccaagatgcggacatctatctgtttgatgatccttttagtgctgtcgatgcacacacagggtcacatctctttaaggaagctctacgagggcttttatgttctaaatcggttatatatgtaacccatcaagttgagttcttaccttctgctgatcttacactggtcatgaaagatgggagaatcagccaagctggaaaatataatgatatcctcatctctggaacagatttcagggagcttataggtgcgcatcaagagtctctggcagtagttgggtcggctgatgccagttctgtttctgaaaactcagctttagacgaagaaaatggtgttgtgagagatgatattggtttcgacgggaaacaagaaagtcaagatctgaagaacgataaattagattctggggagccccaaagacaatttgttcaagaggaagagagggcgaaaggtagcgtcgctttggatgtatactggaaatatatcacactggcatacggaggagctcttgtgcctttcatattgttggggcaaattctctttcagcttctacagattggaagtaactactggatggcttgggctactcctatttctgaggatgtgcaagctcctgtgaaactttctacgttaatggttgtgtatgttgctttggcatttggaagttccctctgcattcttgttagagccacgcttcttgtcacggctggttacaagactgctactgaactgtttcataaaatgcatcactgcattttccgttctccaatgtcttttaaaattgcaaaaacttgttcaaaaacttgtatatattcatcataa

SEQ ID NO: 176 - protein, 324 aa, Arabidopsis thaliana
MDRERYDKVIEACSLSKDLEILSFGDQTVIGERGINLSGGQKQRIHIARALYQDADIYLFDDPFSAVDAHTGSHLFKEALRGLLCSKSVIYVTHQVEFLPSADLTLVMKDGRISQAGKYNDILISGTDFRELIGAHQESLAVVGSADASSVSENSALDEENGVVRDDIGFDGKQESQDLKNDKLDSGEPQRQFVQEEERAKGSVALDVYWKYITLAYGGALVPFILLGQILFQLLQIGSNYWMAWATPISEDVQAPVKLSTLMVVYVALAFGSSLCILVRATLLVTAGYKTATELFHKMHHCIFRSPMSFKIAKTCSKTCIYSS

SEQ ID NO: 177 - DNA, 603 bp, Arabidopsis thaliana
atggagtccagtgaggatgtggagaatctgagtagagctattgagaagcttcttcatgagaagaggaagagagaagcttctggtgacgccttcattgaagacgctgatgatcagcttttcctctctagccttatctctcagttggaatcaccaaaccccaaggggaaagaagatgtcataaccggagaagaagaagaaaaagaagaagaatctgcagattcttcaccatccaaaggaaaaagcgagggccagagacaattggaagaaagtatagaagaaatagctaaagacatcaagaaggtgaagaagcagaacaaaataacccatgtacttctctcggctacgatcatcctgacattggtttggcagctctctgagtactccatgattttcatgttgaaagatagaataagccacccagtcagatccatcggaggtatgcttaatggaatgttcaaaggtaagttacgtccaatcaagaaccaacttgcggggacttccaactccaatgaccaaaacaaccatgggaatggatcacacactggacctcaacttcaagtgcccgagctgttgcgagaattcggtttcgacgatgaagaatga

SEQ ID NO: 178 - protein, 200 aa, Arabidopsis thaliana
MESSEDVENLSRAIEKLLHEKRKREASGDAFIEDADDQLFLSSLISQLESPNPKGKEDVITGEEEEKEEESADSSPSKGKSEGQRQLEESIEEIAKDIKKVKKQNKITHVLLSATIILTLVWQLSEYSMIFMLKDRISHPVRSIGGMLNGMFKGKLRPIKNQLAGTSNSNDQNNHGNGSHTGPQLQVPELLREFGFDDEE

SEQ ID NO: 179 - DNA, 1626 bp, Arabidopsis thaliana
atgaagcttcttatgctcgcctttgtttttctattagctttggcgacttgtaaaggtgacgagtttgtttgtgaagagaacgagccattcacatgtaaccaaactaaacttttcaacagtggcaatttcgaaaaaggcttcatcttcggtgttgcatcttctgcttaccaggtggaaggcggtagaggccgtggacttaacgtttgggatagcttcactcaccgattcccagagaaaggtggagctgatttgggaaatggagacactacttgtgactcatatactctttggcagaaagatatagacgtgatggacgagctcaactctactggctacagattctccattgcgtggtcaagactccttccaaaaggaaagaggagcaggggagtgaacccaggagctattaagtactacaacggtctcatagatggcctcgtcgcaaagaatatgacgccctttgttaccctctttcattgggaccttcctcaaacactacaagatgaatataacggtttcttgaacaaaacgatcgtagacgatttcaaggattacgcggatctatgtttcgagttatttggtgatagggtaaagaactggatcaccatcaaccagctatacacagtgcctactagaggatatgcattgggaacagatgcacccggtcgatgttctcctaagattgacgttagatgtcccggcggaaattcgtcaacagaaccctatattgttgcacataaccagcttcttgctcatgcagcggccgttgatgtttacaggacgaaatataaggatgaccaaaaaggtatgattggaccagtgatgataactagatggtttcttccatttgatcatagtcaagagagcaaagatgcaactgagcgggctaaaatatttttccatggatggttcatggggcctctaacagaaggtaaatacccagacatcatgagggaatatgttggtgatcggcttccagagttcagtgaaacagaagccgcacttgtaaagggttcatatgattttcttggtctcaactattacgtcactcaatacgcccaaaataatcagacgattgttccttcggacgtacacactgccttgatggactcacgcacaactctcacatctaaaaatgcaactggtcatgctcctggtccaccgttcaatgcagccagttactactacccaaaaggcatttactacgtaatggattacttcaaaaccacttacggtgaccctttaatatatgtcactgagaatggatttagtaccccaggtgatgaggactttgagaaggctactgccgattacaagcggattgattatctctgtagtcatctctgtttcctcagtaaagtcatcaaggagaagaatgtcaacgtgaaaggatattttgcttggtctcttggggataattacgaattctgtaacggatttaccgtcagattcggactaagttacgttgatttcgcaaatatcactggtgatagagacctcaaagcatctggcaaatggttccagaagttcataaacgttaccgacgaagactctacgaaccaagatctactccgctcaagcgtctcctccaagaaccgtgatcggaagagtcttgcagatgcatga

SEQ ID NO: 180 - protein, 541 aa, Arabidopsis thaliana
MKLLMLAFVFLLALATCKGDEFVCEENEPFTCNQTKLFNSGNFEKGFIFGVASSAYQVEGGRGRGLNVWDSFTHRFPEKGGADLGNGDTTCDSYTLWQKDIDVMDELNSTGYRFSIAWSRLLPKGKRSRGVNPGAIKYYNGLIDGLVAKNMTPFVTLFHWDLPQTLQDEYNGFLNKTIVDDFKDYADLCFELFGDRVKNWITINQLYTVPTRGYALGTDAPGRCSPKIDVRCPGGNSSTEPYIVAHNQLLAHAAAVDVYRTKYKDDQKGMIGPVMITRWFLPFDHSQESKDATERAKIFFHGWFMGPLTEGKYPDIMREYVGDRLPEFSETEAALVKGSYDFLGLNYYVTQYAQNNQTIVPSDVHTALMDSRTTLTSKNATGHAPGPPFNAASYYYPKGIYYVMDYFKTTYGDPLIYVTENGFSTPGDEDFEKATADYKRIDYLCSHLCFLSKVIKEKNVNVKGYFAWSLGDNYEFCNGFTVRFGLSYVDFANITGDRDLKASGKWFQKFINVTDEDSTNQDLLRSSVSSKNRDRKSLADA

SEQ ID NO: 181 - DNA, 2742 bp, Arabidopsis thaliana
atgtctctcagtcacctcctccgccgtctctgtacaaccactaccactacccgtagccctctttccatctcgttcctccaccaacgcatccacaacatctcactttccccggcaaatgaagatccggagacgaccactggtaataatcaggattcagagaaatacccaaaccttaatcccattccaaatgatccttcccaattccagattcctcagaatcacacccctccaattccctatccacccatcccgcatcgtaccatggccttctcttcagccgaagaagccgctgctgagcgccgccgccgtaaacgtcgtctccgaattgaacctcctctccacgctctccgtcgcgatccttcagctcctcctccaaaacgtgatcccaacgcgccacggcttccggattcaacttccgctctcgtcggccaaaggcttaaccttcacaacagagtccaatcactgatcagagcatcagatctcgacgctgcatcaaagctcgctcgccagtctgtgttttccaatactcgacctactgtcttcacctgtaacgccatcatcgccgctatgtaccgagccaagcgttacagtgaatcgatttctctatttcagtatttctttaagcagtctaacatcgtccccaatgtagtctcatacaatcagatcatcaacgctcattgtgatgaagggaatgtcgacgaagcccttgaagtgtacagacacatattggctaatgctccttttgctccatcctcagttacttatagacatttgaccaaaggtttggttcaagctggaaggatcggagatgctgcgagtttattaagggagatgttgagcaaaggtcaagctgcggattccacggtgtacaacaatctgattaggggatatttggaccttggtgatttcgataaggctgttgagttctttgatgaattgaagtctaagtgtactgtttatgatgggattgtgaatgctacctttatggagtactggtttgagaaagggaacgataaggaagctatggagtcttacaggtctttgttagataagaaattcagaatgcatccaccgactggtaatgtacttttggaagtgtttcttaagtttggtaagaaggatgaagcttgggctttgtttaatgagatgttggataatcacgctcctccgaatatcctttcggtgaattcggatacggttggtataatggtcaatgaatgtttcaagatgggagagtttagtgaagctattaatacattcaagaaggtcggaagtaaggtcacctccaaaccgtttgtgatggattatttaggttactgtaacatagtaacaagattctgtgaacaagggatgttaacagaagctgaaaggttctttgctgaaggtgtatctagatctttgcctgctgatgctccaagtcatagagcaatgatcgatgcttatctcaaggcagagagaattgacgatgctgtcaagatgttggacaggatggttgatgtgaatctacgggtggttgctgatttcggtgcaagagtctttggtgagctgattaagaatggtaagctcacggaatctgcagaagttttgactaagatgggagagagggaaccaaaaccagatccttccatttatgatgtggtggttagaggtctttgtgatggtgatgcacttgaccaagccaaggacattgttggtgagatgattagacataatgttggggttactactgtgctgcgggaattcatcattgaggtttttgagaaggcaggacgtcgtgaggagattgagaaaattttgaactctgttgcccggccggttagaaacgctgggcagtctggtaacactccacctagggtacccgcagtgtttggaaccacacctgcagctccgcagcagcctagagacagggccccatggacgagccaaggagtggtgcattccaattcaggttgggccaatggaactgcaggtcaaacagcaggaggagcttacaaggctaataatggccagaatccctcttggtccaacacgtctgataaccagcagcaacaatcgtggtcgaatcagacggcagggcaacagccaccgtcatggtcgagacaggcaccgggatatcaacagcagcaatcttggtctcagcaatcggggtggtcaagtccttcaggtcatcagcaatcatggactaatcagacagctggccagcagcaaccttgggctaatcagacgcctggtcagcagcaacagtgggctaatcaaacgcctggtcagcagcaacaattggctaatcagacgcctggccagcagcaacagtgggctaatcaaacgcctggccagcagcaacaatgggctaatcagaataatggtcaccagcaaccgtgggctaatcagaacactggtcatcagcaatcatgggctaatcagactcctagccagcagcaaccatgggctaatcagacaaccggccagcaacaagggtggggaaatcagacaaccggccagcaacagcagtgggctaaccagacagctggccagcagtcagggtggacagcgcagcaacagtggtctaatcagacagctagccatcagcagtcacagtggttaaatcccgtgccaggagaggtggctaatcagacaccgtggtcaaactctgtggacagtcatcttcctcaacaacaggagccagggccttcccatgagtgccaagagacacaagaaaaaaaggtagtggagttgaggaactag

SEQ ID NO: 182 - protein, 913 aa, Arabidopsis thaliana
MSLSHLLRRLCTTTTTTRSPLSISFLHQRIHNISLSPANEDPETTTGNNQDSEKYPNLNPIPNDPSQFQIPQNHTPPIPYPPIPHRTMAFSSAEEAAAERRRRKRRLRIEPPLHALRRDPSAPPPKRDPNAPRLPDSTSALVGQRLNLHNRVQSLIRASDLDAASKLARQSVFSNTRPTVFTCNAIIAAMYRAKRYSESISLFQYFFKQSNIVPNVVSYNQIINAHCDEGNVDEALEVYRHILANAPFAPSSVTYRHLTKGLVQAGRIGDAASLLREMLSKGQAADSTVYNNLIRGYLDLGDFDKAVEFFDELKSKCTVYDGIVNATFMEYWFEKGNDKEAMESYRSLLDKKFRMHPPTGNVLLEVFLKFGKKDEAWALFNEMLDNHAPPNILSVNSDTVGIMVNECFKMGEFSEAINTFKKVGSKVTSKPFVMDYLGYCNIVTRFCEQGMLTEAERFFAEGVSRSLPADAPSHRAMIDAYLKAERIDDAVKMLDRMVDVNLRVVADFGARVFGELIKNGKLTESAEVLTKMGEREPKPDPSIYDVVVRGLCDGDALDQAKDIVGEMIRHNVGVTTVLREFIIEVFEKAGRREEIEKILNSVARPVRNAGQSGNTPPRVPAVFGTTPAAPQQPRDRAPWTSQGVVHSNSGWANGTAGQTAGGAYKANNGQNPSWSNTSDNQQQQSWSNQTAGQQPPSWSRQAPGYQQQQSWSQQSGWSSPSGHQQSWTNQTAGQQQPWANQTPGQQQQWANQTPGQQQQLANQTPGQQQQWANQTPGQQQQWANQNNGHQQPWANQNTGHQQSWANQTPSQQQPWANQTTGQQQGWGNQTTGQQQQWANQTAGQQSGWTAQQQWSNQTASHQQSQWLNPVPGEVANQTPWSNSVDSHLPQQQEPGPSHECQETQEKKVVELRN

SEQ ID NO: 183 - DNA, 804 bp, Arabidopsis thaliana
atggaagcttcacccaatgatcgacttcattttggcaaaatgggtttcgggtgtaagcattacaagaggagatgccaaatcagagctccatgttgcaacgaagtcttcgattgtcgccattgtcacaacgagagcactagcacattgcgcaatatctacgaccgtcacgatcttgttcgtcaagacgttaaacaagtgatttgttctgtttgcgatacagagcagccggcagctcaagtttgttcgaattgtggtgtcaacatgggagaatatttttgcagcatctgcatattctatgatgatgatactgaaaaacaacagtttcattgcgatgactgtggaatttgcagagttggtgggcgtgagaatttcttccattgcaagaagtgtggatcttgttatgcggttggtctgcgcaacaaccatcgctgcgttgagaattcaatgcgtcatcactgtcccatttgttacgagtacctttttgactctctaaaggacacaaatgtgatgaaatgcgggcacacaatgcacgtagaatgctacaacgagatgatcaaacgtgacaagttttgttgtccaatttgctcgaggtcagtgattgatatgtctaaaacatggcagagactcgatgaagagatcgaagccactgctatgccttcagattaccgtgacaagaaggtttggatactttgcaacgattgtaacgacacaacagaagtgcacttccacataatcggacagaaatgtggacattgcagatcatacaacacacgagcgattgcgcctcctgttcttcctcaatga

SEQ ID NO: 184 - protein, 267 aa, Arabidopsis thaliana
MEASPNDRLHFGKMGFGCKHYKRRCQIRAPCCNEVFDCRHCHNESTSTLRNIYDRHDLVRQDVKQVICSVCDTEQPAAQVCSNCGVNMGEYFCSICIFYDDDTEKQQFHCDDCGICRVGGRENFFHCKKCGSCYAVGLRNNHRCVENSMRHHCPICYEYLFDSLKDTNVMKCGHTMHVECYNEMIKRDKFCCPICSRSVIDMSKTWQRLDEEIEATAMPSDYRDKKVWILCNDCNDTTEVHFHIIGQKCGHCRSYNTRAIAPPVLPQ

SEQ ID NO: 185 - DNA, 954 bp, Arabidopsis thaliana
atggctaattcctcctccttctccccctctaccaccgtaacagatttaatctccaccgtccatgacgacatcatagagtctcacatcttgacacgtctcgacggcgcaaccttagcatccgtctcttgcgcctcctcacatcttcatcatctcgcttccaatgagatcctctggtccaaaatctgccgatccacgtggccttcttgctccggtggttctcgttctttcttctccgacgcttattctatggtggaaaccgccggtacagtctctgatctcgaccgtccgtttccggaattgatctccgccgtggatcttcactacagagggaagttgatttttagtagagtcgtgaagacggagactacgacggcgtggtttaagagttcgccgttgaggattgatctggtggatacaaaggatacggtggcgacgccgattaagagaagacagaggacggaagacacgtgtcgtgatctagagaaggatttgactttgagctggatcgtgattgatccgatcgggaaacgagcggcgaatatttcgagtcaccggccggtgtcggtgcagaggaactggataagcggagaagtggaggcgcaattcgcgacggtggtgggggcggtggagtgtgtgatcacggtggtcacgtgcggtgaggaggagatgcacgtgagggaagtgagtctcaaggtagagaagatggagggaacgcatttaaacgggagggacagtttggttattttaaggagtgtcatggagggtaaaagggtaaatggaagtaggagggaagtagaatcgaagaagagacacgaagagtttatggagaagaagagagagatgaaggagaagaagatgagggtagaatcggtatttgacattttgactgtagcttttggtattttaggctttgtgttgcttgttgtgttttgtctttggagaacctctatatga

SEQ ID NO: 186 - protein, 317 aa, Arabidopsis thaliana
MANSSSFSPSTTVTDLISTVHDDIIESHILTRLDGATLASVSCASSHLHHLASNEILWSKICRSTWPSCSGGSRSFFSDAYSMVETAGTVSDLDRPFPELISAVDLHYRGKLIFSRVVKTETTTAWFKSSPLRIDLVDTKDTVATPIKRRQRTEDTCRDLEKDLTLSWIVIDPIGKRAANISSHRPVSVQRNWISGEVEAQFATVVGAVECVITVVTCGEEEMHVREVSLKVEKMEGTHLNGRDSLVILRSVMEGKRVNGSRREVESKKRHEEFMEKKREMKEKKMRVESVFDILTVAFGILGFVLLVVFCLWRTSI

SEQ ID NO: 187 - DNA, 1428 bp, Arabidopsis thaliana
atggcgactctttatagtcaagttccttctgtatcagcagttttctctctttacacatctttttccgcaatcacgatgctttttcgaacaatcctcaacgagattgtgcctaaaagaatcagagagtacatagctatgaaagctgtagacttcttctcttcttactttcaatctgatttcacttttgtgatagagcaacgttgggagtttgttgagaatcagacgttccgtgctgctgaagtttacttacctacctgtctcgccggactttctacaggcaaacttcttgtgggttcaagtaatcttaagaatccagctgctgagccaaaacttggtatccctgtgaacactaagatcattgataactttgaagggattcatctagaatggactcttcactctgttgaaactaagaagtatctacccgaaaaacggtactttcatttgacatgtaagaaggagtttcgtgagaagataatgacggattacttcacttacttagcgaaatcagcggagaagataatgagccatcgcgagaatctcaagatctatacttataaccaagaccggtctaaatgggaatctgctatcttcgagcatcacacgacctttgagacgttagctgttgagccagacctaaagaagactttgattgacgatcttgatgctttctctaaaggaaaagacttcttcaagagcgtaggacgtgcttggaagcgaggatatcttctttacggtccaccgggaaccgggaagtcttctatggtagctgccattgctaatcatatgaagtatcatatctatgatcttcagattcaaagtgttagagatgatggtgagttgcgggagattcttacttcgaccaagaaccggtcgattcttcttattgaagatattgattgtggagctgatgcttctcgtagacgtcagagtaagaagaaggaagaagatggtggagaagatgatggtgagccacaaaagaggaagaagaagtttgaagttgggatatctttgtctggtctattgaactttgttgatggactttggtcaagttgtggagaagagaaaatcataattttcactactaatcacaaggagaagctcgacccggcgttgcttagaccaggacggatggatgttcatattctcatggacaattgtactccctttgtgttcaagaagcttgtggctttgtaccttaaaaccgatgagcatgtcttgtttgatcccattgagaagctcattcttgaagtgagttcgactcccgctgaagtcacgcagcagctcatggcgagtaagaacgctgatatcgcgcttaaaggccttgctgaattcttggagaacaagaagttgaaaaagggagaagattctagtgtggaggaagagggagagattgaagatgctgagactaaagaagcagaaacataa

SEQ ID NO: 188 - protein, 475 aa, Arabidopsis thaliana
MATLYSQVPSVSAVFSLYTSFSAITMLFRTILNEIVPKRIREYIAMKAVDFFSSYFQSDFTFVIEQRWEFVENQTFRAAEVYLPTCLAGLSTGKLLVGSSNLKNPAAEPKLGIPVNTKIIDNFEGIHLEWTLHSVETKKYLPEKRYFHLTCKKEFREKIMTDYFTYLAKSAEKIMSHRENLKIYTYNQDRSKWESAIFEHHTTFETLAVEPDLKKTLIDDLDAFSKGKDFFKSVGRAWKRGYLLYGPPGTGKSSMVAAIANHMKYHIYDLQIQSVRDDGELREILTSTKNRSILLIEDIDCGADASRRRQSKKKEEDGGEDDGEPQKRKKKFEVGISLSGLLNFVDGLWSSCGEEKIIIFTTNHKEKLDPALLRPGRMDVHILMDNCTPFVFKKLVALYLKTDEHVLFDPIEKLILEVSSTPAEVTQQLMASKNADIALKGLAEFLENKKLKKGEDSSVEEEGEIEDAETKEAET

SEQ ID NO: 189 - DNA, 1800 bp, Arabidopsis thaliana
atggctgaagccggtgacgagaatctttacgccgccgccagagacatcgccagagctctcggcaaggatccaagtgccgccggagatatcttacagattctctccggttatggcgcttccggaaaccgcggcggagatcctcgacccaccccatcccgcggcggctcaaacgtcaactttgaccgagccctcacctctttagagagacagatctccagctacatcgtggaagatcgaccgatctggtctgatcccgttgactcgcgcaccttcctcgactctgttgatgagctacttgcgattgccggagacttgagatccatggccggagataaatccgtcgccgtctgtcaatcccgtgccgatgagctgattcaacaggtgatgtttaggcttcaagaagagtttggatttgtaatggaccgagcccctgactcgtttgactcggacgatgagttccccggcgaagaagacaacgacacaagcgacggggtaatcgttgctcgtccaatcactgattacaaaatcgtgatcgaggcgttacaatctagcgttattggcgatctaaacgcgatcgctgtgcgcatggtcgctggtggatttgcaaaagagtgttcaagagtgtacagcagtcgacgaagagagtttctagaggagagtttgtcgaggttacatctcagaggactaagtatggaggaagtgcaagagagtccatggcaagatcttgaagacgaaatcgaccgttggattaaagccgtaacgctgatattccacgttttcttcccgagcgagcgtcttctctgcgatcgcgttttctctgatcttcctgtttcctctgtaaccgatctttctttcatggaagtttgtcgcggaaccacaacacagcttctgaatttcgcagacgcgatcgctttaggaagccgtttacctgaacgtttgtttaaggttgtggatttatacgaagcgatgcaagaccttattcctaagatggaaacgctattttctgatcgatattgttcgccgctaaggcatgaggcgctcgcgattcataaacggttaggagaagcgattagagggatatttatggagctggagaatttaatccgacgtgaccctcccaaaacagcgtttcctggcggtgggattcacccgatcacgcggtacgtgatgaattatctgcgtgcggcgtgtaaatcgcggcaatcgttggagcagatacttgaccagacaggaaatgaaaccggatcagatacgagaccgttgtctgtgcaaatcatatgggttttggagttgttggagagtaacttggaaggcaagaaaagaacttatcgtgatccgtctttgtgtttcttgttcatgatgaacaatgacaagtatattcttgataaggctaaggataacgagctaggtttagtcctaggagaagattggattgtgaagcacgcagcgaaactgaggcaataccattctaattaccgaaggagctcatggaaccaagtggtgggattgcttaggaccgatggtccgtatcccaagttagtagagaacctaagattgttcaaatcacagttcgatgaggtgtgtaaggtgcaatctcaatgggttgttagtgatgggcaattgagggaggagttaagaagctctgttgccggaattgtatctccggcgtactcgaatttcatcagaagattgaaggagtcaccggagattaatgggaggcgtggagagccgtttattccgtatactgttgaagatgtggagtttataatcaaacggttgttcaaggaaagctcaagttga

SEQ ID NO: 190 - protein, 599 aa, Arabidopsis thaliana
MAEAGDENLYAAARDIARALGKDPSAAGDILQILSGYGASGNRGGDPRPTPSRGGSNVNFDRALTSLERQISSYIVEDRPIWSDPVDSRTFLDSVDELLAIAGDLRSMAGDKSVAVCQSRADELIQQVMFRLQEEFGFVMDRAPDSFDSDDEFPGEEDNDTSDGVIVARPITDYKIVIEALQSSVIGDLNAIAVRMVAGGFAKECSRVYSSRRREFLEESLSRLHLRGLSMEEVQESPWQDLEDEIDRWIKAVTLIFHVFFPSERLLCDRVFSDLPVSSVTDLSFMEVCRGTTTQLLNFADAIALGSRLPERLFKVVDLYEAMQDLIPKMETLFSDRYCSPLRHEALAIHKRLGEAIRGIFMELENLIRRDPPKTAFPGGGIHPITRYVMNYLRAACKSRQSLEQILDQTGNETGSDTRPLSVQIIWVLELLESNLEGKKRTYRDPSLCFLFMMNNDKYILDKAKDNELGLVLGEDWIVKHAAKLRQYHSNYRRSSWNQVVGLLRTDGPYPKLVENLRLFKSQFDEVCKVQSQWVVSDGQLREELRSSVAGIVSPAYSNFIRRLKESPEINGRRGEPFIPYTVEDVEFIIKRLFKESSS

SEQ ID NO: 191 - DNA, 2037 bp, Arabidopsis thaliana
atgagaatattaagctacggaatcgttattctctctttactcgttttctctttcattgaatttggcgttcacgctcgtcccgtcgttctcgtcctctcaaatgacgatctcaatagcggcggcgatgataacggagtcggagagtcctctgacttcgatgagtttggagaatccgaacctaagtccgaagaggagcttgatcccggttcatggcgatcgatcttcgagccagatgactcaacagtccaagcagcctcgccgcagtactactccggcctcaaaaagattctatcggcggcgagtgagggaaatttcaggttgatggaagaagcagtggatgagatagaggctgcttcttcagctggagatccacacgcacagtcgataatggggttcgtttacgggataggaatgatgcgagagaagagcaaaagcaagtcgtttcttcaccataatttcgcagctgctggtgggaatatgcagtcgaagatggcacttgcgttcacgtatcttcgtcaagatatgcatgataaagctgttcaattatatgctgaattagcagagacagctgtcaatagttttctgatctcaaaggattctccggtggttgaaccaactagaattcatagcggaactgaagagaacaaaggtgctctaaggaaatctcgaggcgaggaggatgaagatttccagatattggaatatcaggcacagaaagggaatgctaatgcaatgtacaaaattggactgttctactactttggcctgcgaggattaaggcgtgatcacaccaaggcattgcattggtttttgaaagcagtagataaaggagagccgaggtcaatggaacttctgggggagatatatgctagaggagctggtgttgaaagaaattataccaaggcacttgaatggcttacacttgctgcaaaagaaggtctctattcagcatttaatggaattggctacttgtatgtcaaaggctatggagtagataagaaaaactatactaaggcaagagaatattttgagaaggctgttgacaatgaagaccccagtgggcattataaccttggagttttgtatcttaaaggcatcggagtcaacagggatgtgaggcaggcaacaaaatacttctttgttgctgcaaatgctggtcaaccaaaggctttctatcaactcgccaagatgttccatactggtgttgggcttaagaagaatctggagatggcgacttcattttataagctagtagcagaaagggggccgtggagttctctctctagatgggctcttgaagcttacttaaaaggtgatgtgggtaaggctttgattttgtactcaaggatggcagagatgggttatgaagtggcacaaagtaatgctgcctggatcctcgataaatacggcgaaagaagcatgtgcatgggagtatctggattttgcacagacaaagagagacatgagcgggcacattctttgtggtggcgggcctctgaacaaggcaatgaacatgctgctctgcttattggagatgcatattactatggccggggaactgagagagattttgtgcgtgcggcagaagcatacatgcatgctaaatcacagtccaatgcgcaagcaatgttcaacctcggttacatgcatgaacatggacaaggacttccctttgatctccatttagcaaaacgttactatgatgaatcccttcagagcgatgcagccgcgagattgccagtcacacttgctctcgctagcttatggctccgtagaaactatgctgataccgtcctggtgagagttgtggattcattaccagaagtgtatccgaaggtagagacttggatagagaatgtggtgtttgaagaaggtaatgcaacaatacttacactctttgtctgtctcatcacaattctctatctccgggaaagacaacgtagacaagtcgtcgttgttgccgatccagtggctgctgacgtggcacaaccgctcgacgctgatgtggcgcaacacctcgctgcgttcccacggtaa

SEQ ID NO: 192 - protein, 678 aa, Arabidopsis thaliana
MRILSYGIVILSLLVFSFIEFGVHARPVVLVLSNDDLNSGGDDNGVGESSDFDEFGESEPKSEEELDPGSWRSIFEPDDSTVQAASPQYYSGLKKILSAASEGNFRLMEEAVDEIEAASSAGDPHAQSIMGFVYGIGMMREKSKSKSFLHHNFAAAGGNMQSKMALAFTYLRQDMHDKAVQLYAELAETAVNSFLISKDSPVVEPTRIHSGTEENKGALRKSRGEEDEDFQILEYQAQKGNANAMYKIGLFYYFGLRGLRRDHTKALHWFLKAVDKGEPRSMELLGEIYARGAGVERNYTKALEWLTLAAKEGLYSAFNGIGYLYVKGYGVDKKNYTKAREYFEKAVDNEDPSGHYNLGVLYLKGIGVNRDVRQATKYFFVAANAGQPKAFYQLAKMFHTGVGLKKNLEMATSFYKLVAERGPWSSLSRWALEAYLKGDVGKALILYSRMAEMGYEVAQSNAAWILDKYGERSMCMGVSGFCTDKERHERAHSLWWRASEQGNEHAALLIGDAYYYGRGTERDFVRAAEAYMHAKSQSNAQAMFNLGYMHEHGQGLPFDLHLAKRYYDESLQSDAAARLPVTLALASLWLRRNYADTVLVRVVDSLPEVYPKVETWIENVVFEEGNATILTLFVCLITILYLRERQRRQVVVVADPVAADVAQPLDADVAQHLAAFPR

SEQ ID NO: 193 - DNA, 3090 bp, Arabidopsis thaliana
atggtgtttctctcgattccaaacgggaagactttatcgatcgacgtgaaccctaattcaaccaccatctccgccttcgaacaattggcccaccaacgtagtgatgttccacaatctttccttcgttactctctccgtatgcgaaaccctagccgcgtgtttgtagattcaaaggattccgattcgatcttattgtccgatctcggtgtttctcgtttctctactgtgattatccatgtcctgcttttgggtggtatgcaagcggctccgccgaagcctcgtcttgatttcctcaattctaagcctccgtcaaattatgtagcgggtttgggtcgtggtgctactgggtttactactcgatctgatattggtcctgctcgtgctgctccggatcttcctgatcggtctgctttggctacagcggctgctccaggagtaggtcgtggagcagggaagccaagtgaagcggaagcggaggacgatgaagaagctgaggagaaaaggtacgatgagaatcagacgtttgatgagtttgaagggaatgatgttggtttgttcgctaatgctgagtacgatgaggatgataaagaggctgatgccatctgggagtctattgatcagaggatggattcgaggaggaaagatcggagagaagcgaagctgaaggaagaaatcgagaaataccgagcctcgaaccctaagattactgagcagtttgcggatttgaagaggaaattacacactttgtctgcggatgagtgggatagtattcctgagattggggattactcgctgaggaacaagaagaagaagtttgagagctttgtgcctattcctgatacgcttttggagaaggcgaagaaagaaaaggagcttgtcatggccttagacccaaagagcagagccgctggtgggtcggagacaccatgggggcagacgccggtgacagacttgactgctgtcggtgagggaagaggtacggtgttgtctctgaagcttgataacctatcagattcagtttcggggcaaactgtagtggatcctaaaggctacttaactgacctgaagagtatgaaaagaaccactgatgaagagatatacgatcgcaatagagctagattgttatacaagagtctgacccagtcgaatccaaagaatccaaatggctggattgctgctgctagagtggaggaggtggatgggaagattaaagcagctaggtttcagattcagaggggctgcgaagagtgcccgaaaaatgaggatgtttggcttgaagcttgtaggttagctaatccagaagatgccaagggggttattgcgaagggagttaagctgatacccaattcagtgaagctatggttggaggctgcaaagctggagcatgatgtggagaacaagagtagggtgttgagaaagggactggaacatattccagactctgtaagactatggaaggctgttgttgagttggctaatgaggaggatgcaaggattttgcttcacagggctgtggagtgctgccctttgcatctggagctatgggtggcacttgcgaggctcgaaacatatgctgaatcaaagaaggtgttgaacaaagcgagagagaagctcccaaaggagcctgcaatttggatcaccgctgctaagttagaagaagctaatgggaagctagatgaagctaatgataacacggctatggtgggaaagattattgataggggtataaagactctccagagagaaggggttgttattgaccgagaaaattggatgagtgaggctgaggcatgtgagagagttggatctgtcgctacatgccaggccattattaagaacacaataggtattggagtggaagaagaggatagaaagagaacttgggttgctgatgcagatgagtgcaagaagaggggttccattgagaccgcaagagcaatatacgcccatgctcttagtgtattcttgaccaagaaaagtatctggcttaaagcggcgcagcttgagaagagccatgggagtcgggagtcccttgatgccttgttgcgtaaggctgtaacatatgtcccgcaagctgaggttctctggctcatgggtgccaaagagaagtggctcgctggagatgttccagcagcccgtgctattctacaagaggcttatgctgcaattcccaactctgaggaaatctggcttgctgctttcaagcttgagtttgagaacaaggagccggagagggcaagaatgctgcttgcaaaagcaagggaaagaggagggactgaaagggtctggatgaaatcagccattgttgagagagaacttggcaacgtagaggaggagaggagattgcttaatgaaggtttgaagcaattcccaacattcttcaagctttggttaatgcttgggcagctcgaggaacggttcaagcatctagaacaggccaggaaagcttatgacactggtttgaagcactgtccccactgcataccactgtggctctcactcgctgatcttgaagagaaagtgaatgggctaaacaaagctcgggctattctcaccacggccaggaagaagaatcctgggggggctgagctatggttagctgctattcgcgctgaactgaggcatgacaacaagagagaagcagagcacttgatgtcaaaggctctgcaagactgtcccaagagtggtatcctctgggctgcggacattgagatggcgccacgtcctcgacggaaaacaaagagtattgatgctatgaagaagtgtgatcgcgaccctcatgtcaccatagctgttgccaagctcttttggcaagacaagaaggtggagaaagccagagcatggtttgaacgtgctgttaccgttggcccagatattggcgatttctgggcgttgttctacaaatttgaacttcaacatggctctgatgaggacaggaaggaagttgtggcgaagtgtgtagcttgtgagccgaagcatggcgagaaatggcaagccatctccaaagcggttgaaaatgctcaccagcctattgaagttatcttgaagagagttgtgaatgcgttgagcaaggaagagaattctgcttga

SEQ ID NO: 194 - protein, 1029 aa, Arabidopsis thaliana
MVFLSIPNGKTLSIDVNPNSTTISAFEQLAHQRSDVPQSFLRYSLRMRNPSRVFVDSKDSDSILLSDLGVSRFSTVIIHVLLLGGMQAAPPKPRLDFLNSKPPSNYVAGLGRGATGFTTRSDIGPARAAPDLPDRSALATAAAPGVGRGAGKPSEAEAEDDEEAEEKRYDENQTFDEFEGNDVGLFANAEYDEDDKEADAIWESIDQRMDSRRKDRREAKLKEEIEKYRASNPKITEQFADLKRKLHTLSADEWDSIPEIGDYSLRNKKKKFESFVPIPDTLLEKAKKEKELVMALDPKSRAAGGSETPWGQTPVTDLTAVGEGRGTVLSLKLDNLSDSVSGQTVVDPKGYLTDLKSMKRTTDEEIYDRNRARLLYKSLTQSNPKNPNGWIAAARVEEVDGKIKAARFQIQRGCEECPKNEDVWLEACRLANPEDAKGVIAKGVKLIPNSVKLWLEAAKLEHDVENKSRVLRKGLEHIPDSVRLWKAVVELANEEDARILLHRAVECCPLHLELWVALARLETYAESKKVLNKAREKLPKEPAIWITAAKLEEANGKLDEANDNTAMVGKIIDRGIKTLQREGVVIDRENWMSEAEACERVGSVATCQAIIKNTIGIGVEEEDRKRTWVADADECKKRGSIETARAIYAHALSVFLTKKSIWLKAAQLEKSHGSRESLDALLRKAVTYVPQAEVLWLMGAKEKWLAGDVPAARAILQEAYAAIPNSEEIWLAAFKLEFENKEPERARMLLAKARERGGTERVWMKSAIVERELGNVEEERRLLNEGLKQFPTFFKLWLMLGQLEERFKHLEQARKAYDTGLKHCPHCIPLWLSLADLEEKVNGLNKARAILTTARKKNPGGAELWLAAIRAELRHDNKREAEHLMSKALQDCPKSGILWAADIEMAPRPRRKTKSIDAMKKCDRDPHVTIAVAKLFWQDKKVEKARAWFERAVTVGPDIGDFWALFYKFELQHGSDEDRKEVVAKCVACEPKHGEKWQAISKAVENAHQPIEVILKRVVNALSKEENSA

SEQ ID NO: 195 - DNA, 921 bp, Arabidopsis thaliana
atggcggacaaatcaagcagatcactgatattgtacggagacggcttggctcgatttgtcgatccgtcaaataccaacatccattctcttgcttccgtcgctacttgtggcttcttgagccttcctaatgcacctccagaaactgagaatgaaagaatagttcgagaattctcccacttgctggatgcatccgaagcttattccatagctagtggactaaaaccaaagggaaatggaaatgatatctcaactttggctgaaaggtttatgggactcaaagctgctttagttacggacagttctactctgacttctttcggaaaactgattggcttagatgtattacagcttagtgaaatatgccaagagagtgattcctttccttctgatgccacatcatctaaactactaaagctgcttggatttgaaggaggaaagtgcttggatgtgaacctatatgacttggtttttgttcatttcggggttgatgaatataataacgggaacaacatgggaattctcgactctttgattggcagtattatgggaatggctcaaccaggttcagagattctatcgcggttgcatctgtctgtcgttcttagctatggttctgtcacagacaaagatgtttcagtttttccaatcaagactccacaagaagacattaacccggcatttataggacttgtcccgcgtcagagctacaccatgcgaggtgaaaagacacgggatgatgttcggcactactgtcctatgttggtagctcagtggcagcatggggtgacccggaaagacttagttgataccttatcatttgaagctctcaaaaagctctgtggaaatcttgttataccggctgatcggttcatccacgaagttgctttcaaactttggaaagccccaaaatatggagcttaa

SEQ ID NO: 196 - protein, 306 aa, Arabidopsis thaliana
MADKSSRSLILYGDGLARFVDPSNTNIHSLASVATCGFLSLPNAPPETENERIVREFSHLLDASEAYSIASGLKPKGNGNDISTLAERFMGLKAALVTDSSTLTSFGKLIGLDVLQLSEICQESDSFPSDATSSKLLKLLGFEGGKCLDVNLYDLVFVHFGVDEYNNGNNMGILDSLIGSIMGMAQPGSEILSRLHLSVVLSYGSVTDKDVSVFPIKTPQEDINPAFIGLVPRQSYTMRGEKTRDDVRHYCPMLVAQWQHGVTRKDLVDTLSFEALKKLCGNLVIPADRFIHEVAFKLWKAPKYGA

SEQ ID NO: 197 - DNA, 6030 bp, Arabidopsis thaliana
atgttgaaaaggaagcttacgagtccgaagaaatctaagccgtcgaagaagacgaagaagaactctaaaacccaattcgatgattctccagtagaggtcgtagaaaccaaagctgaagagcttccgcgtacgggttcgaagaaatcgaatccgtcgaagaagagaaagcagacgaagaagaattctgaaactcaatttgaagattcttcagtagaggtcgtagaaaccaaagcttgtgaccaggaggaaacggttacggacattgttgttgaagagggtccatggaagaaccttgaactcatactttcgttgcagagcaatacattgggctttaaaaagaaggtggagttggcttttagttttgttaaaggttatggaggagaaaatgggactaatgaggatgaagaatgtcaagcggttaagatatcgcggctgattatatttctcagcgactggatccagtctcttttgattccttcagagaagaatattaaagttaagtgtgatttagattctgaaccatgtttggacttcaggtgttgggagatcttcagtttctgcttgaaggaggcgacaatcttgggagtctctttaaatttgtcaagaaacctattaaaggctattgggcttatcacgggaagatttttatctgccctgaacgaatccttggctacgggggttgatttctgcaatggtcaaggttttgtagtttacagttctgtggttgattgtctcggcttgttattttcatcgaaaagtggcatgtctaatgacaatttagacttgtggttttcgactgttgaaccagttctgaagctcacacatacggttcttgtagagaatatcaaggatagtcttggtgacagacatgtccttaaattctcttgcttggttcttgagccattctctaggttcttaatgactcatccaactacgaagaatgggttttgtgattttctggacaagctttttgagccatttatggatgtgttgggtttattaaatctcatcgaggacaaaaacaaggatttggagatatccttgctgaggttgattgaagacatattatctctggctctgtttcattcagctcatattgatgggttcttaggcctgggtggagcgaaaaagtatttaccagaatcgaaagagaacaaaactattctgaaaagctatcatcggcatttttttaccaagttcaaaaatatgctattaatgaagaaggagttggagctgagctgtatggggtcattgtttaaagtgtttatttacagagtgatgaaacaacaaagagatcctaatcagttgcaggaaggcatgatgacaaaggcctcaaatgcgaggcaagcagaagaaaggccatggaagctggcggacacagctacaaatgataatgggtcttctacaaaaagtcattactcaagttccctccggctggagacacgaaaatcaatttttgatttcttcctgcatcttatggaacctatattacttgagatcaatggatataatcagtctggctctgaaatggctcctttattgggtgatttttgttgtgttattaagtcagcaaatagtttgctgttcaactttgctcatgagcgaatgtatgtgaagacagaagatgcatctgaaggagcttgctcttgttttttgaggacgatcttcaaaacaatagtttcagttgcttctgaattaaagaaacattgtccatatgataatgggtcagagatgcatgttttgttagccaaggagctagtaaccgcaataggctatctgttacatattgaatacgaaatcattgagagtgatttagttactttgtggctaatcattctctctttcctggagtttagtagtttgtcaccagagaattcagaaggggactgcccgttgacttcattgttagttggccttggatgccagctgataactttatatagtgaccttcgccaggtaagtgttgctgtattttctctgttcaaagctgtaaggcttgtgatgcctgttgtgacacctgctgatggtgatgatgatgagatgattgccactgaagagcttccactatcaactgtgttccctttccgtttagagagaagtgaaaaatcagtggaaaagctcttgtcatctcaagctttaagacttgctatacataaagctattaaagtgataccagaaggccaagcaagtggttgtatcaagagcttgactgcagatgtatcaaaaaccatgaaatggataaaacaagtttgttgctcaacaggtgctacagaacaagatggacaggtggcagcattcttggctggatctttgtctgatatttattcactaattctcgactcaataactattacaacagggaatagtaaccttgttggccagtccatgaaagatctgttggatctcatcagtccttgcttaacccacctggtttcttcagactccgattgcatcgaaaatttcctttctgctctcaccggaaaagatttggagattgtgatggctgaaaagaagatagagacctacagaaagtctgtgcgcttgtttgttatattcgtcttgcgtatttacatgtcttccagaagcttatataggcaggtgattagtcttatgcctccgaaaaaaacaaaggatatggctggtattaagggcgactctgttgcagttcgttgcggaagcgattggataaaagagaaaagttggaattatgaaggatatttttcatggatctcccaaccttctgcttccattgttgacactattaaacacatttcagctttttaccttaaggatgacagtgcagattgctccttgctgatatatatattgtatggagtcgctcttcagagacttgttgatttaaacagccacataaaatcacttgattatgtgtcacagataagtgataatcagataaatgatacaatgctcaagcatgtatcagttcttaagcgtgaaggagaagagcttactgatttccttttaggcaacaacatcatatcaggttttgttgatgatggaacatttgagacgataaaagacactgatcagtgggttcttagggtttctggcatcaacgggaagtgtttgcctactatgcgtttgtgggttcttagccagcatattgatctttggtgcccccatgcaggaaaaaagaaattgaagaatttcctgtctcagctaataggtagttccgttccttgtatattgaacggagtgggtatgtctactcttggctgggaaaataatgtagacaagggctctcaaaagaagaaaatagggttggaacagttctcgtttggacttctatttgattcagtactgtatgaacacgaatttgttcgcaggtatttggccccgagtttttctcacgtactgaaaatgacagcagaaacgtttttcaaggatattactgaagaagtaaactttgattctccatcagattggtcagaggtgttaattttgcttgaaagttcaattgctaacttatctggaaagcttaaatcagaagcctttctagaggcacatgtgtcactgctggacaatcggaagttcacagcttgccaaaatttgctaaatctgttaggtgtgatgcccaaggagtatacgaataagaagtcgttccaactttatgcaagttatgttctcgaccttgagaggtttatagtttttagcatgttgagatgtttgaacaagctgtcctgtggtgatatgcaaaaccttttcagccttttcagtacttgcagaaaaactttgaaaagtattgctatgatttcttgcgacaaggtactaggagctaccaagttgcctttatctgatagttcgttgttggcttcttggctttttaaatcagcacaagctgcgacttgtcaagtgagatttaggaatgatgttacaggaaaagcaagggacgccctcttttctttgatggatcacacatcgtatatgtttctaaccgtaagtaaatatcaatttagcaaggcactaccattttctgatgaaaaactcatttcatcagaaatttctgagggaactggacaagcgaaccttataattgagaacttgacagaacaggcagaaactctactaaatgctttgagggctaccttcagagatgagaaaacagcctttaaatgtgagagtctgatactgaacaagttaacacctatattttcttgttttagtgggttgttgtggggattagcatctgcagtgagtaacagagatatgcagaagaatcatcagaacgcaaaactgagatggaaatcagaacagttctcaaagctttcccgcattatccatgtgcttagcaattttttcgaggtttttgcacagtgtctgtttcttagtggtgatgtgcagcgagaaatccaaaccaatatcaactggaccagattgcttgatgggaccgagggttcaaatggtcttgtgtgtggtgacgtagtagagactagtgatgtgaaaaagaaaattattgagagcttgataaagggtgattcttcagaagtagtattggcactcaagcatctgttaattgcttctgctgctattttaaggttaaacctgcaaattgatggcattacattctcacctacatttgtctctgttctcacgaacatttcgaatgatttactgtctgtattcgctgacatgagcgaggcaccacttgaattctcatttatttggttggatggtgcagttaaagttgtagaagaactagggagccaattctgcttatctaaccctacattaaacatagatctgtactcaaagttgattgagttgcacctgaaggtgattgggaaatgcatatcactacaaggaaaagaggctaccttggaatctcatgagacaggatttggtactaatgcaatccatgctaagctagtgctaacagaaaaaaaacggtctcacagattgcattggttggacgaattaaaacagaggcttaggatgtcatttaaagtgtttatacatagttcctcagagctacacttattgtcaggagtacaagctatagaaagagcactggttggagtatgggaagtgtgcccagctatctattgcatacagactggaaatagagatggaggcagaatttctgaaaccgtcgctgctggtcttgactgtctggacctaattctggaacatgccacaggtcgcaaacgtttgaatgtggttaaaaggcacattcaaggcttaatgtctgcagtgtttggtataatggctcacatgcagagtccatttattttcttctcaaatgcagtcgttggcaaccagggttccaattctccagattctggggcagtcattctcatgtgtgttggagtcttgataagaatagcagggaaacacgctttgtttcggatggattcatcccacgtaagtcaatccatacatatacccggagcaatttttcttgattacctccacgcaacaagggtgggattctcggttttggatggaaatctgttatctaaggatgatcagcaacaagatcttttaggatgctcaaaagaacttcaagtagacaggaaattctcagtgagcctgtatgctgcttgctgccgactactatatacagctgttaagcatcataagagtcaaactgaggggtccattgctacactccaagaatctgtttccgcgcttcttcattgtctggagacagcaggaaaaaatttgggtaattgtgtttcatgggaagtggaagagggaattagatgtgcttgtttcctccggaggatctatgaagagctaagacagcagaaggaggtctttggacagcattgtttcaagttcttgtcaacttacatatgggtttcttccggatatggacctcttaagacgggtcttgaaagggaggtagatgaagctttaaggcctggtgtgtatgctcttatagactcttgctcacctaacgatcttcaatatctccatacagtatttggtgaaggtccttgtagaaactccctagcaactctgcaacaagactacaagttgaatttcaagtatggaggaaaagtctag

SEQ ID NO: 198 - protein, 2009 aa, Arabidopsis thaliana
MLKRKLTSPKKSKPSKKTKKNSKTQFDDSPVEVVETKAEELPRTGSKKSNPSKKRKQTKKNSETQFEDSSVEVVETKACDQEETVTDIVVEEGPWKNLELILSLQSNTLGFKKKVELAFSFVKGYGGENGTNEDEECQAVKISRLIIFLSDWIQSLLIPSEKNIKVKCDLDSEPCLDFRCWEIFSFCLKEATILGVSLNLSRNLLKAIGLITGRFLSALNESLATGVDFCNGQGFVVYSSVVDCLGLLFSSKSGMSNDNLDLWFSTVEPVLKLTHTVLVENIKDSLGDRHVLKFSCLVLEPFSRFLMTHPTTKNGFCDFLDKLFEPFMDVLGLLNLIEDKNKDLEISLLRLIEDILSLALFHSAHIDGFLGLGGAKKYLPESKENKTILKSYHRHFFTKFKNMLLMKKELELSCMGSLFKVFIYRVMKQQRDPNQLQEGMMTKASNARQAEERPWKLADTATNDNGSSTKSHYSSSLRLETRKSIFDFFLHLMEPILLEINGYNQSGSEMAPLLGDFCCVIKSANSLLFNFAHERMYVKTEDASEGACSCFLRTIFKTIVSVASELKKHCPYDNGSEMHVLLAKELVTAIGYLLHIEYEIIESDLVTLWLIILSFLEFSSLSPENSEGDCPLTSLLVGLGCQLITLYSDLRQVSVAVFSLFKAVRLVMPVVTPADGDDDEMIATEELPLSTVFPFRLERSEKSVEKLLSSQALRLAIHKAIKVIPEGQASGCIKSLTADVSKTMKWIKQVCCSTGATEQDGQVAAFLAGSLSDIYSLILDSITITTGNSNLVGQSMKDLLDLISPCLTHLVSSDSDCIENFLSALTGKDLEIVMAEKKIETYRKSVRLFVIFVLRIYMSSRSLYRQVISLMPPKKTKDMAGIKGDSVAVRCGSDWIKEKSWNYEGYFSWISQPSASIVDTIKHISAFYLKDDSADCSLLIYILYGVALQRLVDLNSHIKSLDYVSQISDNQINDTMLKHVSVLKREGEELTDFLLGNNIISGFVDDGTFETIKDTDQWVLRVSGINGKCLPTMRLWVLSQHIDLWCPHAGKKKLKNFLSQLIGSSVPCILNGVGMSTLGWENNVDKGSQKKKIGLEQFSFGLLFDSVLYEHEFVRRYLAPSFSHVLKMTAETFFKDITEEVNFDSPSDWSEVLILLESSIANLSGKLKSEAFLEAHVSLLDNRKFTACQNLLNLLGVMPKEYTNKKSFQLYASYVLDLERFIVFSMLRCLNKLSCGDMQNLFSLFSTCRKTLKSIAMISCDKVLGATKLPLSDSSLLASWLFKSAQAATCQVRFRNDVTGKARDALFSLMDHTSYMFLTVSKYQFSKALPFSDEKLISSEISEGTGQANLIIENLTEQAETLLNALRATFRDEKTAFKCESLILNKLTPIFSCFSGLLWGLASAVSNRDMQKNHQNAKLRWKSEQFSKLSRIIHVLSNFFEVFAQCLFLSGDVQREIQTNINWTRLLDGTEGSNGLVCGDVVETSDVKKKIIESLIKGDSSEVVLALKHLLIASAAILRLNLQIDGITFSPTFVSVLTNISNDLLSVFADMSEAPLEFSFIWLDGAVKVVEELGSQFCLSNPTLNIDLYSKLIELHLKVIGKCISLQGKEATLESHETGFGTNAIHAKLVLTEKKRSHRLHWLDELKQRLRMSFKVFIHSSSELHLLSGVQAIERALVGVWEVCPAIYCIQTGNRDGGRISETVAAGLDCLDLILEHATGRKRLNVVKRHIQGLMSAVFGIMAHMQSPFIFFSNAVVGNQGSNSPDSGAVILMCVGVLIRIAGKHALFRMDSSHVSQSIHIPGAIFLDYLHATRVGFSVLDGNLLSKDDQQQDLLGCSKELQVDRKFSVSLYAACCRLLYTAVKHHKSQTEGSIATLQESVSALLHCLETAGKNLGNCVSWEVEEGIRCACFLRRIYEELRQQKEVFGQHCFKFLSTYIWVSSGYGPLKTGLEREVDEALRPGVYALIDSCSPNDLQYLHTVFGEGPCRNSLATLQQDYKLNFKYGGKV

SEQ ID NO: 199 - DNA, 2466 bp, Arabidopsis thaliana
atgagaggcgtcttcatcgtcatcgtaacgtgtctggttttcttaccggatcctctacgtgccggtgtagcgtccatcgggagcatcactccaggttttggaggatctcagatgaattacatcaacaacgatggtatcttcctcgaatccaacaactcagccttcggtttcggtttcgtaactacacaagattccgttactctgttcacactcagtatcatccacaagagcagcacgaaactgatctggtccgcgaacagagcttcccctgtttccaattccgacaagtttgtgttcgatgacaacggaaatgtggtgatggaaggaactgaggtttggagattggataattcaggcaaaaacgcttcaagaatcgagctgcgtgactccgggaatctcgttgttgtttccgttgacggaacttcgatctgggagagttttgatcatccgacagatactctgatcacgaatcaagctttcaaagaaggcatgaagctcactagcagtccttcttcgagcaacatgacttatgcccttgagatcaaatcaggagatatggttttatctgttaacagcttaacccctcaagtgtattggtcaatggcaaatgccagagagaggatcatcaacaaagatggcggcgtagtgacttcatcgtctctccttgggaattcatggcggttctttgatcagaaacaggttttgttgtggcagtttgtattctcagacaataaagatgataacacaacttggatcgctgttttgggaaacaacggtgtgatctctttttctaatcttggaagcggagcatctgctgccgattcttcgactaaaatacctagcgatctgtgcggaacacctgagccttgcgggccttactatgtctgctcgggttctaaagtgtgtggatgtgtgtccgggttgtctcgggctcggtctgattgcaaaaccgggattacttctccctgtaagaaaaccaaggataatgcaacattgcctttgcagctagtaagtgctggagacggtgtagactatttcgctcttgggtatgctcctccgttctccaagaaaactgatcttgatagctgtaaagagttctgccacaacaattgctcgtgccttggtcttttcttccagaacagttctggtaattgcttcttgtttgattatattggaagctttaaaacctctggcaatggaggctctgggtttgtgtcttacatcaagatcgcaagtactggttctggaggtggagataacggagaagatgatgggaaacattttccttatgtagtgattattgtcgtggtaacagtttttatcatcgctgttttgatctttgtggccttccggattcataagagaaagaaaatgattttggaggctcctcaagagagttcagaagaagataacttcttggagaacttatccgggatgcctattcggttcgcttacaaagatcttcagtcagcgacgaataacttctcggtgaagttaggtcaaggagggtttggatcggtctatgaaggtactttaccagatggttctcgtctagctgtgaagaaacttgaaggaatcggtcaagggaagaaagaattcagagccgaggttagtataatcggaagtattcatcatctgcacttggtgcggctaagaggattctgcgcagaaggggctcataggctgctcgcatacgagttcttatccaaaggttcgttggagagatggatatttaggaaaaaggatggcgatgttcttctagattgggacacaagatttaacatagcactcggaacagccaaaggtttagcgtatctacatgaagattgtgatgcaaggattgttcactgcgatataaaacccgagaacatcctattagacgataacttcaatgccaaggtatccgatttcggactggcgaagctcatgacccgcgaacaaagccatgtcttcacaacaatgcgcgggacaagaggctacttggctccagaatggatcacaaactatgcgatatcagagaagagtgatgtttacagctacggaatggtgttgctagagttaataggaggaagaaagaactatgatccatcagaaacttcggagaaatgccattttccttcttttgctttcaagaagatggaagaagggaagcttatggatattgtcgatgggaagatgaagaatgttgatgtgactgacgaaagggttcaaagggctatgaaaaccgcactttggtgtatacaagaagatatgcaaacgagaccctcgatgagcaaagttgttcaaatgcttgaaggtgtttttccggtggtccagccacctagttcttccactatgggatcgagactttactcaagcttctttaagtccatcagcgaggacggcggtgctactacgtcatctggaccgtccgattgtaacagtgagaattatctctccgccgtgagactctccggtccgagatag

SEQ ID NO: 200 - protein, 821 aa, Arabidopsis thaliana
MRGVFIVIVTCLVFLPDPLRAGVASIGSITPGFGGSQMNYINNDGIFLESNNSAFGFGFVTTQDSVTLFTLSIIHKSSTKLIWSANRASPVSNSDKFVFDDNGNVVMEGTEVWRLDNSGKNASRIELRDSGNLVVVSVDGTSIWESFDHPTDTLITNQAFKEGMKLTSSPSSSNMTYALEIKSGDMVLSVNSLTPQVYWSMANARERIINKDGGVVTSSSLLGNSWRFFDQKQVLLWQFVFSDNKDDNTTWIAVLGNNGVISFSNLGSGASAADSSTKIPSDLCGTPEPCGPYYVCSGSKVCGCVSGLSRARSDCKTGITSPCKKTKDNATLPLQLVSAGDGVDYFALGYAPPFSKKTDLDSCKEFCHNNCSCLGLFFQNSSGNCFLFDYIGSFKTSGNGGSGFVSYIKIASTGSGGGDNGEDDGKHFPYVVIIVVVTVFIIAVLIFVAFRIHKRKKMILEAPQESSEEDNFLENLSGMPIRFAYKDLQSATNNFSVKLGQGGFGSVYEGTLPDGSRLAVKKLEGIGQGKKEFRAEVSIIGSIHHLHLVRLRGFCAEGAHRLLAYEFLSKGSLERWIFRKKDGDVLLDWDTRFNIALGTAKGLAYLHEDCDARIVHCDIKPENILLDDNFNAKVSDFGLAKLMTREQSHVFTTMRGTRGYLAPEWITNYAISEKSDVYSYGMVLLELIGGRKNYDPSETSEKCHFPSFAFKKMEEGKLMDIVDGKMKNVDVTDERVQRAMKTALWCIQEDMQTRPSMSKVVQMLEGVFPVVQPPSSSTMGSRLYSSFFKSISEDGGATTSSGPSDCNSENYLSAVRLSGPR

SEQ ID NO: 201 - DNA, 4350 bp, Arabidopsis thaliana
atggcggcttcttcttcttctggcagacggagatacgacgtttttccaagcttcagtggggttgatgttcgcaagacgttcctcagccatctaatcgaggcgctcgacggcaaatcaatcaatacattcatcgatcatggaatcgagagaagccgcacaatcgcccctgagcttatatcggcgattagagaagctaggatctcaatcgtcatcttctctaagaactatgcttcttcaacgtggtgcttaaatgaattggttgagatccacaagtgctttaatgatttaggtcaaatggtgattccagttttctacgacgttgatccttcggaagttagaaaacagaccggcgaatttggaaaggtctttgaaaagacatgcgaggtcagcaaggacaaacaaccaggggatcagaaacaaagatgggtgcaagctctcacagatatagcaaatatagccggagaggatcttctgaacgggcctaatgaagcgcatatggttgaaaagatatccaatgatgtttcgaataaacttatcactcggtcaaagtgttttgatgacttcgtcggaattgaagctcatattgaggcaataaaatcagtattgtgcttggaatccaaggaagctagaatggtcgggatttggggacaatcagggattggtaagagtaccataggaagagctcttttcagtcaactctctatccaattcccccttcgcgctttcctaacttataaaagcaccagtggtagtgacgtctctggcatgaagttgagttgggaaaaagaacttctctctgaaatcttaggtcaaaaggacataaagatagagcattttggtgtggtggagcaaaggttgaagcacaagaaagttcttatccttcttgatgatgtggataatctagagtttcttaagaccttggtgggaaaagctgaatggtttggatcgggaagcagaattattgtgatcactcaagataggcaatttctcaaggctcatgacattgaccttgtatatgaggtgaagctgccatctcaaggtcttgctcttacgatgttatgccgatctgcttttgggaaagactctccacctgatgattttaaggaactagcatttgaagttgcgaagcttgccggccatcttcctttgggtctcaatgtcctgggttcgtcattaagaagaaggggcaaaaaagagtggatggagatgatgcctaggctccgaaatggtttgaacggagatattatgaaaacattaagagtcagctacgatagattacatcaaaaagatcaagatatgttcctttgcattgcgtgtttattcaatggttttgaggtcagttacgtcaaagatttacttgaagataatgttgggcttacaatgttgtctgagaagtccctcatacgtattacaccggatggacatatagagatgcacaatttgctagagaaattgggtagagaaattgatcgtgcaaagtccaagggtaatcctggaaaacgtcaatttctgacgaattttgaggatattcatgaagtagtgaccgagaaaactgggacagaaactcttcttggaatacgtttgccattcgaggaatatttttcgacaaggccgttattaatagataaagaatcgttcaaaggcatgcgtaatctccaatatctaaaaattggtgattggtcagatgggggtcaacctcagagcctcgtttatttgccccttaaactcagattgctagactgggatgattgtccattgaagtctttgccatctacttttaaggcggaatatctagttaacctcataatgaagtatagtaagcttgagaaactgtgggaaggaactctgccccttggaagtctcaagaagatgaatttgttgtgttccaaaaatttgaaagaaattccagatctttctaatgccagaaacctcgaggaattagatcttgaaggatgcgaatctttggtgacacttccttcctcgattcagaatgccattaaactgaggaagttacattgttcgggggtgatattaatagatttaaaatcattagaaggcatgtgtaatctcgaatatctatcagttgattgctcacgtgtggaaggcactcagggcatcgtttatttccctagtaaactcagattgctattgtggaataattgtccattgaagcgtttgcattctaattttaaggttgagtatctggttaaactcagaatggagaatagtgaccttgagaagctgtgggatggaactcagccacttggaagactcaagcagatgtttctgcgtggttccaaatatttgaaagagattccagatctttctttagccataaacctcgaggaagtagatatttgtaaatgcgaatccttggtgacatttccttcctcgatgcagaatgccattaaacttatctatttagatattagtgattgcaaaaagctagagagttttccaaccgatctcaacttggaatctctcgagtacctcaatctcactggatgcccgaatttgagaaatttcccagcaatcaaaatgggatgttcagacgttgactttccggaagggagaaatgagatcgtggtagaagattgtttctggaacaagaatctccctgctggactagattatctcgactgccttatgagatgtatgccttgtgaatttcgcccagaatatctcgtttttctcaatgtgaggtgctacaagcatgagaagctatgggaaggcatccagtcgcttggaagtctcgaagagatggatctgtcagaatctgaaaacctgacagaaattccagatctttcaaaggccaccaatctgaagcatttatatctcaacaactgcaaaagtttggtgacacttccttctactattgggaatctccaaaaattggtgaggttggaaatgaaagaatgcacagggctggaggttcttccaaccgatgtcaacttgtcatctctcgaaaccctcgatctcagtggttgctcaagtttgagaacttttcctctgatttcaaagagtatcaaatggctctatctggaaaacaccgccattgaagaaattctagatctttcaaaggccaccaagctcgagtctttgatactcaacaactgcaaaagtttggtgacacttccttctacaattgggaatcttcaaaatttgagacgtttgtacatgaaaagatgcacagggctggaggttcttccaaccgatgtcaacttgtcatctctgggtatcctcgatctcagtggttgctcaagtttgagaacttttcctctgatttcaactaatattgtatggctctatctggaaaacaccgccattggagaagttccctgctgcattgaggatttcacgaggctccgtgtactactgatgtattgttgccagaggttgaaaaacatctccccaaacattttcagactgagaagtctaatgttcgccgactttacagactgtagaggtgtcatcaaggcgttgagtgatgcaactgtggtagcgacaatggaagatagcgtttcttgtgtaccattatctgaaaacattgaatatacatgtgaacgtttctggggtgagttgtatggtgatggtgattgggacttaggtactgaatattttagcttccgtaattgcttcaaattggatagagatgcgcgagagctcatcctacgatcatgcttcaagcctgtggccttaccaggtggagaaatccctaagtatttcacgtatcgagcttatggagattccctaactgtcactttacctcggagctctctttctcaatccttcttgcgatttaaggcttgtctcgtggttgaccctctctccgagggcaagggtttttatcgatatttggaggtaaactttggcttcaatggcaaacagtatcagaaatcatttttggaagatgaagaactggagttttgtaagacggatcatctgtttttctgttccttcaagttcgagtctgaaatgactttcaacgatgtggagtttaagttttgttgctccaataggatcaaagaatgcggtgtacgactcatgtatgtctctcaagaaacagagtacaaccaacagactacgagaagcaagaagcggatgcggatgacatcgggaacatctgaagaatatatcaacttagccggtgaccaaattgtagcagacacaggattggccgctctaaatatggagctttcgttaggggagggagaagcatcatcatcaacatctctagagggggaagctttgtctgttgattatatgataactaaagaacaagatgaagacattcctttcttggatcctgtttctgatggtacatggagatcattttattctgcagaatga

SEQ ID NO: 202 - protein, 1449 aa, Arabidopsis thaliana
MAASSSSGRRRYDVFPSFSGVDVRKTFLSHLIEALDGKSINTFIDHGIERSRTIAPELISAIREARISIVIFSKNYASSTWCLNELVEIHKCFNDLGQMVIPVFYDVDPSEVRKQTGEFGKVFEKTCEVSKDKQPGDQKQRWVQALTDIANIAGEDLLNGPNEAHMVEKISNDVSNKLITRSKCFDDFVGIEAHIEAIKSVLCLESKEARMVGIWGQSGIGKSTIGRALFSQLSIQFPLRAFLTYKSTSGSDVSGMKLSWEKELLSEILGQKDIKIEHFGVVEQRLKHKKVLILLDDVDNLEFLKTLVGKAEWFGSGSRIIVITQDRQFLKAHDIDLVYEVKLPSQGLALTMLCRSAFGKDSPPDDFKELAFEVAKLAGHLPLGLNVLGSSLRRRGKKEWMEMMPRLRNGLNGDIMKTLRVSYDRLHQKDQDMFLCIACLFNGFEVSYVKDLLEDNVGLTMLSEKSLIRITPDGHIEMHNLLEKLGREIDRAKSKGNPGKRQFLTNFEDIHEVVTEKTGTETLLGIRLPFEEYFSTRPLLIDKESFKGMRNLQYLKIGDWSDGGQPQSLVYLPLKLRLLDWDDCPLKSLPSTFKAEYLVNLIMKYSKLEKLWEGTLPLGSLKKMNLLCSKNLKEIPDLSNARNLEELDLEGCESLVTLPSSIQNAIKLRKLHCSGVILIDLKSLEGMCNLEYLSVDCSRVEGTQGIVYFPSKLRLLLWNNCPLKRLHSNFKVEYLVKLRMENSDLEKLWDGTQPLGRLKQMFLRGSKYLKEIPDLSLAINLEEVDICKCESLVTFPSSMQNAIKLIYLDISDCKKLESFPTDLNLESLEYLNLTGCPNLRNFPAIKMGCSDVDFPEGRNEIVVEDCFWNKNLPAGLDYLDCLMRCMPCEFRPEYLVFLNVRCYKHEKLWEGIQSLGSLEEMDLSESENLTEIPDLSKATNLKHLYLNNCKSLVTLPSTIGNLQKLVRLEMKECTGLEVLPTDVNLSSLETLDLSGCSSLRTFPLISKSIKWLYLENTAIEEILDLSKATKLESLILNNCKSLVTLPSTIGNLQNLRRLYMKRCTGLEVLPTDVNLSSLGILDLSGCSSLRTFPLISTNIVWLYLENTAIGEVPCCIEDFTRLRVLLMYCCQRLKNISPNIFRLRSLMFADFTDCRGVIKALSDATVVATMEDSVSCVPLSENIEYTCERFWGELYGDGDWDLGTEYFSFRNCFKLDRDARELILRSCFKPVALPGGEIPKYFTYRAYGDSLTVTLPRSSLSQSFLRFKACLVVDPLSEGKGFYRYLEVNFGFNGKQYQKSFLEDEELEFCKTDHLFFCSFKFESEMTFNDVEFKFCCSNRIKECGVRLMYVSQETEYNQQTTRSKKRMRMTSGTSEEYINLAGDQIVADTGLAALNMELSLGEGEASSSTSLEGEALSVDYMITKEQDEDIPFLDPVSDGTWRSFYSAE

SEQ ID NO: 203 - DNA, 1173 bp, Arabidopsis thaliana
atggtgaagcttttggagctgttcataacttcatcaaaaccagtcgttgagattctgttgataacatcagtcggattttatatggctctcgatggagtcaatcttcttggtcatgatgctcgtaaatatctgaacaacattgtcttctatgtgtttagtccttcgcttattggaagccgtttagctgatagtgttacatacgaaagcttggtcaaaatgtggttcatgccggtgaatgttctgcttacattcatcattggttcattacttggctggattgttattgtcatcactaagcctccttcacaccttcgtggtctcattcttggttgttgtgctgctgggaatttggggaatatgccactgattataatcccagctgtttgtaaagaaaaaggaggtccctttggagatcctgagagttgccagaaatatggaatgggttatgttgctctctccatggctatgggatctatttacatatggacttatgtatacaatcttatgcgtgtgctatcgaactctcccgttgaaacccctccctctgttgaatccaactacgacagctacaaagttccccttatttcttccaaggaagaagaaaacaaccaaaaggctgggaggtgggaaaaagtcaagcggagattggtttcactgtcacaaaaagtcaaccttaagacaatttttgctccatcaactattgctgcgatgattgcacttgtgatcgggctcattactcctttaaggaagctaataatcggcacggaagctcctctccgggtgcttcaagactcagtaactctagtgggagatggggcagttcctgcaatgaccatgattataggaggaaacctactcaaaggtttgaggagttcaggaatgaaaatgtccagtattatcggcgtcttggttgcgcgttacgttttactgcctatgagcggtgttttaatcgtaagaggagcatataagttggatttagttacatcagagcccttataccaattcgttcttcttcttcaatatgctgtcccaccagccatgaatctaggtacaattactcagttatttggaactggggagagtgaatgctcagtgattatgctctggacttactctttggcttcgattgcactcactgtttggccaacattcttcatgtggcttgtagcttag

SEQ ID NO: 204 - protein, 390 aa, Arabidopsis thaliana
MVKLLELFITSSKPVVEILLITSVGFYMALDGVNLLGHDARKYLNNIVFYVFSPSLIGSRLADSVTYESLVKMWFMPVNVLLTFIIGSLLGWIVIVITKPPSHLRGLILGCCAAGNLGNMPLIIIPAVCKEKGGPFGDPESCQKYGMGYVALSMAMGSIYIWTYVYNLMRVLSNSPVETPPSVESNYDSYKVPLISSKEEENNQKAGRWEKVKRRLVSLSQKVNLKTIFAPSTIAAMIALVIGLITPLRKLIIGTEAPLRVLQDSVTLVGDGAVPAMTMIIGGNLLKGLRSSGMKMSSIIGVLVARYVLLPMSGVLIVRGAYKLDLVTSEPLYQFVLLLQYAVPPAMNLGTITQLFGTGESECSVIMLWTYSLASIALTVWPTFFMWLVA

SEQ ID NO: 205 - DNA, 1407 bp, Arabidopsis thaliana
atggggacagggaattctaaagaaaactggagacagtcatcgtttaggtcaacttctgcttcatcagcatcaccatcttcatcttcatgggcttctcaacaaagttatcctcagtatggtgcagaaagctataattaccctcctccaccttcttatgcccaacctcctgagtatacgcaacctcctcctcctttatatagtactcagccttactctgctccgtcttattctgcaccgccttctcaaagttatggtagtgataataagaagaggttggagcgcaagtattcgaaaatttctgatgattactcttctttggagcaggtgacggaggctcttgcacgggcgggtctagaatcttcaaatctcatcgttggtattgatttcactaagagtaacgaatggacaggggccaggtccttcaataggaaaagcttacacttcataggcagtagtcccaatccttatgaacaagcgataactatcataggaagaaccttagccgcctttgacgaggacaacttgattccatgttatggttttggagatgcatcaacacatgatcaagacgtgttcagtttcaattcagaggatagattctgtaatggatttgaggaagtactttcccggtataaggagatcgtgcctcaacttaagcttgcagggccaacctcctttgctccgatcatcgatatggccatgaccattgttgagcagagtggtgggcaatatcacgtcctagtgataatagcagatgggcaggttacaagaagtgttgacacggaaaatggacagttaagtccacaagaacagaagacggtagatgcgatcgtgcaagcgagtaagcttcctctatcaatcgtcttagtcggggtgggggatggaccttgggacatgatgagggaatttgacgataatattccggccagagcgtttgataacttccaattcgtgaacttcacagagatcatggcaaagaacaaagctcaatccttgaaggaaacagagtttgccctttctgctctcatggagattcctcaacaatacaaggcgacaatagagcttaaccttttaggaagaagaaatggatatatcccggagagattccctcttccgcctccaatgcgcggtggatcatcgtcctacaacagtccaaagccttcacgtcttccaagtttcaaaccgagtgttcctcctcatccaactgaaggctatcacgtaaggtctagtcccgtcccaccccctacaagctctgcttctgataaccagctatgtccgatttgtttgagcaacccgaaagacatggcctttggttgtggccatcagacttgttgcgagtgtggaccagatcttcaaatgtgtccgatttgccgtgcaccaatccagacaagaataaagctctactaa

SEQ ID NO: 206 - protein, 468 aa, Arabidopsis thaliana
MGTGNSKENWRQSSFRSTSASSASPSSSSWASQQSYPQYGAESYNYPPPPSYAQPPEYTQPPPPLYSTQPYSAPSYSAPPSQSYGSDNKKRLERKYSKISDDYSSLEQVTEALARAGLESSNLIVGIDFTKSNEWTGARSFNRKSLHFIGSSPNPYEQAITIIGRTLAAFDEDNLIPCYGFGDASTHDQDVFSFNSEDRFCNGFEEVLSRYKEIVPQLKLAGPTSFAPIIDMAMTIVEQSGGQYHVLVIIADGQVTRSVDTENGQLSPQEQKTVDAIVQASKLPLSIVLVGVGDGPWDMMREFDDNIPARAFDNFQFVNFTEIMAKNKAQSLKETEFALSALMEIPQQYKATIELNLLGRRNGYIPERFPLPPPMRGGSSSYNSPKPSRLPSFKPSVPPHPTEGYHVRSSPVPPPTSSASDNQLCPICLSNPKDMAFGCGHQTCCECGPDLQMCPICRAPIQTRIKLY

SEQ ID NO: 207 - DNA, 1671 bp, Arabidopsis thaliana
atgtcaccatttttgaagttctttctctttctctatgattatctttcaccttcctctttctttctggtccaaagaaataccttaggagcatcattagatactacagatggggttgtgagaagtggcataattggagagattatatacatttggaagcagacaagaatctttgtctttataccaatcttgaaatgcttagtgacaatatgtttggtaatgtcccttttgttgttcatagaaagagtttatatgagcatagtagtagtgtttgtgaaattacttagacgaacacctgagaaagtacacaagtgggaacctataaacgatgatgaccttgagcttgccaatacaaactacccaatggttctcattcagatcccaatgtacaatgaaaaagaggtttgtcagttatctataggagcagcctgtagactttcttggccattggatcgaatgatagttcaagtacttgatgattccacagatccagctagtaaggaattggtgaatgcggaatgtgataaatgggcgaggaaaggtataaacataatgtcagagattagagacaacagaattggatacaaagcaggagcattaaaggcaggaatgatgcacaactatgtgaaacaatgcgaattcgtcgccattttcgatgctgattttcagcctgatcctgactttcttgaacgaaccattccttttcttattcacaaccatgaaatctctcttgttcaatgccgttggaagtttgtgaatgcaaacgagtgcttaatgacaagaatgcaagagatgtcactaaactaccattttgtggctgagcaagaatctggatcttcaatacatgctttctttggattcaatggaaccgcgggtgtatggagaatcgcagctttaaacgaagctggaggatggaaagatcgaacaaccgtagaagatatggatttagcagtaagagcttgtcttcatggttggaaatttgtctatgtccatgacgtcgaggtgaaaaatgaattgccaagtacattcaaagcatacaggtttcagcaacatagatggtcttgtggaccagctaatctatggaggaagatgacaatggaaatcttacagaacaagaaagtgtcggcctggaagaaattgtatctcatatacaatttcttcttcataaggaagattgtagtacacatcttcacatttgtcttctactgtctgatattaccaacaactgtgctattccctgagctccaagttcctaaatgggcaactgtttattttcctactacaatcactatccttaacgcaatcgctacacctcgatcactccatcttcttgtcttttggatcttattcgagaatgtaatgtcgatgcatcgcacaaaagcgacattcatcgggttactagaggcaggacgggttaacgaatgggttgttactgaaaaattaggtgacactctcaagtctaagttaataggtaaagctacaactaagctttataccagatttggacaaagactcaactggagagaactcgttgttggattatatatattcttctgcggatgttacgatttcgcatatggaggatcatacttttatgtttatctgtttttacagtcttgtgcattttttgttgctggagttggttatattggcacatttgttccaactgtttag

SEQ ID NO: 208 - protein, 556 aa, Arabidopsis thaliana
MSPFLKFFLFLYDYLSPSSFFLVQRNTLGASLDTTDGVVRSGIIGEIIYIWKQTRIFVFIPILKCLVTICLVMSLLLFIERVYMSIVVVFVKLLRRTPEKVHKWEPINDDDLELANTNYPMVLIQIPMYNEKEVCQLSIGAACRLSWPLDRMIVQVLDDSTDPASKELVNAECDKWARKGINIMSEIRDNRIGYKAGALKAGMMHNYVKQCEFVAIFDADFQPDPDFLERTIPFLIHNHEISLVQCRWKFVNANECLMTRMQEMSLNYHFVAEQESGSSIHAFFGFNGTAGVWRIAALNEAGGWKDRTTVEDMDLAVRACLHGWKFVYVHDVEVKNELPSTFKAYRFQQHRWSCGPANLWRKMTMEILQNKKVSAWKKLYLIYNFFFIRKIVVHIFTFVFYCLILPTTVLFPELQVPKWATVYFPTTITILNAIATPRSLHLLVFWILFENVMSMHRTKATFIGLLEAGRVNEWVVTEKLGDTLKSKLIGKATTKLYTRFGQRLNWRELVVGLYIFFCGCYDFAYGGSYFYVYLFLQSCAFFVAGVGYIGTFVPTV

SEQ ID NO: 209 - DNA, 3312 bp, Arabidopsis thaliana
atggctccagttccggatccgaacagtgttggcggtggtgcgaagcgggacgaagctacgacgaagattccttctaaggattccaagaagaaagatgataaaaaggaagaggatctgtctgaagaggacttgcaactaaagcagaatctggagctctatgttgagagagttcaggaccccaatcctgagttacagaagattgctcttgaaagcatgaggaaggaaattcgtgactcaacaagctccatgacatcagttccaaaacccctcaagtttctccgccctcattatggagttcttaaagaatttcatgcaaaaatggcagagtctgatctcaaaaaaatgttggctgatatactttctgtcctggcactgaccatgtctgctgaaggtgaaaggatttgtgttttgtggttcttggtagaatttgacttaagctatttgttgctgatcctttgttatgcaatactctttcaggaaagcttaaactataggttgaatggatcagagagtgacatcggatcgtggggtcacgagtatgtcaggaatttggctggagagattgcaaaagagtatacaatacgtcagggtgaagagtcctctattgaagacttaatggatcttgtgcagcaaattgtttcttttcacatgaagcataatgccgaaaccgaagctgttgaccttttaatggatgttgaggatcttgatctcttacttgagcatgttgacaatacaaatttcaggaggacgtgcaactatctcacgagtgcagcaaagtatcttccaggaccagatgacatgttggttctagatattgcttacatgatctacattaagtttgcagaatatccaaacgcgctgcaaattgcattatttcttgataacatgcagtatgtgaagcaagtatttacctcatgtaccgatctggtaaaaaagaaacagttctgctacatgattgcacgtcatggtatgacctttgagcttgaccaagagatggttgcaaatgacgaagacaaagaagcgctacaggatattgttaacaactctaagttgagtgaaggatatctgacgcttgctagggatattgaggtcatggaggccaagacgcctgaagacatctacaaggctcacttgcttgatggtagggctagctctggtccaagtgtggactcagctaggcaaaatctatctgcgacttttgtgaatgcatttgtaaatgctggattcggccaggacaaattaatgacagtaccatctgactcaaccagtggatcggctggaaactggctcttcaaaaataaagaacatggaaagaccagtgcagttgctagtctggtatacctcatcttacttgataaattgattagctatgtttttattttggaaggtatgattcaattgtgggatgtggagaccggactaggtcatctcgacaaatatttccatagtaacgataatcccgtcgttgctggagctctgctgggagttgggattgttaattgtggcattaagaatgattgtgaccctgcatttgcccttctttcaggttatattgacaatgaggattcatctgtccgaattggtgctattatgggtctcgggattgcatatgcgggttcccaaaatgatcagataaaaatcaggttgtctccaatactaaatgatgccaacgcacctctcgatgtgattgcatttgctgcacttagtttggggatgatttatgttggttcgtgtaacgaagaggttgcacaatctattatatttgctttgatggatcggagcgaggcagagctgggtgaagccctcactcgtttcttgcctcttggacttggtcttttgtaccttggcaaacaggtgggcagccagtcatacttgattatttttcttgttcgtgaaagtgtggaggctactgcagaagtttcaaagacgttcaatgagaaaatcagaaagtattgtgatatgacacttctttcatgtgcatatgctggaaccgggaatgtccttaaggtatctgatcaatttagtctgactcttcaaactattcaaactattcaggtccaagaccttctggctcagtgtggagagcatctggtgaaaggtgatatccaccagggtccagctgtgattggattagctatggttgctatgtctgaggaattgggtctggatatggagatccgttctttggagcgcgtactacagtatggagagcagaacattcgacgtgcagtgcctttggctcttggtctcctatgtatatcaaacccaaaggtgactgttatggacactttgagcagactaagccatgacacagattcagaagttgcaatggcagcaattatctcccttggattgataggcgctggaaccaacaatgcaaggatagctggcatgcttagaaatctctccagctattattacaaggatgccagccttcttttctgtgtaacgttttatgatttctttttaagttttcatggaataaacacggtttctacttatgataggcttgttctcattgtcttaagtcacaatgcaggtgcgcatcgctcaagggtttgtgcatatgggaaagggtctcttaactctcaatcctttccactccgaacggctcttgctatgccaaccgcacttgctggtatagtgacattgttgcatgcatgccttgacatgaaatccattatactggggaaatatcactatgtgctctacttccttgttttggcgatgcagccaaggatgatgctgacggtggatcagagcctgaagcccatctcggtgccagtgcgggtaggacaagcggttgatgtggttggacaggcaggccgacctaagacaatcactgggttccaaacgcactcaacacctgttctccttgctgctggggagagagctgaactcgcaaccgagaagtatgttgttcctctaatccccttgttacattatcctactcgaaataaaactctgttttacatattggaatctaaaaaaactctgcttctttttgggtcacaggtacattccgttgtcgcccatattagaaggtttcgtcatattgaaggaaaatccagactacagagaggagtaaatccaaagttgcaagcatttgaagaaagagagagagcctttgaatactttcactacggttgtcaaaagttttttagtttattcccgtctgttcccaggaaatggttcacaatctctccttttaaaagaaaaaatagcttcattgcaatatataggaacttcttgtgcactactttaatatcgcattctaaaagctggataagtttccaaatccaattctcttaa

SEQ ID NO: 210 - protein, 1103 aa, Arabidopsis thaliana
MAPVPDPNSVGGGAKRDEATTKIPSKDSKKKDDKKEEDLSEEDLQLKQNLELYVERVQDPNPELQKIALESMRKEIRDSTSSMTSVPKPLKFLRPHYGVLKEFHAKMAESDLKKMLADILSVLALTMSAEGERICVLWFLVEFDLSYLLLILCYAILFQESLNYRLNGSESDIGSWGHEYVRNLAGEIAKEYTIRQGEESSIEDLMDLVQQIVSFHMKHNAETEAVDLLMDVEDLDLLLEHVDNTNFRRTCNYLTSAAKYLPGPDDMLVLDIAYMIYIKFAEYPNALQIALFLDNMQYVKQVFTSCTDLVKKKQFCYMIARHGMTFELDQEMVANDEDKEALQDIVNNSKLSEGYLTLARDIEVMEAKTPEDIYKAHLLDGRASSGPSVDSARQNLSATFVNAFVNAGFGQDKLMTVPSDSTSGSAGNWLFKNKEHGKTSAVASLVYLILLDKLISYVFILEGMIQLWDVETGLGHLDKYFHSNDNPVVAGALLGVGIVNCGIKNDCDPAFALLSGYIDNEDSSVRIGAIMGLGIAYAGSQNDQIKIRLSPILNDANAPLDVIAFAALSLGMIYVGSCNEEVAQSIIFALMDRSEAELGEALTRFLPLGLGLLYLGKQVGSQSYLIIFLVRESVEATAEVSKTFNEKIRKYCDMTLLSCAYAGTGNVLKVSDQFSLTLQTIQTIQVQDLLAQCGEHLVKGDIHQGPAVIGLAMVAMSEELGLDMEIRSLERVLQYGEQNIRRAVPLALGLLCISNPKVTVMDTLSRLSHDTDSEVAMAAIISLGLIGAGTNNARIAGMLRNLSSYYYKDASLLFCVTFYDFFLSFHGINTVSTYDRLVLIVLSHNAGAHRSRVCAYGKGSLNSQSFPLRTALAMPTALAGIVTLLHACLDMKSIILGKYHYVLYFLVLAMQPRMMLTVDQSLKPISVPVRVGQAVDVVGQAGRPKTITGFQTHSTPVLLAAGERAELATEKYVVPLIPLLHYPTRNKTLFYILESKKTLLLFGSQVHSVVAHIRRFRHIEGKSRLQRGVNPKLQAFEERERAFEYFHYGCQKFFSLFPSVPRKWFTISPFKRKNSFIAIYRNFLCTTLISHSKSWISFQIQFS

SEQ ID NO: 211 - DNA, 966 bp, Arabidopsis thaliana
atgaaactcgcaggtctgaaatcgatcgagaacgctcacgaagattccgtttgggcagcgacgtgggttccggcgacggaagatcgaccggcgttgcttctgactggatctcttgacgagacggtgaagttatggcgaccggacgagctggatcttgtgcggactaatactggacactctttgggagtagcagctttggctgcgcatccttctgggattattgcagcatcttcttcgattgatagctttgtccgtgtgtttgatgttgatactaatgctacgattgctgttttggaagctcctccttctgaggtttggggaatgcaatttgaacctaagggtacgatccttgctgttgcaggtggaagtagtgcctcagtcaagctttgggacactgcaagctggagattaatctcaactctatcaatcccacgcccagatgcaccaaaaccttccgataaaaccagcagcaagaaattcgttctctcggtggcttggtctcctaatgggaaacgacttgcttgtggttcaatggatggtacgatctgtgtttttgatgttgaccgctcaaagctacttcaccagctagaaggtcacaatatgcctgtaaggtcccttgtgttctcccctgtagacccgagagtcctcttctctggatcagatgatgggcatgtgaacatgcacgatgcagaagggaaaacgctgttggggtccatgtcagggcacacgagttgggtgctgagcgttgatgctagcccagacggtggagccatagcaaccggctcaagcgatagaactgtgaggctatgggatcttaaaatgagagctgcgattcagacaatgagcaaccacaatgaccaggtttggtctgtggcctttagaccaccaggtggaaccggtgtccgggctggtcgacttgctagtgtctctgatgacaagagtgtatcgctctatgattactcatga

SEQ ID NO: 212 - protein, 321 aa, Arabidopsis thaliana
MKLAGLKSIENAHEDSVWAATWVPATEDRPALLLTGSLDETVKLWRPDELDLVRTNTGHSLGVAALAAHPSGIIAASSSIDSFVRVFDVDTNATIAVLEAPPSEVWGMQFEPKGTILAVAGGSSASVKLWDTASWRLISTLSIPRPDAPKPSDKTSSKKFVLSVAWSPNGKRLACGSMDGTICVFDVDRSKLLHQLEGHNMPVRSLVFSPVDPRVLFSGSDDGHVNMHDAEGKTLLGSMSGHTSWVLSVDASPDGGAIATGSSDRTVRLWDLKMRAAIQTMSNHNDQVWSVAFRPPGGTGVRAGRLASVSDDKSVSLYDYS

SEQ ID NO: 213 - DNA, 321 bp, Arabidopsis thaliana
atgtgggatgaaactgtagccggacctaaaccggagcatggccttggccgcctccgcaataagatcaccacccaaccccttgacatcaaaggagaagggagcagtagtaaaactgtggcggcggtggccgggagtcctggaactccgacgacgccaggatcggcgcgtaaggaaaacgtgtggagaagtgtgtttcatccaggaagtaacatcgccactagaggaatgggcacaaacctcttcgacaagccttctcacccaaactctcccaccgtctacgattggctatacagcgacgacactaggagcaagcaccgttga

SEQ ID NO: 214 - protein, 106 aa, Arabidopsis thaliana
MWDETVAGPKPEHGLGRLRNKITTQPLDIKGEGSSSKTVAAVAGSPGTPTTPGSARKENVWRSVFHPGSNIATRGMGTNLFDKPSHPNSPTVYDWLYSDDTRSKHR

SEQ ID NO: 215 - DNA, 2538 bp, Arabidopsis thaliana
atggaagagaaaaaagtagtaagagcgttaagcgaacacctatcactacctcctccaccatctccttctgtagcggtagccatcaacgggaagaagaagagcaaatacgtcgttttttgggctcttgagaagtttatacctgaaggtttcactgatttcaaattgctctatgttcgtcctcctgtctcttacatccctaccccaatggggattgcggtagcggtatcagagcttagagaggatgtagtatcagcttacaaacaagaactggattggagcgcaaacgagatgcttcgtccttacaagaaaatgtttgaaaggagaaaggtgcaagtagaggttttgttgctggattcacttgagcctgcagccgcgatagcggaagagattgctggaactggagtcacaaaactggtaataggaatgtctctccgcggattcttttcaagaaagatcgatatgtcttctttgatcgcaacagctgttccgagattctgcactgtctatgtgatctcgaaggggaaactagcttccgtgcgtccttctgagtcagacgctagcggaagcataagattcgagagaagcagttccacaagtggctccactgatagtcctagactccctcctgagtaccaagactttctctccgctgtttcggaagcacaatcccgagtctctcctttttctcctgctctgaaacattcgatgggaagcaacgcagtggctcagatggatacgagttcgagcgggacggaccaagaggaagtatctacggggagagggatggagattgtccatagcggtattgaaggaaagaagaataaggatgagagctttagcgcttcgttcccaatgggtacagaggcttacaactcgatgagctggacgtctaaatggagagatcacgaggataggagagagatgaggagctcttcttcgagtaacaaccacgatctagtcaatatggactggggtgccgtggttcctgagaactattcttgggtttctcatactgcctctcacatgtctgatggactcctcagtgtccattctattaccgataatcaggtgaatctgaactttgagatagagaaactgagagcggagctgaagcatgttcaggagatgtatgccatggctcaaaccgagactgttggtgcttcaaaaaagctgactgagctaaaccagaggcggttcgaggaatccgagaagcttgtggaactgaaggaaaaagaagaagtagcaaaagatacagcttcaaaggagaagcaaaggtacgaagaggcgatgaaggaagcagagaaggttaaagaactcatgatgaaagaggctttacatagaagagaagctgagttcaaagcagagcgcgatgctagagagaaagataagctccaggcttctctcgtctctcccggggtccaataccaacattatacctgggaggaaatcgcagccgcaacttctgacttcgcagaaaatctcaagattggaatcggagcctatggatcagtctacaaatgtaatctacatcacacgaccggtgctgtcaaggtccttcacgctggagaaactcagctctcgaaacagtttgatcaagagcttgagatcttaagcaaaattcgacatcctcacttagtcctcctactaggggcgtgtcccgaacgcggctgccttgtctacgagtacatggacaacggaagcttagatgaccggttgatgctagtcaacgacacaccaccgatcccttggtttgagcgtttcaggatcgctttagaagtcgcttcagcgcttgtattcctccacaaatccaagcctagaccaatcattcaccgtgacctcaaaccaggaaacatcttgcttgaccacaacttcgtcagcaaactcggcgatgttggtctctcaacaatggttaaccaagacgatgtttcatctagaactatcttcaagcaaaccagtcccgtgggcacgctctgttacattgaccctgagtatcagcgaaccgggattatctcacctaaatcggatgtgtactccctcggagttgtgattctgcagctaataaccgcgaaacccgccatagcgattactcatatggtggaagaagctatcggagacgatgctgaatttatggcaatcttggataagaaagctgggtcttggcccatcagtgatactcgtgagttagccgctttgggactgtgttgtacagaaatgagacgcagagacagaccggatcttaaagatcaaatcatcccggctttggaacggctcaggaaagtcgccgacaaagctcaaaacttgctttcgagaactccgtctggtcctccatctcatttcatttgcccacttttgaagggagtaatgaacgagccgtgcgtggctgcggatgggtacacgtacgatcgggaagctatagaggaatggctgagacagaaagatacatcaccggtgacgaatcttccattgcctaacaagaaccttattgctaattacactctttactcagcaatcatggagtggaaatctaataaacggtag

SEQ ID NO: 216 - protein, 845 aa, Arabidopsis thaliana
MEEKKVVRALSEHLSLPPPPSPSVAVAINGKKKSKYVVFWALEKFIPEGFTDFKLLYVRPPVSYIPTPMGIAVAVSELREDVVSAYKQELDWSANEMLRPYKKMFERRKVQVEVLLLDSLEPAAAIAEEIAGTGVTKLVIGMSLRGFFSRKIDMSSLIATAVPRFCTVYVISKGKLASVRPSESDASGSIRFERSSSTSGSTDSPRLPPEYQDFLSAVSEAQSRVSPFSPALKHSMGSNAVAQMDTSSSGTDQEEVSTGRGMEIVHSGIEGKKNKDESFSASFPMGTEAYNSMSWTSKWRDHEDRREMRSSSSSNNHDLVNMDWGAVVPENYSWVSHTASHMSDGLLSVHSITDNQVNLNFEIEKLRAELKHVQEMYAMAQTETVGASKKLTELNQRRFEESEKLVELKEKEEVAKDTASKEKQRYEEAMKEAEKVKELMMKEALHRREAEFKAERDAREKDKLQASLVSPGVQYQHYTWEEIAAATSDFAENLKIGIGAYGSVYKCNLHHTTGAVKVLHAGETQLSKQFDQELEILSKIRHPHLVLLLGACPERGCLVYEYMDNGSLDDRLMLVNDTPPIPWFERFRIALEVASALVFLHKSKPRPIIHRDLKPGNILLDHNFVSKLGDVGLSTMVNQDDVSSRTIFKQTSPVGTLCYIDPEYQRTGIISPKSDVYSLGVVILQLITAKPAIAITHMVEEAIGDDAEFMAILDKKAGSWPISDTRELAALGLCCTEMRRRDRPDLKDQIIPALERLRKVADKAQNLLSRTPSGPPSHFICPLLKGVMNEPCVAADGYTYDREAIEEWLRQKDTSPVTNLPLPNKNLIANYTLYSAIMEWKSNKR

SEQ ID NO: 217 - DNA, 891 bp, Arabidopsis thaliana
atgaacaagaaacttctcaaccctcttgaagatccaccaaccgcttcttcaagcgaagacgtcgacgaagagatttcatcaggagaagatgaaaaagaacatatctccaattcttcttcttctgaagaagaaaacgaactcaaagatctctccactcaaaccctaaattctccttccaccgaggctccaactctcgattctggatctgagacaaattccgactcagataagccaatcgtcttaaccagtcagaagaagaaagaaggtactgattcatcagggacgaagcgagctagtgaaggaactagctcaaaggacatcaaaagagctaagaaagtttcaggagatgacgataacaaaaaatttcagagtttatggactaaagaagatgagatctctctgttacaaggtatgattgatttcaaagctgagacaggtacaagtgctcatgatgatatgaatgggttttttgatattgctaagagatacataagctttgatgttagtaagatccaattcggtgacaagattagaggtttaaagaagaagtattttggtgtaaggaagaagaaaggtttagacttggatcatgataagaaatgtttgggattggctaagtctatttggggacttgatggtaaggaagtggtggttcttggaggagattcggagacgtcgaattggtttgagaagtcgtttttggttcgggttgttgcgaggcttggtgtggatgagtgtattgtgaagtggaaatggagtaaggtgtctaaggagactaagaagaggattgaagagaagatgaagatggtggaggctaaggaacttgagttgttgtcgcagaagatagatgttttgaaggaggtggcttctgtgattgctgaaactatctaa

SEQ ID NO: 218 - protein, 296 aa, Arabidopsis thaliana
MNKKLLNPLEDPPTASSSEDVDEEISSGEDEKEHISNSSSSEEENELKDLSTQTLNSPSTEAPTLDSGSETNSDSDKPIVLTSQKKKEGTDSSGTKRASEGTSSKDIKRAKKVSGDDDNKKFQSLWTKEDEISLLQGMIDFKAETGTSAHDDMNGFFDIAKRYISFDVSKIQFGDKIRGLKKKYFGVRKKKGLDLDHDKKCLGLAKSIWGLDGKEVVVLGGDSETSNWFEKSFLVRVVARLGVDECIVKWKWSKVSKETKKRIEEKMKMVEAKELELLSQKIDVLKEVASVIAETI

SEQ ID NO: 219 - DNA, 1113 bp, Arabidopsis thaliana
atggttaaaccctgttggagaataggtgccggtatggagagaagtaagatcaatcccacaaaggttgatggtttgacatggtacaaagatcttggtcttcacacctttggagagttttccatggcaatgatccaagccaacagtgtgatggaggatcagtgccagatcgaatcagggccgcttacattcaacaatccgacagttcaaggcacatttgttggagtttacgatggccatggaggtccagaggcttccagattcattgcagacaacatcttccccaagttaaagaagtttgcgtccgagggtagggagatttcagagcaggtgatcagcaaagcatttgccgagacagacaaagattttctcaagacagtgacgaagcaatggcctacgaacccacagatggcatcagtggggtcatgttgcttggcaggagtgatatgcaacggattggtgtatattgcaaacacgggagattccagagctgtgttgggcagatctgagagaggtggagtgagagctgttcagttatctgtagagcacaatgccaatcttgagtctgcgaggcaagagctatggtcattgcatcctaatgaccccaccattcttgtgatgaagcaccgcttgtggcgtgtgaaaggcgttatccaggtcacaagatccataggtgatgcatacctcaaaagagcagagttcaacagagaacctttgctgcccaaattcagactaccagaacatttcactaagccaatccttagtgcggatccatcagtcaccattacgcggcttagcccacaagatgagtttataattcttgcttcagatgggctttgggagcatcttagcaaccaggaagctgttgatattgtgcataattcccctcgacaaggaatagcaaggagactacttaaagctgcattgaaggaagcagcaaagaaaagagagatgagatactcagacctaacagagatccatcctggtgtaagaaggcatttccacgacgatataaccgttattgtggtctatctcaacccccacccggtcaaaaccaattcttgggcttcacctctgtcaattagagggggatacccgatgcattcaacatcatga

SEQ ID NO: 220 - protein, 370 aa, Arabidopsis thaliana
MVKPCWRIGAGMERSKINPTKVDGLTWYKDLGLHTFGEFSMAMIQANSVMEDQCQIESGPLTFNNPTVQGTFVGVYDGHGGPEASRFIADNIFPKLKKFASEGREISEQVISKAFAETDKDFLKTVTKQWPTNPQMASVGSCCLAGVICNGLVYIANTGDSRAVLGRSERGGVRAVQLSVEHNANLESARQELWSLHPNDPTILVMKHRLWRVKGVIQVTRSIGDAYLKRAEFNREPLLPKFRLPEHFTKPILSADPSVTITRLSPQDEFIILASDGLWEHLSNQEAVDIVHNSPRQGIARRLLKAALKEAAKKREMRYSDLTEIHPGVRRHFHDDITVIVVYLNPHPVKTNSWASPLSIRGGYPMHSTS

SEQ ID NO: 221 - DNA, 879 bp, Arabidopsis thaliana
atggctggtcttgatctaggcacagcttttcgttacgttaatcaccagctccatcgtcccgatctccaccttcaccacaattcctcctccgatgacgtcactcccggagccgggatgggtcatttcaccgtcgacgacgaagacaacaacaacaaccatcaaggtcttgacttagcctctggtggaggatcaggaagctctggaggaggaggaggtcacggcgggggaggagacgtcgttggtcgtcgtccacgtggcagaccaccgggatccaagaacaaaccgaaacctccggtaattatcacgcgcgagagcgcaaacactctaagagctcacattcttgaagtaacaaacggctgcgatgttttcgactgcgttgcgacttatgctcgtcggagacagcgagggatctgcgttctgagcggtagcggaacggtcacgaacgtcagcatacgtcagccatctgcggctggagcggttgtgacgctacaaggaacgttcgagattctttctctctccggatcgtttcttcctcctccggcacctcccggagcaacgagtttgacaattttcttagccggaggacaaggtcaggtggttggaggaagcgttgtgggtgagcttacggcggctggaccggtgattgtgattgcagcttcgtttactaatgttgcttatgagagacttcctttagaagaagatgagcagcagcaacagcttggaggaggatctaacggcggaggtaatttgtttccggaggtggcagctggaggaggaggaggacttccgttctttaatttaccgatgaatatgcaaccaaatgtgcaacttccggtggaaggttggccggggaattccggtggaagaggtcctttctga

SEQ ID NO: 222 - protein, 292 aa, Arabidopsis thaliana
MAGLDLGTAFRYVNHQLHRPDLHLHHNSSSDDVTPGAGMGHFTVDDEDNNNNHQGLDLASGGGSGSSGGGGGHGGGGDVVGRRPRGRPPGSKNKPKPPVIITRESANTLRAHILEVTNGCDVFDCVATYARRRQRGICVLSGSGTVTNVSIRQPSAAGAVVTLQGTFEILSLSGSFLPPPAPPGATSLTIFLAGGQGQVVGGSVVGELTAAGPVIVIAASFTNVAYERLPLEEDEQQQQLGGGSNGGGNLFPEVAAGGGGGLPFFNLPMNMQPNVQLPVEGWPGNSGGRGPF

SEQ ID NO: 223 - DNA, 1281 bp, Arabidopsis thaliana
atgcagaatcaaaggcttattaagcagcaacaacaacaacaacaacagcaacatcaacaagctatgattcaacaagctatgatgcaacaacatccttctctttatcatcctggtgttatggctcctcctcagatggagcctttaccaagtggaaaccttcctcctggttttgatccaactacttgccgtagtgtgtatgctggaaacattcatacgcaggtcacagagattcttcttcaagagatttttgcaagtactggtcctattgaaagctgtaaactcatcagaaaggataagtcatcatatggatttgttcactactttgatcgaagatgtgctagtatggctataatgactcttaacggaaggcatatatttggacagcctatgaaagttaattgggcgtatgcaactggtcaaagggaagatacatcaagtcatttcaacatttttgttggagatcttagtccagaggttactgatgcagcattgtttgatagcttttctgcttttaacagctgctcggacgcaagagtaatgtgggaccagaaaactggacgctcaagaggctttggttttgtttccttccgtaatcagcaggatgctcaaactgccataaatgagatgaatggtaaatgggtaagtagcagacagatcagatgcaactgggcgacaaaaggtgctacttttggcgaggacaaacatagctctgatggaaaaagtgttgtagaacttactaacggatcttcagaggatggtagagagctgtcaaatgaagatgcccctgaaaacaatcctcaatttacaactgtctatgtaggaaatctctctccagaagtaactcagcttgatctacaccgtctattctatacccttggtgctggagtgatcgaagaggtccgtgtccagcgagacaaagggtttggttttgtgagatataacactcatgacgaggctgctcttgctattcagatgggcaacgctcagcctttcctctttagcagacagataaggtgttcctggggaaacaaaccaactccatcaggcacagcctcaaacccacttcccccaccagccccggcatcagtcccttctctgtctgcaatggacctcttagcctacgagaggcaactggctctagccaagatgcatcctcaggctcaacattctctgaggcaagcaggtcttggagtcaatgttgctggaggaactgcagctatgtatgatggtggctatcagaatgtagctgcggcccatcagcagctcatgtactatcagtaa

SEQ ID NO: 224 - protein, 426 aa, Arabidopsis thaliana
MQNQRLIKQQQQQQQQQHQQAMIQQAMMQQHPSLYHPGVMAPPQMEPLPSGNLPPGFDPTTCRSVYAGNIHTQVTEILLQEIFASTGPIESCKLIRKDKSSYGFVHYFDRRCASMAIMTLNGRHIFGQPMKVNWAYATGQREDTSSHFNIFVGDLSPEVTDAALFDSFSAFNSCSDARVMWDQKTGRSRGFGFVSFRNQQDAQTAINEMNGKWVSSRQIRCNWATKGATFGEDKHSSDGKSVVELTNGSSEDGRELSNEDAPENNPQFTTVYVGNLSPEVTQLDLHRLFYTLGAGVIEEVRVQRDKGFGFVRYNTHDEAALAIQMGNAQPFLFSRQIRCSWGNKPTPSGTASNPLPPPAPASVPSLSAMDLLAYERQLALAKMHPQAQHSLRQAGLGVNVAGGTAAMYDGGYQNVAAAHQQLMYYQ

SEQ ID NO: 225 - DNA, 999 bp, Arabidopsis thaliana
atgggttttataactcgatttttagttttcatgtcactcttcaccagtttggtttctggatttgctctacaaaagcttcctcttatacagttcgacgaaggttacacacagctctttggtgaccagaatcttattgttcacagagatggaaaatctgtccggttaacgcttgatgaaagaaccggttctggatttgtctcaaatgatatttacttgcatggcttcttcagttcctctatcaaattgccagcagattactctgcaggagttgttatcgccttttatttatcaaatggggacttatatgagaagaatcatgacgagattgattttgagtttttggggaatattagaggcagagaatggaggattcagaccaatatatacggtaatggaagcacacacttgggcagagaagaaagatacaatctttggtttgatccaacagaggatttccatcaatacagtatcctttggtctctatctcacatcatattttatgtagacaatgttccgatcagagaagtcaaacgtacggcgtcgatgggcggtgacttcccggcgaagccaatgtctttatattcaaccatatgggatggttccaaatgggcgactgatggaggcaagtacggtgtaaattacaaatatgccccttacgtctctcaattcactgatctgatcctccacggctgcgccgttgaccccaccgagaagtttccgagctgcaaagatgaagcggttcagaatctccggctagcatcggagataacggagtctcagaggaacaagatggagattttccgacagaaacacatgacttattcgtattgttacgatcatatgaggtacaaggtggttttgtcggagtgtgttgtgaatccggctgaggctaagcgtctcagggtctatgatccggtcacgttcggtgggattcctcacggccaccgtcgtgggaagcatcggagcaggagccgattagctcgaactgagtcgatatga

SEQ ID NO: 226 - protein, 332 aa, Arabidopsis thaliana
MGFITRFLVFMSLFTSLVSGFALQKLPLIQFDEGYTQLFGDQNLIVHRDGKSVRLTLDERTGSGFVSNDIYLHGFFSSSIKLPADYSAGVVIAFYLSNGDLYEKNHDEIDFEFLGNIRGREWRIQTNIYGNGSTHLGREERYNLWFDPTEDFHQYSILWSLSHIIFYVDNVPIREVKRTASMGGDFPAKPMSLYSTIWDGSKWATDGGKYGVNYKYAPYVSQFTDLILHGCAVDPTEKFPSCKDEAVQNLRLASEITESQRNKMEIFRQKHMTYSYCYDHMRYKVVLSECVVNPAEAKRLRVYDPVTFGGIPHGHRRGKHRSRSRLARTESI

SEQ ID NO: 227 - DNA, 1065 bp, Arabidopsis thaliana
atgtttgggtcaagaggtctctgttgcagcagaatctggaatcgttctctgtttctcaaacgttcttcaaacttccgagctagtttctctacgaaacgtgttgggacccataatggaacattccactgcgacgaagctttagcttgcttcatccttcgtcgttccaatagattctccgatgctcaaatcgtccgaaccagagatcatcaggttttggagaagcttgatgcggcacttgatgttggaggtgtgtatgatcctcagagtgaacgttatgaccatcaccagaaaggatttagtgaagtgtttggccttgggtttaatactaaactcagtagtgctgggcttgtctataagcattatggattggaaataatttccaaggagcttcaacttgagcagagacatcctgatgtgtttcgattgtttctagctgtgtacaaaaacttcattgaggcagtagatgctttagacaatggtatccatcaatatgatactgaccaacctccaagatatgtaaacaatactagcctggggcataggattggaagattgaacttagactggattgaacctgatcagtctagtgccaaagaagatgaagcctttcatcgggcaatggagcttgctggctctgagttcttggagtgtgttcattttcacgcgaaatcgtggttaccagctcggtcaattgttatggagtgtcttgcaaaacggtatgatatagactccagtggagaaattatgaagctcagtaaacaatgcccatggaaactccatatattcgagctcgaggaagaaatgaagattgatcctccaataaaatatgttctttaccaggatgatagaagcgaaaactggagaatacaagcagtttcggtttcaccagagaggtttgagagccgtaaagctttaccattagcatggagaggtttagaaaaggagaagctctcagaggaaagctcaattccacgctgtgtttttgtgcatatgagtggtttcattggtgcaaaccaaacctatgaaggtgccttagcaatggcaagagcttctttgatggcttag

SEQ ID NO: 228 - protein, 354 aa, Arabidopsis thaliana
MFGSRGLCCSRIWNRSLFLKRSSNFRASFSTKRVGTHNGTFHCDEALACFILRRSNRFSDAQIVRTRDHQVLEKLDAALDVGGVYDPQSERYDHHQKGFSEVFGLGFNTKLSSAGLVYKHYGLEIISKELQLEQRHPDVFRLFLAVYKNFIEAVDALDNGIHQYDTDQPPRYVNNTSLGHRIGRLNLDWIEPDQSSAKEDEAFHRAMELAGSEFLECVHFHAKSWLPARSIVMECLAKRYDIDSSGEIMKLSKQCPWKLHIFELEEEMKIDPPIKYVLYQDDRSENWRIQAVSVSPERFESRKALPLAWRGLEKEKLSEESSIPRCVFVHMSGFIGANQTYEGALAMARASLMA

SEQ ID NO: 229 - DNA, 1350 bp, Arabidopsis thaliana
atggccaaagcgccaccgtcaatctctcttctcctcctcctctgcgccgccgtattcctcaccatccccgccgtgatctccgccatcggtgttaactacggaactctcggaaacctcccaccaccgactcaggtggctaactttatcaagacacaaacttcgattgatagcgtcaagatcttcgatgtgaatcccgatatcctacgtgccttcgctggaactggtatctccgtcgttgtcaccgttcctaacggtgatattccggcgttggctaacggaagacaagctcgtcggtgggtttcggttaacattttgccgtttcatcctcagacgaagattaagtatatctcagtcggaaatgagattctgctcaccggagataataacatgatcaataatctcttaccggcgatgaggaatcttaacaacgctttggttcgtgctggtgtcagagatgttaaggttacaaccgcacactcacttaacatcatagcctatgacctgaccggtgcaccaagcagcggtagattcaggccgggttgggacaaaggcatattggctccaatcctagcttaccatcgccgaaccaagtcacctttcatggttaacccgtacccttactttggttttgaccccaaaaacgtcaacttcgcaattttccgaacaccgtacaaggcagtccgtgacccgttcacccgccacgtctacaccaacatgtttgatgcactcatggactcgacatactcagccatgaaagctcttggatacggtgatgttaacattgtcgttggcgagactggctggccatctgcttgtgacgcaccttggtgctcgcctgcgaatgctgcttggttcaacctcaacattatcaaacgtgcacaaggccaagggacacctctcatgcctaacagacggttcgagacatacattttcggtctcttcaacgaagaaggcaaacccggtccgaccgcagagcgtaactggggacttttccgagcagatttctccccggtttacgatgttggtcttctccgaaacggacaaggcggtggaggccgcccagcattgcccgcacctagtactgccggcggtaaatggtgtgtagcgaggtccggggcgacgaatactcagctgcaagacagtattaattgggtgtgtggtcagggtgttgactgtaaaccgatccaagctggtggttcgtgctttaacccgagcagtttgaggacgcacgcatcttttgttatgaatgcttatttccagagccacggccgcactgatggtgcttgtaacttcagtggaactggtatgatcgtagggaacaacccaagcaatggtgcatgtaagtactaa

SEQ ID NO: 230 - protein, 449 aa, Arabidopsis thaliana
MAKAPPSISLLLLLCAAVFLTIPAVISAIGVNYGTLGNLPPPTQVANFIKTQTSIDSVKIFDVNPDILRAFAGTGISVVVTVPNGDIPALANGRQARRWVSVNILPFHPQTKIKYISVGNEILLTGDNNMINNLLPAMRNLNNALVRAGVRDVKVTTAHSLNIIAYDLTGAPSSGRFRPGWDKGILAPILAYHRRTKSPFMVNPYPYFGFDPKNVNFAIFRTPYKAVRDPFTRHVYTNMFDALMDSTYSAMKALGYGDVNIVVGETGWPSACDAPWCSPANAAWFNLNIIKRAQGQGTPLMPNRRFETYIFGLFNEEGKPGPTAERNWGLFRADFSPVYDVGLLRNGQGGGGRPALPAPSTAGGKWCVARSGATNTQLQDSINWVCGQGVDCKPIQAGGSCFNPSSLRTHASFVMNAYFQSHGRTDGACNFSGTGMIVGNNPSNGACKY

SEQ ID NO: 231 - DNA, 219 bp, Arabidopsis thaliana
atggagcttccatctccttacagctcaagaaaggaggaatcaactgttcctccgaagagaggccgagtcaagatcatgatctttcgtgatctagtcagatcggaaacctcgatggcaccgactccgaggagaggccgaatcaagaaaatgatcgcgggtgatctagtcggatcagggaaacagaacaactacgacggagacggtaagagaggaggctag

SEQ ID NO: 232 - protein, 72 aa, Arabidopsis thaliana; identical to SEQ ID NO: 4

SEQ ID NO: 233 - DNA, 564 bp, Arabidopsis thaliana
atgtcttcgccaagcaaacgcagagaaatggatatgatgaagctgatgatgagcgattataaagtggaaacgatcaacgatggcatgcaagaattctatgttgaattcaatggtcccaaagacagtctctatcaaggaggtgtgtggaagataagagttgagcttccagatgcttatccttataaatctccatctgttggtttcattactaaaatttatcatcctaatgttgatgaactgtcgggttctgtttgtttagatgtgattaaccaaacttggagtcctatgttcgaccttgtgaatgtgtttgagacatttcttcctcagcttcttctgtatccaaacccatcagatccattgaatggagaagctgctgcgttaatgatgcgtgatcgtcctgcttatgagcaacgagttaaagaatactgtgagaagtatgcaaagccaggggaaggttcagaagataagtctagcgatgaagaactaagtgaagaggaatacggctcagataatgaggatgatgatgatgatgatgttgcaattgctggcaaaccagatccttga

SEQ ID NO: 234 - protein, 187 aa, Arabidopsis thaliana
MSSPSKRREMDMMKLMMSDYKVETINDGMQEFYVEFNGPKDSLYQGGVWKIRVELPDAYPYKSPSVGFITKIYHPNVDELSGSVCLDVINQTWSPMFDLVNVFETFLPQLLLYPNPSDPLNGEAAALMMRDRPAYEQRVKEYCEKYAKPGEGSEDKSSDEELSEEEYGSDNEDDDDDDVAIAGKPDP

SEQ ID NO: 235 - DNA, 1584 bp, Arabidopsis thaliana
atggagaaattgctcgtgatctctttgctactactgatctcaacatcagttacaacttcacaatccgtgaccgatccaatagctttcctccgatgtctcgatagacaaccaacggacccaacaagtcctaactccgccgttgcttacatcccaacaaactcttctttcaccactgtcctccgcagccgtatacctaacctccgtttcgacaaacccactactccaaaacccatctccgtggtggctgccgccacgtggacacacatacaagctgctgtaggatgcgcacgtgagctctctctccaagtcaggatcagaagtggtggccacgacttcgaaggactctcttacacttccaccgtccctttctttgttctcgacatgttcggttttaaaaccgtggacgtaaatctcaccgagagaacggcttgggttgattctggtgctaccctcggagagctttactatagaatctctgagaagagcaatgttcttggatttccggcgggtttgtctaccacattgggcgttggtggacactttagcggcggaggatacggtaatctgatgagaaagtatggtttgtcggtggataacgttttcggctccgggatcgttgattcgaacggaaatatcttcaccgatcgggtttcgatgggggaagaccgtttttgggcgattcgtggaggtggtgcagcgagctacggtgttgtcctcggctacaagatccagctagtaccggtgcctgagaaagttacggtttttaaagtcggaaaaactgtcggagaaggagccgttgatcttataatgaagtggcagagttttgctcatagtacggatcggaatttgttcgtgaggttaactttgactttagtcaacggtacgaagcctggtgagaatacggttttagcgactttcattgggatgtatttaggccggtcggataagctgttgaccgtgatgaaccgggatttcccggagttgaagctgaagaaaaccgattgtaccgagatgagatggatcgattcggttctgttttgggacgattatccggttggtacaccgacttctgtgctactaaatccgctagtcgcaaaaaagttgttcatgaaacgaaaatcggactacgtgaagcgtctgatttcgagaaccgatctcggtttgatactcaagaaattggtagaggttgagaaagttaaaatgaattggaatccgtatggaggaaggatgggtgagatcccgagttcgaggacaccattcccacatagagcaggcaatttgttcaacattgagtatatcatagactggtcagaagctggagataatgtggagaagaaatatttggcactcgcgaatgaattttatagattcatgaccccgtacgtgtctagtaatccgagggaggcgtttttgaattaccgtgatcttgacatagggtcaagtgttaagtctacgtaccaggaaggtaaaatctacggggctaaatatttcaaggagaatttcgagagattagtggatattaaaaccacgattgatgcggaaaacttttggaaaaacgaacaaagcattccggttagaagataa

SEQ ID NO: 236 - protein, 527 aa, Arabidopsis thaliana
MEKLLVISLLLLISTSVTTSQSVTDPIAFLRCLDRQPTDPTSPNSAVAYIPTNSSFTTVLRSRIPNLRFDKPTTPKPISVVAAATWTHIQAAVGCARELSLQVRIRSGGHDFEGLSYTSTVPFFVLDMFGFKTVDVNLTERTAWVDSGATLGELYYRISEKSNVLGFPAGLSTTLGVGGHFSGGGYGNLMRKYGLSVDNVFGSGIVDSNGNIFTDRVSMGEDRFWAIRGGGAASYGVVLGYKIQLVPVPEKVTVFKVGKTVGEGAVDLIMKWQSFAHSTDRNLFVRLTLTLVNGTKPGENTVLATFIGMYLGRSDKLLTVMNRDFPELKLKKTDCTEMRWIDSVLFWDDYPVGTPTSVLLNPLVAKKLFMKRKSDYVKRLISRTDLGLILKKLVEVEKVKMNWNPYGGRMGEIPSSRTPFPHRAGNLFNIEYIIDWSEAGDNVEKKYLALANEFYRFMTPYVSSNPREAFLNYRDLDIGSSVKSTYQEGKIYGAKYFKENFERLVDIKTTIDAENFWKNEQSIPVRR

SEQ ID NO: 237 - DNA, 4605 bp, Arabidopsis thaliana
atggtggaaaatggggctaaagctgcgaagcgaaagaagagaccacttccagagattcaagaggtagaagatgtacctaggacgaggagaccaaggcgtgctgcagcgtgtaccagtttcaaggagaaatctattcgagtctgtgagaaatctgctactattgaagtaaagaaacagcagattgtggaggaagagtttctcgcgttacggttaacggctctggaaactgatgttgaagatcgtccaaccaggagactgaatgattttgttttgtttgattcagatggagttccacaacctctggagatgttggagattcatgacatattcgtttcaggtgctatcttaccttcagatgtgtgtactgataaggagaaagagaagggtgtgaggtgtacatcgtttggacgggttgagcattggagtatctctggttatgaagatggttcccctgttatttggatctcaacggaattggcggattatgattgtcgtaaacctgctgctagctacaggaaggtttatgattacttctatgagaaagctcgtgcttcagtggctgtgtataagaaattgtccaagtcatctggtggggatcctgatataggtcttgaggagttacttgcggcggttgtcagatcaatgagcagtggaagcaagtacttttctagtggtgcggcaatcatcgattttgttatatcccagggagattttatatataaccaactcgctggtttggatgagacagccaagaaacatgaatcaagctatgttgagattcctgttcttgtagctctcagagagaagagtagtaagattgacaagcctctgcagagggaaagaaacccatctaatggtgtgaggattaaagaagtttctcaagttgcggagagcgaggccttgacatctgatcaactggttgatggtactgatgatgacagaagatatgctatactcttacaagacgaagagaataggaaatctatgcaacagcccagaaaaaacagcagctcaggttctgcttcaaatatgttctacattaagataaatgaagatgagattgccaatgattatcctctcccatcgtactataagacctccgaagaagaaacagatgaacttatactttatgatgcttcctatgaggttcaatctgaacacctgcctcacaggatgcttcacaactgggctctttataactctgatttacgattcatatcactggaacttctaccgatgaaacaatgtgatgatattgatgtcaacatttttgggtcaggtgtggtgactgatgataatggaagttggatttctttaaacgatcctgacagcggttctcagtcacacgatcctgatgggatgtgcatattcctcagtcaaattaaagaatggatgattgagtttgggagcgatgatattatctccatttctatacgaacagatgtggcctggtaccgtcttgggaaaccatcaaaactttatgccccttggtggaaacctgttctgaaaacagcaagggttgggataagcattcttacttttcttagggtggaaagtagggttgctaggctttcatttgcagatgtcacaaaaagactgtctgggttacaggcgaatgataaagcttacatttcttctgaccccttggctgttgagagatatttggtcgtccatgggcaaattattttacagctttttgcagtttatccggacgacaatgtcaaaaggtgtccatttgttgttggtcttgcaagcaaattggaggataggcaccacacaaaatggatcatcaagaagaagaaaatttcgctgaaggaactgaatctgaatccaagggcaggcatggcaccagtagcatcgaagaggaaagctatgcaagcaacaacaactcgcctggtcaacagaatttggggagagttttactccaattactctccagaggatccattgcaggcgactgctgcagaaaatggggaggatgaggtggaagaggaaggcggaaatggggaggaagaggttgaagaggaaggtgaaaatggtctcacagaggacactgtaccagaacctgttgaggttcagaagcctcatactcctaagaaaatccgaggcagttctggaaaaagggaaataaaatgggatggtgagagtctaggaaaaacttctgctggcgagcctctctatcaacaagcccttgttggaggggaaatggtggctgtaggtggcgctgtcaccttggaagttgatgatccagatgaaatgccggccatctattttgtggagtacatgttcgaaagtacagatcactgcaaaatgttacatggtagattcttacaaagaggatctatgactgttctggggaatgctgctaacgagagggaactattcctgactaatgaatgcatgactacacagctcaaggacattaaaggagtagccagttttgagattcgatcaaggccatgggggcatcagtataggaaaaagaacatcactgcggataagcttgactgggctagagcattagaaagaaaagtaaaagatttgccaacagagtattactgcaaaagcttgtactcacctgagagagggggattctttagtcttccactaagtgatattggtcgcagttctgggttctgcacttcatgtaagataagggaggatgaagagaagaggtctacaattaaactaaatgtttcaaagacaggctttttcatcaatgggattgagtattctgttgaggattttgtctatgtcaaccctgactctattggtgggttgaaggagggtagtaaaacttcttttaagtctgggcgaaacattgggttaagagcgtatgttgtttgccaattgctggaaattgttccaaaggaatctagaaaggctgatttgggttcctttgatgttaaagtgagaaggttttataggcctgaggatgtttctgcagagaaggcctatgcttcagacatccaagaattgtatttcagccaggacacagttgttctccctccaggtgctctagagggaaaatgtgaagtaagaaagaaaagtgatatgcccttatcccgtgaatatccaatatcagaccatattttcttctgtgatcttttctttgacacctccaaaggttctctcaagcagctgcccgccaatatgaagccaaagttctctactattaaggacgacacacttttaagaaagaaaaagggaaagggagtagagagtgaaattgagtctgagattgtcaagcctgttgagccacctaaagagattcgtctggctactctagatatttttgctggttgtggtggcctgtctcatggactgaaaaaggcgggtgtatctgatgcaaagtgggcgattgagtatgaagagccagctgggcaggcttttaaacaaaaccatcctgagtcaacagtttttgttgacaactgcaatgtgattcttagggctataatggagaaaggtggagatcaagatgattgtgtctctactacagaggcaaatgaattagcagctaaactaactgaggagcagaagagtactctgccactgcctggtcaagtggacttcatcaatggtggacctccatgtcagggattttctggtatgaacaggttcaaccaaagctcttggagtaaagttcagtgtgaaatgatattagcattcttgtcctttgctgactatttccggccaaggtattttcttctggagaacgtgaggacctttgtgtcattcaataaagggcagacatttcagcttactttggcttcccttctcgaaatgggttaccaggtgagatttggaatcctggaggccggtgcatatggagtatcccaatctcgtaaacgagctttcatttgggctgctgcaccagaagaagttctccctgaatggcctgagccgatgcatgtctttggtgttccaaagttgaaaatctcactatctcaaggtttacattatgctgctgttcgtagtactgcacttggtgcccctttccgtccaatcaccgtgagagacacaattggtgatcttccatcagtagaaaacggagactctaggacaaacaaagagtataaagaggttgcagtctcgtggttccaaaaggagataagaggaaacacgattgctctcactgatcatatctgcaaggctatgaatgagcttaacctcattcgatgcaaattaatcccaactaggcctggggctgattggcatgacttgccaaagagaaaggttacgttatctgatgggcgcgtagaagaaatgattcctttttgtctcccaaacacagctgagcgccacaacggttggaagggactatatgggagattagattggcaaggaaactttccgacttccgtcacggatcctcagcccatgggtaaggttggaatgtgctttcatcctgaacagcacagaatccttacagtccgtgaatgcgcccgatctcaggggtttccggatagctacgagtttgcagggaacataaatcacaagcacaggcagattgggaatgcagtccctccaccattggcatttgctctaggtcgtaagctcaaagaagccctacatctcaagaagtctcctcaacaccaaccctag

SEQ ID NO: 238 - protein, 1534 aa, Arabidopsis thaliana
MVENGAKAAKRKKRPLPEIQEVEDVPRTRRPRRAAACTSFKEKSIRVCEKSATIEVKKQQIVEEEFLALRLTALETDVEDRPTRRLNDFVLFDSDGVPQPLEMLEIHDIFVSGAILPSDVCTDKEKEKGVRCTSFGRVEHWSISGYEDGSPVIWISTELADYDCRKPAASYRKVYDYFYEKARASVAVYKKLSKSSGGDPDIGLEELLAAVVRSMSSGSKYFSSGAAIIDFVISQGDFIYNQLAGLDETAKKHESSYVEIPVLVALREKSSKIDKPLQRERNPSNGVRIKEVSQVAESEALTSDQLVDGTDDDRRYAILLQDEENRKSMQQPRKNSSSGSASNMFYIKINEDEIANDYPLPSYYKTSEEETDELILYDASYEVQSEHLPHRMLHNWALYNSDLRFISLELLPMKQCDDIDVNIFGSGVVTDDNGSWISLNDPDSGSQSHDPDGMCIFLSQIKEWMIEFGSDDIISISIRTDVAWYRLGKPSKLYAPWWKPVLKTARVGISILTFLRVESRVARLSFADVTKRLSGLQANDKAYISSDPLAVERYLVVHGQIILQLFAVYPDDNVKRCPFVVGLASKLEDRHHTKWIIKKKKISLKELNLNPRAGMAPVASKRKAMQATTTRLVNRIWGEFYSNYSPEDPLQATAAENGEDEVEEEGGNGEEEVEEEGENGLTEDTVPEPVEVQKPHTPKKIRGSSGKREIKWDGESLGKTSAGEPLYQQALVGGEMVAVGGAVTLEVDDPDEMPAIYFVEYMFESTDHCKMLHGRFLQRGSMTVLGNAANERELFLTNECMTTQLKDIKGVASFEIRSRPWGHQYRKKNITADKLDWARALERKVKDLPTEYYCKSLYSPERGGFFSLPLSDIGRSSGFCTSCKIREDEEKRSTIKLNVSKTGFFINGIEYSVEDFVYVNPDSIGGLKEGSKTSFKSGRNIGLRAYVVCQLLEIVPKESRKADLGSFDVKVRRFYRPEDVSAEKAYASDIQELYFSQDTVVLPPGALEGKCEVRKKSDMPLSREYPISDHIFFCDLFFDTSKGSLKQLPANMKPKFSTIKDDTLLRKKKGKGVESEIESEIVKPVEPPKEIRLATLDIFAGCGGLSHGLKKAGVSDAKWAIEYEEPAGQAFKQNHPESTVFVDNCNVILRAIMEKGGDQDDCVSTTEANELAAKLTEEQKSTLPLPGQVDFINGGPPCQGFSGMNRFNQSSWSKVQCEMILAFLSFADYFRPRYFLLENVRTFVSFNKGQTFQLTLASLLEMGYQVRFGILEAGAYGVSQSRKRAFIWAAAPEEVLPEWPEPMHVFGVPKLKISLSQGLHYAAVRSTALGAPFRPITVRDTIGDLPSVENGDSRTNKEYKEVAVSWFQKEIRGNTIALTDHICKAMNELNLIRCKLIPTRPGADWHDLPKRKVTLSDGRVEEMIPFCLPNTAERHNGWKGLYGRLDWQGNFPTSVTDPQPMGKVGMCFHPEQHRILTVRECARSQGFPDSYEFAGNINHKHRQIGNAVPPPLAFALGRKLKEALHLKKSPQHQP

SEQ ID NO: 239 - DNA, 762 bp, Arabidopsis thaliana
atgaagaaggttacatcgtctaagattccggccaaggatgattgggtggctgtagcgataactgacgacgatttggtcgttgagcttcttttacggctgaagcatgccggaacggtagtgtcggataatccggcggtgattctccctccgttgcggtggggaatccgtcaacgacggtctcgttcctcaagatttggtggcggcggcggcgttctcgtttccttgaagaaagatgtcgattccgttagagccagtccgaagactcctctctcgtggagcggcggatctggaagtggtggcggctctgcttctccttccgccgatggattcgaggataacagtcgccaagctagctgctctacatctacaggatctggatctaaggtttttcccacaaacgaaatcaccagttgtttctccaagagattgaagaagaggaagtcatcttttgagcttaaaaatgaagagaacttgaagttgaaggagagacttgaccttgaaaaggagattgcaagtctccgagcaacattcgatgaacaaaaccttaggaaccaaaagctgaagaggattaagcttgacttaaactcaggccgtgtcacaaacaagaaacctgttgatttgattcgtaaatcacaactcgagcggctacagggatcaaaatcttgcaaaaccagtgactcgcaaaatcaggggagtttcttcgtcctccctgatctcaacatggcgccatccgaggaagagatattgtacggaactagctaa

SEQ ID NO: 240 - protein, 253 aa, Arabidopsis thaliana
MKKVTSSKIPAKDDWVAVAITDDDLVVELLLRLKHAGTVVSDNPAVILPPLRWGIRQRRSRSSRFGGGGGVLVSLKKDVDSVRASPKTPLSWSGGSGSGGGSASPSADGFEDNSRQASCSTSTGSGSKVFPTNEITSCFSKRLKKRKSSFELKNEENLKLKERLDLEKEIASLRATFDEQNLRNQKLKRIKLDLNSGRVTNKKPVDLIRKSQLERLQGSKSCKTSDSQNQGSFFVLPDLNMAPSEEEILYGTS

SEQ ID NO: 241 - DNA, 870 bp, Arabidopsis thaliana
atggggaaatacataagaaagagcaaaatcgacggagctggagctggagctggtggtggaggtggaggcggaggtggaggtgaatcctctattgctttaatggatgttgtttcaccttcttcctcttcttcacttggtgttttaactcgagctaaatctctagctcttcaacaacaacaacaacgctgtcttcttcaaaaaccctcttctccttcttcgttaccaccgacttctgcttctcctaatccaccgtcaaagcagaagatgaagaagaagcagcagcagatgaacgattgtggttcgtatcttcagctacggagtcgtcggcttcagaagaaaccaccaattgttgtgattcgttctactaaacggaggaaacagcaacggaggaatgagacatgcggaagaaaccctaaccctaggagtaatttggattcgattcgtggtgatgggtctaggtctgattctgtttctgaaagtgttgtctttggtaaagacaaggatttgatttctgaaatcaataaagatccaacctttggccaaaatttcttcgaccttgaagaagaacacactcaaagcttcaacaggaccacaagggaatccacaccatgcagtttgataagaaggcctgaaatcatgacaaccccgggatcgtctacaaagcttaacatttgtgtaagtgaaagcaaccagagagaagacagtttgtcacgcagccatcgtcgccgaccaactacacctgaaatggacgagtttttctcgggtgctgaagaagaacaacagaagcaattcattgagaagtacaactttgatcctgtgaacgaacaaccactaccaggacggtttgaatggacgaaggtagatgattag

SEQ ID NO: 242 - protein, 289 aa, Arabidopsis thaliana
MGKYIRKSKIDGAGAGAGGGGGGGGGGESSIALMDVVSPSSSSSLGVLTRAKSLALQQQQQRCLLQKPSSPSSLPPTSASPNPPSKQKMKKKQQQMNDCGSYLQLRSRRLQKKPPIVVIRSTKRRKQQRRNETCGRNPNPRSNLDSIRGDGSRSDSVSESVVFGKDKDLISEINKDPTFGQNFFDLEEEHTQSFNRTTRESTPCSLIRRPEIMTTPGSSTKLNICVSESNQREDSLSRSHRRRPTTPEMDEFFSGAEEEQQKQFIEKYNFDPVNEQPLPGRFEWTKVDD

SEQ ID NO: 243 - DNA, 1410 bp, Arabidopsis thaliana
atgtctgaagaagtacctcaacaattcccatcttctaagcggcagcttcatccttctctttcttctatgaagcctcctctagttgctcctggtgagtatcaccggtttgatgcggcggagactcgcggtggtggagctgttgctgatcaggttgtctctgacgcgattgtgatcaaatctactctgaagcgtaagacagatttggtaaaccaaatagttgaggtcaatgaattgaataccggtgttcttcaaacacctgtatcagggaaaggggggaaagccaagaaaacttctaggtctgcgaagtctaataagtctggaacgctagcttctggctctaatgcaggttctcctggaaataactttgcacaggccggtacttgtcgatatgatagttcgttaggtcttttgacaaagaaatttatcaatttgataaaacaagcagaggatggtattcttgatctaaacaaagcagctgatactttagaggtacaaaagagaaggatatatgatataaccaatgtgttagaaggaataggtttgatagagaagacgcttaagaacaggattcagtggaagggtctcgatgtctcaaaaccaggagaaacaatcgaaagcatagctaacctacaggatgaagtacaaaacctcgcagctgaggaggcaagattagatgaccaaatcagagaatcacaagaaagattaacaagcttgagtgaggatgaaaacaacaaaaggttactgttcgtcactgaaaacgacattaagaacctaccatgcttccagaataagacgctgatagctgtaaaggcaccgcatggaacaactcttgaggttccagatcctgatgaggctggtggttatcagaggaggtacagaatcattctgagaagcacaatgggaccaatagacgtgtacctagtcagtcaattcgaagagagctttgaggacattcctcaggctgatgaaccttcaaatgttcctgatgaaccctctaatgtccctgatgtaccttcaaatcttccatcaacatctggtctccctgagaaccatgatgtatctatgccgatgaaagaggaaagcaccgaaagaaacatggaaacacaggaagttgatgatacgcaaagagtttactctgacatcgaatctcatgactttgtcgatggtatcatgaagattgttcctccagatttggatatgggtgtagattactggtttcgatcagaggtaggcgaagtcagcatcacagacatgtggccagatgaatctggaccagactggaaccagatgattacatttgatcaagaccacgctggaccgagcgacaacaaaatcttggagcagccacaaactccatcgagcccaacaccagaagaatccactgctacgagatcacctacaggtagctga

SEQ ID NO: 244 - protein, 469 aa, Arabidopsis thaliana
MSEEVPQQFPSSKRQLHPSLSSMKPPLVAPGEYHRFDAAETRGGGAVADQVVSDAIVIKSTLKRKTDLVNQIVEVNELNTGVLQTPVSGKGGKAKKTSRSAKSNKSGTLASGSNAGSPGNNFAQAGTCRYDSSLGLLTKKFINLIKQAEDGILDLNKAADTLEVQKRRIYDITNVLEGIGLIEKTLKNRIQWKGLDVSKPGETIESIANLQDEVQNLAAEEARLDDQIRESQERLTSLSEDENNKRLLFVTENDIKNLPCFQNKTLIAVKAPHGTTLEVPDPDEAGGYQRRYRIILRSTMGPIDVYLVSQFEESFEDIPQADEPSNVPDEPSNVPDVPSNLPSTSGLPENHDVSMPMKEESTERNMETQEVDDTQRVYSDIESHDFVDGIMKIVPPDLDMGVDYWFRSEVGEVSITDMWPDESGPDWNQMITFDQDHAGPSDNKILEQPQTPSSPTPEESTATRSPTGS

SEQ ID NO: 245 - DNA, 669 bp, Arabidopsis thaliana
atggggaaatacatgaagaaatcaaagataactggcgatatcagcgtcatggaagtctctaaagcaacagctccaagtccaggtgttcgaaccagagccgctaaaaccctagccttgaagcggcttaattcctccgccgctgattcagctctacctaacgactcttcttgctatcttcagctccgtagccgccgtctcgagaaaccctcttcgctgattgaaccgaaacagccgccgagagttcacagatcgggaattaaagagtctggttccaggtctcgcgttgactcggttaactcggttcctgtagctcagagctctaatgaagatgaatgttttgacaatttcgtgagtgtccaagtttcttgtggtgaaaacagtctcggttttgaatcaagacacagcacaagggagagcacgccttgtaactttgttgaggatatggagatcatggttacaccagggtctagcacgaggtcgatgtgcagagcaaccaaagagtacacaagggaacaagataacgtgatcccgaccactagtgaaatggaggagttctttgcatatgcagagcagcagcaacagaggctattcatggagaagtacaacttcgacattgtgaatgatatccccctcagcggacgttacgaatgggtgcaagtcaaaccatga

SEQ ID NO: 246 - protein, 222 aa, Arabidopsis thaliana
MGKYMKKSKITGDISVMEVSKATAPSPGVRTRAAKTLALKRLNSSAADSALPNDSSCYLQLRSRRLEKPSSLIEPKQPPRVHRSGIKESGSRSRVDSVNSVPVAQSSNEDECFDNFVSVQVSCGENSLGFESRHSTRESTPCNFVEDMEIMVTPGSSTRSMCRATKEYTREQDNVIPTTSEMEEFFAYAEQQQQRLFMEKYNFDIVNDIPLSGRYEWVQVKP

SEQ ID NO: 247 - DNA, 1458 bp, Arabidopsis thaliana
atgtccggtgtcgtacgatcttctcccggttcttctcagccgccaccgccgccgccgcaccatccaccgtcatctccggttccggttacatctacgccggttataccacctatacgtcgtcacttagctttcgcctcaacaaaacctccgtttcatccttccgatgattaccatcgatttaacccttcttcgctcagtaataataacgacaggagcttcgttcatggttgtggtgttgtagatcgggaggaagatgctgtcgttgttagatctccttcacgaaagagaaaggcgacaatggatatggttgttgctccatctaataatggattcacgagttctggtttcactaacatacctagcagtccctgtcaaactcctagaaaagggggcagagtcaacatcaagtcaaaggccaaaggaaacaagtcaactcctcaaacacccatctcgacaaacgctggttctcctatcacacttactccatcaggaagttgtcgttatgacagttctttaggtctccttacaaaaaagttcgtcaatctaattaaacaagccaaagatggaatgctggacctaaacaaagctgcagaaacattggaggtgcagaaacgacgtatatatgatattacaaacgttttggaggggatagatctcattgaaaagcctttcaagaatcgaatactttggaagggagttgatgcgtgtcctggcgatgaggatgctgacgtatctgtattacagctgcaggcagaaattgaaaacctcgccctcgaagagcaagcattagacaaccaaatcagacaaacagaggaaagattaagagacctgagcgaaaatgaaaagaatcagaaatggctttttgtaactgaagaggatatcaagagtttaccaggtttccagaaccagactctgatagccgtcaaagctcctcatggcacaactttggaagtgcctgatccagatgaagcggctgaccacccacaaaggagatacaggatcattcttagaagtacaatgggacctattgacgtatacctcgtcagcgaatttgaagggaaattcgaagacacaaatgggagtggtgcagcaccaccagcatgcttgcctattgcttctagctcaggatctacaggacaccatgacatcgaagccttaactgttgacaacccagaaactgctattgtgtctcatgatcatcctcatcctcaacccggcgatacctctgatcttaattatttgcaagagcaagtaggaggaatgcttaagattactccctctgatgttgaaaatgatgagtcggactactggcttctctcaaatgctgagattagcatgacggatatttggaaaactgactctggtatcgattgggattatggaatagccgacgtgagtactccaccaccaggaatgggcgaaatagcaccaacagctgttgactcaaccccgagatga

SEQ ID NO: 248 - protein, 485 aa, Arabidopsis thaliana
MSGVVRSSPGSSQPPPPPPHHPPSSPVPVTSTPVIPPIRRHLAFASTKPPFHPSDDYHRFNPSSLSNNNDRSFVHGCGVVDREEDAVVVRSPSRKRKATMDMVVAPSNNGFTSSGFTNIPSSPCQTPRKGGRVNIKSKAKGNKSTPQTPISTNAGSPITLTPSGSCRYDSSLGLLTKKFVNLIKQAKDGMLDLNKAAETLEVQKRRIYDITNVLEGIDLIEKPFKNRILWKGVDACPGDEDADVSVLQLQAEIENLALEEQALDNQIRQTEERLRDLSENEKNQKWLFVTEEDIKSLPGFQNQTLIAVKAPHGTTLEVPDPDEAADHPQRRYRIILRSTMGPIDVYLVSEFEGKFEDTNGSGAAPPACLPIASSSGSTGHHDIEALTVDNPETAIVSHDHPHPQPGDTSDLNYLQEQVGGMLKITPSDVENDESDYWLLSNAEISMTDIWKTDSGIDWDYGIADVSTPPPGMGEIAPTAVDSTPR

SEQ ID NO: 249 - DNA, 930 bp, Arabidopsis thaliana
atggagaagtacgagaagctagagaaggtcggagaaggaacatacgggaaagtctacaaagcgatggagaaaggaactggtaagcttgttgctctgaagaaaactcgtctcgagatggacgaagaaggtattccaccaactgctcttcgtgagatctcgcttctccagatgttatcaacatcgatctatgttgttcgattactctgcgtcgaacatgttcatcaaccatcaaccaaatctcaatctaccaaatccaatctctatctcgttttcgagtatctcgatactgatcttaagaaattcatcgattcgtataggaaaggacctaatcctaagcctcttgagccttttttgattcagaagttgatgtttcagctttgtaaaggtgttgcgcattgtcatagtcatggtgtgcttcaccgtgatcttaaaccgcagaatcttcttctggtgaaagataaagagcttcttaagattgctgatttgggtcttggtcgtgcttttactgttcctcttaagtcttatacgcatgagattgttactctttggtatagagctcctgaagttcttcttggatctactcattattcaactggtgttgacatgtggtctgttggttgtatctttgctgagatggttcggaggcaagctcttttccctggtgattctgagtttcagcaattgcttcatatcttcaggttgctaggaacaccaactgagcagcaatggccgggtgtttccacactgcgtgactggcatgtttaccctaagtgggagccgcaagacttaactcttgctgttccttctctttcacctcaaggagttgatcttctcacgaaaatgctcaagtacaatccagccgaaagaatttcagcaaaaacagcacttgatcacccatattttgacagccttgacaagtctcagttctga

SEQ ID NO: 250 - protein, 309 aa, Arabidopsis thaliana
MEKYEKLEKVGEGTYGKVYKAMEKGTGKLVALKKTRLEMDEEGIPPTALREISLLQMLSTSIYVVRLLCVEHVHQPSTKSQSTKSNLYLVFEYLDTDLKKFIDSYRKGPNPKPLEPFLIQKLMFQLCKGVAHCHSHGVLHRDLKPQNLLLVKDKELLKIADLGLGRAFTVPLKSYTHEIVTLWYRAPEVLLGSTHYSTGVDMWSVGCIFAEMVRRQALFPGDSEFQQLLHIFRLLGTPTEQQWPGVSTLRDWHVYPKWEPQDLTLAVPSLSPQGVDLLTKMLKYNPAERISAKTALDHPYFDSLDKSQF

SEQ ID NO: 251 - DNA, 1542 bp, Arabidopsis thaliana
atggcggagaaggaagaaaaagaaccatcgaagttaaaatcatccaccggagtttcacggccaacgatttcactacctcctcgaccgtttggtgaaatgttttttagcggtggcgttggatttagtcctggaccaatgactctcgtctcaaatttattctctgatcctgatgagttcaagtctttctctcagcttttagctggagctatggcttctccggcggcagctgctgttgccgccgctgctgtggttgctactgctcatcatcagacacctgtgagctctgtcggtgatggcggtggaagcggtggtgatgttgacccgaggtttaagcagagtagaccaacgggattgatgataactcaaccaccggggatgtttactgtaccgccggggttaagtccggctactcttttggattctccgagcttctttggtcttttttcacctcttcagggaacatttggtatgacacatcaacaagctttagcacaagtcactgcacaagcagttcaaggcaataatgttcatatgcagcaatcacaacaatctgaatatccttcttctacacaacaacaacaacaacaacaacaacaagcttcattgactgagattccatcattttcttctgcacctaggtctcagattcgagcctcggttcaagaaacatcgcagggtcagagagagacttcggaaatatctgtctttgagcatcggtcacagcctcaaaatgctgacaaaccagctgatgatggatacaactggcggaaatatgggcagaagcaagtgaaggggagcgattttcctcggagttattacaaatgtacgcatccagcttgtcctgtcaagaagaaagtggagaggtcactcgatggacaagtaacggaaatcatctacaagggtcaacacaatcatgagcttcctcaaaagcgcggtaacaataacgggagttgtaaaagttctgatattgcaaatcagtttcaaacaagtaatagcagtctcaacaagagtaagagggaccaggaaacaagccaagttacaacaacagagcagatgtctgaagcaagtgatagcgaggaggttgggaatgcagagactagtgtgggagaaagacatgaggatgagcctgatcccaagcgaagaaatacagaagttcgggtttcagaaccagttgcttcatcgcatagaactgtgacagagcctaggattattgtccaaacgacgagtgaagttgacctcttagatgatggatataggtggcgcaagtatggtcagaaagtagtcaaaggaaatccttatccgaggagctactataagtgtacaacaccagattgcggagtaaggaaacatgtagagagagcagcaactgacccaaaagctgttgtaacaacatatgaaggtaaacataaccatgatgttccagctgctagaaccagcagccatcagttaagaccaaacaatcaacacaacacctcaacggttaacttcaatcatcaacagcctgttgcacgtttaaggcttaaagaagagcaaatcacttga

SEQ ID NO: 252 - protein, 513 aa, Arabidopsis thaliana
MAEKEEKEPSKLKSSTGVSRPTISLPPRPFGEMFFSGGVGFSPGPMTLVSNLFSDPDEFKSFSQLLAGAMASPAAAAVAAAAVVATAHHQTPVSSVGDGGGSGGDVDPRFKQSRPTGLMITQPPGMFTVPPGLSPATLLDSPSFFGLFSPLQGTFGMTHQQALAQVTAQAVQGNNVHMQQSQQSEYPSSTQQQQQQQQQASLTEIPSFSSAPRSQIRASVQETSQGQRETSEISVFEHRSQPQNADKPADDGYNWRKYGQKQVKGSDFPRSYYKCTHPACPVKKKVERSLDGQVTEIIYKGQHNHELPQKRGNNNGSCKSSDIANQFQTSNSSLNKSKRDQETSQVTTTEQMSEASDSEEVGNAETSVGERHEDEPDPKRRNTEVRVSEPVASSHRTVTEPRIIVQTTSEVDLLDDGYRWRKYGQKVVKGNPYPRSYYKCTTPDCGVRKHVERAATDPKAVVTTYEGKHNHDVPAARTSSHQLRPNNQHNTSTVNFNHQQPVARLRLKEEQIT

SEQ ID NO: 253 - DNA, 1164 bp, Arabidopsis thaliana
atggcttcttcttctctacctctttctcttccgtttccactccgatctcttactagtaccactcgatctctaccatttcaatgttctcctctctttttctctattccttcttcaatcgtttgcttctccactcaaaatcccgaccgcgaagaggtccggtggctccgggaagagcagagatggattcgcgaggagcaacgatggattcgtgaagaacagagatggatacgcgaacgtgaatcgcttctacaagagatttcggatctacagctcagaattcaatccctagagtcacgaaattcgcaattggggaattctattcccgatacgatttcgaatatcgctgctttgcttcaggttttgaaggagaagaatcggatttctgagagtggattgagcgcaacgccgatggtattggagagtacgagagaacaaattgttgaggaggtggaagaagaagagaagcgagtgattattgctgaagagaaagttagggtttcggagccggtgaagaagatcaagaggaggatattgaaagttggaagcgaaggcgacgatgttcaagctttgcaggaagctctgttgaaattaggattctattcgggcgaagaggatatggagttctcgagcttttcaagtgggactgcaagtgctgttaagacttggcaagcatcgcttggggtccgtgaggatggggtaatgacagcagagcttcttcagaggttgttcatggatgaagacgtagagacagataaggatgaagcaagtacaatgaagaaagaggaagctggtaatggggcggtatttacttcagtgacacaagtccctgagaagaagcaatcaatcgtgaaagatcaaagtgacagagaagttgacgttactcaaaatcgggtttttcttcttggagaaaacagatgggaagatccctccaggctcattggcaggaacaaaccggtagacagaagtgaatcaacaaacaccaaaacgaggtgcatcacttgtcgaggggagggtcgattgatgtgcctagagtgcgatggaaccggtgagccaaacattgagccgcagttcatggagtgggttggtgaagatacgaagtgtccgtactgtgaaggtcttggctatacagtttgcgatgtctgcgacggcaaaaaaaacttataa

SEQ ID NO: 254 - protein, 387 aa, Arabidopsis thaliana
MASSSLPLSLPFPLRSLTSTTRSLPFQCSPLFFSIPSSIVCFSTQNPDREEVRWLREEQRWIREEQRWIREEQRWIRERESLLQEISDLQLRIQSLESRNSQLGNSIPDTISNIAALLQVLKEKNRISESGLSATPMVLESTREQIVEEVEEEEKRVIIAEEKVRVSEPVKKIKRRILKVGSEGDDVQALQEALLKLGFYSGEEDMEFSSFSSGTASAVKTWQASLGVREDGVMTAELLQRLFMDEDVETDKDEASTMKKEEAGNGAVFTSVTQVPEKKQSIVKDQSDREVDVTQNRVFLLGENRWEDPSRLIGRNKPVDRSESTNTKTRCITCRGEGRLMCLECDGTGEPNIEPQFMEWVGEDTKCPYCEGLGYTVCDVCDGKKNL

SEQ ID NO: 255 - DNA, 849 bp, Arabidopsis thaliana
atgaagctttcttgtggtacaagttttgcgttcttgattatgtttctctttgcggcacaatctatgcatgtctatgcgggtagcttccacaaagatgttcagatacattggggtgacggccgtggaaaggtgcgcgacagagatggaaagcttctatctctctcgctcgacaaatcctctggatccggttttcagtccaaccaggagtttctctatggcaaagccgaggttcaaatgaaacttgtccctggtaactcagctggaacagtaacaacattctatcttaagtctccgggaactacgtgggatgagattgatttcgagttcttaggaaacctaagtggtcatccgtatactctccatactaatgtttacacaaaaggctcaggagacaaagaacaacaatttcatctatggttcgacccaactgttaactttcacacttattgcatcacatggaatccccaaaggattatttttacagttgatggaattcctattagagagttcaagaactccgagtcaattggagttccgttcccaacgaagcaaccaatgaggctttacgcgagtctctgggaagccgagcattgggctacaaggggagggttagagaaaacagattggtcaaaggctcctttcaccgctttctacagaaactacaatgttgaaggatgtgtatgggctaatggaaaatcatcttgtcccgcaaattcctcatggttcactcaacaactcgattcaaacggccagacaagaatgaaaggggtacagagtaagtacatggtctacaactattgtaacgacaaaagaaggtttcctcgaggtgttcctgtagagtgcagttaa

SEQ ID NO: 256 - protein, 282 aa, Arabidopsis thaliana
MKLSCGTSFAFLIMFLFAAQSMHVYAGSFHKDVQIHWGDGRGKVRDRDGKLLSLSLDKSSGSGFQSNQEFLYGKAEVQMKLVPGNSAGTVTTFYLKSPGTTWDEIDFEFLGNLSGHPYTLHTNVYTKGSGDKEQQFHLWFDPTVNFHTYCITWNPQRIIFTVDGIPIREFKNSESIGVPFPTKQPMRLYASLWEAEHWATRGGLEKTDWSKAPFTAFYRNYNVEGCVWANGKSSCPANSSWFTQQLDSNGQTRMKGVQSKYMVYNYCNDKRRFPRGVPVECS

SEQ ID NO: 257 - DNA, 468 bp, Arabidopsis thaliana
atgcattacatgggtttgtttagtagagctggaaacatatttaggcagcctagagcgttgcaggcctcaaacgctatgttacagggcaatctttcattaactccatccaaaatctttgttggaggtctctcaccatctactgatgtggagctcttgaaagaagcttttggcagttttggaaaaattgttgatgcggtagtggttttggaccgtgaaagtggtttatcaaggggctttggtttcgtaacatatgattcgatcgaagttgctaataacgcaatgcaagctatgcaaaataaggagcttgatgggcgaataattggagtgcatccagctgattcaggaggtggtgggggtggtggtggttttgcaagaaggggaggttatggtggtggtcgtgggggatatgctcgtggtggatttggtcgcggtggatttggtggtggtggctatggctttgttcgttaa

SEQ ID NO: 258 - protein, 155 aa, Arabidopsis thaliana
MHYMGLFSRAGNIFRQPRALQASNAMLQGNLSLTPSKIFVGGLSPSTDVELLKEAFGSFGKIVDAVVVLDRESGLSRGFGFVTYDSIEVANNAMQAMQNKELDGRIIGVHPADSGGGGGGGGFARRGGYGGGRGGYARGGFGRGGFGGGGYGFVR

SEQ ID NO: 259 - DNA, 1215 bp, Arabidopsis thaliana
atggaccgaacacaatctccaaagacagctctgttcgccgtgttggcaacactccttgtcttaaccgtgaacggccagtcactttgtaacacacacaggttcaccaataacctcgccttcgcagattgctctgacctctcggccttaggctctttccttcactggacctacaatgaacaaaacggtaccgtctcaatcgcctatcgccaccctggaacctctgcttcttcttgggttgcttggggacttaacccaagtagtactcagatggttgggacgcaagctctcgtagccttcacaaacacaacaactaaccaattccaggcctatacctcttccgtgagttcctatggtacgcggcttgaacgtagtagcctaagtttcggtgtgagtggcctctccgcgactctggtcagtggcgaggttacgatctttgcaactcttgagttgtctccgaatctgatcacggccaaccagctttggcaggtgggacctgttgtcaacggtgttcctgcgagtcatcaaacctcaggagataatatgagatcgagtggtaggattgatttccggactggtcaggcatcagctggtggtggtggttccggtgacaggctgaggaagagaaacacgcatggagtactaaatgcggtcagctggggagtactaatgccaatgggagcaatgatggctcggtacatgaaagtcttcgccgatccaacatggttctatctccacattgcctttcaagtgtcgggttacgtcatcggggtagccggttgggccaccggaatcaagcttggtaacgactcaccaggcacatcttactcaacccatcgtaaccttggaatagcactcttcacatttgccacacttcaagtatttgctctgcttgtaaggccaaagccagaccacaaatatcgaacgtactggaacgtgtaccatcacaccgttggatacacaaccatcatcctctctattgtcaacattttcaaaggattcgacattttggacccggaggataaatggcgatgggcttacattgggatcctcatctttcttggtgcttgtgtccttattctcgagccactcacttggttcattgttcttcgccgtaagagccgtggaggtaacacagtcgctgcaccaacttcgagcaagtactctaacggcgtcaatggtaccaccaccactggaccacatcaccaggacgcctag

SEQ ID NO: 260 - protein, 404 aa, Arabidopsis thaliana
MDRTQSPKTALFAVLATLLVLTVNGQSLCNTHRFTNNLAFADCSDLSALGSFLHWTYNEQNGTVSIAYRHPGTSASSWVAWGLNPSSTQMVGTQALVAFTNTTTNQFQAYTSSVSSYGTRLERSSLSFGVSGLSATLVSGEVTIFATLELSPNLITANQLWQVGPVVNGVPASHQTSGDNMRSSGRIDFRTGQASAGGGGSGDRLRKRNTHGVLNAVSWGVLMPMGAMMARYMKVFADPTWFYLHIAFQVSGYVIGVAGWATGIKLGNDSPGTSYSTHRNLGIALFTFATLQVFALLVRPKPDHKYRTYWNVYHHTVGYTTIILSIVNIFKGFDILDPEDKWRWAYIGILIFLGACVLILEPLTWFIVLRRKSRGGNTVAAPTSSKYSNGVNGTTTTGPHHQDA

SEQ ID NO: 261 - DNA, 1098 bp, Arabidopsis thaliana
atgagttgctttgggtgttgtggggaggatgatgatatgcataaaactgctgattatggaggtcgtcataaccaagccaaacactttcctccaggaaatgatgcaaggcaccaccaagcctctgaaactgcacagaagggtcctccagttgtgaagttgcagcctattgaagtacctattatcccttttagtgaactcaaagaagcaactgatgattttggatcgaattctctcatcggtgaaggctcttatggaagagtatactacggggtattaaacaatgatctgccttcagcgattaaaaagttggattctaacaaacagcctgacaatgaattccttgctcaggtttccatggtttctaggcttaaacatgataactttgttcaacttcttggctactgtgttgatgggaattcacggatactttcttatgaatttgccaataatggatctcttcatgatattcttcatgggagaaaaggtgtgaaaggagcacagccaggtcctgtcttgtcgtggtatcaacgagtcaaaattgcagttggagctgcaagaggccttgagtacttgcatgaaaaagctaatcctcacatcattcaccgtgacattaaatccagcaatgtcctcctctttgaagatgatgttgccaaaattgctgactttgatctctctaatcaagctcctgatatggcagctcgccttcattccacccgagttcttgggacttttggttaccatgcccctgaatatgcaatgaccgggcagttaaatgccaagagtgatgtctacagctttggagttgtcttactcgaacttcttacaggtcgaaagcctgttgatcatagactacccagaggccagcaaagtttagtcacatgggctacacctaaactgagtgaagacaaggttaaacaatgcgttgatgcaagactcggtggcgattaccctccaaaagctgttgctaagttagccgcggttgctgcgttgtgtgtgcaatatgaagcagattttaggccgaatatgagtatcgttgtcaaagctcttcaacctttgttgaatgctcgagccgtagctccaggggaaggagtacattag

SEQ ID NO: 262 - protein, 365 aa, Arabidopsis thaliana
MSCFGCCGEDDDMHKTADYGGRHNQAKHFPPGNDARHHQASETAQKGPPVVKLQPIEVPIIPFSELKEATDDFGSNSLIGEGSYGRVYYGVLNNDLPSAIKKLDSNKQPDNEFLAQVSMVSRLKHDNFVQLLGYCVDGNSRILSYEFANNGSLHDILHGRKGVKGAQPGPVLSWYQRVKIAVGAARGLEYLHEKANPHIIHRDIKSSNVLLFEDDVAKIADFDLSNQAPDMAARLHSTRVLGTFGYHAPEYAMTGQLNAKSDVYSFGVVLLELLTGRKPVDHRLPRGQQSLVTWATPKLSEDKVKQCVDARLGGDYPPKAVAKLAAVAALCVQYEADFRPNMSIVVKALQPLLNARAVAPGEGVH

SEQ ID NO: 263 - DNA, 1608 bp, Arabidopsis thaliana
atgtccaaagacaaagtctcttctcccaccgccgatctcatcccgcagcttgctgctacactcgtcgctgctcttggcgctcaatgctaccgcctcacactaccgccgtctcctccgcccagaatcctgacgccgcaagtgccaccttcgtctgctaccatggcttcctccttcaatcctacccgaatccttgaccatcgcgcgagctctcaccggaatcgtcgtggggcttttccggctagcaaacgtcgccgtctggtcgatgagcccatcgattacccggatctctccaacccggcttaccaggttctctccactccgcttttcgcctctggaattgggtcgattcgcgagcttctgtcgtcctctcctccgccgacgacgtcttctcagcctccgtctgtctcgattccaccaccgtccgctccaccgctcgttctcagcgattctaaggatgccgaacccgctggtctcaccaatccgtctgctcctccgtccccgttggctcccaaaaacatcactccggttgcttcaccggtcgcagacgtcccgatgcctgatcctctgatttcgcccaccgctgagactgcagagggtgctagtgtgccagatgcggctgtctcttatgctgctcgtgctgcagctcatcgtcaggtttttgccgagagagatgaactggatagaactcttcgtcgccctttggtgccgccacacaccaagcgttttttgtctgccgctgctgctgaaaggtacaaacacatcgctaaacgcgatttcatattccagaaaactctgcccttagatcctgaggtcctgaccgccaccaagtattttctggaacactcgggtatggctcagactgtcgttgcggtggaacagtttgtcccagaagttgttcgtgaattctatgcgaatctgccagagatggaatatcgagaatgtggtcttgatctggtgtatgttcggggcaagatgtatgagttctcgcctgctcttatcaatcacatgttctcgattgatgactccgctttagatccagaggctccggttaccctctctacagcttctcgtgatgatcttgctctcatgatgacaggtgggactacacgacgttggctccgcttgcaacctgctgatcatctagataccatgaagatgctgcacaaggtttgctgtggaaattggtttccaacgaccaataccagcactcttcgggttgaccgtctccggttgattgacatggggactcatggtaagagtttcaacctgggcaaattggtggtaactcataccatgagtttggcacgtttgggacccctttcttcacatcgtctggcttacccaaatctgatctaccagctgctcacctttcagcgtgatgtgcgctctcgtcctcgtgatactctctctgacgaaccgggtgtctttgtcaacgatccgccacccacgcagcctacccaagcaccacctccgatgggtcataaactccttcttgaagacattaatgatcttcttgagatagggaagcgcatacgacgtcgcttgacagttgaggaagaacctaggaagaggaagaggaagaatttgatcctggctgagttactatag

SEQ ID NO: 264 - protein, 535 aa, Arabidopsis thaliana
MSKDKVSSPTADLIPQLAATLVAALGAQCYRLTLPPSPPPRILTPQVPPSSATMASSFNPTRILDHRASSHRNRRGAFPASKRRRLVDEPIDYPDLSNPAYQVLSTPLFASGIGSIRELLSSSPPPTTSSQPPSVSIPPPSAPPLVLSDSKDAEPAGLTNPSAPPSPLAPKNITPVASPVADVPMPDPLISPTAETAEGASVPDAAVSYAARAAAHRQVFAERDELDRTLRRPLVPPHTKRFLSAAAAERYKHIAKRDFIFQKTLPLDPEVLTATKYFLEHSGMAQTVVAVEQFVPEVVREFYANLPEMEYRECGLDLVYVRGKMYEFSPALINHMFSIDDSALDPEAPVTLSTASRDDLALMMTGGTTRRWLRLQPADHLDTMKMLHKVCCGNWFPTTNTSTLRVDRLRLIDMGTHGKSFNLGKLVVTHTMSLARLGPLSSHRLAYPNLIYQLLTFQRDVRSRPRDTLSDEPGVFVNDPPPTQPTQAPPPMGHKLLLEDINDLLEIGKRIRRRLTVEEEPRKRKRKNLILAELL

SEQ ID NO: 265 - DNA, 1692 bp, Arabidopsis thaliana
atggcagaagcagcatacacagtagcatcagacagtgaaaacactggagaggagaaatcatcatcatctccttcattacccgaaatcgcccttggtatcgacattggtacttctcaatgcagtatagctgtttggaacggttctcaagttcacatcttgaggaacacaagaaaccagaagctcatcaaatcatttgtcactttcaaagatgaagttcctgctggtggtgttagcaaccagctcgcacatgagcaggaaatgctaaccggagccgctatcttcaacatgaagcggctcgttggtcgtgtagacactgatcctgtggttcacgctagcaagaaccttcctttcttggttcaaactcttgatattggagttagaccgtttattgcagctttggtgaacaatgcttggagatcaacaacaccagaggaagttttagctatatttctggtggagttacgtctgatggctgaagctcagttgaaacgtcctgtgagaaatgtagtgcttacggttccggtttcgttctctaggttccagctcacacggttcgaaagagcttgcgctatggctggacttcatgttcttcgtttgatgccggaaccaactgctattgcgttgctttatgcgcaacagcagcagatgactacccatgataacatgggaagcggaagcgagaggcttgcggttatattcaatatgggagctggttactgcgatgttgcggttactgctactgctggtggtgtttcacagataaaagctttagctggtagccccattgggggtgaagacattttgcagaacacaattcgccatatcgctccacctaatgaagaagcttcggggttgcttcgtgtagcggcacaggacgcgattcacaggctaacggatcaagaaaatgtccaaattgaagtggatttgggaaatggtaacaagatatccaaggttcttgataggttagagtttgaggaagtgaaccagaaggtatttgaggaatgtgagagacttgttgtgcagtgcctgcgagatgcgagagtcaatggtggtgatatcgatgatttgataatggttggagggtgttcgtacatcccgaaagtaagaactattatcaagaacgtatgcaagaaggatgagatatacaaaggcgtgaatcctttagaagctgcggttagaggagctgctttggaaggtgcggtgacttcagggattcatgatccttttgggagcttagatctgttaaccatacaagccacacctcttgcagttggagtaagagctaacggaaacaaattcatacccgtgattccgcgtaacacaatggttccagcgcggaaagacctcttcttcacaacggttcaagacaaccagaaggaagctctgatcattatatacgaaggagaaggagagactgttgaagagaatcatcttcttggttatttcaagctcgttgggattccgccagcaccgaaaggtgttccagagatcaatgtgtgtatggacattgatgcatcaaatgctttacgggttttcgcagctgtgttgatgccgggatcttcgagtccagtggttcctgtgattgaggtgaggatgcctacggttgatgatggacatggttggtgtgctcaagctttgaatgtgaaatatggagctactcttgatttgattactcttcagagaaagatgtaa

SEQ ID NO: 266 - protein, 563 aa, Arabidopsis thaliana
MAEAAYTVASDSENTGEEKSSSSPSLPEIALGIDIGTSQCSIAVWNGSQVHILRNTRNQKLIKSFVTFKDEVPAGGVSNQLAHEQEMLTGAAIFNMKRLVGRVDTDPVVHASKNLPFLVQTLDIGVRPFIAALVNNAWRSTTPEEVLAIFLVELRLMAEAQLKRPVRNVVLTVPVSFSRFQLTRFERACAMAGLHVLRLMPEPTAIALLYAQQQQMTTHDNMGSGSERLAVIFNMGAGYCDVAVTATAGGVSQIKALAGSPIGGEDILQNTIRHIAPPNEEASGLLRVAAQDAIHRLTDQENVQIEVDLGNGNKISKVLDRLEFEEVNQKVFEECERLVVQCLRDARVNGGDIDDLIMVGGCSYIPKVRTIIKNVCKKDEIYKGVNPLEAAVRGAALEGAVTSGIHDPFGSLDLLTIQATPLAVGVRANGNKFIPVIPRNTMVPARKDLFFTTVQDNQKEALIIIYEGEGETVEENHLLGYFKLVGIPPAPKGVPEINVCMDIDASNALRVFAAVLMPGSSSPVVPVIEVRMPTVDDGHGWCAQALNVKYGATLDLITLQRKM

SEQ ID NO: 267 - DNA, 2754 bp, Arabidopsis thaliana
atggcggcctctgtagataatcgccaatacgctcgtctcgagccaggtttgaacggcgtggttcgttcttacaaacctcccgttccaggccggtccgattcccctaaggcgcaccagaaccaaaccaccaaccaaaccgtgttcttgaaaccagccaaggttcatgacgatgacgaagacgtgtcgagcgaagacgagaacgagacacacaacagcaacgccgtgtactacaaggagatgataagaaaatccaacgccgagcttgaaccgtccgttttggacccgagggacgaatacacggctgatagctggatcgagcgtaacccttccatggtacgtctcacagggaaacatcccttcaactccgaggcgcctcttaaccgtttaatgcaccacgggtttatcacccctgtcccgttgcactacgttcgtaaccacggccacgtccctaaagcccaatgggccgaatggacggtcgaggtgaccggattcgtcaaacggcccatgaaattcaccatggaccagctcgtctccgagtttgcttaccgcgagttcgccgcgacgctagtctgcgcggggaaccgccgtaaggaacagaacatggtgaagaagtcaaagggattcaactggggatccgccggagtttccacctccgtgtggcgtggtgtccctctctgcgacgtactgcgtcgctgcgggatctttagccgaaaaggcggcgctctcaacgtctgcttcgaagggtcggaggatcttccgggcggtgccggaactgctggttccaaatacggaacgagcatcaagaaggaatatgccatggatccatcaagagacatcattttggcttatatgcaaaacggagagtatctaacaccagaccacggttttccggttcggatcatcatccccggtttcattggtggccggatggttaaatggttgaaacgaatcattgtcacaactaaagaatccgacaatttctaccatttcaaggacaacagagttttaccttctttggtagacgccgaactcgccgacgaagaaggttggtggtataagccagagtacataatcaacgagctaaacataaactccgtgattacgacgccatgtcacgaggagattcttcccatcaacgctttcacaacccaaagaccttatactttaaagggttacgcatattccggaggtggaaaaaaagtgacccgtgtggaggtcacggtagatggtggagagacatggaacgtatgtgcacttgaccatcaagagaagccaaacaagtatgggaagttctggtgttggtgtttttggtcacttgaggttgaggttttggacttgcttagtgccaaagagattgctgttcgtgcatgggacgagactctcaacacgcagcccgagaaaatgatatggaatctcatggggatgatgaataactgctggtttagagtgaagactaacgtgtgcaagccacacaagggagagattgggattgtgttcgagcatccaacgcttcctggtaatgaatctggtggatggatggcgaaggaacgtcacctcgaaaaatcggctgacgcgcctcctagtctaaagaagtctgtctcgacgccgtttatgaacacaactgcgaagatgtactcgatgtccgaggtcaagaagcataattcggctgactcttgctggatcattgtccatggacatatctatgattgtacacgattccttatggatcacccgggtggttcggattcaatcttgatcaatgctggtacggattgtacggaggagtttgaagccattcactcggataaagccaagaagatgcttgaggattaccgtatcggtgagctcatcaccactggttattcctctgactcttcctcgcctaacaactcggttcacggttcatccgccgtgttctcgctgttggctcccattggagaggcgactccggttaggaacctcgctttggttaatccccgggctaaagtcccggttcaactcgtcgaaaagacttccatttctcatgatgttcgtaaattccggtttgctttaccggttgaggatatggttctaggcttaccggttggtaagcacattttcctttgcgccaccatcaatgacaagctctgcctcagagcttacacaccaagcagcaccgttgatgtggttggctacttcgagctcgtggtcaagatttactttggcggtgtccacccaagattccctaacggcgggctcatgtctcagtacctagactctttgcctatagggtcaactttggagattaaaggaccattgggtcacgttgagtatctcggcaagggtagtttcacggttcacggtaaaccaaagtttgctgataaattggcaatgttggcaggtggaaccggaataactccggtttaccaaattatccaagccattctcaaggatccagaggatgagactgaaatgtacgtcatttatgctaaccggaccgaggaagatattctcctaagggaggaactggatggttgggcagagcaatacccggaccggttaaaggtttggtacgtagtggaatcagctaaggaaggttgggcatacagtaccgggtttatttccgaggcgattatgcgagaacatatccctgatggattagatggctcagcccttgccatggcttgcggaccaccaccgatgattcagtttgcggttcagccgaatttggagaagatgcaatataacatcaaggaggatttcttgatattctag

SEQ ID NO: 268 - protein, 917 aa, Arabidopsis thaliana
MAASVDNRQYARLEPGLNGVVRSYKPPVPGRSDSPKAHQNQTTNQTVFLKPAKVHDDDEDVSSEDENETHNSNAVYYKEMIRKSNAELEPSVLDPRDEYTADSWIERNPSMVRLTGKHPFNSEAPLNRLMHHGFITPVPLHYVRNHGHVPKAQWAEWTVEVTGFVKRPMKFTMDQLVSEFAYREFAATLVCAGNRRKEQNMVKKSKGFNWGSAGVSTSVWRGVPLCDVLRRCGIFSRKGGALNVCFEGSEDLPGGAGTAGSKYGTSIKKEYAMDPSRDIILAYMQNGEYLTPDHGFPVRIIIPGFIGGRMVKWLKRIIVTTKESDNFYHFKDNRVLPSLVDAELADEEGWWYKPEYIINELNINSVITTPCHEEILPINAFTTQRPYTLKGYAYSGGGKKVTRVEVTVDGGETWNVCALDHQEKPNKYGKFWCWCFWSLEVEVLDLLSAKEIAVRAWDETLNTQPEKMIWNLMGMMNNCWFRVKTNVCKPHKGEIGIVFEHPTLPGNESGGWMAKERHLEKSADAPPSLKKSVSTPFMNTTAKMYSMSEVKKHNSADSCWIIVHGHIYDCTRFLMDHPGGSDSILINAGTDCTEEFEAIHSDKAKKMLEDYRIGELITTGYSSDSSSPNNSVHGSSAVFSLLAPIGEATPVRNLALVNPRAKVPVQLVEKTSISHDVRKFRFALPVEDMVLGLPVGKHIFLCATINDKLCLRAYTPSSTVDVVGYFELVVKIYFGGVHPRFPNGGLMSQYLDSLPIGSTLEIKGPLGHVEYLGKGSFTVHGKPKFADKLAMLAGGTGITPVYQIIQAILKDPEDETEMYVIYANRTEEDILLREELDGWAEQYPDRLKVWYVVESAKEGWAYSTGFISEAIMREHIPDGLDGSALAMACGPPPMIQFAVQPNLEKMQYNIKEDFLIF

SEQ ID NO: 269 - DNA, 1455 bp, Arabidopsis thaliana
atgattcctcctttcaaacgcggtcgtttcatcactaagttgcgttccgtcgccgggaacagccgaatctttagcatggatgctcgagagaaatcacgatcgtttgtgttggtatcatcaaggcacaagagagttccagtttttgtgatgatgccgattgatacatttggaattgatgcttctgggtgtccaaagattaaaaggctcaaggctttaactgtatctcttaaggcactcaagttagctggtgttcatggaatcgcagttgaggtttggtgggggattgtagagcgtttctctcctcttgagtttaaatggtcactgtatgaagagctttttagactgatttctgaggcagggttgaagttacatgttgctctttgctttcattcaaatatgcatttgtttggtgggaaaggaggcatcagtcttccactctggatccgagagattggagacgtcaataaggacatatactatagagataaaagcggattttccaacaatgactatctcacacttggagtcgatcaacttcctttgttcggtggccgtactgctgttcaatgctatgaagattttatgctcagtttttcaacaaaatttgagccatatcttgggaatgtgattgaagaaataagtataggtcttggtccttcgggggagcttagatatcctgcacatccttctggagatgggaggtggaaatttcctggaattggtgaattccaatgccatgacaagtacatgatggaagacttgatggcagtggcatcccaagaaggcaaacctcaatggggaagcagagatcctccgaataccggctgctataatagctttccatctggagttccgttctttgaggagggcaatgatagctttctctctgactatggtcgtttctttctagaatggtacagtgggaagttgatttgtcatgctgatgctattcttgcaaaggcagccgatgtcttgcggagacgtcaggaagaagagaaaagctctgtaatgctggttgcaaaaattggtggaatctattggtggtataagacatcttcacaccccgctgaactaactgcaggttattacaacacctccctcagggatggttatgatcctgtagcttccgtcttgtctcgtcatggtgctgctctcaacatcccctgcttggatatggcagatagtgaaatacctgagaaatatctttgcagccctgaaggattacgtagacagatacatgatgtttcgaagaagtggacaatacatgtgactggtagaaacacaagcgaaagatttgatgagatgggactaaggcaaatacgagagaactgtgtgcaaccgaatggcgacactctaagatcatttacgttttgcagaatgaatgagaagatctttagggtcgagaactggaacaactttgtccctttcattagacagatgagtgcagatatgtaa

SEQ ID NO: 270 - protein, 484 aa, Arabidopsis thaliana
MIPPFKRGRFITKLRSVAGNSRIFSMDAREKSRSFVLVSSRHKRVPVFVMMPIDTFGIDASGCPKIKRLKALTVSLKALKLAGVHGIAVEVWWGIVERFSPLEFKWSLYEELFRLISEAGLKLHVALCFHSNMHLFGGKGGISLPLWIREIGDVNKDIYYRDKSGFSNNDYLTLGVDQLPLFGGRTAVQCYEDFMLSFSTKFEPYLGNVIEEISIGLGPSGELRYPAHPSGDGRWKFPGIGEFQCHDKYMMEDLMAVASQEGKPQWGSRDPPNTGCYNSFPSGVPFFEEGNDSFLSDYGRFFLEWYSGKLICHADAILAKAADVLRRRQEEEKSSVMLVAKIGGIYWWYKTSSHPAELTAGYYNTSLRDGYDPVASVLSRHGAALNIPCLDMADSEIPEKYLCSPEGLRRQIHDVSKKWTIHVTGRNTSERFDEMGLRQIRENCVQPNGDTLRSFTFCRMNEKIFRVENWNNFVPFIRQMSADM

SEQ ID NO: 271 - DNA, 753 bp, Arabidopsis thaliana
atggcgagatacgatcgagcaatcactgtattctcccccgatggtcacctcttccaagtagagtatgccctagaagccgtccgaaagggtaacgccgccgtcggagtccgcggcacagatactgtcgtcctcgccgtcgaaaagaaatccacccctaagctccaggattccagatcagcaaggaagatagtgagccttgataatcacattgcattggcctgtgctggactgaaagcagatgctcgtgtcttgataaacaaggcgaggatagagtgtcaaagccacaggcttacgttggaggacccagttactgttgagtacattactcggtacatagcagggcttcaacagaagtatactcaaagtggtggtgtgaggccttttggtctttccactcttattgttgggtttgatccctacactcgtatacccgcgctttatcagaccgatccatctggtacattctctgcttggaaagctaatgcaactgggagaaactctaactcaattagggagtttctggagaaaaactacaaagaaagcgctggccaagaaactgttaagcttgctatccgtgctctgcttgaggttgttgagagtgggggaaagaacattgaggttgctgtaatgacacgagaggaaggtgttctgaagcaactagaagaagaagaaattgatatcattgtggctgagatcgaagcagagaaggctgcagctgaagcagccaagaaaggccctgcgaaggaaacatga

SEQ ID NO: 272 - protein, 250 aa, Arabidopsis thaliana
MARYDRAITVFSPDGHLFQVEYALEAVRKGNAAVGVRGTDTVVLAVEKKSTPKLQDSRSARKIVSLDNHIALACAGLKADARVLINKARIECQSHRLTLEDPVTVEYITRYIAGLQQKYTQSGGVRPFGLSTLIVGFDPYTRIPALYQTDPSGTFSAWKANATGRNSNSIREFLEKNYKESAGQETVKLAIRALLEVVESGGKNIEVAVMTREEGVLKQLEEEEIDIIVAEIEAEKAAAEAAKKGPAKET

SEQ ID NO: 273 - DNA, 438 bp, Arabidopsis thaliana
atgctctcataccaacttatatttttcactgcaatggtttattgttattgttatacatcgccaacgatgacatcaagcttgcggttacgaacccttattttgggcaaacaaaggtggatcaaacctagaaatttttatcagttttgtgacaagtacgctatcggatacgagaacaagaagaacaactcacttcgtaaccacaagatcttgagatttaatgatggatccgtcgcgaactaccgaatttatgagtttgaaatctacaattttaactctgattcatggaaggtttttgacttcactcccgactgggatatctcttttactgaccttagcgtgtctctcaaggggtatacttactggctgatccgttccaacgggctgatccaagaatattatgctcgaagtctgaggaaaatgatgatcaagaattattga

SEQ ID NO: 274 - protein, 145 aa, Arabidopsis thaliana
MLSYQLIFFTAMVYCYCYTSPTMTSSLRLRTLILGKQRWIKPRNFYQFCDKYAIGYENKKNNSLRNHKILRFNDGSVANYRIYEFEIYNFNSDSWKVFDFTPDWDISFTDLSVSLKGYTYWLIRSNGLIQEYYARSLRKMMIKNY

SEQ ID NO: 275 - DNA, 1488 bp, Arabidopsis thaliana
atgtcagacgcaagagataatgatgaccgtgtggatttcgaggagggtagctacagtgagatggaggatgaagtggaggaggaacaagtagaagagtatgaagaggaggaagaagaagatgatgatgatgatgacgttggcaatcagaatgccgaagaacgtgaggtggaggattatggtgatacaaaaggtggggatatggaagatgttcaggaggaaatagctgaagatgacgacaaccatattgatattgagacagcagatgatgatgagaaaccaccatctcctattgatgatgaagatagggaaaagtattcccaccttctttcacttcctcctcatggttctgaagtttttattggtgggctcccaagggatgttggagaagaggacctgagggatctatgtgaagagataggcgagatctttgaggtgagactgatgaaagatagggactctggtgatagcaaaggctatgcttttgtagctttcaaaaccaaagacgttgcacaaaaggccattgaggagttgcacagtaaagagtttaagggaaaaaccataaggtgctctctttccgaaacgaagaataggttgttcattggtaacataccaaagaactggactgaggatgagtttagaaaagtcatagaggatgttggtcctggagtggagaacatcgagctcataaaagacccaacaaataccactcgtaaccgtggttttgcatttgttttgtactataacaatgcatgtgctgattattcaagacagaaaatgatagattctaattttaagcttgagggtaacgctccaactgtgacttgggcagacccaaaaagctctcctgagcattctgctgctgctgctcaggtgaaagccctttatgtcaagaatattccagagaatacctcaacagagcagctaaaggaactctttcagaggcatggagaagtgaccaaaatcgttacacctcctggaaagggtggaaaacgtgattttgggtttgtccactatgctgaaagatctagtgcattgaaggctgtcaaagataccgagagatatgaagtcaatggtcaaccactagaagttgtgcttgctaaaccccaggctgaaaggaagcatgacccttcttcttattcttacggggctgcacctactcctgccccctttgtgcatcccacgtttggtggttttgctgcggctccttacggtgctatgggtgccggtttgggtattgccggtagttttagtcagccaatgatctatggtagaggagcaatgccaacagggatgcaaatggttccaatgcttcttcccgatggccgagttggctatgttctgcaacagcctggtatgccgatggcagcagcaccaccacaacgaccaagaagaaatgaccggaataacggctcaagcggagggtcaggcagagataacagtcatgaacatgatggtaaccgaggaggccgaaggtaccgaccctactag

SEQ ID NO: 276 - protein, 495 aa, Arabidopsis thaliana
MSDARDNDDRVDFEEGSYSEMEDEVEEEQVEEYEEEEEEDDDDDDVGNQNAEEREVEDYGDTKGGDMEDVQEEIAEDDDNHIDIETADDDEKPPSPIDDEDREKYSHLLSLPPHGSEVFIGGLPRDVGEEDLRDLCEEIGEIFEVRLMKDRDSGDSKGYAFVAFKTKDVAQKAIEELHSKEFKGKTIRCSLSETKNRLFIGNIPKNWTEDEFRKVIEDVGPGVENIELIKDPTNTTRNRGFAFVLYYNNACADYSRQKMIDSNFKLEGNAPTVTWADPKSSPEHSAAAAQVKALYVKNIPENTSTEQLKELFQRHGEVTKIVTPPGKGGKRDFGFVHYAERSSALKAVKDTERYEVNGQPLEVVLAKPQAERKHDPSSYSYGAAPTPAPFVHPTFGGFAAAPYGAMGAGLGIAGSFSQPMIYGRGAMPTGMQMVPMLLPDGRVGYVLQQPGMPMAAAPPQRPRRNDRNNGSSGGSGRDNSHEHDGNRGGRRYRPY

SEQ ID NO: 277 - DNA, 1308 bp, Arabidopsis thaliana
atggcagaagaaaagagcttcaagtatgtgatcgtcggaggtggtgtcgccgccggatacgcggcgagagagttcttcaaccaaggtgtcaagcctggtgaacttgctatcatttccagggaacaagttcctccatatgagcgtcctgcacttagcaagggatatatccacctcgaaaataaagctacacttccgaatttctatgttgctgctggaattgggggagagagacagttccctcaatggtacaaagagaaaggtattgagctgattttgggcacagagattgtcaaagcagatcttgctgcgaagacacttgtcagtgggactggacaagtcttcaagtaccaaactttgctagctgcaactggttcttctgtcataaggttgtcagattttggcgtcccaggtgcagatgctaagaatatattctacctgagagaactcgaagatgctgattaccttgcttatgcaatggaaacaaaggaaaaaggaaaggctgtggttgttggtggcggttacatcggtcttgaactcggtgctgctctgaaggctaacaacctcgacgttaccatggtttatccagaaccttggtgcatgcctcggcttttcaccgctggcattgcttccttctacgagggttactatgccaacaaaggaattaacattgtcaaaggcactgttgcatctggtttcactaccaactcaaatggagaggtcactgaggtgaaattgaaagacggaagaacgttagaagctgatattgtgatagtgggtgtcggtggtagaccaattatatcactcttcaaagatcaagttgaagaagagaagggtggtttgaagactgatgggttcttcaaaacaagccttccagatgtatacgccattggtgatgtagccaccttcccaatgaaactctacaatgaaatgagacgcgttgaacacgttgaccatgctcgcaaatccgctgaacaagccgtaaaggcaatcaaggcggctgaggaagggaactcaattccggaatatgactatcttccatacttttactctcgagcctttgatctctcatggcaattctacggtgacaacgttggagaaagcgtattgtttggggacaatgacccggaatcgccaaagccgaaattcgggagctactggattaaagaacggaaagtggttggagcatttttagaaggtggaagtcctgaagagaacaatgcaattgctaaacttgcacgagcacaaccttctgttgagagccttgaagtgctatctaaggaaggcctttccttcgccacaaatatataa

SEQ ID NO: 278 - protein, 435 aa, Arabidopsis thaliana
MAEEKSFKYVIVGGGVAAGYAAREFFNQGVKPGELAIISREQVPPYERPALSKGYIHLENKATLPNFYVAAGIGGERQFPQWYKEKGIELILGTEIVKADLAAKTLVSGTGQVFKYQTLLAATGSSVIRLSDFGVPGADAKNIFYLRELEDADYLAYAMETKEKGKAVVVGGGYIGLELGAALKANNLDVTMVYPEPWCMPRLFTAGIASFYEGYYANKGINIVKGTVASGFTTNSNGEVTEVKLKDGRTLEADIVIVGVGGRPIISLFKDQVEEEKGGLKTDGFFKTSLPDVYAIGDVATFPMKLYNEMRRVEHVDHARKSAEQAVKAIKAAEEGNSIPEYDYLPYFYSRAFDLSWQFYGDNVGESVLFGDNDPESPKPKFGSYWIKERKVVGAFLEGGSPEENNAIAKLARAQPSVESLEVLSKEGLSFATNI

SEQ ID NO: 279 - DNA, 1704 bp, Arabidopsis thaliana
atgtttgggtgtgattgtttttactggagcagaggaatctccgagttggattcggaatcgtccgagccaaagcccttctcacttccggctcctcttcctagttggccgcaaggtaaaggttttgccacaggaagaattagcctaggagaaatagaagtggtgaaaatcaccaagttccatcgagtttggagctctgattcatcacacgacaaatcaaaacgtgctacattttacagagccgatgacattccagaaggattccattgccttggtcactattgccagccaaccgatcagcccttgagaggttatgtacttgcagctcggactagcaaagccgtcaatgctgatgatttcccgcccttgaaaaagcctgtgagttattctttagtttggagtgcagattcagagaaaaatggtggtggttatttctggctacctaatcctccggttggttacagagcaatgggagttattgtaacccatgaaccaggtgaacctgaaacagaggaggtcagatgtgtaagagaggatcttacagagagttgtgaaacctctgagatgatacttgaggtgggttcttcgaagaagtcgaacggctctagttctccttttagtgtatggagcacccgaccttgcgagagagggatgctgtcacaaggtgtcgctgttgggtcattcttttgctgcacgtatgatctgtcgtctgagaggacggtccctgatatcggatgcttaaagaatcttgatccgaccttacacgcgatgccaaatctcgaccaggtccatgcggttatcgaacacttcggaccaacagtctacttccacccagaagaggcttacatgccttcatctgtacaatggttctttaagaatggagctttgttgtaccggtcagggaaatcagaaggtcaaccgattaactccacgggctcgaacttgcctgctggaggatgcaatgatatggatttctggatagatcttcctgaagacgaagaagcaaagagtaatctcaagaaaggaaaccttgaaagctcggagctttacgttcatgtgaaaccagcacttggtggaactttcaccgacatcgttatgtggattttctgcccctttaatggcccagccacgctcaaaatcggcctattcacgttacctatgacccgcataggagaacatgtcggtgattgggaacatttcactttccgcatatgtaatttctctggtgagctttggcaaatgttcttttctcagcatagtggtggtggttgggttgatgcatcagatattgagtttgtgaaagataacaaaccggctgtgtactcatctaaacacggacatgcgagtttccctcatccaggaatgtacctccaaggctcgtcaaagctcgggattggagtcagaaacgatgttgcaaaaagcaagtacattgtggattcaagccaaaggtatgtgatagtagcagctgagtatttaggtaaaggagctgtgatagagccgtgctggttacagtatatgagagaatggggtccgaccattgcatatgattcagggtctgagatcaataagatcatgaatcttcttcctttggttgttaggttctctattgagaacattgttgatttgtttcccattgctctttatggagaagaaggtcccacagggccaaaggagaaagataactgggaaggagatgagatgtgctga

SEQ ID NO: 280 - protein, 567 aa, Arabidopsis thaliana
MFGCDCFYWSRGISELDSESSEPKPFSLPAPLPSWPQGKGFATGRISLGEIEVVKITKFHRVWSSDSSHDKSKRATFYRADDIPEGFHCLGHYCQPTDQPLRGYVLAARTSKAVNADDFPPLKKPVSYSLVWSADSEKNGGGYFWLPNPPVGYRAMGVIVTHEPGEPETEEVRCVREDLTESCETSEMILEVGSSKKSNGSSSPFSVWSTRPCERGMLSQGVAVGSFFCCTYDLSSERTVPDIGCLKNLDPTLHAMPNLDQVHAVIEHFGPTVYFHPEEAYMPSSVQWFFKNGALLYRSGKSEGQPINSTGSNLPAGGCNDMDFWIDLPEDEEAKSNLKKGNLESSELYVHVKPALGGTFTDIVMWIFCPFNGPATLKIGLFTLPMTRIGEHVGDWEHFTFRICNFSGELWQMFFSQHSGGGWVDASDIEFVKDNKPAVYSSKHGHASFPHPGMYLQGSSKLGIGVRNDVAKSKYIVDSSQRYVIVAAEYLGKGAVIEPCWLQYMREWGPTIAYDSGSEINKIMNLLPLVVRFSIENIVDLFPIALYGEEGPTGPKEKDNWEGDEMC

SEQ ID NO: 281 - DNA, 1173 bp, Arabidopsis thaliana
atgcggttgcgttttccgatgaaatctgccgttttagcgtttgctatctttctggtgtttattccactgttttccgtcggtatacggatgattccgggaagactcaccgccgtatccgccaccgtcggaaatggctttgatctggggtcgttcgtggaagctccggagtacagaaacggcaaggagtgcgtgtctcaatcgttgaacagagaaaacttcgtgtcgtcttgcgacgcttcgttagttcatgtagctatgacgcttgactcggagtacttacgtggctcaatcgcagccgtacattcaatgctccgccacgcgtcgtgtccagaaaacgtcttcttccatctcatcgctgcagagtttgacccggcgagtccacgcgttctgagtcaactcgtccgatctactttcccgtcgctaaacttcaaagtctacattttccgggaagatacggtgatcaaccttatctcttcttcaatcagacaagctttagagaatccattgaactatgctcggaactacctcggagatattcttgatccatgcgtagacagagtcatttacctagactcggacatcatcgtcgtcgatgacataacaaagctttggaacacgagtttgacagggtcaagaatcatcggagctccggagtattgtcacgctaacttcacaaagtacttcacttcaggtttctggtccgacccggctttacccggtttcttctcgggtcgaaagccttgttatttcaacacgggtgtgatggtgatggatctagttagatggagagaaggaaactacagagaaaagcttgaaacttggatgcagatacagaagaagaagagaatctacgatttgggttctttgcctccgtttcttcttgtcttcgcagggaacgttgaagcaattgatcataggtggaaccaacatggtttaggaggagacaatgtacgaggaagttgtaggtctttgcataaaggaccagtgagtttgttgcattggagtggtaaaggtaagccatgggtgagacttgatgagaagagaccgtgtccgttggatcatttatgggaaccgtatgatttatatgagcataagattgaaagagctaaagatcagtctttgttcgggttctcttctttgtctgagttaacagaagattcaagctttttctga

SEQ ID NO: 282 - protein, 390 aa, Arabidopsis thaliana
MRLRFPMKSAVLAFAIFLVFIPLFSVGIRMIPGRLTAVSATVGNGFDLGSFVEAPEYRNGKECVSQSLNRENFVSSCDASLVHVAMTLDSEYLRGSIAAVHSMLRHASCPENVFFHLIAAEFDPASPRVLSQLVRSTFPSLNFKVYIFREDTVINLISSSIRQALENPLNYARNYLGDILDPCVDRVIYLDSDIIVVDDITKLWNTSLTGSRIIGAPEYCHANFTKYFTSGFWSDPALPGFFSGRKPCYFNTGVMVMDLVRWREGNYREKLETWMQIQKKKRIYDLGSLPPFLLVFAGNVEAIDHRWNQHGLGGDNVRGSCRSLHKGPVSLLHWSGKGKPWVRLDEKRPCPLDHLWEPYDLYEHKIERAKDQSLFGFSSLSELTEDSSFF

SEQ ID NO: 283 - DNA, 483 bp, Arabidopsis thaliana
atggctagtggaatcgctcgtggtcgtttagctgaagagaggaaatcgtggaggaagaatcatcctcatggttttgtggcaaagccggagacggggcaggatggaactgtgaatctaatggtgtggcattgcactatacctggtaaagctgggactgattgggaaggtggattctttccattaacgatgcacttcagtgaggattatccgagcaaacctccgaaatgtaaatttccacaagggtttttccaccctaatgtctatccatctggaactgtctgtctctctatccttaacgaggattatggatggagaccagccatcaccgtgaagcagattcttgttggtattcaggatttacttgacacaccgaatcccgctgaccctgcacagacagatggttatcatctcttctgtcaggatccagttgagtacaagaaaagggtgaagctgcagtccaagcagtatcctgctcttgtctaa

SEQ ID NO: 284 - protein, 160 aa, Arabidopsis thaliana
MASGIARGRLAEERKSWRKNHPHGFVAKPETGQDGTVNLMVWHCTIPGKAGTDWEGGFFPLTMHFSEDYPSKPPKCKFPQGFFHPNVYPSGTVCLSILNEDYGWRPAITVKQILVGIQDLLDTPNPADPAQTDGYHLFCQDPVEYKKRVKLQSKQYPALV

SEQ ID NO: 285 - DNA, 4044 bp, Arabidopsis thaliana
atggctccgagccgcaagagagggggtggtagggctgcggcggcatcatccgctcgccgagagtggaaggttggcgatctcgttcttgccaaagtcaaaggatttcctgcttggcctgccgtggttgacgaaccggaaaaatggggccactcagccgattcgaagaaagtaactgttcacttttttggcactcaacagatagctttttgcaatcatggtgatgttgaatcatttactgaggagaagaagcaatcacttttgacaagacggcacgccaaaggttcagattttgtccgtgctgtcaaggagatcacagagagttacgagaagctgaagcagcaggaccaagctagtgggcctaaatatgctgaagaaacaactgctggaagttctgggaacacttcacagctgcctcaggcctgtgaaaatctaattggttcaagacttgacactcaaatagagtcaagttctagtcatggtagagatgagttgactcttctcagcgaagatgcttcagctgctgaacaaatgctagccctgcgtcataacactctagctcataatggtgcctgtgatagtgcagcagctaaagatctatgtgagatagctacatattcctcaaggagaagaaatgaaagggtgcgggctctaaagtatgctccacagagtataatattaccggttgagcactctaaaatctcatcaaggttggaattggatagagttcaaaggtccatgcttcaatgcagtgatggtggtccaagtgtcaatagtataaatggcaaagctataagaaggagaaaaagaatccgtacgtcaggtcaatctgaatcagatgacgtggtttcatcagatctaaatctgcacggatctgatgaggacaacgcatctgaaattgctacagttgaatctaacaataatagtaggaatgaaggcaatggtgtggattctggttccaaagttgagtattctgatgccgttggtgagggttgtgacggaggtcatgagcttaacaaagggcttgattttcatattagcaccatggttaagaggaagaagaggaaacccaccagaaaacgtgaaaccagtgacattattgaccctcctgctaaagttgaagcagaaggtcttgggcccaatgcatgtgatagctgccagagatctcaaaattctcatgaaaggctgaatgagaggccctgtgaagagaatggtgatgaacatttgcctctggtaaagcgagccagagttcgaatgagtagagctttttatgctgatgaaaaggtcaatgcctcttcacaggtggaagagagatcgtcgaaagacaccctactaagtgcagctttgcagacaagcccttctgtgaatcatgaaaatggtattggttctggtcatgatacttctgcagccgaagaatttaacagctttgagttgtctgctaagctttcaggtgttatggttgatgtagtgccttctcatatggagaaaccttcagacagaatgtctccttctgtggcctgtgttcagactgtaggagatagacaaacggctgtgaatttccatgagaacgagtttaccatgacactagatgatgaagtaactcgagcacaatctaaccaacttagcagtttggtagaaacagaagctcgtgttcctgaagtagttcagggatgttctgaggaatcgcaaactgggaactgtctaattagtgagactgatcctattgatatacaatgctcacatcaaagtgagaaacatgaaacccctttgaatcctgatatcgttgattcatctgcaaataagtcccccggtttatgctcgagtttggatatgacaacaacagtggtacctgctcaatctcctcaccaacacaaaatccaggagtatgattctagtgaccattcattggtcattgttggagattctcttaatggaaaatgtgagaaaattgattactgtatgactcaggttgttcagtcccaagccttagaaccgccgcctccattgttctgttcagtggtcaattatcaggaggttgaaaacctgcaggagactgaaaatactctttggaaagaaaaccaaggaagtcccggtaaagaacttgatagtgacaaacaagctcacatgatacagaatccagtactctctgctactgaaagtgaaatgatcgtagatgatgcggaacctcagtatgaaactgtatatagtcactgtgcagatgctgtggagaacagagagctggaaaagagttgtgaggttgatgagcagaaggagcagatgcaagccaccaattctatctcagtatctgagaacttttcacgtgaaaaattgaattcatctcctgcaaggggtactccaaattgcaactcagtatgccgaatttctaccgcagaaagtgaaaatgctatgcagaacaacagttattacagcaccaatgttcagtatggtgagaacaaatcattaaatgttgacactgtcaaagaagaaagcaaagttgaaacaggcacaactcaggtgaagaaagttgttagttctgatgtgcaatgcactgttgagtcttttgagactgcacttgactcattggtgaggacaaaggagaccattggccgagcaactcgcttggctatggacttggcgaaatttggcgtttcagcaaaggcgatggaaattctggcccacactttggaaagtgagtcaaatttacaaaggagggtggatttatttttccttgtggattctattgctcagtgctccaaaggtttgaatggtgatgctggtggtgtttatctttcatccattcaggctatgctacctcgcctattaactgctgctgtcccagctggagctaccacacaagaaaaccgaaaacagtgcttgaaggttttgaggctttggcttgaaagacggatccttcctgaatctatagttcgtcaccatataagagaacttgattcgcttagtaatgttcctgcttgcctctattctcggcgatccgctcgaacagaaagggcgctggatgaccctgttagagatatggagggtatactggtggatgaatatggaagtaattcaactctccagcttcatggattctgcatacctccaatacttagggatgaagacgaaggaagtgactcggatgggggtgattttgagtctgtcacccctgaacacgagtcaagaagccttgaagaacatgtcacaccgtccattaccgaaaggcatacccgtatactggaagatgttgatggtgagcttgaaatggaagacgtggctccaccttgggaaggtggaagcagtgctagtgcgatcacagatcaagctgataatagagagtctgcaaattgtctgcttgtccctggaacttcacatcagaatgttacctcgtcatctccaccagctcgcccttcgcagaatgctcagttggcaatgtctaattcctactcaaatggctttgactaccgcagaaatcccagcatgcagggcgactatcatgccggtcctccaaggatgaatcccccaatgcattacggaagtcctgaaccatcttatagttcccgagtatctttgtcaaaaagcatgccacgtggggagggttctaacttccagcataggccatatccatcttctcatcccccacctcctccgccatcacatcattattcatatatggagccggaccaccatataaagtcgcggagagaaggtctatcataccctcacagatctcattacacactggaatttgacgaaaggaattatcaagacagctatgagagaatgaggcctgaaccatgcgagaatcgagacaattggagatatcatccgccctcttctcatggtccacgatatcatgacagacacaaaggacctcatcaatcgagctcatacagtgggcatcaccgtgactcaggaaggttgcagaacaataggtggagtgattctccgcgtgcatataacaatagacactcttatcactataagcagcattcggaaggtcctgttccagtaggaatgagagatccagggacgtggcatcaaaggtga

SEQ ID NO: 286 - protein, 1347 aa, Arabidopsis thaliana
MAPSRKRGGGRAAAASSARREWKVGDLVLAKVKGFPAWPAVVDEPEKWGHSADSKKVTVHFFGTQQIAFCNHGDVESFTEEKKQSLLTRRHAKGSDFVRAVKEITESYEKLKQQDQASGPKYAEETTAGSSGNTSQLPQACENLIGSRLDTQIESSSSHGRDELTLLSEDASAAEQMLALRHNTLAHNGACDSAAAKDLCEIATYSSRRRNERVRALKYAPQSIILPVEHSKISSRLELDRVQRSMLQCSDGGPSVNSINGKAIRRRKRIRTSGQSESDDVVSSDLNLHGSDEDNASEIATVESNNNSRNEGNGVDSGSKVEYSDAVGEGCDGGHELNKGLDFHISTMVKRKKRKPTRKRETSDIIDPPAKVEAEGLGPNACDSCQRSQNSHERLNERPCEENGDEHLPLVKRARVRMSRAFYADEKVNASSQVEERSSKDTLLSAALQTSPSVNHENGIGSGHDTSAAEEFNSFELSAKLSGVMVDVVPSHMEKPSDRMSPSVACVQTVGDRQTAVNFHENEFTMTLDDEVTRAQSNQLSSLVETEARVPEVVQGCSEESQTGNCLISETDPIDIQCSHQSEKHETPLNPDIVDSSANKSPGLCSSLDMTTTVVPAQSPHQHKIQEYDSSDHSLVIVGDSLNGKCEKIDYCMTQVVQSQALEPPPPLFCSVVNYQEVENLQETENTLWKENQGSPGKELDSDKQAHMIQNPVLSATESEMIVDDAEPQYETVYSHCADAVENRELEKSCEVDEQKEQMQATNSISVSENFSREKLNSSPARGTPNCNSVCRISTAESENAMQNNSYYSTNVQYGENKSLNVDTVKEESKVETGTTQVKKVVSSDVQCTVESFETALDSLVRTKETIGRATRLAMDLAKFGVSAKAMEILAHTLESESNLQRRVDLFFLVDSIAQCSKGLNGDAGGVYLSSIQAMLPRLLTAAVPAGATTQENRKQCLKVLRLWLERRILPESIVRHHIRELDSLSNVPACLYSRRSARTERALDDPVRDMEGILVDEYGSNSTLQLHGFCIPPILRDEDEGSDSDGGDFESVTPEHESRSLEEHVTPSITERHTRILEDVDGELEMEDVAPPWEGGSSASAITDQADNRESANCLLVPGTSHQNVTSSSPPARPSQNAQLAMSNSYSNGFDYRRNPSMQGDYHAGPPRMNPPMHYGSPEPSYSSRVSLSKSMPRGEGSNFQHRPYPSSHPPPPPPSHHYSYMEPDHHIKSRREGLSYPHRSHYTLEFDERNYQDSYERMRPEPCENRDNWRYHPPSSHGPRYHDRHKGPHQSSSYSGHHRDSGRLQNNRWSDSPRAYNNRHSYHYKQHSEGPVPVGMRDPGTWHQR

SEQ ID NO: 287 - DNA, 450 bp, Arabidopsis thaliana
atgacctcgtacaagttgtttttgagagttataagcaagagaagaacatgggcctgtctgtttcttgtagtctacgcgatcctattgtcttcttcatggaattcgttgaattcaatagttaattggtacggagagaatcatcagacatcatctggtttgcctgcgatttacgcgtcggtgcttcttggtgcggtgttcggagttttatctatggcggcggcgctgttcatagccgtgcctgcgatcgtggtgatctggatatcagtggtggtgacgatggcgttcgccggaaaatctaggaagagagtggtgattgaaggaaggaaagtgacgaaagagatcgctggttttgtgtttagggttcttcttaaagaaggaaactttgtggctcttctttgtgctcttcttgcttacttcgtcttctttaactcttactcttcatcttcttga

SEQ ID NO: 288 - protein, 149 aa, Arabidopsis thaliana
MTSYKLFLRVISKRRTWACLFLVVYAILLSSSWNSLNSIVNWYGENHQTSSGLPAIYASVLLGAVFGVLSMAAALFIAVPAIVVIWISVVVTMAFAGKSRKRVVIEGRKVTKEIAGFVFRVLLKEGNFVALLCALLAYFVFFNSYSSSS

SEQ ID NO: 289 - DNA, 2190 bp, Arabidopsis thaliana
atggtaaacaaagacgaccggattagaccggttcatgaagccgacggtgaaccgctttttgagactaggagaagaaccggtagagtgattgcgtaccggtttttctcagcctcggttttcgtgtgtatctgtttgatttggttctacagaattggtgagattggtgataaccgtaccgttttagatcgattaatctggtttgttatgtttattgtggagatttggttcggtttatattgggtagtcacacaatcttcccggtggaatccggtttggcgatttcccttctccgatagactctctcggagatacggaagcgaccttccgaggctcgacgtcttcgtttgcacggcggatccggtgattgagccgccgttgttggtggtaaacacagtcttatctgtgacggctcttgactacccaccggagaaactcgccgtttatctctcagatgacggtggttctgagctgacgttctatgctctcacggaggcagctgagtttgctaaaacttgggttcccttctgcaagaagttcaacgttgagccaacatctcccgctgcttacttgtcttccaaggcaaactgtcttgattctgcggctgaggaggtggctaagctgtatagagaaatggcggcgaggattgaaacggcggcgagactgggacgaataccggaggaggcgcgggtgaagtacggtgacgggttttcacagtgggatgctgacgctactcgaagaaaccatggaaccattcttcaagttttggtagatggaagagaagggaatacaatagcaataccaacgttggtgtatttatcaagagaaaagagacctcaacatcatcataacttcaaggctggagcaatgaacgcattgctgagggtttcttcgaaaattacttgtgggaaaatcatactaaacttggactgtgatatgtacgcaaacaactcaaagtcaacacgcgacgcgctctgcatcctcctcgatgagaaagagggaaaagagattgctttcgtgcagtttccgcagtgttttgacaatgttacaagaaatgatttgtatggaagcatgatgcgagtaggaattgatgtggaatttcttggattggatggaaatggtggtccgttatacattggaactggatgctttcacagaagagatgtgatctgtggaagaaagtatggagaggaagaagaagaagaagaatctgagagaattcacgaaaatttagagcctgagatgattaaggctctcgcgagctgcacttatgaggaaaacactcaatggggaaaggagatgggtgtgaaatatggttgcccggtagaggatgtaataactggtttgacgattcagtgtcgcggatggaaatcagcctacctgaacccggaaaagcaagcatttctcggggtagcgccgaccaatttgcatcaaatgctagtgcagcagaggagatggtcagagggagactttcagattatgctttcgaagtatagtccggtttggtatggaaaaggaaagatcagtttaggactgatacttggttactgttgctattgtctttgggctccatcttcactacctgtgctcatttactctgttttgacttctctctgtctcttcaaaggcattcctctgtttccaaaggtctcgagctcgtggtttattccgtttggatacgtcactgttgcagctaccgcatatagcctagccgagttcttgtggtgcggagggacgttccgtggatggtggaacgagcaaaggatgtggctttatagaagaacaagctcgtttcttttcggatttatggacacgattaagaagctacttggagtttctgagtctgcgtttgtgatcacagcaaaagtagcagaagaagaagcagcagagagatacaaggaagaggtaatggagtttggagtggagtctcccatgtttctcgtcctcggaacactcggtatgctcaatctcttctgcttcgccgcagcggttgcgagacttgtttccggagacggtggagatttgaaaacaatggggatgcaatttgtgataacaggagtactagttgtcataaactggcctctgtataaaggtatgttgttgaggcaagacaaaggaaagatgccaatgagcgttacagttaaatcagttgttttagctttatctgcctgtacctgtttagcgtttttgtaa

SEQ ID NO: 290 - protein, 729 aa, Arabidopsis thaliana
MVNKDDRIRPVHEADGEPLFETRRRTGRVIAYRFFSASVFVCICLIWFYRIGEIGDNRTVLDRLIWFVMFIVEIWFGLYWVVTQSSRWNPVWRFPFSDRLSRRYGSDLPRLDVFVCTADPVIEPPLLVVNTVLSVTALDYPPEKLAVYLSDDGGSELTFYALTEAAEFAKTWVPFCKKFNVEPTSPAAYLSSKANCLDSAAEEVAKLYREMAARIETAARLGRIPEEARVKYGDGFSQWDADATRRNHGTILQVLVDGREGNTIAIPTLVYLSREKRPQHHHNFKAGAMNALLRVSSKITCGKIILNLDCDMYANNSKSTRDALCILLDEKEGKEIAFVQFPQCFDNVTRNDLYGSMMRVGIDVEFLGLDGNGGPLYIGTGCFHRRDVICGRKYGEEEEEEESERIHENLEPEMIKALASCTYEENTQWGKEMGVKYGCPVEDVITGLTIQCRGWKSAYLNPEKQAFLGVAPTNLHQMLVQQRRWSEGDFQIMLSKYSPVWYGKGKISLGLILGYCCYCLWAPSSLPVLIYSVLTSLCLFKGIPLFPKVSSSWFIPFGYVTVAATAYSLAEFLWCGGTFRGWWNEQRMWLYRRTSSFLFGFMDTIKKLLGVSESAFVITAKVAEEEAAERYKEEVMEFGVESPMFLVLGTLGMLNLFCFAAAVARLVSGDGGDLKTMGMQFVITGVLVVINWPLYKGMLLRQDKGKMPMSVTVKSVVLALSACTCLAFL

SEQ ID NO: 291 - DNA, 1362 bp, Arabidopsis thaliana
atgccatatatagaaatgaagagcaagataagcaaggttcttggtgtctgtaagaaacataaagcaagtacaagaaattcttgctctttgtccaaaatatcaggagacttggaaagcataaccgcagctattactacttgccacgacgatgagaaacagcaccctgggttggatactttttctcgggagagtgaaactaatgagcccgctgaaatgcttgttgaagatacttctcagtctcaggggtttgcaccttgggtcgatggttctcaatctgtcgaaaatatggaaaatgcttgcaatcacatgtcaaactcagatacaatattttcacctgttctgaatgatgaactggatggaactggtcgagtatttacagcaggaaattctgtgatctgggaaacccccaggtggggagccgacgagagcagcaacaagatttgctttgacaaccaaacgtgcaacgtttctgatttctatatttctgacgttcttattgcgagcttgccgtttgatgagagtggaaacaacgatgcgttcactgaaataagccccttgcctcattacatctttcctgagcagtacatggtactaccttacttagaagatggatcagccaacaaagatgatattaagtcagatactgacaagattaatctcgataaccatgacttgtttctggcattcaaccggacaagatcgtacaatgtggaaccagatgatcgtgctgaatctgaagtagctgaagactttgatcctcagctttttataaaaaatcagccggaattatcggatgttgtatccaattattggcctcgggataccctaagaaagaagtctgtgacccttgtccttgatttggatgaaactttggtccattcgactctggaatcgtgtaatgttgcagatttttccttcagagtctttttcaacatgcaagaaaacacggtctatgtgagacaaaggccacacctttacaggttcttggagagggtgggagagttgtttcatgtcgttatcttcacagcaagccacagcatctatgcctcacaacttctagatatactggacccagatggaaagttcatatcacagcgtttttatcgcgattcatgcattcttttggatggaatttacaccaaggatttaactgttctgggtcttgatctggccaaagtggctataattgacaactgtccgcaggtgtacagattgcaaataaataatgggatccctatcaaaagttggtacgatgatccaactgatgatgggttgattactatacttcccttcttagagactttggctgttgctgatgatgttcggcctatcattggcaggagatttggtaacaaggaataa

SEQ ID NO: 292 - protein, 453 aa, Arabidopsis thaliana
MPYIEMKSKISKVLGVCKKHKASTRNSCSLSKISGDLESITAAITTCHDDEKQHPGLDTFSRESETNEPAEMLVEDTSQSQGFAPWVDGSQSVENMENACNHMSNSDTIFSPVLNDELDGTGRVFTAGNSVIWETPRWGADESSNKICFDNQTCNVSDFYISDVLIASLPFDESGNNDAFTEISPLPHYIFPEQYMVLPYLEDGSANKDDIKSDTDKINLDNHDLFLAFNRTRSYNVEPDDRAESEVAEDFDPQLFIKNQPELSDVVSNYWPRDTLRKKSVTLVLDLDETLVHSTLESCNVADFSFRVFFNMQENTVYVRQRPHLYRFLERVGELFHVVIFTASHSIYASQLLDILDPDGKFISQRFYRDSCILLDGIYTKDLTVLGLDLAKVAIIDNCPQVYRLQINNGIPIKSWYDDPTDDGLITILPFLETLAVADDVRPIIGRRFGNKE

SEQ ID NO: 293 - DNA, 2769 bp, Arabidopsis thaliana
atgttgacgagtcccagtaacgcacttcacagtagtactccacaattctggccacttcgccggagcaagctttgccgttcccggaatttccctcgttttcactccggcgaacgcagcagcggcggaggaggaaaattgtgctcgctctctcttctctccggaagtggcgccggtaaattcagtgtcagagctctagttaggcctgatgataccgacgacgctgactccgtcggcgatgggtctctggcttttcctaaccacgtttctgtcaaaattccattcggaaatagagagattttagttgagactggtctcatggggagacaagcaagttctgcagtcacggtcacagatggagaaactattgtctacacatccgtttgtctagctgatgttccgagtgagccatcagattttcttcccctttatgttcactatcaggagcgattctcagctgtaggtcgaactagtggtggattttttaagcgagaagggagaaccaaagatcacgaggttctgatttgtaggttgatcgatagacctctacgccccactatgcccaaaggtttctacaatgaaactcagattttatcctgggttttgagctacgatggattacacgcacctgatgctttagctgttacatctgctggaattgctgtagctctttcagaagtaccaaatgcgaaagcgattgcaggagttcgggttggtcttattgggggtgaattcattgtcaatccaaccgtgaaggagatggaagaatcacagctagatttgtttctagctggaacagatactgcaattctaacgatagagggatacagtaattttcttcctgaggaaatgcttctccaagctgttaaagttggacaggatgctgtacaggctacatgcattgctattgaagttttagcaaagaaatatggaaagcctaaaatgcttgacgctatcagattaccacctccagagctatacaagcatgtgaaagaacttgctggtgaggaattgacaaaagcgttacaaattaagagtaaaatatcgagaaggaaagccatatcgtccctggaagaaaaggtcttgacaatactgacagagaagggatatgttattgatgaggtagcttttggaaccatagaagcacaaccggatctgttggaggatgaagacgaggatgaggaagttgttcctgaaggtgaggtggaccaaggcgatgttcacattagacccatccctcggaaacctattcctttactattttctgaagtagatgtcaagctagtcttcaaagaagtatcgtcgaagcttctacgtaggcgaattgttgagggaggtaaaagaagtgatggtcggactctggatgagattcgtccaattaattcaagatgtggactgcttcccagggcacatggaagtactctgttcacacgtggggaaacacaggcactggcagttgttacgcttggtgataaacaaatggcgcagagaattgacaaccttgagggttctgatgaatacaagaggttctatcttcagtacacttttcctccatcgtctgttggtgaagttggacgaattggtgcacccagtagaagagaaataggtcatgggacactagcagagcgagcattggagaccattctacctagtgatgatgactttccttacacaatacgtgttgaaagtacagtaattgaaagcaatggttcttcaagtatggcatctgtttgtggcggttgcttggctttgcaagatgctggagttccagtcaaatgttctgttgctgggatagcaatgggaatggtttgggatactgaagaatttggaggtgatggatctccccttatcctttctgacatcactggagctgaagatgcatctggtgatatggactttaaggttgctgggaatgaagatggcgttaccgcctttcagatggacatcaaggtaggaggaattactttagagataatggaaaaggctctaatacaggcaaaagctgggcgtcgccatattcttgctgaaatggcaaagtgctcaccgcctcccacgctaagcctctcaaaatatgctccattgatacttattatgaaggttcatccaagcaaagtatactctcttattggttctggaggtaagaaagtaaagagcatcattgaagaatctggagttgaggccattgacatgcaagatgatggaactgtcaaaattatggcaattgatgtagcgagtctagaaagggcgaaagcgattattagtggattgacaatggttccctctgttggtgatatctacaggaattgtgaaatcaagtcaatggctccttatggtgcatttgtagagatagcgcctgggcgggaaggtctttgccatatcagtgagctgagtgctgaatggcttgcaaaaccagaggatgcctataaagtaggagaccgcattgacgtcaaattaatagaggtaaatgaaaagggtcagcttcgacttagtgtacgggctttacttcccgaatcagagacagacaaagacagtcagaaacaacagccggcaggtgattctaccaaagacaagagttcgcaaaggaaatatgtaaatacttcgtcaaaggaccgtgcagctgcaggagcatcaaaggtttcatctggggatgaacttgtcctgaagaagaaagatgtaaggagagcaactggtggtagtagtgacaagacaatgaatagcaatagcagtaccaacgaagaaagtttagtcaacggtgaagctacaatcagctag

SEQ ID NO: 294 - protein, 922 aa, Arabidopsis thaliana
MLTSPSNALHSSTPQFWPLRRSKLCRSRNFPRFHSGERSSGGGGKLCSLSLLSGSGAGKFSVRALVRPDDTDDADSVGDGSLAFPNHVSVKIPFGNREILVETGLMGRQASSAVTVTDGETIVYTSVCLADVPSEPSDFLPLYVHYQERFSAVGRTSGGFFKREGRTKDHEVLICRLIDRPLRPTMPKGFYNETQILSWVLSYDGLHAPDALAVTSAGIAVALSEVPNAKAIAGVRVGLIGGEFIVNPTVKEMEESQLDLFLAGTDTAILTIEGYSNFLPEEMLLQAVKVGQDAVQATCIAIEVLAKKYGKPKMLDAIRLPPPELYKHVKELAGEELTKALQIKSKISRRKAISSLEEKVLTILTEKGYVIDEVAFGTIEAQPDLLEDEDEDEEVVPEGEVDQGDVHIRPIPRKPIPLLFSEVDVKLVFKEVSSKLLRRRIVEGGKRSDGRTLDEIRPINSRCGLLPRAHGSTLFTRGETQALAVVTLGDKQMAQRIDNLEGSDEYKRFYLQYTFPPSSVGEVGRIGAPSRREIGHGTLAERALETILPSDDDFPYTIRVESTVIESNGSSSMASVCGGCLALQDAGVPVKCSVAGIAMGMVWDTEEFGGDGSPLILSDITGAEDASGDMDFKVAGNEDGVTAFQMDIKVGGITLEIMEKALIQAKAGRRHILAEMAKCSPPPTLSLSKYAPLILIMKVHPSKVYSLIGSGGKKVKSIIEESGVEAIDMQDDGTVKIMAIDVASLERAKAIISGLTMVPSVGDIYRNCEIKSMAPYGAFVEIAPGREGLCHISELSAEWLAKPEDAYKVGDRIDVKLIEVNEKGQLRLSVRALLPESETDKDSQKQQPAGDSTKDKSSQRKYVNTSSKDRAAAGASKVSSGDELVLKKKDVRRATGGSSDKTMNSNSSTNEESLVNGEATIS

SEQ ID NO: 295 - DNA, 762 bp, Arabidopsis thaliana
atgtcgagttctatggaatgttctgagttcgtcggtagccggagatttactgggaagaagcctagcttctcacagacgtgtagtcgattgagtcagtatctaaaagagaacggtagctttggagatctgagcttaggaatggcatgcaagcctgatgtcaatggaactttaggcaactcacgtcagccgacaacaaccatgagtttattcccttgtgaagcttctaacatggattccatggttcaagatgttaaaccgacgaatctgtttcctaggcaaccaagcttttcttcctcatcttcctctcttccaaaggaagatgttttgaaaatgacacagactaccagatctgtgaaaccagagtctcaaactgcaccattgactatattctacgccgggcaagtgattgtattcaatgacttttctgctgagaaagccaaagaagtgatcaacttggcgagcaaaggcaccgctaatagcttagccaagaatcaaaccgatatcagaagcaacatcgctactatcgcaaaccaagttcctcatccaagaaaaaccacaacacaagagccaatccaatcctccccaacaccattgacagaacttcctattgctagaagagcttcacttcaccggttcttggagaagagaaaggacagagttacgtcaaaggcaccataccaattatgcgatccagccaaagcgtcttcaaaccctcaaaccacaggcaacatgtcgtggctcggtttagcagctgaaatatga

SEQ ID NO: 296 - protein, 253 aa, Arabidopsis thaliana
MSSSMECSEFVGSRRFTGKKPSFSQTCSRLSQYLKENGSFGDLSLGMACKPDVNGTLGNSRQPTTTMSLFPCEASNMDSMVQDVKPTNLFPRQPSFSSSSSSLPKEDVLKMTQTTRSVKPESQTAPLTIFYAGQVIVFNDFSAEKAKEVINLASKGTANSLAKNQTDIRSNIATIANQVPHPRKTTTQEPIQSSPTPLTELPIARRASLHRFLEKRKDRVTSKAPYQLCDPAKASSNPQTTGNMSWLGLAAEI

SEQ ID NO: 297 - DNA, 1773 bp, Arabidopsis thaliana
atggtgaagcacgagattctcaactacagcgaggatgaagaagaaaattactcagacgaaggagattggggagactggaaagctgatgataatggtatagaaggaggagaggaggaggaggaggatgatggtgacgactcggaatctgattttctgtgtttgttttgtgattctcacttcgtttcctgtgatttactcttcgaacactgtcgtctaagccacggattcgactttcatggagttagaaaggaattgaagctcgatttctactcttcttttaagctcatcaactatattcgctcacaggtggctgagaacatgtgtttcagttggaagattgaagctgatgattacaaagatgttaagtttccttgggatgaagagaagtatctgaagcctttttggcaggaggattcacttttgtactcgtttgcagatgatgaggaagatgaagaagtcacgtttgacagagaggaagtgatggaggaattgcagaagcttggggatttaagcattgatgtcgaggctttaggggaaagctcaatgtcgaacagtgataaatgcaatataaatggaagtaaggatgtaacttcgctctcaaactgcaatggcctaaagcaaagttctgcggatgatttgatagtcaatgggaaagatgcagaaccaaaggtttgtgatggaaggctagttaataggaacatcagaaaggtgaatgagaactattttggatcttatagttcgtttggcattcacagggagatgctaagtgataaggttagaacagaagcataccgagatgcacttttgaagaatcctactctcttgaatggctctgttgtaatggatgttggttgtggaactgggatattgagtctttttgctgctaaagctggggcttcaagggtagttgcagttgaagctagtgagaagatggccaaagataacaaagtattcaatgataacgagcataatggggtacttgaagttgcacactcaatggtagaagagctagataaatcgatacagattcagcctcatagtgttgatgtgttagtcagcgaatggatgggatactgccttttatatgagtcaatgctcagttctgtgctctatgcaagagatcggtggttgaaacctggaggtgcaatcctccctgacacggccactatgtttgttgcgggatttggaaaaggtgcaacaagtcttcctttctgggaagatgtctatggctttgacatgtcttcaattgggaaggagatacatgacgacactactcgacttcccattgttgacgttatagcggagcgtgatttagtgacacagcctacccttcttcagacatttgacctggctaccatgaaaccggatgaagtagatttcacagcaacggcaacgctggagcccactgagtcagaagcaaaaactaggttgtgccatggtgttgtgttgtggtttgacacaggtttcaccagtaggttctgtaaggaaaacccaaccgtactatccacatcaccctacactcccccaacacactgggctcagacaatcttaacttttcaagaaccaatctcagtggcaccggcctcggttctgtctggtaatgacagaagagaagccatcggaaccgaagagtgtcccgcctcaagcattcatctgcgtgtgagtgttgcacgagcacatgagcatcgcagcatagacatctcgttagaggctactgggctgagctcaaagggtcagaagcgtcactggccggttcagatatttaatctatga

SEQ ID NO: 298 - protein, 590 aa, Arabidopsis thaliana
MVKHEILNYSEDEEENYSDEGDWGDWKADDNGIEGGEEEEEDDGDDSESDFLCLFCDSHFVSCDLLFEHCRLSHGFDFHGVRKELKLDFYSSFKLINYIRSQVAENMCFSWKIEADDYKDVKFPWDEEKYLKPFWQEDSLLYSFADDEEDEEVTFDREEVMEELQKLGDLSIDVEALGESSMSNSDKCNINGSKDVTSLSNCNGLKQSSADDLIVNGKDAEPKVCDGRLVNRNIRKVNENYFGSYSSFGIHREMLSDKVRTEAYRDALLKNPTLLNGSVVMDVGCGTGILSLFAAKAGASRVVAVEASEKMAKDNKVFNDNEHNGVLEVAHSMVEELDKSIQIQPHSVDVLVSEWMGYCLLYESMLSSVLYARDRWLKPGGAILPDTATMFVAGFGKGATSLPFWEDVYGFDMSSIGKEIHDDTTRLPIVDVIAERDLVTQPTLLQTFDLATMKPDEVDFTATATLEPTESEAKTRLCHGVVLWFDTGFTSRFCKENPTVLSTSPYTPPTHWAQTILTFQEPISVAPASVLSGNDRREAIGTEECPASSIHLRVSVARAHEHRSIDISLEATGLSSKGQKRHWPVQIFNL

SEQ ID NO: 299 - DNA, 1482 bp, Arabidopsis thaliana
atggccgatcaaatctccggcgagaagccggccggagttaatagattcgctcttcaatgtgctatcgtcgcctccatcgtctccatcatctttggttacgatactggtgttatgagtggagcgatggtgtttatagaagaagatttgaagacaaacgacgttcaaatagaagttctcactggaattctcaacctttgtgcccttgtcggatcattgctcgccggaagaacgtcggacataatcggacggcgttacacaatcgtcttggcctcaatactattcatgttaggctcaatattgatgggttggggtccgaattatccggttctcctatccggtagatgcaccgctggactcggagtcggttttgctctgatggttgctccggtttactctgccgagatcgcaactgcttcacatagaggactcttagcttctcttcctcacctttgtatcagtatagggattttactaggttatatcgtgaattacttcttctccaagttacctatgcatatcggttggagactcatgctcggtatagccgcggttccgtccctagtgctagcgttcgggatcttgaaaatgccggaatctccacggtggttgattatgcaaggccgtcttaaggaaggcaaggagatattggaattggtatctaattcccctgaagaagcagaactccgctttcaagacatcaaagctgctgcgggaatcgacccgaaatgcgtagacgatgttgtgaaaatggagggtaagaagactcatggtgaaggagtgtggaaagagctcattctaagaccaactcctgcagtgagacgtgttcttttaactgctcttgggattcatttcttccaacacgcctccggaatcgaagcagtgcttttatacggtccgaggatctttaagaaagcaggaatcacgactaaagacaagcttttcttggttactatcggtgtcggaatcatgaaaacgacgtttattttcactgcgactttattgttagacaaggtaggtcgaaggaagcttttgttgaccagcgttggaggaatggtcattgcgttgacaatgttgggatttgggcttacaatggcccaaaatgctggcgggaaattagcgtgggctttagtactgagcatagttgcggcttatagtttcgtggcgtttttctctattgggctcggcccaataacttgggtctacagttctgaggttttcccgttgaagcttagggcacaaggagcgagtctcggcgttgcggtgaacagagtaatgaacgccaccgtgtcgatgtcgtttttgtcgttgactagtgcgataaccaccggtggagctttctttatgttcgccggagttgcggcagtggcgtggaatttcttcttcttcctcttgccggagacgaaaggaaaatcacttgaagaaatcgaagcgctttttcaaagagacggtgataaagtacgcggcgaaaacggtgcagcttag

SEQ ID NO: 300 - protein, 493 aa, Arabidopsis thaliana
MADQISGEKPAGVNRFALQCAIVASIVSIIFGYDTGVMSGAMVFIEEDLKTNDVQIEVLTGILNLCALVGSLLAGRTSDIIGRRYTIVLASILFMLGSILMGWGPNYPVLLSGRCTAGLGVGFALMVAPVYSAEIATASHRGLLASLPHLCISIGILLGYIVNYFFSKLPMHIGWRLMLGIAAVPSLVLAFGILKMPESPRWLIMQGRLKEGKEILELVSNSPEEAELRFQDIKAAAGIDPKCVDDVVKMEGKKTHGEGVWKELILRPTPAVRRVLLTALGIHFFQHASGIEAVLLYGPRIFKKAGITTKDKLFLVTIGVGIMKTTFIFTATLLLDKVGRRKLLLTSVGGMVIALTMLGFGLTMAQNAGGKLAWALVLSIVAAYSFVAFFSIGLGPITWVYSSEVFPLKLRAQGASLGVAVNRVMNATVSMSFLSLTSAITTGGAFFMFAGVAAVAWNFFFFLLPETKGKSLEEIEALFQRDGDKVRGENGAA

SEQ ID NO: 301 - DNA, 1311 bp, Arabidopsis thaliana
atgaactttacaaaagaaaattgtcaatttcgaaaaatgttgagcacaagctctgatcttcatggccgtcttctccgattatcagaaccaatagcagagattcttagacgtacacagtacacaccgcaagagagcagcaaagtatccaccaaagatatactcttgtccttgttaccaaacacttcgtcttctcgtctcgccaatgaagaatcgatcaaaagtctcgcgcttgcttgtgcccttctcgcttcttcacgttcatccactcacgaacttctctcatggattccagaaaacctctctgtcatgggggaatctacattttgggagatttcaagggattgtttcagtgatttttctagcaacagtaatgctgagaagcttgtggaattggtagaggatagtgagaagatcgaaatgttgccgatagttttgccggagttaaaagatggaatcgaaaagagttcacttggtaaaggcagtgatgcagaggatgtttcagctgcaatggctagaacacctgttggttatgctatacttgctgctcaccagctcaggtggtttgttactcaggttaaaaaaccgaatttggtgaaattttgtaacttggtggttccttgtgctttgacagcacttgatcattggtctcctgaagtcaaagggcagggtatgataacctttgttcatcttgctaaaaatgtgagttccggtgatcttggtttgtatggagatgtggttcttgatgcgtgttgccagaatatagcttccgatgatgagatttggatacatgtggtagagttatctgtgcttcttgttactaaaatccacccaaataatcctcgaagcccgtggtatgagaagatcatgaatgagatgctcgggcatttggaacgccaaccaagaaataaggagcgacgtatcacttggctaagatttgttgagccactcttgaactctctagggcttttcttacttgctcattttcgacgtatcttccctcttttctttcagtggatgcattcagacgacgccgaaacagttctgttggttcttgagagactggagacagttgtgaggttgacgtggattagacactcacctgtgttcccaagattggtggatgagcttgtttccttgtacaaagagtcatcgatgcgtaaggatcgcgatgatattagacctcttatcctccgtatcttgatgctactccgccagtgcaaaggtctacggtttgagtcagcgtggagtcaataccaggaggatccaaatctgagtactgttagtcaacatatatggactagttcaagttga

SEQ ID NO: 302 - protein, 436 aa, Arabidopsis thaliana
MNFTKENCQFRKMLSTSSDLHGRLLRLSEPIAEILRRTQYTPQESSKVSTKDILLSLLPNTSSSRLANEESIKSLALACALLASSRSSTHELLSWIPENLSVMGESTFWEISRDCFSDFSSNSNAEKLVELVEDSEKIEMLPIVLPELKDGIEKSSLGKGSDAEDVSAAMARTPVGYAILAAHQLRWFVTQVKKPNLVKFCNLVVPCALTALDHWSPEVKGQGMITFVHLAKNVSSGDLGLYGDVVLDACCQNIASDDEIWIHVVELSVLLVTKIHPNNPRSPWYEKIMNEMLGHLERQPRNKERRITWLRFVEPLLNSLGLFLLAHFRRIFPLFFQWMHSDDAETVLLVLERLETVVRLTWIRHSPVFPRLVDELVSLYKESSMRKDRDDIRPLILRILMLLRQCKGLRFESAWSQYQEDPNLSTVSQHIWTSSS

SEQ ID NO: 303 - DNA, 3369 bp, Arabidopsis thaliana
atgtcaggctctaggccgactcagtcctctgagggctcaaggcgatcaaggcacagcgctaggatcattgcgcagaccactgtagatgcgaaactccatgctgattttgaggagtcaggcagctcctttgattactcaacctcagtgcgtgtcactggcccggttgtggagaatcagccaccaaggtctgacaaagttaccacgacttatcttcatcatatacagaagggaaagctgattcagcccttcggttgtttacttgccttggatgagaagaccttcaaagttattgcatacagcgagaatgcatctgagctgttgacaatggccagtcatgcagttcctagtgttggcgaacaccctgttctaggcattgggacagatataaggagtcttttcactgctcctagtgcgtctgcattgcagaaagcccttggatttggagatgtctctcttttgaatcccattcttgtgcactgcaggacttctgcaaagcccttttatgcgattatccacagggttacagggagcatcatcatcgactttgaacccgtgaagccttatgaagtccccatgacagctgctggtgccttacaatcatacaagctcgctgccaaagcaatcactaggctgcaatctttacccagcgggagtatggaaaggctttgtgatacaatggttcaagaggtttttgaactcacggggtatgacagggtgatggcttataagtttcatgaagatgatcacggtgaggttgtctccgaggttacaaaacctgggctggagccttatcttgggctgcattatcctgccaccgacatccctcaagcagcccgttttctgtttatgaagaacaaggtccggatgatagttgattgcaatgcaaaacatgctagggtgcttcaagatgaaaagctttcctttgaccttaccttgtgtggctccacccttagagcaccgcacagctgccatttgcagtacatggccaacatggattcaattgcatctctggttatggcggttgtagttaacgaggaagatggagaaggggatgctcctgatgctactacacagcctcaaaagagaaagagactatggggtttagtggtttgtcacaatacgactccgaggtttgttccatttcctctcaggtatgcctgtgagtttctagctcaagtgtttgccatacacgtcaataaggaggtggaactcgataaccagatggtggagaagaacattttgcgcacgcagacactcttgtgcgatatgctgatgcgtgatgctccactgggtattgtgtcgcaaagccccaacataatggaccttgtgaaatgtgatggagcagctctcttgtataaagacaagatatggaaactgggaacaactccaagtgagttccacctgcaggagatagcttcatggttgtgtgaataccacatggattcaacgggtttgagcactgatagtttgcatgacgccgggtttcctagggctctatctctcggggattcggtatgtgggatggcagctgtgaggatatcatcgaaagacatgattttctggttccgttctcataccgctggtgaagtgagatggggaggtgcgaagcatgatccagatgatagggatgatgcaaggagaatgcacccaaggtcatcgttcaaggctttccttgaagtggtcaagacaaggagtttaccttggaaggactatgagatggatgccatacactccttgcaacttattttgaggaatgctttcaaggatagtgaaactactgatgtgaatacaaaggtcatttactcgaagctaaatgatctcaaaattgatggtatacaagaactagaagctgtgaccagtgagatggttcgtttaattgagactgctacggtgccaatattggcggttgattctgatggactggttaatggttggaacacgaaaattgctgagctgactggtctttcggttgatgaagcaatcgggaagcatttcctcacacttgttgaagattcttcagtggaaatcgttaaaaggatgctagagaacgcattagaaggaactgaggagcagaatgtccagtttgagatcaagacacatctgtccagggctgatgctgggccaataagtttagttgtaaatgcatgcgcaagtagagatctccatgaaaacgtggttggggtgtgttttgtagcccatgatcttactggccagaagactgtgatggacaagtttacgcggattgaaggtgattacaaggcaatcatccaaaatccaaacccgctgatcccgccaatatttggtaccgatgagtttggatggtgcacagagtggaatccagcaatgtcaaagttaaccggtttgaagcgagaggaagtgattgacaaaatgctcttaggagaagtatttgggacgcagaagtcatgttgtcgtctaaagaatcaagaagcctttgtaaaccttgggattgtgctgaacaatgctgtgaccagtcaagatccagagaaagtatcgtttgctttctttacaagaggtggcaagtatgtggagtgtctgttgtgtgtgagtaagaaactggacagggaaggtgtagtgacaggtgtcttctgtttcctgcaacttgccagccatgagctgcagcaagcgctccatgttcaacgtttagctgagcgaaccgcagtgaagagactaaaggctctagcatacataaaaagacagatcaggaatccgctatctgggatcatgtttacaaggaaaatgatagagggtactgaattaggaccagagcaaagacggattttgcaaactagcgcgttatgtcagaagcaactaagcaagatcctcgatgattcggatcttgaaagcatcattgaaggatgcttggatttggaaatgaaagaattcaccttaaatgaagtgttgactgcttccacaagtcaagtaatgatgaagagtaacggaaagagtgttcggataacaaatgagaccggagaagaagtaatgtctgacactttgtatggagacagtattaggcttcaacaagtcttggcagatttcatgctgatggctgtaaactttacaccatccggaggtcagctaactgtttcagcttccctgaggaaggatcagctcgggcgttctgtgcatcttgctaatctagagatcaggttaacgcataccggagctgggatacctgagtttttactaaaccaaatgtttgggactgaggaagatgtgtcagaagaaggattgagcttaatggttagccggaaactggtgaagctgatgaatggagatgttcagtacttgagacaagctgggaaatcaagtttcattatcactgcggaactcgctgcagcaaacaagtag

SEQ ID NO: 304 - protein, 1122 aa, Arabidopsis thaliana
MSGSRPTQSSEGSRRSRHSARIIAQTTVDAKLHADFEESGSSFDYSTSVRVTGPVVENQPPRSDKVTTTYLHHIQKGKLIQPFGCLLALDEKTFKVIAYSENASELLTMASHAVPSVGEHPVLGIGTDIRSLFTAPSASALQKALGFGDVSLLNPILVHCRTSAKPFYAIIHRVTGSIIIDFEPVKPYEVPMTAAGALQSYKLAAKAITRLQSLPSGSMERLCDTMVQEVFELTGYDRVMAYKFHEDDHGEVVSEVTKPGLEPYLGLHYPATDIPQAARFLFMKNKVRMIVDCNAKHARVLQDEKLSFDLTLCGSTLRAPHSCHLQYMANMDSIASLVMAVVVNEEDGEGDAPDATTQPQKRKRLWGLVVCHNTTPRFVPFPLRYACEFLAQVFAIHVNKEVELDNQMVEKNILRTQTLLCDMLMRDAPLGIVSQSPNIMDLVKCDGAALLYKDKIWKLGTTPSEFHLQEIASWLCEYHMDSTGLSTDSLHDAGFPRALSLGDSVCGMAAVRISSKDMIFWFRSHTAGEVRWGGAKHDPDDRDDARRMHPRSSFKAFLEVVKTRSLPWKDYEMDAIHSLQLILRNAFKDSETTDVNTKVIYSKLNDLKIDGIQELEAVTSEMVRLIETATVPILAVDSDGLVNGWNTKIAELTGLSVDEAIGKHFLTLVEDSSVEIVKRMLENALEGTEEQNVQFEIKTHLSRADAGPISLVVNACASRDLHENVVGVCFVAHDLTGQKTVMDKFTRIEGDYKAIIQNPNPLIPPIFGTDEFGWCTEWNPAMSKLTGLKREEVIDKMLLGEVFGTQKSCCRLKNQEAFVNLGIVLNNAVTSQDPEKVSFAFFTRGGKYVECLLCVSKKLDREGVVTGVFCFLQLASHELQQALHVQRLAERTAVKRLKALAYIKRQIRNPLSGIMFTRKMIEGTELGPEQRRILQTSALCQKQLSKILDDSDLESIIEGCLDLEMKEFTLNEVLTASTSQVMMKSNGKSVRITNETGEEVMSDTLYGDSIRLQQVLADFMLMAVNFTPSGGQLTVSASLRKDQLGRSVHLANLEIRLTHTGAGIPEFLLNQMFGTEEDVSEEGLSLMVSRKLVKLMNGDVQYLRQAGKSSFIITAELAAANK

SEQ ID NO: 305 - DNA, 1614 bp, Arabidopsis thaliana
atggcgaatgcccagaaagtcttcactgtagaaaccctaagatctgcatcgaaacagtgtctccgctgcctagtcgtccccgtccgtctccgccgcgctattaagaaatatctccgcgaggaagatgatcctcacattaggaagaaggtgcgtcagttatcggaatcattccaagagatcaaggacaccaatcttcagttacctgaaaccacggccaagagtctggctgattctatgaactcgctagagaccaaacgatggaagatacaaaccgtttatggagatagcggtctccaatacagagacggtgagactgctgcttacattgcttctcgtatgcctgccgtcttttccgtctgctatagagtcctcatcgagattcgtcgaagagtaccaggttttacgcctacaagagtgctggattttggtgctggcactggttcaggtttctgggcggttaaagaggtttggcctaagtctgtggagaaagtaaatatagtggaaccatctcaatcaatgcagcgtgcaggacgtaacttaatccagggccttaaggatttgcctctgatccatgggtatactagcctgctagctcttaataaagagatcaacaaaaagtctgagaggaaacatgatcttgtcatcgcttcctatgtgttaggggagataccatctctgaaagacaggattactgtggttcgccagctctgggaccttacagatgatctcttggttttggttgaaccaggaacgccacacggtgctaatattatatctcagatgcggtcccatatactgtggatggagaagaggaaactgcgtaaactggaaaagaaaatgaagaaagatggaaaggaggtgctcgatctcaaatctggtgcgcatattgttgctccatgccctcatgatggaaagtgtccgctggaaaacactggaaagtactgtcattttgttcagcggttgcagagaacttcgtctcagcgttcctacaagcgtacaaagggtgtccccctacgtgggtttgaggatgagaagttttgttttgtggctttcaggagaggtcagcgcccacgggagttgtggcctcttgacggtatgaagttggagacattgaaggagagacgcgcaaataagaaacccgaggatcttgagattgattatgaggactttatcaaatcacaggtggttgaagtgccttacattgatccaagagcttatgactccgacaccatggatgagaacgaggaggaacaagaagacggtggaggtactgatgaggatgaagaagacaagattgaagaggaaatagaagaggagagtgagagggcgagtgtgggaggcggatggggaagaatcatattccctccattccgcaaagggaaacaagtgacgttggatatgtgtgtgccaaccaaagaagatgggtccgagggagcctttgaaaggagagtgataacaaaaagcaaaaacccggatcttcatttgcaggccaagaaatccttttggggagacttatggcctctcacgactcaacaagaaaatggcaaaaagaagcaagtagatgctgagtggtgtcgcccagacgaagaccagaaatggagtggttggccttag

SEQ ID NO: 306 - protein, 537 aa, Arabidopsis thaliana
MANAQKVFTVETLRSASKQCLRCLVVPVRLRRAIKKYLREEDDPHIRKKVRQLSESFQEIKDTNLQLPETTAKSLADSMNSLETKRWKIQTVYGDSGLQYRDGETAAYIASRMPAVFSVCYRVLIEIRRRVPGFTPTRVLDFGAGTGSGFWAVKEVWPKSVEKVNIVEPSQSMQRAGRNLIQGLKDLPLIHGYTSLLALNKEINKKSERKHDLVIASYVLGEIPSLKDRITVVRQLWDLTDDLLVLVEPGTPHGANIISQMRSHILWMEKRKLRKLEKKMKKDGKEVLDLKSGAHIVAPCPHDGKCPLENTGKYCHFVQRLQRTSSQRSYKRTKGVPLRGFEDEKFCFVAFRRGQRPRELWPLDGMKLETLKERRANKKPEDLEIDYEDFIKSQVVEVPYIDPRAYDSDTMDENEEEQEDGGGTDEDEEDKIEEEIEEESERASVGGGWGRIIFPPFRKGKQVTLDMCVPTKEDGSEGAFERRVITKSKNPDLHLQAKKSFWGDLWPLTTQQENGKKKQVDAEWCRPDEDQKWSGWP

SEQ ID NO: 307 - DNA, 1395 bp, Arabidopsis thaliana
atggctgctggtccggtggttatcaagcgcgaaactgaagatactcctggagaagaagaagaaggtaacacctctagagacaacgccttggttgaagtcaagttagagaagcaagaagaacttggtcttctcgttacttgtggaatccagaaacgaaaacgactcgctcgtggagcaagatctcgaagatattcagacaccagcttcgaggaaaagccgattattatccctccgaagcacaagcagcagagagtattaaccactcgatggaacaatgaaaggattaagttcgcagagcaaaccttagcggatattatgaaggagaaaggtgctacttttgaaaaacctgttacgcgacaactgttaagagttattgctcgaagcaagataggtgatactgggctcttggatcattccttgaagcacatggatggcaaagtaacaccaggtggttctgatcggtttaggaggtgttacaatactgatggatgcatgcagtattggctcgaaagtgctgaccttgtcaagattaaacttgaatctggaattcctgatcctacttgggttcccccagcttggtggatggttcagactgcatcatcacatgatcaatctgcggttacgtcaaagcttcttatgggggagattgagcaaatgaagagtgaaatcaaagaacttgtatcaaagcaaaatttaccagatcatgctgatgcaaatgagaaactattcaaggaacttaagagttggagggaaaacactgataagcaaattgtggagatctcagaatcgttgacttcaactcagggcatgttcaaggaattgaattcgtggaaagataaagtagatcagcagttactgggaatttcaaacacgctgagcaatctgcagccgaatgggagcacgtcattcagtccagctcaggaaaattgggaacatatattgaagacttccaatttggaagattttacaacgaatggttttgaccaatgggatgaccttattgatggtctaccagaggctgtcaggccggagacctacgcgcttccaacaaatccttgcaaaagctctctccaagatcagtcattgatctctctccaagaccagtcattggtctctctccaagaccagtcattggtcaacgtagatatgcaaatgacagaaagcatgactagaggtgaatccagaagctccagtcaggaaaaagctgaaatgactccgggttcttcgattactgcaggtccaaaatcagatattgacgacccaacaatccagactcaggaaaccttgaaggagttggtgacatggaaagccaaagcggagcagcagctgatggaattatcaaacgctgtccttgctcttaagggacagaatcaacccaactggcgttacccgtga

SEQ ID NO: 308 - protein, 464 aa, Arabidopsis thaliana
MAAGPVVIKRETEDTPGEEEEGNTSRDNALVEVKLEKQEELGLLVTCGIQKRKRLARGARSRRYSDTSFEEKPIIIPPKHKQQRVLTTRWNNERIKFAEQTLADIMKEKGATFEKPVTRQLLRVIARSKIGDTGLLDHSLKHMDGKVTPGGSDRFRRCYNTDGCMQYWLESADLVKIKLESGIPDPTWVPPAWWMVQTASSHDQSAVTSKLLMGEIEQMKSEIKELVSKQNLPDHADANEKLFKELKSWRENTDKQIVEISESLTSTQGMFKELNSWKDKVDQQLLGISNTLSNLQPNGSTSFSPAQENWEHILKTSNLEDFTTNGFDQWDDLIDGLPEAVRPETYALPTNPCKSSLQDQSLISLQDQSLVSLQDQSLVNVDMQMTESMTRGESRSSSQEKAEMTPGSSITAGPKSDIDDPTIQTQETLKELVTWKAKAEQQLMELSNAVLALKGQNQPNWRYP

SEQ ID NO: 309 - DNA, 702 bp, Arabidopsis thaliana
atggcgacgtctgcgaggatttgttgcggaggaggaagtgcatgcgccgttcgttgtgatcgtcgcacgttaaatttgaattctcgatcgtcatgtgttgttccagtgacgaatcgacggaatatgtgtgcgatcgggaagatttcgatgtcgatggaggatttgtcaccaccgtctgcggcggtgaagattgaaaggatcggtggaaggaaacgcggtggatctgttgtgtcgagggagaagctagatgtgtggttgagagattcggtggttgagatcgtgaagaatcttagagagtcgccgttattgatgcatttatacgcggaggctaatggtggtttgacgacgacggcaacgaatccaaaggcggaggattggacagagatggaaggaaagtggggtagaggagaagagaggacgccggaaggagttatattggtggagaagctcgcagacggtgacatagcagatgatgatgatcacgatggtggcgcgtgtggggaagatacaagcgcgtgggggattgtggcgcaaggaagaggatcggatactgggccggtttgttatctattgaaaacgacccgggtccggtcgggtatgggtacggtttgcacccatttctgtttggttaaggtcaagagttttagggaaacggctatgtcacagttgaataattcgtggttggtgcagactggtcaatga

SEQ ID NO: 310 - protein, 233 aa, Arabidopsis thaliana
MATSARICCGGGSACAVRCDRRTLNLNSRSSCVVPVTNRRNMCAIGKISMSMEDLSPPSAAVKIERIGGRKRGGSVVSREKLDVWLRDSVVEIVKNLRESPLLMHLYAEANGGLTTTATNPKAEDWTEMEGKWGRGEERTPEGVILVEKLADGDIADDDDHDGGACGEDTSAWGIVAQGRGSDTGPVCYLLKTTRVRSGMGTVCTHFCLVKVKSFRETAMSQLNNSWLVQTGQ

SEQ ID NO: 311 - DNA, 1713 bp, Arabidopsis thaliana
atgactaaaaagaagaatcctaatgttttcttggatgtatcaattggtggggatcccgttcaacggattgtcattgagctttttgctgatgttgtccccaagacagcggaaaacttccgtgccctctgcacaggtgaggcgggcgttggaaagtccactgggaagcctctacatttcaaaggatcatctttccatcgggttatcaaaggattcatggctcagggtggtgatttttccaatgggaatggcactggtggggagagcatctatggtgggaagttttcagatgagaactttagattggaccatgatggagctggagtcctttcaatggcaaattgtggcccaaataccaacgggtcccaattttttatactttttaaacgccaaccacatcttgatgggaagcatgttgtatttggcaaagtcgttgaagggatggcagtaatcaagaaaatggaacttgtggggacgagtgatgggaaacctactagcccagtcaaaataatagactgtggtgaaacgtctcagataagagcacatgatgctgctgaaagagaaaaagggaaatcgaaaaaatcaaacaagaacttttctcctggtgacgtatctgaccgtgaagctaaggagacacgcaaaaaagaatctaacgagaaaaggataaaacgaaaaagaagatactcttcgtcagattcatatagctcaagttccgactcagattcagattcggaatcagaagcatattcatcttcctcctatgagtctagttcttccagtgatgggaagcataggaagaggaagtcaacaacaagacacaaaggccgacgcggggaaagaaagagtaaaggacgaagcgggaaaaagaaagctcggccagatagaaaaccaagcacgaatagttcaagtgacacggagagtagcagcagttctgatgatgagaaagtgggccacaaagccataaagtcagtgaaagttgataacgctgatcaacacgccaacttggatgactcagtgaaatcaaggagcaggagcccaattcgtaggagaaaccaaaacagcaggagcaaaagtcctagtaggagccctgtgagagttcttggaaatggaaacagaagtcctagtaggagccctgtgagagatcttggaaatggaagcagaagtcctcgtgagaagccaacagaggaaactgtggggaaatctttcagaagcccatctccaagtggtgtgcccaagcgcatccgaaaggggcgtgggttcaccgaacgctattcctttgctcggaagtaccatactccttctcctgagcgttctcctcctagacattggcctgacagaagaaactttcaggataggaacagggataggtatccgagcaacagaagttactctgagcgctcaccgaggggacgctttagaagcccacccagaagaaggagccctccaaggtacaaccggaggagaaggagcacttctcggagtccagatgggtaccgtagacgattgagagacggaagcaggagccagagtccgaggcatcgtagccgtagccagagccctagaaagaggcagccaattagccaagacctgaaatcccgtctcgggccacagagatcccccatcagaggaggacgcacctctcctgcagaatcactcagcccttctcactcaccttctccaccaggaaagagaggtctggttagctatgcggattga

SEQ ID NO: 312 - protein, 570 aa, Arabidopsis thaliana
MTKKKNPNVFLDVSIGGDPVQRIVIELFADVVPKTAENFRALCTGEAGVGKSTGKPLHFKGSSFHRVIKGFMAQGGDFSNGNGTGGESIYGGKFSDENFRLDHDGAGVLSMANCGPNTNGSQFFILFKRQPHLDGKHVVFGKVVEGMAVIKKMELVGTSDGKPTSPVKIIDCGETSQIRAHDAAEREKGKSKKSNKNFSPGDVSDREAKETRKKESNEKRIKRKRRYSSSDSYSSSSDSDSDSESEAYSSSSYESSSSSDGKHRKRKSTTRHKGRRGERKSKGRSGKKKARPDRKPSTNSSSDTESSSSSDDEKVGHKAIKSVKVDNADQHANLDDSVKSRSRSPIRRRNQNSRSKSPSRSPVRVLGNGNRSPSRSPVRDLGNGSRSPREKPTEETVGKSFRSPSPSGVPKRIRKGRGFTERYSFARKYHTPSPERSPPRHWPDRRNFQDRNRDRYPSNRSYSERSPRGRFRSPPRRRSPPRYNRRRRSTSRSPDGYRRRLRDGSRSQSPRHRSRSQSPRKRQPISQDLKSRLGPQRSPIRGGRTSPAESLSPSHSPSPPGKRGLVSYAD

SEQ ID NO: 313 - DNA, 918 bp, Arabidopsis thaliana
atgacactttatattcgtcgtgaatcttccaagctatggaagagattttgctctgagatatcgacggagattggtcttcttgctgagaactggaaatatcttctcgctggtcttatctgtcagtacattcatggtttagctgctaaaggagttcattatattcatcgcccgggaccgacacttcaggatcttggcttctttcttcttccggagcttggtcaagagagaagctacataagtgaaaccgtgttcactagtgtgtttctttcgtttttcctgtggactttccatccattcattctgaaaaccaaaaagatatacaccgttttgatatggtgcagagttctagcattcttagttgcctgccagtttctccgtgttataactttctattcaactcagcttcctggccctaactatcactgccgtgagggctctaaagtttctaggttgccatggcccaaaagcgctcttgaggttctcgagattaaccctcatggggtgatgtatggatgcggagacctgattttctcatcgcacatgatattcactctagtctttgtccgtacttaccagaaatatggcactaaaaggttcataaagctgtttgggtggctcactgcaattgtgcagagcctcttgatcattgcctctcgtaaacattacagtgtcgatgtagttgttgcatggtatactgtgaatttggtggtgttctgtctagacaagaaattaccagaattaccagatcggactgctgtgttgctcccagtaatctcaaaagacagaacaaaagaagagaaccacaagctgttgaatggaaacggtgttgaccctgctgattggagaccgagggctcaggtgaacgggaagattgacagcaacggagttcacacggataacacaatgaatggcgcgtga

SEQ ID NO: 314 - protein, 305 aa, Arabidopsis thaliana
MTLYIRRESSKLWKRFCSEISTEIGLLAENWKYLLAGLICQYIHGLAAKGVHYIHRPGPTLQDLGFFLLPELGQERSYISETVFTSVFLSFFLWTFHPFILKTKKIYTVLIWCRVLAFLVACQFLRVITFYSTQLPGPNYHCREGSKVSRLPWPKSALEVLEINPHGVMYGCGDLIFSSHMIFTLVFVRTYQKYGTKRFIKLFGWLTAIVQSLLIIASRKHYSVDVVVAWYTVNLVVFCLDKKLPELPDRTAVLLPVISKDRTKEENHKLLNGNGVDPADWRPRAQVNGKIDSNGVHTDNTMNGA

SEQ ID NO: 315 - DNA, 996 bp, Arabidopsis thaliana
atgaagatcaggtgcgacgtctgcgataaagaagaagcgtcggtgttttgcacggccgacgaagcatctctctgcggcggctgcgaccaccaagtccaccacgctaacaaactcgcctctaaacatctccgtttctctctcctttatccttcttcttccaacacctcctctcctctctgcgacatctgtcaggataaaaaagctctgttgttctgtcaacaagatagagctattttatgcaaagattgcgattcatcgatccacgctgcgaacgaacacacaaagaaacacgataggtttcttcttacaggggttaagctctctgcaacatcgtctgtttacaaacctacttcgaaatcttcttcttcttcttcaagcaaccaagatttctctgtccctggatcatcaatctctaatcctcctcctctcaagaaacctctctcagctcctcctcagagcaacaagatccaacccttttcgaagatcaacggcggtgatgcgtcggtgaatcagtggggatccacaagcacgatttctgagtatttgatggatacgttacctggttggcacgttgaggatttcctcgattcctctcttcctacttatggtttctctaagagtggtgatgatgatggagtgttaccatatatggaaccagaagatgacaacaacactaagagaaacaacaacaacaacaacaacaacaacaacaatacagtgtcacttccatctaagaatttagggatttgggtccctcagattccacaaactcttccttcttcatacccaaatcaatacttttctcaagacaacaacatacagtttgggatgtacaacaaagaaacatcaccagaagtagtgtcttttgctccaatacaaaacatgaaacaacaaggacagaacaacaagagatggtatgatgatggtggcttcactgtcccacagatcactcctcctcctctttcttctaataaaaagtttagatctttctggtaa

SEQ ID NO: 316 - protein, 331 aa, Arabidopsis thaliana
MKIRCDVCDKEEASVFCTADEASLCGGCDHQVHHANKLASKHLRFSLLYPSSSNTSSPLCDICQDKKALLFCQQDRAILCKDCDSSIHAANEHTKKHDRFLLTGVKLSATSSVYKPTSKSSSSSSSNQDFSVPGSSISNPPPLKKPLSAPPQSNKIQPFSKINGGDASVNQWGSTSTISEYLMDTLPGWHVEDFLDSSLPTYGFSKSGDDDGVLPYMEPEDDNNTKRNNNNNNNNNNNTVSLPSKNLGIWVPQIPQTLPSSYPNQYFSQDNNIQFGMYNKETSPEVVSFAPIQNMKQQGQNNKRWYDDGGFTVPQITPPPLSSNKKFRSFW

SEQ ID NO: 317 - DNA, 1236 bp, Arabidopsis thaliana
atgctagaaggagcaaagttcaacgtgcttgctgttgggaatcatcacaacaacgacaacaattactatgcttttacgcaagagttttatcaaaaacttaatgaaggttcaaacatgtccatggagagtatgcagacgagtaacgctggaggatctgtctcaatgtctgtggataacagtagcgttggttccagcgatgctcttattggccacccgggtttgaagcctgtacgccattactcactctcggttggtcaaagcgtgtttcgcccgggaagagttacccatgcgttgaatgatgatgctttggctcaagcactgatggataccaggtatccaactgaagggctgacgaactatgatgagtggacgattgatctgaggaaactcaacatgggtcctgcctttgctcaaggggcttttggtaaattatacaaagggacatacaacggtgaagatgtagctatcaaaatacttgagcggccagagaacagcccagaaaaggcacagttcatggaacaacagtttcagcaagaggtgtctatgcttgctaatttgaagcacccaaacattgtgaggttcattggtgcatgtcgcaagccaatggtgtggtgtatagtgactgaatacgccaaaggaggttcagtgaggcagtttttgactaggagacagaaccgagccgtccctttgaagttagctgttaaacaggctttggatgttgctaggggtatggcttatgtccatggacgcaacttcatacacagagatctcaagtcagataaccttctcatctcagcagataagtccatcaagattgcagattttggtgttgcaagaattgaagttcaaaccgaaggaatgacaccagaaactggaacttacagatggatggctccagagatgatacagcatagagcctacaatcaaaaagtggatgtgtatagtttcgggattgtgctgtgggagttaatcacaggactcttaccgttccagaacatgacagctgtacaggcagcgtttgcggttgtaaacagaggagtgcgtccaacagtcccaaacgattgtctcccggtgctgagtgacattatgactcgatgttgggatgctaatccagaagtccgtccatgttttgtggaggttgtgaagctgcttgaagctgcagaaacagagataatgacgacagcgagaaaagcccgtttcagatgttgcttgagccagccgatgacgattgactaa

SEQ ID NO: 318 - protein, 411 aa, Arabidopsis thaliana
MLEGAKFNVLAVGNHHNNDNNYYAFTQEFYQKLNEGSNMSMESMQTSNAGGSVSMSVDNSSVGSSDALIGHPGLKPVRHYSLSVGQSVFRPGRVTHALNDDALAQALMDTRYPTEGLTNYDEWTIDLRKLNMGPAFAQGAFGKLYKGTYNGEDVAIKILERPENSPEKAQFMEQQFQQEVSMLANLKHPNIVRFIGACRKPMVWCIVTEYAKGGSVRQFLTRRQNRAVPLKLAVKQALDVARGMAYVHGRNFIHRDLKSDNLLISADKSIKIADFGVARIEVQTEGMTPETGTYRWMAPEMIQHRAYNQKVDVYSFGIVLWELITGLLPFQNMTAVQAAFAVVNRGVRPTVPNDCLPVLSDIMTRCWDANPEVRPCFVEVVKLLEAAETEIMTTARKARFRCCLSQPMTID

SEQ ID NO: 319 - DNA, 1383 bp, Arabidopsis thaliana
atggccaagcttttcgctagaagaggagccaaatcaactctcctcacaaccccaataaatgctaagatcttggagaaacccattgaagcattcaaagttcaaaatcctgatctcgaaatcggaatcaagatcctcaatttcccttgtgtagagcttggattgccagaaggatgcgagaaccgtgacttcattaactcataccaaaaatctgactcatttgacttgttcttgaagtttcttttctctaccaagtatatgaaacagcagttggagagtttcattgaaacaaccaaaccgagtgctcttgtagccgatatgttcttcccttgggcaacagaatccgcggagaagatcggtgttccaagacttgtgttccacggcacatcatcctttgccttgtgttgttcgtataacatgaggattcataagccacacaagaaagtcgcttcgagttctactccatttgtaatccctggtctccctggagacatagttattacagaagaccaagccaatgtcaccaacgaagaaactccattcggaaagttttggaaagaagtcagggaatcagagaccagtagctttggtgttttggtgaatagcttctacgagctggaatcatcttatgctgatttttaccgtagttttgtggcgaaaaaagcgtggcatataggtccactttcactatccaacagagggattgcagagaaagccggaagagggaaaaaggcaaacattgatgagcaagaatgcctcaaatggcttgactctaagacacctggctcagtagtttacttgtcctttggtagcggaaccggcttacccaacgaacagctgttagagattgctttcggccttgaaggctctggacaaaatttcatttgggtggttagcaaaaatgaaaaccaagttgggacaggtgaaaatgaagattggttgcctaaagggtttgaagagaggaataaaggaaaagggctgataatacgcggatgggccccgcaagtgctgatacttgaccacaaagcaatcggaggatttgtgacgcattgcggatggaactcgactttggagggcattgccgcagggctgcctatggtgacttggccgatgggggcagaacagttctacaacgagaagttattgacaaaagtgttgagaataggagtgaacgttggagctaccgagttggtgaaaaaaggaaagttgattagtagagcacaagtggagaaggcagtaagggaagtgattggtggtgagaaggcagaggaaaggcggctaagggctaaggagctgggcgagatggctaaagccgctgtggaagaaggagggtcttcttataatgatgtgaacaagtttatggaagagctgaatggtagaaagtag

SEQ ID NO: 320 - protein, 460 aa, Arabidopsis thaliana
MAKLFARRGAKSTLLTTPINAKILEKPIEAFKVQNPDLEIGIKILNFPCVELGLPEGCENRDFINSYQKSDSFDLFLKFLFSTKYMKQQLESFIETTKPSALVADMFFPWATESAEKIGVPRLVFHGTSSFALCCSYNMRIHKPHKKVASSSTPFVIPGLPGDIVITEDQANVTNEETPFGKFWKEVRESETSSFGVLVNSFYELESSYADFYRSFVAKKAWHIGPLSLSNRGIAEKAGRGKKANIDEQECLKWLDSKTPGSVVYLSFGSGTGLPNEQLLEIAFGLEGSGQNFIWVVSKNENQVGTGENEDWLPKGFEERNKGKGLIIRGWAPQVLILDHKAIGGFVTHCGWNSTLEGIAAGLPMVTWPMGAEQFYNEKLLTKVLRIGVNVGATELVKKGKLISRAQVEKAVREVIGGEKAEERRLRAKELGEMAKAAVEEGGSSYNDVNKFMEELNGRK

SEQ ID NO: 321 - DNA, 2586 bp, Arabidopsis thaliana
atggggtcaaaatcatttggaaatctattagacttggcctctggggatcttttggacattcctcagactccgagatatcttccaagagtgatgactgttcctggcattatctctgacgttgatggatatggaattagtgatggcgattcagatgtcatttcattaccttgccgtgagcggaaaatcattgtggccaattttcttcctttgaatggtaaaaaggattcagaaactggaaagtggaaattcagtctcgacaatgattctcccctgttacatctcaaggatggtttttctccagagactgaagtcatttatgttggatcgctcaagacgcatgttgatgttagtgagcaagacgaggtttcccataatctttttgaggaattcaattgtgtagcgactttcctcccacaagatgtgcataaaaaattctaccttggcttttgtaaacagcaactatggccacttttccattacatgttacccatgtgtcctgatcatggtgaacggtttgatcgtggtctttggcaggcatatgtttctgccaacaagatatttgcagataaggtaatgggtgtgattaatcttgaagaagattatatctggattcatgactatcatttaatggttctcccaacatttttgagaaggcggtttcacagggttaagcttggtttcttcctccacagtccattcccttcttcagaaatttatcgaaccttacctgttcgagaggaactactaagagggctcttaaattgtgacttaattggttttcacacgtttgattatgcacggcatttcttgtcatgctgctgtagaatgcttggattggagtatgaatctaagagagggcatattgctcttgactacttgggacgtacagtttttctgaagattcttcctataggtattcacatgggaaggctggaatccgttctgaatcttcctgctacagctgaaaagctgaaagagattcaagaaaagtatcggggtaaaaagataattctcggtgttgatgacatggatatattcaaaggtttaagtcttaaaattttggcctttgaacacctccttcagcaatatcctagcatgctagggaaaatagttcttattcagattgtgaacccagccagaggctcaggtaaagacgttcaggaagcgaggaaagaaacgtatgatactgttaaaagaatcaacgagcgttatggttcacatgattatgagccagtggttctgattgatcgccctgttcctcggtttgagaagtctgcctattatgccctggcagaatgctgcatagtcaatgcagtgagggatgggatgaacttagttccgtacaagtacactgtttgtcggcagggaactcctagtatgaataagtctttgggagtaagtgatgatttgcctcgcacaagcacccttgttctgtccgagttcattggttgctcgccttctctaagtggtgcgattagggttaatccttgggacgttgacgcggtagccgattcactatattctgctattaccatgtctgattttgagaagcaactacgacataaaaaacactttcactacattagtacacatgatgtgggttattgggcgcgcagcttttcgcaggatttggagagggcatctcgagatcattacagtaaacggtgctggggtgtgggttggggtttgggtttcaggcttgtcgctctctctcctaatttcagaaggctatccattgagcaaactgttagtgcttacagaagatcgagcaagagagcaatatttcttgattatgatggtactttagttcctgagacctcgattgtaaaggacccaagtgctgaagttatatctgcgttgaaggcactgtgtagtgatcctaacaacactatatttattgttagcgggaggggaaaagtttctttgagcgagtggcttgcgccatgtgagaatcttggaatagcggctgaacatggttactttacaaggtggaataagtcttctgactgggaaacaagcggcttatctgatgaccttgagtggaagaaagttgtggaacctattatgagactttatacagagactactgatggatccaatatagaagcaaaagagagtgctttagtctggcatcaccaagatgctgacccagactttggttcttgtcaagccaaggaactactggaccatctagaaactgttcttgtgaatgaaccagttattgtgaacagaggccaccaaatcgttgaagttaagcctcagggagtaagcaaagggcttgtcaccgggaaaattcttagccgaatgcttgaagatgggatagcgccagattttgtggtatgcattggggatgatagatcagacgaggagatgtttgaaaacatatcaacaaccctctcagctcaatcatcgtcaatgtctacagagatattcgcgtgtactgtgggaagaaaaccgagcaaagccaaatacttcctcgatgaagtaagcgacgtggtgaagttgcttcaaggacttgccaacacttcgagcccaaagcctaggtacccttctcacctcagagtctccttcgaaagcgtggtatga

SEQ ID NO: 322 - protein, 861 aa, Arabidopsis thaliana
MGSKSFGNLLDLASGDLLDIPQTPRYLPRVMTVPGIISDVDGYGISDGDSDVISLPCRERKIIVANFLPLNGKKDSETGKWKFSLDNDSPLLHLKDGFSPETEVIYVGSLKTHVDVSEQDEVSHNLFEEFNCVATFLPQDVHKKFYLGFCKQQLWPLFHYMLPMCPDHGERFDRGLWQAYVSANKIFADKVMGVINLEEDYIWIHDYHLMVLPTFLRRRFHRVKLGFFLHSPFPSSEIYRTLPVREELLRGLLNCDLIGFHTFDYARHFLSCCCRMLGLEYESKRGHIALDYLGRTVFLKILPIGIHMGRLESVLNLPATAEKLKEIQEKYRGKKIILGVDDMDIFKGLSLKILAFEHLLQQYPSMLGKIVLIQIVNPARGSGKDVQEARKETYDTVKRINERYGSHDYEPVVLIDRPVPRFEKSAYYALAECCIVNAVRDGMNLVPYKYTVCRQGTPSMNKSLGVSDDLPRTSTLVLSEFIGCSPSLSGAIRVNPWDVDAVADSLYSAITMSDFEKQLRHKKHFHYISTHDVGYWARSFSQDLERASRDHYSKRCWGVGWGLGFRLVALSPNFRRLSIEQTVSAYRRSSKRAIFLDYDGTLVPETSIVKDPSAEVISALKALCSDPNNTIFIVSGRGKVSLSEWLAPCENLGIAAEHGYFTRWNKSSDWETSGLSDDLEWKKVVEPIMRLYTETTDGSNIEAKESALVWHHQDADPDFGSCQAKELLDHLETVLVNEPVIVNRGHQIVEVKPQGVSKGLVTGKILSRMLEDGIAPDFVVCIGDDRSDEEMFENISTTLSAQSSSMSTEIFACTVGRKPSKAKYFLDEVSDVVKLLQGLANTSSPKPRYPSHLRVSFESVV

SEQ ID NO: 323 - DNA, 2634 bp, Arabidopsis thaliana
atggtaccatcagagccgcctaatcctgttgggggtggtgaaaatgttccgccttcgatattaggaggacaaggaggagctcctcttccttctcaaccagcatttccttcacttgtctctccgcgtactcagtttggtaacaatatgagtatgagtatgcttgggaatgctccaaatatatcttctcttctcaataatcagtcttttgtaaatggtatccctggttctatgatttctatggatacaagtggtgctgagtctgacccgatgtctaacgtcgggtttagtggtttgtcgtcttttaatgcgtcgagtatggtgtctccgcgctcatcaggtcaagttcagggtcagcagttttcgaatgtttcggctaaccagttgttggctgagcaacaacggaataagaaaatggagacgcagagttttcaacatggtcagcagcagtcaatgcagcagcagttttcgacagtgcgtggtggtggattagcaggtgtgggacctgttaagatggagcctggtcaggtttcgaatgatcagcagcatggtcaagtacaacagcagcaacagaaaatgttgagaaacctagggtcagttaagttggaaccgcagcaaattcaggccatgagaaatttggcccaagtgaaaatggaacctcaacattctgagcagtcattgtttctccaacaacagcagaggcaacaacagcaacaacaacaacaacaatttcttcaaatgccggggcaatctccgcaggctcaaatgaacatatttcagcagcagagacttatgcaacttcaacaacagcaactcttgaaatctatgcctcaacagcgtcctcaattaccacagcagttccaacagcagaatttacctctaaggccacctctgaaaccagtgtatgaacctggcatgggtgctcagcgtcttacacagtatatgtacagacaacaacataggcctgaagacaataatatcgagttctggagaaaatttgtagctgagtactttgctcctaatgccaaaaagagatggtgcgtctctatgtatggcagtggcaggcaaacaacaggcgttttccctcaggatgtgtggcactgtgagatatgtaaccgaaagcctggacgtggttttgaggcaaccgccgaagtccttccgcggctgtttaagattaagtatgagagtgggacgttagaagaactgttatatgtagatatgccaagggagtcccagaattcatctggccaaattgtcctggagtatgcaaaagcaacacaagagagtgtctttgagcatcttcgggttgttcgtgatggccaacttcgaatagtcttctcgccagatcttaagatattctcctgggaattttgtgctcggcggcatgaagagcttattccacgaagacttttgataccgcaggttagtcagcttggatcggcagctcagaaatatcaacaagctgctcaaaatgcaacaacagattctgctcttccggagctacaaaataattgcaatatgtttgttgcatctgctagacaattggcaaaggccctggaagtaccacttgtgaatgatttgggatacacaaagagatatgttcggtgtttgcagatctcagaggtggtaaatagtatgaaggacctgatagattatagcagagaaacacgaacaggaccaatcgagagtttagccaagtttcctcggagaacaggcccttcatctgcactgcctggtccttctcctcagcaagccagcgaccagcttaggcagcagcagcaacaacaacagcagcagcagcaacagcaacaacaacaacaacaacaacagcagcagcagcaaacagtttcccagaatacaaacagtgatcaaagtagtaggcaagttgcactaatgcagggtaatccaagcaatggtgtaaattatgcctttaatgcagcctctgcatccacttccaccagcagcatcgcagggctcatccaccagaattcaatgaagggaagacatcagaatgctgcttacaatcctccaaacagcccctatggaggaaactctgttcagatgcaatcacctagttcctcgggtaccatggtgccatcatcatcgcagcaacaacacaacctgccaacatttcagtctccaacatcctcatctaataacaataatccctctcaaaacgggataccatctgttaatcacatgggttccacaaactcaccagcaatgcaacaggcaggtgaggttgatggaaacgagtctagctcggtgcagaagatactgaatgaaatcctgatgaacaaccaagctcataataatagctcaggaggaagcatggttgggcatgggtctttcgggaatgatgggaagggtcaagctaatgtaaatagttctggtgttttactgatgaatggccaagtgaacaacaacaacaacacaaatattggaggtgctggtgggtttggtggtgggattggtcaatccatggcagcaaacggaatcaataatataaacggtaacaatagtctcatgaacggaagagttgggatgatggtgcgggatccaaacggtcaacaggatttaggaaaccaacttttaggagcagtgaatggtttcaacaattttgattggaacgcgtga

SEQ ID NO: 324 - protein, 877 aa, Arabidopsis thaliana
MVPSEPPNPVGGGENVPPSILGGQGGAPLPSQPAFPSLVSPRTQFGNNMSMSMLGNAPNISSLLNNQSFVNGIPGSMISMDTSGAESDPMSNVGFSGLSSFNASSMVSPRSSGQVQGQQFSNVSANQLLAEQQRNKKMETQSFQHGQQQSMQQQFSTVRGGGLAGVGPVKMEPGQVSNDQQHGQVQQQQQKMLRNLGSVKLEPQQIQAMRNLAQVKMEPQHSEQSLFLQQQQRQQQQQQQQQFLQMPGQSPQAQMNIFQQQRLMQLQQQQLLKSMPQQRPQLPQQFQQQNLPLRPPLKPVYEPGMGAQRLTQYMYRQQHRPEDNNIEFWRKFVAEYFAPNAKKRWCVSMYGSGRQTTGVFPQDVWHCEICNRKPGRGFEATAEVLPRLFKIKYESGTLEELLYVDMPRESQNSSGQIVLEYAKATQESVFEHLRVVRDGQLRIVFSPDLKIFSWEFCARRHEELIPRRLLIPQVSQLGSAAQKYQQAAQNATTDSALPELQNNCNMFVASARQLAKALEVPLVNDLGYTKRYVRCLQISEVVNSMKDLIDYSRETRTGPIESLAKFPRRTGPSSALPGPSPQQASDQLRQQQQQQQQQQQQQQQQQQQQQQQQTVSQNTNSDQSSRQVALMQGNPSNGVNYAFNAASASTSTSSIAGLIHQNSMKGRHQNAAYNPPNSPYGGNSVQMQSPSSSGTMVPSSSQQQHNLPTFQSPTSSSNNNNPSQNGIPSVNHMGSTNSPAMQQAGEVDGNESSSVQKILNEILMNNQAHNNSSGGSMVGHGSFGNDGKGQANVNSSGVLLMNGQVNNNNNTNIGGAGGFGGGIGQSMAANGINNINGNNSLMNGRVGMMVRDPNGQQDLGNQLLGAVNGFNNFDWNA

SEQ ID NO: 325 - DNA, 3306 bp, Arabidopsis thaliana
atggatatggatatggacacttcccctagctacttcgaccccgaggccctcagtgttagggatcaattccgtcgctatcgaaagagacactctacatcgccacatgaggaaatgttgagttcaaatgtcagcgagaacagattactgtatgacgggcataacattcatagtccaacaaatactgcattgctccttgaaaacattaaggaagaggttgacaactttcacactgatcattacgaaggaacacctacaaacccgatatctgcttccaggagggagagtgttggaattcttaatgatgacgatgaggctttgtttcgtcgagtagaaagtcaatcactcaaggcttgcaagattgagaatgatgagttagcggagagtggagatacaacctttgctttgtttgcttccctgtttgattctgcgcttcaaggactaatgtccattccaaatctaatgttgaggcttgaagaatcatgcaggaatgtttcacaatcaattagatatggatcagatattagacatcgtgctgtggaggataaacttatgagacagaaggctcagcttttgcttggtgaggctgcctcctggtcacttttatggaacctatatggaaaaggtactgatgaagttcctgagaatttgatcctgatcccatcaacatctcatttggaggcttgtcagtttgttttaaacgaccatacagctcagctatgccttcggatagtcatgtggcttgaagaacttgcttcaaaatcacttgacttggaaaggaaggtgcagggatctcatgtgggtacttatcttcctaatgctggagtgtggcatcacacacaaagatatctcaagaaaaatggctctaacgctgacactttacaccatctggattttgatgctccaacacgtgaacatgctcgtcttcttcctgatgactataaacaagatgaatctgttcttgaggatgtatggactttgataagggctgggagaatagaagaggcatgtgatctctgcaggtctgctgggcagtcatggagagctgcgactttatgccctttttctggaatggacatgtttccttctattgaggcactggtaaagaatggggaaaataggactctccaggccatcgagcaggaaagtggctttggcaatcaactgcgtctttggaaatgggcttcctactgtgcatcagagaaaattgcagagcaggacggcggcaaacatgaagttgctgtttttgcaactcaatgtagcaacctgaaccgcatgttaccaatttgtactgattgggagtcagcttgctgggcgatggcaaaatcctggcttgatgttcaggttgatcttgaactcgcccaatcaaagcctggtttgacagaaaggtttaaaagctgcattgatgaaagccctgaagctacgcaaaatggttgtcaggcttcatttgggccagaagattggcccctccatgttctaaaccaacaaccccgcgaccttcctgctcttcttcagaaacttcattcaggggaaatggtgcacgaagctgttgtcagaggatgcaaagagcagcaccgccaaattcagatgaaccttatgttgggggatatatcacatctccttgatatcatatggtcatggatagcgcccttagaagatgatcaaagcaacttcaggccccatggagatcctcatatgataaagttcggtgcacacatggtacttgttcttaggcttctatttactgatgaaatcaacgactctttcaaggagaagctcaataatgttggtgatcttattcttcatatgtatgcgatgtttctattttcaaaacaacatgaagaattggtaggaatttatgcttctcagcttgctcgccatcgatgcattgaactttttgtacacatgatggagttaaggatgcatagcagcgtacatgtgaagtacaaaatcttcctgtccgctatggagtacttgtcattctctcctgtggatgatttacatggaaattttgaagaaatagttgacagggttttgtcaagatctcgggaaatcaaacttgcaaaatatgatccctcaattgatgttgcggagcagcatcgtcagcagagtcttcaaaaagcaatagccattcagtggctctgttttacacctccatctactataaaggatgtgaaggatgttacttccaaattacttttgcgatctttgatgcacagcaacatacttttcagagagtttgcattgattgccatgtggagggtgcctgcaactcctgtgggtgcacacacacttcttagttatcttgctgaacctctgaagcaactctcagaaaatccagataccctcgaggattatgtttccgagaatttgcaagagttccaagactggaatgagtattattcctgtgatgcaaaatatcgcaactggctcaaattccagttagagaatgctgaagtcactgaactgtcagaagaggaaaatcagaaagctgttgtagcagccaaagagactctggattcttctttgtcattgcttctcagacaagacaacccctggatgacatttctcgaagaccatgtattcgaatcagaagaatatttattccttgaattgcatgcaactgcgatgctctgtttgccttctggtgaatgtctgcgcccagatgccactgtttgtgctgcactaatgagtgcactttactcttctgtcagtgaggaagttgttttagatcgccagttaatggtaaatgtatcgatttcgtcaagggacagctactgcatcgaggttgtgctccggtgtttagcaattaagggcgatggacttgggccacataatgcaaatgacggtggtattctaagcgcagtggctgcagctggttttaaaggttcggatatctatggaacatatttctcattcacctatgatttacctcctttctccatagaaatttggggatgtgagcttacacggttccaggcaggtgttacaatggatatatcccgcctagacgcttggtattcaagcaaagaaggctcgcttgaaacacctgcaacttatattgtccggggtctctgtagaagatgctgtcttccagaactcgttcttcgatcaatgcaggtttctgtttctctaatggagtcgggaaatccacctgaagatcatgatgaactgattgagcttgttgcttctgatgaaactggttttctctctttgttcagtcggcaacaattacaggagttcatgttatttgagagggagtatcgtatgtcccagttggagcttcaagaggaactttcatcaccttga

SEQ ID NO: 326 - protein, 1101 aa, Arabidopsis thaliana
MDMDMDTSPSYFDPEALSVRDQFRRYRKRHSTSPHEEMLSSNVSENRLLYDGHNIHSPTNTALLLENIKEEVDNFHTDHYEGTPTNPISASRRESVGILNDDDEALFRRVESQSLKACKIENDELAESGDTTFALFASLFDSALQGLMSIPNLMLRLEESCRNVSQSIRYGSDIRHRAVEDKLMRQKAQLLLGEAASWSLLWNLYGKGTDEVPENLILIPSTSHLEACQFVLNDHTAQLCLRIVMWLEELASKSLDLERKVQGSHVGTYLPNAGVWHHTQRYLKKNGSNADTLHHLDFDAPTREHARLLPDDYKQDESVLEDVWTLIRAGRIEEACDLCRSAGQSWRAATLCPFSGMDMFPSIEALVKNGENRTLQAIEQESGFGNQLRLWKWASYCASEKIAEQDGGKHEVAVFATQCSNLNRMLPICTDWESACWAMAKSWLDVQVDLELAQSKPGLTERFKSCIDESPEATQNGCQASFGPEDWPLHVLNQQPRDLPALLQKLHSGEMVHEAVVRGCKEQHRQIQMNLMLGDISHLLDIIWSWIAPLEDDQSNFRPHGDPHMIKFGAHMVLVLRLLFTDEINDSFKEKLNNVGDLILHMYAMFLFSKQHEELVGIYASQLARHRCIELFVHMMELRMHSSVHVKYKIFLSAMEYLSFSPVDDLHGNFEEIVDRVLSRSREIKLAKYDPSIDVAEQHRQQSLQKAIAIQWLCFTPPSTIKDVKDVTSKLLLRSLMHSNILFREFALIAMWRVPATPVGAHTLLSYLAEPLKQLSENPDTLEDYVSENLQEFQDWNEYYSCDAKYRNWLKFQLENAEVTELSEEENQKAVVAAKETLDSSLSLLLRQDNPWMTFLEDHVFESEEYLFLELHATAMLCLPSGECLRPDATVCAALMSALYSSVSEEVVLDRQLMVNVSISSRDSYCIEVVLRCLAIKGDGLGPHNANDGGILSAVAAAGFKGSDIYGTYFSFTYDLPPFSIEIWGCELTRFQAGVTMDISRLDAWYSSKEGSLETPATYIVRGLCRRCCLPELVLRSMQVSVSLMESGNPPEDHDELIELVASDETGFLSLFSRQQLQEFMLFEREYRMSQLELQEELSSP

SEQ ID NO: 327 - DNA, 1272 bp, Arabidopsis thaliana
atggcgtcggtgtcgtcgtcggatcaaggacctaagacagaagcaggatgtagcggcggaggaggaggagagagctcggagacagtggcggcgagtgatcagatgttgttgtatagaggttttaagaaggcgaagaaggagagaggttgtacagctaaggagcgtattagtaaaatgcctccgtgcactgctgggaaaaggagttccatataccggggagtcaccagacatagatggacaggtcgttatgaagctcacctttgggataagagtacctggaaccaaaaccagaacaagaagggaaaacaagtttatctaggagcatatgatgatgaagaggctgctgctagagcttacgaccttgctgccttaaaatattggggtcctgggacacttataaattttccggtgactgattataccagggatttagaagaaatgcaaaatctctcaagggaagaataccttgcatctttacgtagaaaaagcagcggtttctctaggggaatagcgaaatatcgtggacttcaaagccgatgggacgcatcagccagtcgtatgcctggacctgaatacttcagtaacattcattacggggcaggtgatgatcgtggaacagaaggtgactttctaggtagcttttgtctggaaagaaagattgatctaacaggatacataaagtggtggggagccaacaagaaccgtcaaccagaatcttcatcaaaagcatcagaggatgcaaacgtcgaagatgctggtactgagcttaaaacactggaacacacatcccatgcaacagaaccatacaaggcgccaaaccttggcgtcctttgtggaactcagagaaaagaaaaagaaatatcatcaccatcaagctcttctgctttaagcatcttgtctcagtcgcctgccttcaagagcctagaggagaaagtgttgaagatccaagaaagctgcaataatgaaaacgatgagaatgcaaaccgtaacatcatcaatatggagaagaataacggcaaggcaatagagaaaccagttgtgagtcatggagttgctttaggcggtgctgctgctttgtctcttcagaaaagcatgtacccacttacctctctcttaacggctccattgctcaccaactacaatacattggatcctcttgcagaccctattctctggacaccatttcttccttcaggatcctctcttacttcagaggtgacaaagacagagaccagctgttccacgtacagctacctcccacaagagaaatga

SEQ ID NO: 328 - protein, 423 aa, Arabidopsis thaliana
MASVSSSDQGPKTEAGCSGGGGGESSETVAASDQMLLYRGFKKAKKERGCTAKERISKMPPCTAGKRSSIYRGVTRHRWTGRYEAHLWDKSTWNQNQNKKGKQVYLGAYDDEEAAARAYDLAALKYWGPGTLINFPVTDYTRDLEEMQNLSREEYLASLRRKSSGFSRGIAKYRGLQSRWDASASRMPGPEYFSNIHYGAGDDRGTEGDFLGSFCLERKIDLTGYIKWWGANKNRQPESSSKASEDANVEDAGTELKTLEHTSHATEPYKAPNLGVLCGTQRKEKEISSPSSSSALSILSQSPAFKSLEEKVLKIQESCNNENDENANRNIINMEKNNGKAIEKPVVSHGVALGGAAALSLQKSMYPLTSLLTAPLLTNYNTLDPLADPILWTPFLPSGSSLTSEVTKTETSCSTYSYLPQEK

SEQ ID NO: 329 - DNA, 1041 bp, Arabidopsis thaliana
atggttacgagcagcgatcaaatccaaaatggttctgaagagcaatcaaaaagatcagagatttacacatacgaagcaccatggcagatctacgcaatgaactggagcattcgtcgagacaagaagtatcggctcgcaatcacaagcctcatcgagcaatatccgaatcgcgtcgaaattgttcagcttgatgaatcaaatggtgagattcgttcagatccaaatctctgcttcgaacatccttacccaccaacgaaaaccagtttcatacccgataaagaatgtcaaagacccgatcttttagctacttctagtgatttccttcgtttatggcgaatctctgatgatgaatctcgtgttgagcttaagtcttgtcttagtagtgataagaatagtgagtttagtggtccaatcacttcatttgattggaatgaagctgagcctagacgaattggtacttctagtattgataccacttgtactatttgggatatagagcgtgaagttgttgatacccagcttattgctcatgataaagaggtttatgacattgcttggggtggtgttggtgtctttgcctctgtctcagaggatggttccgttagagtgtttgatctccgtgataaggagcattcgacgattatctacgagagtggtgagcctagtactcctttggtgcgacttagttggaacaagcaggatccgaggtatatggctactgttatcatgggcagtgctaaaattgttgtgttggatattcggtttccggctcttcctgtcgtggagcttcagcgacatcaggctagtgtcaatgctatagcttgggctcctcatagctcttcccatatctgctccgctggagatgattctcaggcgttgatttgggatatatcttccatgggacagcatgttgaaggtggtctggatccgattctagcttacacagccggcgctgaggttgagcagcttcagtggtcatcttctcagcctgattgggttgccattgccttctctaacaagctgcagattctccgggtctga

SEQ ID NO: 330 - protein, 346 aa, Arabidopsis thaliana
MVTSSDQIQNGSEEQSKRSEIYTYEAPWQIYAMNWSIRRDKKYRLAITSLIEQYPNRVEIVQLDESNGEIRSDPNLCFEHPYPPTKTSFIPDKECQRPDLLATSSDFLRLWRISDDESRVELKSCLSSDKNSEFSGPITSFDWNEAEPRRIGTSSIDTTCTIWDIEREVVDTQLIAHDKEVYDIAWGGVGVFASVSEDGSVRVFDLRDKEHSTIIYESGEPSTPLVRLSWNKQDPRYMATVIMGSAKIVVLDIRFPALPVVELQRHQASVNAIAWAPHSSSHICSAGDDSQALIWDISSMGQHVEGGLDPILAYTAGAEVEQLQWSSSQPDWVAIAFSNKLQILRV

SEQ ID NO: 331 - DNA, 927 bp, Arabidopsis thaliana
atggctttggttcattacatgaatgtttcacgtagcacttttcctttgagtagatcttcaaagattaatttgagctcatcttttgcttctttgccacttcagtttcataaaaacattaagagattagaatcctctgttccaccatcagcttcagcttcagcttcaccggcgtttcctattgatgttgagtatctccggcgagagttctccggccatggagccactttcgaagatattggtgagacatgtattgctagactaaaactggacaatgggagttcagcgaatgtgatgttgacacgtgggatgataacatcgtacaaagtccgagtgtggcacggtggcaaagtggagcttctccacacatgggtcgaacaagaggaggaagaagtagtgatacgaggaggtgtttcatctgcatttagatcatcagattctgatgaaatcagtgactggagactccaagggatcagtggtgattcaaaggattgcgttcaaatggagctgagaagaagtgacaagaagatcaaagagattgaactgaaacagattattagtctgagagaaaacacactgagcattgagctttctatgacaaacaaaggcatttcaccaatcaagcttgaaggttgttcacttgtaagttatttgacagtgagtacaccagaagctacatatgcagttggactggaaggttcggattttgtggaaacgactccgtttcttcctcgtttcggggtggttcaaggcgagaaggaagaagaaaaacccgggtttggtggggaagaagagagcaactacaaacagttgaatagagagatgagtaggatatacacatgtgctccaaagagcttcactgtcattgatagggtagtaatacttactaaacttcaattatatttaaattttctctgtggattcatatga

SEQ ID NO: 332 - protein, 308 aa, Arabidopsis thaliana
MALVHYMNVSRSTFPLSRSSKINLSSSFASLPLQFHKNIKRLESSVPPSASASASPAFPIDVEYLRREFSGHGATFEDIGETCIARLKLDNGSSANVMLTRGMITSYKVRVWHGGKVELLHTWVEQEEEEVVIRGGVSSAFRSSDSDEISDWRLQGISGDSKDCVQMELRRSDKKIKEIELKQIISLRENTLSIELSMTNKGISPIKLEGCSLVSYLTVSTPEATYAVGLEGSDFVETTPFLPRFGVVQGEKEEEKPGFGGEEESNYKQLNREMSRIYTCAPKSFTVIDRVVILTKLQLYLNFLCGFI

SEQ ID NO: 333 - DNA, 939 bp, Arabidopsis thaliana
atgcttgaagttagatcaatggatatgactccaaaatcaccagaacccgaatccgaaactccgacccggatccaaccagctaaaccaatctctttcagtaacggaatcatcaaacgccaccaccaccaccaccacaacaacaacaaagtcacttacaaagaatgtctcaagaaccacgcggcggcgattggtggtcacgcgcttgacggttgcggcgaatttatgccgtctccttcgtcaacaccttccgatccaacttctctcaagtgtgcagcttgtggttgtcaccgtaacttccaccgccgtgaaactgacgattcctccgccgttccaccaccgtctcttcttccatcttcaacaacaaccgccgcaattgagtatcagcctcatcaccgtcatcatcctcctcctccgctagctcctccgttaccacgtagtcctaattcatcttctccgccgcctatctcttcctcctacatgcttttagctctctccggtaataataaaaccgcaccgttctcagatctaaacttcgccgccgcggctaaccatctctccgccacgcctggctcgaggaagcgattcaggacgaagtttagctcaaatcagaaagagaagatgcatgaattcgccgatcgaatcggttggaagattcagaaacgtgacgaagacgaagttcgtgatttttgccgtgagatcggagttgataaaggtgttctcaaagtttggatgcataataacaaaaactccttcaaattctccggcggaggagcaaccaccgtgcagagaaacgataacggtatcggcggcgagaacagtaacgatgatggagttcgcggtttagctaacgacggtgacggtggtggtgggagatttgagagtgatagtggaggagctgatggtggcggaaacgtaaacgcctcgtcgtcttcgtcgtga

SEQ ID NO: 334 - protein, 312 aa, Arabidopsis thaliana
MLEVRSMDMTPKSPEPESETPTRIQPAKPISFSNGIIKRHHHHHHNNNKVTYKECLKNHAAAIGGHALDGCGEFMPSPSSTPSDPTSLKCAACGCHRNFHRRETDDSSAVPPPSLLPSSTTTAAIEYQPHHRHHPPPPLAPPLPRSPNSSSPPPISSSYMLLALSGNNKTAPFSDLNFAAAANHLSATPGSRKRFRTKFSSNQKEKMHEFADRIGWKIQKRDEDEVRDFCREIGVDKGVLKVWMHNNKNSFKFSGGGATTVQRNDNGIGGENSNDDGVRGLANDGDGGGGRFESDSGGADGGGNVNASSSSS

SEQ ID NO: 335 - DNA, 1065 bp, Arabidopsis thaliana
atgcagcgactgcgagagtcaccaccaccgaagacgcgttgtcttggagaagcttccgacattattccggccgccgatcgatttctccgatgtgcgaatttgattctcccatggctaaaccctcgagaactcgccgttgttgctcaaacctgcaaaaccttatccctaatctcgaaatctctaaccattcaccgatctctcgacgctgcacgatccttggaaaacatctcaatcccgtttcacaactccatcgattctcaacgatacgcgtacttcatctacacaccttttcagatccccgcttcatctcctcctccgccgcgacaatggtggggagctgctgctaatgaatgtggatcggagtctagaccttgttttgactcagtgagtgaaagcggacgttttggggtgagtttagtggacgagtcaggatgcgaatgcgagaggtgtgaggaaggatactgcaagtgtttagctttcgcggggatggaagagatagctaacgaatgtgggtcgggttgtggatgcgggtccgattgttcgaaccgggttacgcagaagggggtttcggttagtttgaagattgtgagagatgagaagaaaggttggtgcttgtacgctgaccagcttatcaagcaaggccaattcatctgtgaatatgcaggtgagctattgacaacagatgaagcacgtagacgtcaaaacatttacgacaaactcagatcaacacaatccttcgcttcagctcttttggtcgtacgcgaacacctcccttcaggacaagcttgtttaaggataaacatcgacgccacaagaattgggaacgttgctagattcatcaaccattcttgtgacggtggaaatctctccactgttctgttgagaagctcaggagcgttgcttcctcggctctgtttctttgcagcaaaggacataatcgcagaggaggagttaagtttcagttatggagacgtaagtgtggccggagagaacagagacgacaagctaaactgctcttgtggtagttcctgctgtttgggaacgttgccttgtgagaatacctga

SEQ ID NO: 336 - protein, 354 aa, Arabidopsis thaliana
MQRLRESPPPKTRCLGEASDIIPAADRFLRCANLILPWLNPRELAVVAQTCKTLSLISKSLTIHRSLDAARSLENISIPFHNSIDSQRYAYFIYTPFQIPASSPPPPRQWWGAAANECGSESRPCFDSVSESGRFGVSLVDESGCECERCEEGYCKCLAFAGMEEIANECGSGCGCGSDCSNRVTQKGVSVSLKIVRDEKKGWCLYADQLIKQGQFICEYAGELLTTDEARRRQNIYDKLRSTQSFASALLVVREHLPSGQACLRINIDATRIGNVARFINHSCDGGNLSTVLLRSSGALLPRLCFFAAKDIIAEEELSFSYGDVSVAGENRDDKLNCSCGSSCCLGTLPCENT

SEQ ID NO: 337 - DNA, 1005 bp, Arabidopsis thaliana
atgagtacacgaagaaatggcatttccaagcatcagcgaggtgataaattttgtggtgaagggccaaactggatactaattgcagggggtgcattgttgagcacattgtccattcgctttggatacaagctaaagcagtcgcttgattcgaaacctcaatcaaatggctctgctggattaaaacctaatggaacatctgagaggcaaaaatctacaagctgttgcttacactctaccacatcttcctgtacacaaaataatgatttttgttgcttccgctccattccaggaactgagagtgtggaaggaaaagaggtgacaagcgagcaaatgatatccgcatctgacacttcactgcctcttgtgacagttcctgctccatcgagcaaagagaatggagtcatgtgggcaacttctcctgatcgcctggaacttcccccaagaccatacaatcacaattcaaactgctcagattctccttgcgtatctgaaaccagctcagacattttcagcaaacgagaagtaatacagaaactaaggcagcagctgaagagacgggatgacatgatacaggaaatgcaagaacagattctagagctgcaaaactcgtataacgcacagacggcacactcaagccatctccaggcacagctagacacactgaacagagatctgtttgaatcagaaagagaagttcaaagactgagaaaggcaattgctgatcacagcgtgggatgtggcgcggacagcaatggcaagacatctccggttggaccttggaatggcgggtttatggacagcgaaagcaattatgagtcacaagaaaagagcctaagggatggagaaagagtagagatgttgagaaaggaagtgagtgagcttaaagaagtgatagatgggaaagagtatctacttagaagctataaggagcagaagattgagctttcgcagaaggtaaaagagttgcagcagagactggactcacagctccaaaacttattgtag

SEQ ID NO: 338 - protein, 334 aa, Arabidopsis thaliana
MSTRRNGISKHQRGDKFCGEGPNWILIAGGALLSTLSIRFGYKLKQSLDSKPQSNGSAGLKPNGTSERQKSTSCCLHSTTSSCTQNNDFCCFRSIPGTESVEGKEVTSEQMISASDTSLPLVTVPAPSSKENGVMWATSPDRLELPPRPYNHNSNCSDSPCVSETSSDIFSKREVIQKLRQQLKRRDDMIQEMQEQILELQNSYNAQTAHSSHLQAQLDTLNRDLFESEREVQRLRKAIADHSVGCGADSNGKTSPVGPWNGGFMDSESNYESQEKSLRDGERVEMLRKEVSELKEVIDGKEYLLRSYKEQKIELSQKVKELQQRLDSQLQNLL

SEQ ID NO: 339 - DNA, 807 bp, Arabidopsis thaliana
atggctgatgaaatcaatgagataagggaagagcaagaacagctcgcaccctttgatccttccaagaagaaaaagaagaagaaggttgtgattcaggaacctgtcgaggacttagcagagtcttcacagactgagaaatctgattcattgcctgttaatgatggtcttgagagttcatttactggaatgaagaaaaagaagaagaagccaactgaatcaagcttattgaacaacgaaagtgttgatgctggggaagatttggatgagattgctaatgacgagcaagagggggaagaaggaatagttctacagcaacgttacccctgggagggaagtgagagggattacatatatgacgagcttcttggtagagtctttaacattctccgtgaaaataatccggagcttgctggagataggcgtcgtacagttatgaggcctcctcaagttcttcgtgaggggacaaagaagactgtctttgtcaacttcatggacctttgcaagacgatgcatcgtcaaccagatcatgttatgcaatacttgcttgctgagttgggtactagtggttcgcttgatgggcagcaaaggttggttgttaagggaaggtttgcacctaagaattttgaaggaattttgcggcgatatatcactgactacgtcatttgccttggttgcaagagcccagacaccattctctccaaggagaaccgtctcttctttctgagatgtgaaaagtgtggatctcaacgatctgtggctccgatcaaaacagggtttgttgctcgtgttagtcgcaggaagacttga

SEQ ID NO: 340 - protein, 268 aa, Arabidopsis thaliana
MADEINEIREEQEQLAPFDPSKKKKKKKVVIQEPVEDLAESSQTEKSDSLPVNDGLESSFTGMKKKKKKPTESSLLNNESVDAGEDLDEIANDEQEGEEGIVLQQRYPWEGSERDYIYDELLGRVFNILRENNPELAGDRRRTVMRPPQVLREGTKKTVFVNFMDLCKTMHRQPDHVMQYLLAELGTSGSLDGQQRLVVKGRFAPKNFEGILRRYITDYVICLGCKSPDTILSKENRLFFLRCEKCGSQRSVAPIKTGFVARVSRRKT

SEQ ID NO: 341 - DNA, 1704 bp, Arabidopsis thaliana
atgagtttaacaaagaaagcaagtgaaccaaagctaagtggtactagtatcaagccaacaactttaaaccctcatgctgctgagtttgttccgtttactctacgttctccttcatctggaggtacaagtactttggatacaagacttttagcttcttctagttctgttgggaaagcggttttggacaggacagaatcatctgcgtcacatcattcagatgaagaagcacgtcagttctggagtcatcaacttcctgatgatataactccagattttgggttgatgactcaagatgacaattcttatggatctggtagtttgtcactagctaacttgtcgttgtttgacggtaatgaagctgagaagtttccttctgctagtggaggatatggcttttcagatcaaactggattagcttcacataatgctaatggtaatagcttggctgataagagtagatatcccatttcttcatttggggaagatcctcagcgacagagtttcatgcaactgagtccaaagccttgggataagcaaatcatgaatgctgagcagcttcttgggaatgacagggaaagaaacccttttagtgggaaatctcgacatggctttgttaacgacatgattactgagagtccaggggatatggaggtgaaccctgtggattttctcgcttctcagttccccggattcgccgctgagagtctagcagaagtttattttgctaatgggtgtgatttgcagttgacaattgagatgcttactcagcttgagctacaagtggatggtggcttgaatcaaaacataagccctaagacttatgctcctcctagtctaactccaatggattttcctgcactaagcatctcaaatagccatggtattcctgcccagtttggtggggatgatttgcaacaaactggaaatcattaccaatctcctgaaaaggataacatgttcttcttcaagtcgggaccatcggtttctcagcctggtgcaatcgattatgtttctgctgtcaggaagttagcatctcaggattctggtatgtggaaatatgaacgaaatgattcagcagactcatctattggctctagcaggaattctggtgcttacaaaagtggccgtgggaggagtatatattctgataagctgcaaagtcgagcccaaactcgacctgctcctgtttgggtggagaccggggatgctgttggcaatatgtattctgagttacgcgaggaagcacgtgactatgcacgtttgcggaatgtgtactttgaacaggcacgacaagcataccttgttgggaataaggccttagccaaagagctaagtgttaagggacagttgcataatatgcaaatgaaggctgctcatgggaaagctcaagaagccatttaccgccagaggaacccagtgggtcaaggaaacagtagagggaatgagagaatgatagacttgcatgggttacatgtgagtgaagcacttcaggtgttgaagcacgaactgagtgtgttgaggagcacagctcgagcaacgcaagagaggcttcagatttacatatgtgtagggacaggccaccacacaaggggttcccgcactccggctagactcccagttgctgtacagcgctacctactcgaagaagaaggtcttgactattccgaaccacaggccggtctccttagagtcatcatatactga

SEQ ID NO: 342 - protein, 567 aa, Arabidopsis thaliana
MSLTKKASEPKLSGTSIKPTTLNPHAAEFVPFTLRSPSSGGTSTLDTRLLASSSSVGKAVLDRTESSASHHSDEEARQFWSHQLPDDITPDFGLMTQDDNSYGSGSLSLANLSLFDGNEAEKFPSASGGYGFSDQTGLASHNANGNSLADKSRYPISSFGEDPQRQSFMQLSPKPWDKQIMNAEQLLGNDRERNPFSGKSRHGFVNDMITESPGDMEVNPVDFLASQFPGFAAESLAEVYFANGCDLQLTIEMLTQLELQVDGGLNQNISPKTYAPPSLTPMDFPALSISNSHGIPAQFGGDDLQQTGNHYQSPEKDNMFFFKSGPSVSQPGAIDYVSAVRKLASQDSGMWKYERNDSADSSIGSSRNSGAYKSGRGRSIYSDKLQSRAQTRPAPVWVETGDAVGNMYSELREEARDYARLRNVYFEQARQAYLVGNKALAKELSVKGQLHNMQMKAAHGKAQEAIYRQRNPVGQGNSRGNERMIDLHGLHVSEALQVLKHELSVLRSTARATQERLQIYICVGTGHHTRGSRTPARLPVAVQRYLLEEEGLDYSEPQAGLLRVIIY

SEQ ID NO: 343 - DNA, 1206 bp, Arabidopsis thaliana
atgggtaataagttgggaaggaagaggcaagtggtggaagaaaggtatacaaagcctcaaggtttgtatgtgaataaagatgtcgacgttaaaaagctcagaaaactgattgtggagtctaagcttgctccttgctatcctggagacgatgaaagctgtcatgatcttgaagaatgtccaatttgttttctgtactatcctagcctcaatagatcaagatgttgcatgaaaagcatttgtacagagtgttttttgcaaatgaagaatcctaattcagctcggcctactcagtgccctttttgtaaaactcccaactatgctgtcgagtatcgtggagtcaagtcaaaggaggaaaagggcattgaacaagttgaagagcaacgggtaatagaagccaaaataaggatgaggcagaaagaaatgcaggatgatgaagagaaaatgcagaaacgtcttgaatcatgttcctctagcacaagcgcaatgactggcgagatggaatatggttcaacttcagccatatcttataactccctcatggatgacggggaaattgctccatcgcagaacgcatctgttgttagacaacattcccgcccgcgaggaaacagggaggatgaggttgacgttgaccttgaggaattgatggtcatggaagcaatatggctctctgttcaggaaacagggacgcagagaaattcagcttcaggggaaattacctcttctaggcagtatgtaacagataatcatagttatgtttcttcaccaccacgagtgactccaatcgtagaaccagcaacaccgtcttcatcatctggtgggctttcttgtgcaatctccgcacttgctgaacgccaaatggttggcgaatcctccagtcacaatcataatcacaatgtcaacgtttcttcatacagtatgcttcccggaaattgtgacagttactacgacatagaacaagaggtagatggcatagacaaccatcatcatcatcgtcatcattacgagatgggagaaacaggaagcagcaacagctatgtaagttcttacatgacaggcgagggcttccacaactttcctcctcctccacctctggtcattgttccagagagttttgaggaacagatgatgatggctatggctgtgtctatggcagaggttcatgccacgacgacatgtgcaccaactgaagttacctggcaataa

SEQ ID NO: 344 - protein, 401 aa, Arabidopsis thaliana
MGNKLGRKRQVVEERYTKPQGLYVNKDVDVKKLRKLIVESKLAPCYPGDDESCHDLEECPICFLYYPSLNRSRCCMKSICTECFLQMKNPNSARPTQCPFCKTPNYAVEYRGVKSKEEKGIEQVEEQRVIEAKIRMRQKEMQDDEEKMQKRLESCSSSTSAMTGEMEYGSTSAISYNSLMDDGEIAPSQNASVVRQHSRPRGNREDEVDVDLEELMVMEAIWLSVQETGTQRNSASGEITSSRQYVTDNHSYVSSPPRVTPIVEPATPSSSSGGLSCAISALAERQMVGESSSHNHNHNVNVSSYSMLPGNCDSYYDIEQEVDGIDNHHHHRHHYEMGETGSSNSYVSSYMTGEGFHNFPPPPPLVIVPESFEEQMMMAMAVSMAEVHATTTCAPTEVTWQ

SEQ ID NO: 345 - DNA, 2532 bp, Arabidopsis thaliana
atggtgaagtttacagctgatgagcttcgaaggattatggactacaaacacaacatccgtaatatgtctgttattgctcatgtcgaccacgggaaatccactcttactgattctttggttgctgctgctggtatcattgcccaagaggttgctggtgatgttcgtatgactgataccagagctgatgaggctgaacgtggtatcactatcaagtccactggtatttctctctactacgagatgactgatgaatccttgaagagtttcactggagccagagacggaaacgagtacctcatcaatcttattgattcacctgggcacgttgacttttcttctgaggttactgctgctctccgtattactgatggtgctcttgtggtggtcgactgcattgagggtgtgtgtgttcagactgagactgttctacgtcaggctcttggtgagaggattcgacctgtcttgactgtcaacaagatggacaggtgtttccttgagcttcaggttgatggtgaggaggcttaccagactttctcgagggttattgagaacgctaatgtcatcatggctacatacgaggatcctctccttggtgatgttcaggtttacccagagaagggaactgtggcgttttctgctggtctccatggatgggcgtttacactgaccaacttcgccaagatgtatgcttccaagttcggtgttgttgaatctaagatgatggagaggctctggggtgagaatttctttgaccctgccaccaggaagtggagtggcaaaaacactggttccccgacctgcaagcgtgggtttgttcagttctgctatgaacccatcaagcaaattattgctacttgcatgaatgaccagaaggataagttgtggcctatgttggcgaagcttggtgtctcaatgaagaatgatgagaaggagcttatgggtaaacctctaatgaagcgtgttatgcagacttggctccctgcaagtactgcactacttgagatgatgatctttcatttgccatctccccacactgcccagaggtaccgtgttgagaatctgtatgaaggtcctcttgatgatcagtatgcaaatgccatcaggaactgtgaccccaatggacctctcatgctctacgtatccaagatgattccagcctctgacaagggtagattctttgccttcggtcgtgtctttgctggtaaggtttctactggtatgaaggtcagaatcatgggtcccaactatatccctggtgagaagaaggatctgtacactaagagtgttcagaggactgtcatttggatgggtaagaggcaagagacagtggaggatgtcccttgtggtaacactgttgctatggttgggctggatcagttcatcaccaagaatgctacattgactaatgagaaggaagttgatgctcaccccattcgtgctatgaagttttctgtgtctcctgttgttcgtgttgctgttcagtgtaaggttgcgtctgaccttcccaagttggttgagggtctcaagaggttggccaagtctgatcctatggttgtgtgtacaatggaggaatcaggtgagcacattgttgctggtgcaggagaactccatcttgagatttgtcttaaggatcttcaggatgatttcatgggtggtgctgaaattatcaagtcagaccctgtggtctccttccgtgagacagtttgtgatagatctactcgcacagttatgagtaagtctcctaacaagcataaccgtctgtacatggaagcaagacccatggaggaaggtctagctgaggctattgatgatggacgtattggcccaagggatgaccctaagatcagatccaagatcttggctgaggagtttggatgggacaaggatcttgcaaagaagatctgggcttttggacctgaaaccacagggcctaacatggttgtcgatatgtgtaagggagttcagtaccttaacgaaatcaaggattcagttgttgctggtttccagtgggcgtccaaggaaggtcctcttgctgaagagaacatgagaggtatctgttttgaggtatgtgatgtggtgcttcactctgatgccatccacagaggaggtggtcaggttatccccacagccagaagggtcatatacgcttcccagatcacagctaagcccagacttttggagccggtttacatggttgagatccaggcaccagagggagctcttggaggaatctacagtgtgctgaatcagaagcgtggacacgtgttcgaggagatgcagaggccaggaactcccttgtacaacatcaaggcatacctgcctgttgtggagtctttcggattctcaagtcagcttagggcagcaacctcaggacaggcattcccacagtgtgtgtttgatcattgggaaatgatgtcttctgaccctcttgagccaggtactcaggcttcagttttggtggctgatatcaggaagaggaagggattgaaggaagcgatgactccactatctgagttcgaagacaagctttaa

SEQ ID NO: 346 - protein, 843 aa, Arabidopsis thaliana
MVKFTADELRRIMDYKHNIRNMSVIAHVDHGKSTLTDSLVAAAGIIAQEVAGDVRMTDTRADEAERGITIKSTGISLYYEMTDESLKSFTGARDGNEYLINLIDSPGHVDFSSEVTAALRITDGALVVVDCIEGVCVQTETVLRQALGERIRPVLTVNKMDRCFLELQVDGEEAYQTFSRVIENANVIMATYEDPLLGDVQVYPEKGTVAFSAGLHGWAFTLTNFAKMYASKFGVVESKMMERLWGENFFDPATRKWSGKNTGSPTCKRGFVQFCYEPIKQIIATCMNDQKDKLWPMLAKLGVSMKNDEKELMGKPLMKRVMQTWLPASTALLEMMIFHLPSPHTAQRYRVENLYEGPLDDQYANAIRNCDPNGPLMLYVSKMIPASDKGRFFAFGRVFAGKVSTGMKVRIMGPNYIPGEKKDLYTKSVQRTVIWMGKRQETVEDVPCGNTVAMVGLDQFITKNATLTNEKEVDAHPIRAMKFSVSPVVRVAVQCKVASDLPKLVEGLKRLAKSDPMVVCTMEESGEHIVAGAGELHLEICLKDLQDDFMGGAEIIKSDPVVSFRETVCDRSTRTVMSKSPNKHNRLYMEARPMEEGLAEAIDDGRIGPRDDPKIRSKILAEEFGWDKDLAKKIWAFGPETTGPNMVVDMCKGVQYLNEIKDSVVAGFQWASKEGPLAEENMRGICFEVCDVVLHSDAIHRGGGQVIPTARRVIYASQITAKPRLLEPVYMVEIQAPEGALGGIYSVLNQKRGHVFEEMQRPGTPLYNIKAYLPVVESFGFSSQLRAATSGQAFPQCVFDHWEMMSSDPLEPGTQASVLVADIRKRKGLKEAMTPLSEFEDKL

SEQ ID NO: 347 - DNA, 1428 bp, Arabidopsis thaliana
atgccttcttgttcggtaactgaaatttcaaaatgtatcgtctatccggagaagaagtccaccgtctccgatctccgtctctccgtctccgacctccctatgctctcatgtcattacattcaaaaaggcgtcctcctcaccagccctcctccttccttctccttcgacgaccttgtctcctctctccgccgttctctctcctccactctttccctcttccctgctttagccggccgtttctccaccactcccgccggtcacatttccattgtctgcaacgacgccggagttgatttcgtcgccgcttccgctaaacacgtcaaactctctgatgttctcttaccaggtgaagacgttcctctgcttttccgtgagtttttcgtcttcgagcgtctcgttagttacaacggtcatcataagcctctcgccgccgttcaagtgacggagctccacgacggtgtcttcatcggatgtaccgtgaatcattccgttactgacggaacttccttctggcacttcttcaacacctttgctgacgtcactagcggtgcttgtaagatcaaacaccttccagatttctcccgccacaccgtcttcgattctccggtcgttcttccagtccctcccggtggtccacgtgtcactttcgacgccgaccaacctctacgggagagaatttttcatttcagcagagaggcgattaccaaactgaaacagaggacgaataacagagttaacggaattgagactgccgttaacgatggaaggaaatgtaacggagagattaacggaaaaataacaaccgttttggatagttttttgaataataagaagagttatgatcggacggctgagatttcatcgttccaatctctcagcgctcagctatggcgatccgttacacgagcgaggaatctcgatccgagcaagacgacgacgtttcgaatggcggttaattgccggcaccggcttgagccgaagatggatccgtactacttcggaaacgcgatacagagcataccgacgttggcgtctgcgggagatctgctaagcaaagatctcaggtggtccgccgaacagttacacaggaacgtggtggcgcacgacgacgcgacggtccgccgtggaatcgccgcttgggaaagcgatccgaggctgtttcctctcggaaatccagatggagcttcgatcacgatggggagctcgccgagattcccaatgtacgacaatgatttcggatggggaaaaccgttagctgtgagaagcggcggagcgaataaattcgacgggaagatctcggcgtttcccggtagagaaggaaacggaagcgtggatctggaagtagttctggcgccggagactatgactgggattgagaacgatgctgagtttatgcaatacgtatcagaagtcacttacgattgttga

SEQ ID NO: 348 - protein, 475 aa, Arabidopsis thaliana
MPSCSVTEISKCIVYPEKKSTVSDLRLSVSDLPMLSCHYIQKGVLLTSPPPSFSFDDLVSSLRRSLSSTLSLFPALAGRFSTTPAGHISIVCNDAGVDFVAASAKHVKLSDVLLPGEDVPLLFREFFVFERLVSYNGHHKPLAAVQVTELHDGVFIGCTVNHSVTDGTSFWHFFNTFADVTSGACKIKHLPDFSRHTVFDSPVVLPVPPGGPRVTFDADQPLRERIFHFSREAITKLKQRTNNRVNGIETAVNDGRKCNGEINGKITTVLDSFLNNKKSYDRTAEISSFQSLSAQLWRSVTRARNLDPSKTTTFRMAVNCRHRLEPKMDPYYFGNAIQSIPTLASAGDLLSKDLRWSAEQLHRNVVAHDDATVRRGIAAWESDPRLFPLGNPDGASITMGSSPRFPMYDNDFGWGKPLAVRSGGANKFDGKISAFPGREGNGSVDLEVVLAPETMTGIENDAEFMQYVSEVTYDC

SEQ ID NO: 349 - DNA, 1902 bp, Arabidopsis thaliana
atgtcgtcatcgccttttccagtcttggacaaccgaccaattgataagtggaaggttacggaattgaaagaagagcttaaaagacggagactaacaacaagaggcttgaaggaggaattggttaggcgtcttgatgaagcacttcgtgctgagcaagaagagtctgaaaggatcaatagtgctactgttgctgctgctgaaaaagccaatcaagagcctcagatgtttcctgttactgtaggtgatcgtaatcaaaccactcctgttactcctgttgaagcggcatttagcactgagacaactcctgttacagctgagaaaaccccagaaccaactcagaccaagataacaactgaagcttcagctggtgttgagactacaccagccccggtgttttcagaaccagaggttaacgctgtgccattcgctagtgatgaagatgagaaagagaaagttgatgatgttagagacatagctggtcttgatagttcagtggttgcacgtgatgcagcagttgtgcaagtggcgtctagtgagcacaaatctgagaataatgaaccatttagtgggttggatggtggggattctaaggctcaaccatcagaggcagtgcttgaaaaatctgctatgtacaaccaggtatctgaggtcatccccgttacagggtttgaggtaaaatctgattgtatttctactgattctgtgtcaaataatgaaaaaatagaactaaaggataacaaaattgctgataatgtcaaattagaacaaaatgttaataagttccaagagccatcaacagtcgttggcgaatcgcatccaatggatgtcgaggagccacttgagcagaagacatctgttggaggtggggatgacagcaatgctgcaaacgcagatatgatcaaagaaaataatattatcgatgcaggcgactcagaaaagttgaatttagatagaagttctggtgatgagtctatggaggatgagccggagacaaagcaatccgagtcaattacatctgatgataagagtgcaaaaattgaaatgctttctaaggaggaaagccgtgctgatatggatgcggggaaagggaaatcccctgaaaataaaagtcacccactggtggcttctgacaaaagaaagcttcctgctaatgatcaagaagctgttggaaacaatgaacctgcaaagaggcgccgatggaactctaatagtattaaagttcctgaagcacagatcactaatagtgctacacccactacaacaccaaggtcgactggtctgaagcgcgacttctcaaggtctgactcttcggttagtgaagatggacccaaggaacgtgtggttcctccatctccaaaggagcctacaaattccctcaggattgaccgtttccttaggccgttcacactgaaagctgttcaggagctcctgggtaaaaccggaaatgtcactagtttctggatggaccacattaagacccactgctatgtatcgtatccctcggttgaagaagcagcagcaacaagagaagcagtgtataacctccagtggccacctaatggaggccgccatctgatagctgaatttgttagagcagaagaagtaaaagaaaaactggaagctcctctgcctcctcagcctcagcatcagccacaagctcagactctttcgcggccacctccaactgctcttccaccaccaccacctctggccaaaccacctcacgttgtagaacgtcttcctctgcctccccctcctcctatagcccctgaggaacaagaacctcccattgtcactcttgatgatctattcaagaagacaaaagcgatccccaggatatattacttacccttgtcagaggagcaagttgcagctaaacttgcagcgaataataacaagtga

SEQ ID NO: 350 - protein, 633 aa, Arabidopsis thaliana
MSSSPFPVLDNRPIDKWKVTELKEELKRRRLTTRGLKEELVRRLDEALRAEQEESERINSATVAAAEKANQEPQMFPVTVGDRNQTTPVTPVEAAFSTETTPVTAEKTPEPTQTKITTEASAGVETTPAPVFSEPEVNAVPFASDEDEKEKVDDVRDIAGLDSSVVARDAAVVQVASSEHKSENNEPFSGLDGGDSKAQPSEAVLEKSAMYNQVSEVIPVTGFEVKSDCISTDSVSNNEKIELKDNKIADNVKLEQNVNKFQEPSTVVGESHPMDVEEPLEQKTSVGGGDDSNAANADMIKENNIIDAGDSEKLNLDRSSGDESMEDEPETKQSESITSDDKSAKIEMLSKEESRADMDAGKGKSPENKSHPLVASDKRKLPANDQEAVGNNEPAKRRRWNSNSIKVPEAQITNSATPTTTPRSTGLKRDFSRSDSSVSEDGPKERVVPPSPKEPTNSLRIDRFLRPFTLKAVQELLGKTGNVTSFWMDHIKTHCYVSYPSVEEAAATREAVYNLQWPPNGGRHLIAEFVRAEEVKEKLEAPLPPQPQHQPQAQTLSRPPPTALPPPPPLAKPPHVVERLPLPPPPPIAPEEQEPPIVTLDDLFKKTKAIPRIYYLPLSEEQVAAKLAANNNK

SEQ ID NO: 351 - DNA, 3168 bp, Arabidopsis thaliana
atggcaccagttaggaagtcgaggagtgtgaacaagcgtttcaccaatgaaacttccccaagaaaagatgctgggaaatcgaaaaaaaataagctacgtaagaagaaattgtctgacaagctgggacctcagtggaccagattagaacttgagcgtttctatgatgcttaccgcaagcacggacaagagtggagaagggtggctgctgcaattcggaatagcaggtctgttgacatggtggaagctctatttaatatgaatcgggcgtatttatctctccccgagggaactgcctctgtagctggccttattgcgatgatgacagatcattacagtgtcatggaagggagtggcagtgaaggagaaggccatgatgcttcagaagtaccaaggaaacaacaaaagcgcaaacgtgctaaacctcaacgtagcgattctccagaggaagtggatatacaacagtcaattggttcaccagatggatgcctcacgtttttgaagcaagcacgagctaatgttcatgtaggaactcagcgacatgccactggaaaacgtacaccacgggttcctgtacaaacttcatttatgagggatgatagagaaggctctactccaccaaataaaagagccaggaagcaattcgatgccaatgatgatgtagcacattttttagcgttagcattaacagatgcatcgagaaggggagggtctccaaaagtttctgaatcaccaaatagaagaacagaacttagcgatagctcaccgataaagagctgggggaaaatgtcgcgaaccagaaaatctcagtctaagcactgtggcagctccattttcgaggagtggatggaaagtagccgagaaaggaaacttgactctgataaagatactaccttgttgatggatatggaaagggctggcgaaatggaggctccgcggaaggggaaaagagtctacaagaaaagagtgaaagtcgaagaagcagaatgtaatgattctgatgacaatggagaagcatgcagtgccacacaagggctcagaagtaaatcacaaagacgaaaggctgctattgaagcctcaagagagaaatactcaccgcgcagcccaaagaaaagagatgacaaacatacttccggagcttttgatgccctgcaagcattggccgaattgtcagcttcaatgcttccagcaaatttgatggagtcagaattatctgctcagttgaaggaagaaagaacagaatacgacatggacgagaaatctagcacaccagaagctacttccacaagcagtcatggggaaaaagcaaatgtagagccagatgatagtctccttcatgcaatttcttctgttgagaatgctaacaagagaaagtcaaaaccttcaaggctggtatccactgattgtgatgatgttcccacagggaagctacaaccacaaactagtggcagtttaagaaaacgtaaaccaaaggtactaggggatgaagctccagcagagtttagtcagaacaaatccataaacaagaaggaattgcctcaagatgagaataatatgaagtctttggttaaaacaaaacgcgctggtcaagttccggctcagtcaaaacagatgaaaactgttaaggcgttggaggaatctgctataacaagtgataagaaaagacctgggatggatatagtagcgtcacctaaacaagtttctgactcgggtccaaccagtttatcgcagaaacctccaaacaggcgaaagaagagtctgcagaaaagcttacaagaaaaggctaaatcttctgaaaccactcataaagctgcacgtagttccagatctctttcagaacaagagttgttgttaaaggataagcttgctacttctctgtcgtttccctttgcacgtcgaaggtgcatatttgaatggttttatagtgctatcgaccatccctggttttcaaagatggagtttgtcgattacctaaatcacgtggggcttggtcacattccaagacttactcgtcttgaatggagcgtcattaaaagttctcttggtagaccacgaagattctctgagagatttttacatgaagagcgggagaaacttaaacagtaccgcgaatctgtgcgaaagcattatacagagcttcgaacgggtgctagggaggggcttcctacagatttggctcggccattagcagttgggaacagagtcattgccatccatcccaaaacacgggagattcatgatggaaaaattctcactgttgatcataacaaatgcaatgttctcttcgatgacttgggcgttgagttggttatggacattgattgcatgcctttaaatccactggaatacatgccagagggtctaaggaggcaaattgataagtgcttgtctatgaagaaagaagcacagctaagcgggaatacaaaccttggtgtgtctgtgctattccctccttgcggacttgaaaatgtcagcttttccatgaatcctcctctgaatcagggtgatatgattgctcccattctgcatggtaaagtatcaagcaacactagtagtccacggcagactaatcattcatatatcacaacttataacaaagcaaaagaagctgagattcaacgggcacaagcgctacagcatgctttagatgaaaaggaaatggagccagagatgctagaaattgtcaagggttcaaaaacaagagcgcaagcaatggtggatgcagctataaaggctgcatcatctgtgaaggaaggggaagatgtgaacacaatgatccaagaagccttagagttggttggcaaaaatcagctattacgcagctctatggtcaaacatcacgagcatgtaaatggcagtatagagcatcatcacaacccatctccttcaaatggatcagagcctgtggctaacaacgatttaaactcacaagatggttcagagaaaaacgctcaaatgccttcagagcttatcacctcctgtgttgccacttggctcatgattcagatgtgcacggagagacagtaccctccagctgatgtcgcacagcttatagacgcagcagtcacaagcttgcagccacgatgcccacagaacctaccgatctacagagaaatccaaacgtgcatgggacggatcaagactcaaatcatgtcccttgtaccaacttga

SEQ ID NO: 352 - protein, 1055 aa, Arabidopsis thaliana
MAPVRKSRSVNKRFTNETSPRKDAGKSKKNKLRKKKLSDKLGPQWTRLELERFYDAYRKHGQEWRRVAAAIRNSRSVDMVEALFNMNRAYLSLPEGTASVAGLIAMMTDHYSVMEGSGSEGEGHDASEVPRKQQKRKRAKPQRSDSPEEVDIQQSIGSPDGCLTFLKQARANVHVGTQRHATGKRTPRVPVQTSFMRDDREGSTPPNKRARKQFDANDDVAHFLALALTDASRRGGSPKVSESPNRRTELSDSSPIKSWGKMSRTRKSQSKHCGSSIFEEWMESSRERKLDSDKDTTLLMDMERAGEMEAPRKGKRVYKKRVKVEEAECNDSDDNGEACSATQGLRSKSQRRKAAIEASREKYSPRSPKKRDDKHTSGAFDALQALAELSASMLPANLMESELSAQLKEERTEYDMDEKSSTPEATSTSSHGEKANVEPDDSLLHAISSVENANKRKSKPSRLVSTDCDDVPTGKLQPQTSGSLRKRKPKVLGDEAPAEFSQNKSINKKELPQDENNMKSLVKTKRAGQVPAQSKQMKTVKALEESAITSDKKRPGMDIVASPKQVSDSGPTSLSQKPPNRRKKSLQKSLQEKAKSSETTHKAARSSRSLSEQELLLKDKLATSLSFPFARRRCIFEWFYSAIDHPWFSKMEFVDYLNHVGLGHIPRLTRLEWSVIKSSLGRPRRFSERFLHEEREKLKQYRESVRKHYTELRTGAREGLPTDLARPLAVGNRVIAIHPKTREIHDGKILTVDHNKCNVLFDDLGVELVMDIDCMPLNPLEYMPEGLRRQIDKCLSMKKEAQLSGNTNLGVSVLFPPCGLENVSFSMNPPLNQGDMIAPILHGKVSSNTSSPRQTNHSYITTYNKAKEAEIQRAQALQHALDEKEMEPEMLEIVKGSKTRAQAMVDAAIKAASSVKEGEDVNTMIQEALELVGKNQLLRSSMVKHHEHVNGSIEHHHNPSPSNGSEPVANNDLNSQDGSEKNAQMPSELITSCVATWLMIQMCTERQYPPADVAQLIDAAVTSLQPRCPQNLPIYREIQTCMGRIKTQIMSLVPT

SEQ ID NO: 353 - DNA, 1053 bp, Arabidopsis thaliana
atgaagccagtcttctgtgggaactttgagtatgatgcgcgcgaaggtgacctggaacgactattcaggaaatacggcaaggttgagagggttgatatgaaagctgggtttgcttttgtatacatggaagatgaaagggatgcggaagatgccatccgagcacttgaccgctttgaatttgggcgtaagggacgcagacttcgtgttgaatggacaaagagtgaacgtggaggtgataaaagatctggtggtggttcaaggagatcctcatccagcatgagaccttccaagactctctttgtgattaactttgatgcggataatactaggacccgggatctagagaaacactttgagccgtatggaaagatcgtaaacgttaggatcaggaggaattttgcatttatccagtacgaggcacaagaggatgccaccagagcattggatgcttcaaataacagtaagctgatggataaggtgatctcggtggagtatgctgtgaaggatgatgatgctagaggaaatggacacagtcctgaaagacgccgtgataggtcacctgaaaggagaaggcgatcacctagtccttacaaaagagaaagaggaagccctgattatggccgaggagctagtcctgttgctgcctacagaaaggaaaggaccagtcctgactatggtcgaagacgtagcccaagtccttacaagaaatcaagacgtggcagtcccgagtatggtcgtgaccgcagaggcaatgatagccctcgcaggagggagagagtcgcaagccctactaagtacagccgcagtcccaacaacaagagagagaggatgagccctaatcacagcccgttcaagaaggagagtccgagaaatggggttggtgaagttgaaagtcccattgaaaggagagagagatcgaggtctagccccgagaatggccaagttgaaagccctgggtcaataggaagaagagacagtgatggtgggtatgatggtgcagagagcccaatgcagaagagccggtctcctcgttcgccaccagctgacgagtga

SEQ ID NO: 354 - protein, 350 aa, Arabidopsis thaliana
MKPVFCGNFEYDAREGDLERLFRKYGKVERVDMKAGFAFVYMEDERDAEDAIRALDRFEFGRKGRRLRVEWTKSERGGDKRSGGGSRRSSSSMRPSKTLFVINFDADNTRTRDLEKHFEPYGKIVNVRIRRNFAFIQYEAQEDATRALDASNNSKLMDKVISVEYAVKDDDARGNGHSPERRRDRSPERRRRSPSPYKRERGSPDYGRGASPVAAYRKERTSPDYGRRRSPSPYKKSRRGSPEYGRDRRGNDSPRRRERVASPTKYSRSPNNKRERMSPNHSPFKKESPRNGVGEVESPIERRERSRSSPENGQVESPGSIGRRDSDGGYDGAESPMQKSRSPRSPPADE

SEQ ID NO: 355 - DNA, 1518 bp, Arabidopsis thaliana
atggcgatggcatcattcgggcagctaaatctcgaggaacctcctccaatctggggatctcgcagcgttgattgctttgagaagctcgaacaaattggtgaaggcacttacggtcaagtttacatggctaaagaaatcaaaactggtgaaattgtggctctcaaaaagatacgtatggacaatgaaagagaagggtttcctataacagctattagagagataaagattctgaagaagcttcatcatgaaaatgtcattcagctgaaagagattgtgacttcaccaggtcgggacagggatgaccaaggaaagccagataataacaaatacaagggtggcatctacatggtttttgagtacatggatcatgatttgactggactagcagatcgtcctggactgagatttactgttcctcaaattaagtgttacatgaagcaattgcttaccgggcttcactattgtcatgtgaatcaagtgcttcaccgtgatataaaaggctcaaatctccttatcgacaatgagggaaatttaaagctggctgattttgggcttgcacggtcgtattctcatgatcatactggaaatcttacaaatcgtgtcatcacattgtggtataggccccctgaattactacttggggctacaaaatatggcccagcaattgacatgtggtcggttggttgcatatttgccgaacttttgcatgcaaaaccaatcttacctgggaaaaatgagcaagaacaattgaacaagatatttgagctttgtggatcacctgatgaaaaactttggcctggggtttccaagatgccttggttcaacaatttcaagcctgcacggcccttgaagaggcgtgtaagagagttcttcagacactttgatcggcatgctcttgaattactggagaaaatgttggtgcttgatccagcacagagaatatcggcaaaggatgctcttgatgccgagtacttttggactgatccgttgccatgtgacccaaagagtctgcccacatatgaatcatcacatgagttccagacaaagaaaaagcggcaacagcagcgccaaaacgaggaagcagcaaaaagacagaaactgcagcatccaccgctgcagcactctcgcttacccccattacaacatggtggacagtctcatgctgctccacattggcctgcaggtccaaaccatcccactaacaacgcaccaccacaagtacctgctggacccagccacaacttctatgggaagccgcgtggtccacctggtccaaaccgctaccctcctagcggaaaccagagcgggggttataatcaaagccgaggaggttacagcagtggatcatatcctccacaaggacgtggagctccttatgtggctggtcctagagggcctagtggtggcccgtacggggttggacctcctaactacacacaaggtggtcagtatggtggctctggtagctcgggaagagggcagaatcagagaaaccagcaatacggatggcaacagtaa

SEQ ID NO: 356 - protein, 505 aa, Arabidopsis thaliana
MAMASFGQLNLEEPPPIWGSRSVDCFEKLEQIGEGTYGQVYMAKEIKTGEIVALKKIRMDNEREGFPITAIREIKILKKLHHENVIQLKEIVTSPGRDRDDQGKPDNNKYKGGIYMVFEYMDHDLTGLADRPGLRFTVPQIKCYMKQLLTGLHYCHVNQVLHRDIKGSNLLIDNEGNLKLADFGLARSYSHDHTGNLTNRVITLWYRPPELLLGATKYGPAIDMWSVGCIFAELLHAKPILPGKNEQEQLNKIFELCGSPDEKLWPGVSKMPWFNNFKPARPLKRRVREFFRHFDRHALELLEKMLVLDPAQRISAKDALDAEYFWTDPLPCDPKSLPTYESSHEFQTKKKRQQQRQNEEAAKRQKLQHPPLQHSRLPPLQHGGQSHAAPHWPAGPNHPTNNAPPQVPAGPSHNFYGKPRGPPGPNRYPPSGNQSGGYNQSRGGYSSGSYPPQGRGAPYVAGPRGPSGGPYGVGPPNYTQGGQYGGSGSSGRGQNQRNQQYGWQQ

SEQ ID NO: 357 - DNA, 1617 bp, Arabidopsis thaliana
atgggtaattgttgcggaacagcaggatcattggctcaaaacgataacaaacccaaaaaaggaaggaagaagcaaaaccctttctcgattgattacggtcttcaccacggtggtggagatggaggtggaagacctcttaagcttatcgttttgaatgatccaacaggtcgtgagatcgagtctaaatacacgttggggagagagctaggtcgtggagaattcggtgttacgtatctatgtactgataaggagacagacgacgtttttgcttgtaaatcgattttgaagaagaagctgaggacagctgttgatattgaagatgttaggagagaggttgagattatgaggcatatgcctgagcatcctaatgttgttactttgaaggagacttatgaggatgagcatgctgttcatttggttatggagctttgtgaaggtggtgaattgtttgataggattgttgctagagggcattatactgagagagctgctgctgctgtcactaagaccatcatggaagttgttcaggtgtgtcataagcatggggtaatgcacagggacctgaaacctgagaacttcttgtttggaaacaagaaggagactgcacctcttaaggcgattgattttggtctctctgttttctttaaaccaggcgagaggtttaacgaaatcgttggtagtccgtactacatggctcccgaggtgctaaaacggaattatggtccagaagttgatatttggagtgcaggtgtaattctttacatactgctatgtggtgtcccgcctttctgggcagaaactgaacaaggagttgcacaagcaattattcgatctgtactagacttcagaagggacccatggcccaaggtttctgaaaacgcaaaagaccttatcaggaaaatgcttgatcctgaccaaaagcgtcgtcttacagctcaacaagtcctagatcacccgtggttacagaatgcaaagacagcccccaatgtatcattgggtgaaacagtgagggcaaggttgaagcagttcaccgtcatgaacaagctcaagaaacgagcactcagggttattgctgagcatttatcagatgaagaagcttcaggtataagagaagggttccaaataatggacacaagccaaagagggaagattaacatcgacgagcttaaaatcgggttgcagaaacttggtcatgccattccgcaagatgatttacaaattttgatggatgctggagacatcgatagagatggatatttggactgtgacgagtttattgccatatcggtacacctaaggaaaatgggcaatgacgagcatctcaagaaagcgtttgcgttctttgatcaaaacaataacggatatatcgaaatagaggagttaagggaagccttgtctgacgaacttggtacaagtgaagaagttgttgatgccattatccgtgatgttgacaccgacaaggatggaagaataagttacgaagagtttgtaacgatgatgaaaacaggaacagattggagaaaagcttcgagacagtactcgagagaacggtttaacagtatcagtctcaaactgatgcaagatgcgtcgttgcaggtcaatggtgatacaagatga

SEQ ID NO: 358 - protein, 538 aa, Arabidopsis thaliana
MGNCCGTAGSLAQNDNKPKKGRKKQNPFSIDYGLHHGGGDGGGRPLKLIVLNDPTGREIESKYTLGRELGRGEFGVTYLCTDKETDDVFACKSILKKKLRTAVDIEDVRREVEIMRHMPEHPNVVTLKETYEDEHAVHLVMELCEGGELFDRIVARGHYTERAAAAVTKTIMEVVQVCHKHGVMHRDLKPENFLFGNKKETAPLKAIDFGLSVFFKPGERFNEIVGSPYYMAPEVLKRNYGPEVDIWSAGVILYILLCGVPPFWAETEQGVAQAIIRSVLDFRRDPWPKVSENAKDLIRKMLDPDQKRRLTAQQVLDHPWLQNAKTAPNVSLGETVRARLKQFTVMNKLKKRALRVIAEHLSDEEASGIREGFQIMDTSQRGKINIDELKIGLQKLGHAIPQDDLQILMDAGDIDRDGYLDCDEFIAISVHLRKMGNDEHLKKAFAFFDQNNNGYIEIEELREALSDELGTSEEVVDAIIRDVDTDKDGRISYEEFVTMMKTGTDWRKASRQYSRERFNSISLKLMQDASLQVNGDTR

SEQ ID NO: 359 - DNA, 957 bp, Arabidopsis thaliana
atggcggagaagccggcgcaagagcaagagcagaagcgagcgatggaacctgcagttctcgacgatattattcgtcgtttggttgagtttcggaacacgagacctggatcggggaagcaagttcatctcagtgaaggtgaaattcgtcagctttgtgctgtctccaaagaaatatttcttcaacagcccaatctgcttgaattggaagctcccatcaagatctgcggtgatattcatgggcagtattcagatctattgaggctttttgagtatggagggttccctcccgaagctaattatttgttcttgggtgattatgttgaccgtggcaagcaaagcttggaaacaatatgtcttcttctagcttacaaaatcaagtaccctgagaacttcttcttgttgagagggaatcatgaatctgcttccattaatcgtatttacggtttctatgatgagtgcaaacgcaggttcaatgtcagactctggaaaatattcaccgattgctttaactgtcttcctgtggccgccttaattgatgacagaatactatgtatgcatggtgggatttccccagagctgaaaagtttggaccagattagaaatattgcacggccgatggatattccggagtctggtttggtatgtgatttactatggtcggatcctagtggagacgtaggctggggcatgaatgatcgtggtgtttcatacacttttggagctgacaaagtcgcagagttcttggagaaacatgacatggaccttatctgtcgtgcccaccaggttgttgaagatgggtatgagttctttgcagaaagacaacttgttacagtattttcagctcccaactattgcggggaatttgacaacgctggcgcaatgatgagcattgatgagagcttaatgtgctcattccagattctaaagccgtcagaaaagaagtcgccttttctgtga

SEQ ID NO: 360 - protein, 318 aa, Arabidopsis thaliana
MAEKPAQEQEQKRAMEPAVLDDIIRRLVEFRNTRPGSGKQVHLSEGEIRQLCAVSKEIFLQQPNLLELEAPIKICGDIHGQYSDLLRLFEYGGFPPEANYLFLGDYVDRGKQSLETICLLLAYKIKYPENFFLLRGNHESASINRIYGFYDECKRRFNVRLWKIFTDCFNCLPVAALIDDRILCMHGGISPELKSLDQIRNIARPMDIPESGLVCDLLWSDPSGDVGWGMNDRGVSYTFGADKVAEFLEKHDMDLICRAHQVVEDGYEFFAERQLVTVFSAPNYCGEFDNAGAMMSIDESLMCSFQILKPSEKKSPFL

SEQ ID NO: 361 - DNA, 2265 bp, Arabidopsis thaliana
atggcgaggtttccgacttctccggcgcctaacctcctcttgagactcttctcgtcgaacaaacgggcgtcatctcctactgccgcgcttttaaccggagattttcatctgattcgtcatttctccgccggaaccgctgctcgtgcggtcaaggatgagaaggagccatggtggaaagaatccatggacaagcttcgcaacatcgggatctcagctcatatagactctggaaagactacgttgactgagcgtgttctgttctataccggtcggatccatgagatccatgaagtcagaggtagagatggcgtcggcgctaaaatggactctatggacttggagcgagagaaaggtatcactatccagtcagccgctacttactgtacttggaaggattacaaggttaatataattgatactcctggtcacgttgacttcaccattgaagtggagagggctttacgtgtactagacggtgcgattctagtcctatgcagtgtgggtggtgtacagagtcagtctattacggtagataggcaaatgaggagatatgaagtcccgagagttgcgtttattaacaagcttgatagaatgggagcagatccatggaaagtcttgaaccaagcaagagctaagcttcgacatcatagtgcagctgtgcaagtgcccattggtctagaagaaaatttccagggtcttatagaccttattcatgtgaaagcttatttctttcatggatcaagcggtgagaatgttgtggctggtgatattcctgctgatatggagggtttggttggggataagaggagagaattgatagagacagtctctgaagttgatgatgtactcgccgagaaatttctgaatgatgaacctgtatctgctgctgagcttgaggaagctattcgtagagctaccatagcacaaaagtttgttcctgtatttatgggtagtgcattcaaaaacaagggagtacaacctctactagatggtgttgtcagttttctcccttctccaaatgaagtcaataactatgctcttgaccagaataataatgaagagagggtaaccttgactggatctccagatggacctcttgtggcgctggctttcaaattagaggagggtcgttttggtcaattgacatatttgagagtttacgaaggtgtgattaagaaaggtgattttatcataaatgtcaacactgggaagagaattaaggttccacgcttggtccgtatgcattcgaatgatatggaggatattcaagaggcacacgctggacaaattgtagctgtgtttggtattgagtgtgcatcaggtgatacatttacggatggatcagtcaagtacacaatgacatcgatgaacgttcctgaacctgttatgtccttagctgttcaaccagtttcaaaagattctggaggacagttctcgaaagcattgaatcgattccagaaagaggatcctactttccgtgtgggtttggatcccgagagtggccagacgattatttctggtatgggggaattgcatttggacatctatgttgaacgcatgcgaagagaatataaggttgatgcgactgtgggcaaaccccgtgtcaattttagggagactattactcagcgggcagagtttgattatttacataagaagcaaagtggaggagcaggtcaatacggtagagttacagggtacgtggaaccgctaccaccaggctctaaagagaagtttgaatttgaaaacatgattgttggacaagcaattccgtctggttttattccagcaattgagaaaggtttcaaagaagctgcaaactcgggctcactaattggtcaccctgtagagaatcttagaatagtattgacagatggagcttcacacgcggtagattccagtgaacttgcgtttaaaatggctgcaatatacgcattcagactgtgttatacagcagctagaccggtgattctagaacctgttatgctggtcgagttgaaagtaccaacagagtttcagggcactgttgctggtgacatcaacaagaggaaaggtataatcgttggaaacgatcaagagggtgatgattcagtaatcactgctaatgtgcctttgaacaacatgtttggctactccacttctctccggtccatgacacaaggaaaaggagaattcacgatggaatacaaagaacattctgctgtgtccaatgaagtccaggctcagctcgtcaatgcttatagcgccagcaaagctactgaataa

SEQ ID NO: 362 - protein, 754 aa, Arabidopsis thaliana
MARFPTSPAPNLLLRLFSSNKRASSPTAALLTGDFHLIRHFSAGTAARAVKDEKEPWWKESMDKLRNIGISAHIDSGKTTLTERVLFYTGRIHEIHEVRGRDGVGAKMDSMDLEREKGITIQSAATYCTWKDYKVNIIDTPGHVDFTIEVERALRVLDGAILVLCSVGGVQSQSITVDRQMRRYEVPRVAFINKLDRMGADPWKVLNQARAKLRHHSAAVQVPIGLEENFQGLIDLIHVKAYFFHGSSGENVVAGDIPADMEGLVGDKRRELIETVSEVDDVLAEKFLNDEPVSAAELEEAIRRATIAQKFVPVFMGSAFKNKGVQPLLDGVVSFLPSPNEVNNYALDQNNNEERVTLTGSPDGPLVALAFKLEEGRFGQLTYLRVYEGVIKKGDFIINVNTGKRIKVPRLVRMHSNDMEDIQEAHAGQIVAVFGIECASGDTFTDGSVKYTMTSMNVPEPVMSLAVQPVSKDSGGQFSKALNRFQKEDPTFRVGLDPESGQTIISGMGELHLDIYVERMRREYKVDATVGKPRVNFRETITQRAEFDYLHKKQSGGAGQYGRVTGYVEPLPPGSKEKFEFENMIVGQAIPSGFIPAIEKGFKEAANSGSLIGHPVENLRIVLTDGASHAVDSSELAFKMAAIYAFRLCYTAARPVILEPVMLVELKVPTEFQGTVAGDINKRKGIIVGNDQEGDDSVITANVPLNNMFGYSTSLRSMTQGKGEFTMEYKEHSAVSNEVQAQLVNAYSASKATE

SEQ ID NO: 363 - DNA, 2103 bp, Arabidopsis thaliana
atggaatttgcttcgccggaacaacgtcgtctcgaaaccattcgatctcacatcgatacttctccgaccaacgatcaatcatcatctctattcctcaacgccaccgcttcttctgcttcacctttctttaaagaggatagctacagtgttgtgcttccagaaaagcttgatactggaaaatggaatgtctacagatctaaaagatcgcctacgaaactcgttagtaggttcccggatcatcctgaaatcgggactttacatgacaattttgtacatgctgttgaaacatatgctgaaaacaagtatcttggtacacgagttcggtccgatggaaccattggagagtattcatggatgacatatggagaagcagcgtctgagcgacaagccattggttcaggactcttgtttcatggagttaaccaaggagattgcgttggactctattttattaacagaccagagtggttggttgtggatcatgcttgtgcagcatattcatttgtctctgttcctttatatgatacacttggtccagacgctgttaagtttgtggtgaatcatgctaatctgcaagctatattttgtgtaccacaaaccttgaatattttgctaagcttcctagcggaaatcccatccattcgtctcattgtggtggtgggaggggctgatgagcatttgccatcacttcctcgaggaactggagtcacaattgtatcataccaaaagctattgagtcagggtcgaagtagcttacatccattttcgcctccaaagccagaagacattgcaaccatatgctacacaagtggaaccacaggaacaccaaagggtgttgtgttgactcatggaaacttgatcgcgaatgtcgctggttccagtgtggaagcagaattctttccttcagatgtttacatatcatatcttcctttggcgcacatatatgaacgtgcaaatcagattatgggggtgtatggtggtgttgctgtcggtttctatcagggggatgtcttcaagctgatggatgattttgctgtgttaagaccaacaatattctgtagtgtccctcgcttatataatcgaatatatgatggcattacaagtgccgtaaaatcatctggggttgtgaaaaaaaggcttttcgaaattgcctataactcaaagaagcaagcgatcattaatgggcggactccttctgcattttgggacaagctggtgttcaacaaaataaaagaaaagcttggtggacgggttcggtttatggggtctggtgcttctcctttgtcacctgatgtcatggatttcttgagaatatgctttggatgttcggtgcgtgaagggtatggtatgaccgagacttcttgtgtcataagtgctatggatgatggtgacaatttatctggccatgtcggttcccctaatccagcttgcgaggtaaaacttgtggatgttcccgaaatgaattacacatcagacgatcaaccatacccacgtggtgaaatctgtgtaagaggaccaatcatcttcaaaggctactacaaagatgaagaacaaacgagagaaattcttgatggagatggctggctacacacaggagatatcgggttgtggttacctggtggtcggctcaagatcatagacaggaagaagaacatatttaagttggcgcaaggagaatatatagcaccagagaagatcgaaaatgtttataccaaatgtagattcgtttcgcagtgtttcattcacggtgatagcttcaattcctctctagtagctatagtttcagtcgaccccgaagttatgaaagattgggctgcatcagaaggcatcaagtatgagcatctaggacagctctgtaacgatccaagagtgcgaaagactgttcttgctgagatggatgaccttggaagagaagctcagttgagagggtttgagtttgcaaaggctgtgactttggtgccagaaccattcaccttggagaatggacttctcacaccaacattcaagataaagagacctcaagcaaaagcctactttgcagaagcaattagcaaaatgtatgcggaaatcgcagcctcgaaccccattccttctaaactgtga

SEQ ID NO: 364 - protein, 700 aa, Arabidopsis thaliana
MEFASPEQRRLETIRSHIDTSPTNDQSSSLFLNATASSASPFFKEDSYSVVLPEKLDTGKWNVYRSKRSPTKLVSRFPDHPEIGTLHDNFVHAVETYAENKYLGTRVRSDGTIGEYSWMTYGEAASERQAIGSGLLFHGVNQGDCVGLYFINRPEWLVVDHACAAYSFVSVPLYDTLGPDAVKFVVNHANLQAIFCVPQTLNILLSFLAEIPSIRLIVVVGGADEHLPSLPRGTGVTIVSYQKLLSQGRSSLHPFSPPKPEDIATICYTSGTTGTPKGVVLTHGNLIANVAGSSVEAEFFPSDVYISYLPLAHIYERANQIMGVYGGVAVGFYQGDVFKLMDDFAVLRPTIFCSVPRLYNRIYDGITSAVKSSGVVKKRLFEIAYNSKKQAIINGRTPSAFWDKLVFNKIKEKLGGRVRFMGSGASPLSPDVMDFLRICFGCSVREGYGMTETSCVISAMDDGDNLSGHVGSPNPACEVKLVDVPEMNYTSDDQPYPRGEICVRGPIIFKGYYKDEEQTREILDGDGWLHTGDIGLWLPGGRLKIIDRKKNIFKLAQGEYIAPEKIENVYTKCRFVSQCFIHGDSFNSSLVAIVSVDPEVMKDWAASEGIKYEHLGQLCNDPRVRKTVLAEMDDLGREAQLRGFEFAKAVTLVPEPFTLENGLLTPTFKIKRPQAKAYFAEAISKMYAEIAASNPIPSKL

SEQ ID NO: 365 - DNA, 924 bp, Arabidopsis thaliana
atggttggaggaggagttatccagcaaattcttaggaggaagcttcactcccaatcacttgcaactccggttttgtcttggttttcttcgaagaaagctcatgaggatgctggttcttctggtgtaagagcacttgccttgttgggtgctggtgttacaggactgttgagtttttctacagtagcatctgctgatgaggctgaacatggattggagagtccagagtacccttggcctcatgatggcattcttagctcatatgaccatgcttcgatccgtcgtgggcatcaagtttatcagcaagtctgtgcatcatgccattcaatgtctctgatctcataccgagacttggtgggtgtcgcctacacagaggaagaggcaaaggcaatggcagctgaaatcgaggtagtagatggacctaatgatgagggtgagatgttcacccgccctggtaaactcagtgaccggtttcctcagccatatgcaaatgaatcagctgcaaggtttgctaatggtggagcgtatcctcctgatctaagtcttataactaaggcacgtcacaatggtccaaactatgtctttgcgcttctgactggttaccgtgatccccctgctggcatatcgattagagaggggttacactacaatccttatttccctgggggagcaattgctatgccgaaaatgctcaatgatgaagctgttgagtatgaagatggtgtccccgccacagaggcacagatgggtaaagatattgtatcattcttggcctgggcagctgaaccagaaatggaagagaggaaactgatgggtttcaaatggatattcctactctctctcgctcttctccaagctgcttactacaggcgactaaaatggtcggttctcaagtcccgcaagctggttcttgacgtggttaactaa

SEQ ID NO: 366 - protein, 307 aa, Arabidopsis thaliana
MVGGGVIQQILRRKLHSQSLATPVLSWFSSKKAHEDAGSSGVRALALLGAGVTGLLSFSTVASADEAEHGLESPEYPWPHDGILSSYDHASIRRGHQVYQQVCASCHSMSLISYRDLVGVAYTEEEAKAMAAEIEVVDGPNDEGEMFTRPGKLSDRFPQPYANESAARFANGGAYPPDLSLITKARHNGPNYVFALLTGYRDPPAGISIREGLHYNPYFPGGAIAMPKMLNDEAVEYEDGVPATEAQMGKDIVSFLAWAAEPEMEERKLMGFKWIFLLSLALLQAAYYRRLKWSVLKSRKLVLDVVN

SEQ ID NO: 367 - DNA, 1743 bp, Arabidopsis thaliana
atggctgagaaagatgaagagctttctttgtttcttgagatgagacgccgtgagaaagagcaggataatcttcttcttaacaataaccctgatgagtttgaaactccattaggttcaaagcatggaacttcgccggtgtttaacatctcaagtggtgctccaccatctcggaaggctgctcctgatgattttctcaattctgaaggcgataaaaatgactatgaatggcttctgacccctccaggtacgcctctatttccatcgctggagatggaatcacataggactatgatgagtcagactggtgattcaaagagtcgcccggctacattgacttccagactggcaaattcctcaacagagtctgctgcaaggaaccatctaacatctagacaacaaacttcttctcctggattgagctcttccagtggagcaagtcgaagaccttcatcatctggaggacctggatcaagacctgccacacccactggaagatcatcaacactgacggcaaattcaaaatcctcaaggccttcaacacccacttcgcgagccactgtctcctcagctactcgaccttctttgactaactcgaggtccacagtatctgcaacgactaagcccacgcctatgagtaggtcaacaagtttatcatcatctaggctcacacctactgcatctaagccgactacctcaactgctagatctgctggttcagtaactagatctacccctagcaccaccacaaaatctgcaggtccttcaaggtccaccacacctctgtcaagatctactgccagatcttcaacaccaacttcaagacccacacttcctccatctaaaaccatatcaaggtcatctacaccaactcgccgtccaattgcttctgcaagtgctgcaactactacagcaaatcccacaatatcccaaatcaagccttcttctccagcgccagcaaagcctatgccaacaccatctaagaaccctgctttatctcgtgcagcatctcctacagtgaggtcaagaccatggaagccgtcagacatgcctggtttctcattagaaactcctccaaatctaaggacaacattacccgaaaggccactttcagcgacaagaggcagacctggagctccaagctctcgttctggttcagttgagccagggggccctccaggaggaagaccaagaaggcaatcatgttcaccatcaagaggaagagcaccaatgtactctagtggtagctctgttcctgcggttaatcgtggatattccaaagccagtgacaatgttagtccggtgatgatgggaacaaaaatggtggagagagtaataaacatgcggaaacttgctccacccagatcagatgacaagggttctcctcatggtaacttgtctgcaaagtcttcatcacccgacagtgcaggatttggaagaacgctctccaagaagtcccttgatatggcaataaggcatatggatatacgtagaactattccagggaacctgagaccactaatgacgaatattccagcatcatcaatgtacagtgtgaggtctggacatacacgtggtagaccgatgaatgtttcagactcttctccactagcaacaagcagcaacgcaagctcagagatcagtgtctgcaacaacaatggcatttgcttagaggcaagtgaaaaggaagacgacgcaggcagcgagagaggttgcaggtcccctgcaagcttacaagggagatga

SEQ ID NO: 368 - protein, 580 aa, Arabidopsis thaliana
MAEKDEELSLFLEMRRREKEQDNLLLNNNPDEFETPLGSKHGTSPVFNISSGAPPSRKAAPDDFLNSEGDKNDYEWLLTPPGTPLFPSLEMESHRTMMSQTGDSKSRPATLTSRLANSSTESAARNHLTSRQQTSSPGLSSSSGASRRPSSSGGPGSRPATPTGRSSTLTANSKSSRPSTPTSRATVSSATRPSLTNSRSTVSATTKPTPMSRSTSLSSSRLTPTASKPTTSTARSAGSVTRSTPSTTTKSAGPSRSTTPLSRSTARSSTPTSRPTLPPSKTISRSSTPTRRPIASASAATTTANPTISQIKPSSPAPAKPMPTPSKNPALSRAASPTVRSRPWKPSDMPGFSLETPPNLRTTLPERPLSATRGRPGAPSSRSGSVEPGGPPGGRPRRQSCSPSRGRAPMYSSGSSVPAVNRGYSKASDNVSPVMMGTKMVERVINMRKLAPPRSDDKGSPHGNLSAKSSSPDSAGFGRTLSKKSLDMAIRHMDIRRTIPGNLRPLMTNIPASSMYSVRSGHTRGRPMNVSDSSPLATSSNASSEISVCNNNGICLEASEKEDDAGSERGCRSPASLQGR

SEQ ID NO: 369 - DNA, 2646 bp, Arabidopsis thaliana
atgggctcgaagccttggctacatccagctcctcagtataaaaccctagaaaccttttgggatgatgaagacgatgctcctggtcctagatgcgctcatacacttacggctgttgcagctactaagactcacggtcctcgtcttattctcttcggcggcgccaccgctattgagggagggagttcttccgttcctgggatcaggttagctggtgttaccaatacggtgcattcttatgatattctcactaggaagtggacaaggcttaaaccggctggtgagcctccgtctcctagggctgctcacgccgcagctgcagttggcaccatggtcgtttttcagggtggcattggaccggcggggcattctactgatgatctttacgttcttgacatgactaatgataagttcaagtggcacagggtggtggttcaaggggatggtccaggccctcgctatggccatgttatggatttagtttctcagaggtatcttgttacagtcaccggaaatgatgggaaacgagctctttctgacgcttgggcactggatacagctcagaaaccatatgtatggcagagattgaacccagatggtgaccgaccaagtgctagaatgtatgcttctggcagtgctcgttctgatggcatgtttttgctctgcgggggaagagacaccttgggggcgccgttgggagatgcttatgggctactgatgcatagaaatggtcagtgggagtggactctggctccaggtgtagctccttctccaagatatcaacatgcagcggtttttgtaggtgcaagattacatgtcagtggtggtgtgctgagaggaggccgtgtaatagacgctgaagcatctgttgcagtgcttgatactgctgccggtgtatggttggatagaaatgggcaagttacttctgcacgtggaagtaagggacaaatcgatcaagatccgtcttttgaacttatgcgacgctgtcgccatggcgcggcatcagttggtatccggatctatgtgcatggtggtctaagaggagatgtgttacttgacgattttctagttgctgaaaattcaacattccagtcagacatcagttctcctttgctagcatcagatagaacccaacaaagttctactcccaggttttcttatgccgcacgacctccttcaggctctgaaccaagcttctccatgtctgagggactgagcttggatgaaaattcgttggagaaattgacggaggcttctgcagctgaagcagaggtagctagttctgtttggcgagctgcacaactaggagctggtactctggatgaagaaccctctacctctgatgccagctcgccaattgtagaatctactactgatggtaccgcaaatgaaggagatgtcaggcttcatccgagagctgttgtggtagcaaaagagacggttggtagtctgggcggcatggtaagacagctaagcttggatcagtttcagaatgagagccgacggatggttcccatgaacaatagcgatgtgccacaacctaccaagaagttcacgagacagaagtctccgcaaggcctgcataaaaaggtcattgctgctttgttaagacctcgaaactggaaacctcctggcaataggaaatttttcttggattcttacgaagttggggaactctgttatgctgccgaacaaatatttatgcatgaacaaacggttcttcagctaaaggctcctatcaaagtatttggcgatctccatgggcaatttggcgatttaatgcgtttatttgatgaatatggatttccctcaacagctggagacatcacgtatattgactatttattcttgggagattacgttgaccggggacaacacagcctggagactataacgttgctgcttgcattgaagattgaatatccggagaatgttcacttgattcgtggaaaccacgaggctgctgacattaatgcactatttggtttccgtcttgaatgcatagaaagaatgggagagaatgatggcatctgggcgtggacaagatttaatcaactttttaattatcttcctcttgctgcactaatcgagaacaaaattatatgtatgcatggtggaattgggaggtcaatcagtacagtggaacagattgaaaagattgaaagacccataacaatggatgctggatcccttgttctaatggatttattatggtctgatcctacagagaacgatagtatcgagggtttaagaccaaacgccagaggacctggccttgtcacgtttgggcctgatagagtcacagaattctgtaagaggaataaactacagctaattatcagggcccatgaatgtgtgatggatggattcgaaagatttgcacagggacagttgattacgcttttctccgccacaaattactgcggaactgcgaacaatgcaggagctatattggtggttggcagaggattggtgattgttcccaagttaattcatcctcttccacctcccatcttatctccagagaactctccagaacattctggagacgacgcttggatgcaggagctgaatatccagagaccgccgactccaacacgaggcaggccacaaccagattttgacagaagctcgcttgcatacatctga

SEQ ID NO: 370 - protein, 881 aa, Arabidopsis thaliana
MGSKPWLHPAPQYKTLETFWDDEDDAPGPRCAHTLTAVAATKTHGPRLILFGGATAIEGGSSSVPGIRLAGVTNTVHSYDILTRKWTRLKPAGEPPSPRAAHAAAAVGTMVVFQGGIGPAGHSTDDLYVLDMTNDKFKWHRVVVQGDGPGPRYGHVMDLVSQRYLVTVTGNDGKRALSDAWALDTAQKPYVWQRLNPDGDRPSARMYASGSARSDGMFLLCGGRDTLGAPLGDAYGLLMHRNGQWEWTLAPGVAPSPRYQHAAVFVGARLHVSGGVLRGGRVIDAEASVAVLDTAAGVWLDRNGQVTSARGSKGQIDQDPSFELMRRCRHGAASVGIRIYVHGGLRGDVLLDDFLVAENSTFQSDISSPLLASDRTQQSSTPRFSYAARPPSGSEPSFSMSEGLSLDENSLEKLTEASAAEAEVASSVWRAAQLGAGTLDEEPSTSDASSPIVESTTDGTANEGDVRLHPRAVVVAKETVGSLGGMVRQLSLDQFQNESRRMVPMNNSDVPQPTKKFTRQKSPQGLHKKVIAALLRPRNWKPPGNRKFFLDSYEVGELCYAAEQIFMHEQTVLQLKAPIKVFGDLHGQFGDLMRLFDEYGFPSTAGDITYIDYLFLGDYVDRGQHSLETITLLLALKIEYPENVHLIRGNHEAADINALFGFRLECIERMGENDGIWAWTRFNQLFNYLPLAALIENKIICMHGGIGRSISTVEQIEKIERPITMDAGSLVLMDLLWSDPTENDSIEGLRPNARGPGLVTFGPDRVTEFCKRNKLQLIIRAHECVMDGFERFAQGQLITLFSATNYCGTANNAGAILVVGRGLVIVPKLIHPLPPPILSPENSPEHSGDDAWMQELNIQRPPTPTRGRPQPDFDRSSLAYI

SEQ ID NO: 371 - DNA, 810 bp, Arabidopsis thaliana
atggcgggttggcagaagaatttacagattgttattcgtcaagttggtaaaagagttaaggacagtcacatttccacggcaaattactcttccacacggaatttggaatcccctttctcacaaggttatttgcagagtctcttgagatcaacctattcctcaagaccactgtattatcatctacaacaactgggaatttctacctcaagacaattgcaggcgggtgaggagcctgtatcatcacctttgtcatctccagctctgctgggtagtggaaaagaagaagagcagaagattatcccaaagcgtcagaaagttcaggctgtcctcaagtccataaagcagagtcctaagaaggtcaacttggttgcagcactagtccgtggcatgcgtgttgaagatgctttgatgcaattgcaggtcacggtcaaacgagcttcacaaactgtgtaccgggttatacatgctgcgcgggcaaatgctactcataaccatggactagatcctgaccgtctccttgttgcggaagcgtttgttgggaagggactctttgggaagaaggtagcttaccatgcaaaaggaagaagcgggataatatcaatacccaggtgtcgtctaacagtcatagtcagagagacgactgcagaggaagaagctgagattgcaaggctgaaagttcacaattttaagaagctaaacaagcggcagagacagctggtaccacacaagttgatcgagacaagtccaatctggaaccgcagaggtaccaaaggcaatcacaggtcatctgagttggtaccgtctcactaa

SEQ ID NO: 372 - protein, 269 aa, Arabidopsis thaliana
MAGWQKNLQIVIRQVGKRVKDSHISTANYSSTRNLESPFSQGYLQSLLRSTYSSRPLYYHLQQLGISTSRQLQAGEEPVSSPLSSPALLGSGKEEEQKIIPKRQKVQAVLKSIKQSPKKVNLVAALVRGMRVEDALMQLQVTVKRASQTVYRVIHAARANATHNHGLDPDRLLVAEAFVGKGLFGKKVAYHAKGRSGIISIPRCRLTVIVRETTAEEEAEIARLKVHNFKKLNKRQRQLVPHKLIETSPIWNRRGTKGNHRSSELVPSH

SEQ ID NO: 373 - DNA, 612 bp, Arabidopsis thaliana
atgataaaatcagtgactcttcgttcgtttcatctcccaattgagtttaacgacaccaaattcgtctcacggccttgtttcctggcgagatccttcccggtggttcgttgttcaagcaccagagacgtacctaagcttgaactcttcagccgcggaaaattcgaccggattcttcaagatccgccacttattgaaaaagccgaatccgaactctcagattactgttcgacgcttgaaggtgatgactcttacagttgctggagagcttactttgaactcaaagatctcgaaagagagaagccaaaggttgaagttgagaatttgattttgcaaacaggtggtttgaaatcgttaatcgggtgtttacatggagttgcttcaatggagaaagataacaaaaccaagaatggtttacatgtaggagaagaatcagatagagagaaaggaatgaatttgcacattcatattcctgatggtttaccaaaatctgaacaagagttggaggaagaagagaaatcgaaaatgccggattcagctttcactagattgcttagaagtaaaggaactatccctgcttggttctctcacgctcctgaccacgaaaccgactga

SEQ ID NO: 374 - protein, 203 aa, Arabidopsis thaliana
MIKSVTLRSFHLPIEFNDTKFVSRPCFLARSFPVVRCSSTRDVPKLELFSRGKFDRILQDPPLIEKAESELSDYCSTLEGDDSYSCWRAYFELKDLEREKPKVEVENLILQTGGLKSLIGCLHGVASMEKDNKTKNGLHVGEESDREKGMNLHIHIPDGLPKSEQELEEEEKSKMPDSAFTRLLRSKGTIPAWFSHAPDHETD

SEQ ID NO: 375 - DNA, 1266 bp, Arabidopsis thaliana
atgtcgaacccaaacgaaccagccagggctcttctgccttacctgcaacgtgccgatgagctgcagaagcatgaaccacttgttgcttattactgtcggctatatgcaatggaacgaggattgaagattccgcagagcgagagaactaagaccaccaattcgattctcatgtctctcattaatcaactcgaaaaggataaaaaatcattgactctgtccccagatgacaatatgcatgtggaggggtttgcacttagtgtctttgctaaggcagacaagcaggatcgtgcaggaagagcagacttgggcactgccaaaactttttatgctgcgagcatcttctttgaaattctgagccagtttggtcccgtacctcctgatatagagcagaaacacaagtatgctgcttggaaggctgctgacataaggaaagccattaaagaaggaaggaagcccactccaggtgatcctgtggatgatgatactgatttatccatcccatcaagcggtcctagtggctcctatgatcacagtgcaagtgataccaacacaacaagtcatcatagaacagagcttgatccaccccatgactcgaatgatgactccagccaccatcaattccctgaagtgccacaacaccctctacctcccaggttttatgacaatccgaccaacgattatcccgcagatgtcccacctccaccaccgtcttcttacccttccaacgatcatcttccccctcccacaggaccatcagactccccttacccgcatccttacagtcatcaaccataccaccaagacccgccaaaacacatgccgccaccgcaaaactactcatctcatgagccttctccaaattctctccctaatttccaatcttatcctagctttagtgagagcagcctcccatccacttctccccactacccttctcactaccaaaacccagaaccttactattcttctccgcactctgcacctgctccttcttccacaagcttctcctctgctcctcctcctccaccttactcatcaaacgggcgtatcaatattgctcccgtgctagatcctgcaccgagttcagctcagaagtaccattacgatagcagctaccagccagggcctgagaaggttgcagaggcactcaaggctgctagattcgctgtgggagctttggcttttgatgaagtctcgactgctgtagaacatctcaagaagtcacttgagttgctaacaaatccatcggccggtgccggtcactga

SEQ ID NO: 376 - protein, 421 aa, Arabidopsis thaliana
MSNPNEPARALLPYLQRADELQKHEPLVAYYCRLYAMERGLKIPQSERTKTTNSILMSLINQLEKDKKSLTLSPDDNMHVEGFALSVFAKADKQDRAGRADLGTAKTFYAASIFFEILSQFGPVPPDIEQKHKYAAWKAADIRKAIKEGRKPTPGDPVDDDTDLSIPSSGPSGSYDHSASDTNTTSHHRTELDPPHDSNDDSSHHQFPEVPQHPLPPRFYDNPTNDYPADVPPPPPSSYPSNDHLPPPTGPSDSPYPHPYSHQPYHQDPPKHMPPPQNYSSHEPSPNSLPNFQSYPSFSESSLPSTSPHYPSHYQNPEPYYSSPHSAPAPSSTSFSSAPPPPPYSSNGRINIAPVLDPAPSSAQKYHYDSSYQPGPEKVAEALKAARFAVGALAFDEVSTAVEHLKKSLELLTNPSAGAGH

SEQ ID NO: 377 - DNA, 2568 bp, Arabidopsis thaliana
atggtgttcacaaaatcattacttgttcttctttggttcctctcttgttacactactactacttcatcagctttgtttaatccgccagacaattacttgatctcttgtggctcatcacaaaacataactttccaaaacagaatctttgttccagattcactccactcttctcttgtactcaaaatcggaaactcttctgttgcaacatcaactacttccaacaattcaaccaattccatctaccaaaccgctcgtgttttctccagtttagcttcttacagattcaaaatcacttctttaggtcgacattggatccgtcttcatttctcacctatcaacaactctacttggaacttaacctctgcttcaatcactgtcgtaacagaagacttcgtgctcttgaacaacttctccttcaacaacttcaacggttcttacatcttcaaagagtacacagtcaatgtcacttcagagttcttgactttaagtttcattccttcaaacaattcggtggtctttgtcaacgctattgaagttgtctctgttccggataatcttatccctgatcaagctttggcgttaaacccttcaacaccatttagtggtctctctctgcttgcatttgaaacagtctacagattaaatatgggaggaccattgttgacttctcaaaacgatacattggggagacaatgggataatgatgcagagtatcttcatgtgaacagctctgttcttgttgtaacggcgaatccttcttcgattaagtactctccttctgtgactcaagaaacagctcctaacatggtttatgcaactgctgatacaatgggtgatgctaatgttgcgagtccaagttttaatgttacttgggttcttcctgttgatccagacttcaggtactttgttcgtgttcatttctgtgatattgtgagtcaagctttgaacacgcttgttttcaatctttatgtgaatgatgatcttgctcttggaagtcttgatctctctacgttgactaatggtcttaaagttccttactttaaggattttatctccaatggttctgttgaatcttccggtgttttaaccgttagcgttggacctgattcacaagctgatatcactaatgcgactatgaatgggttagaggttttgaagattagtaacgaagctaagagcttaagtggtgtttcttcggttaagtcgttacttccgggaggatcaggttctaagagcaagaagaaggcagtgatcattggttctttggttggtgcggttacattgattctgctgattgctgtttgttgctattgctgtttggttgcttcaaggaagcagaggtcgacgagtcctcaagaaggcggtaatggacatccgtggttgccattacctttatatggactctctcagactcttactaaatcaaccgcttctcacaagagtgccacagctagttgcatttcattagcttctactcatcttggacgttgctttatgtttcaagaaatcatggacgctactaataagttcgatgagagttcgttgcttggggttggtggatttggccgcgtttataaaggaactttagaagacgggactaaagtcgcggttaaaagaggtaacccgagatcagaacaaggtatggctgagttcagaacagagattgaaatgctgtcaaaactcagacatcgacatctcgtctctcttatcggttactgcgacgagaggtctgaaatgatactggtctatgagtacatggcgaatggaccgttgaggagtcatctatatggagctgatcttcctccattgtcttggaaacaaagactcgagatttgcatcggtgcagcgagaggattacattatctacacaccggtgcatcgcagagcattatacaccgtgatgttaaaaccacgaatatcttactcgacgagaatctagtcgccaaagttgcagactttggactatccaaaaccggcccttcgctcgatcaaacacacgtgagcacggcggttaaaggaagctttggttatctagacccggaatacttcaggagacagcagttaacagagaaatcagacgtttattcgtttggtgttgtactaatggaagtactctgttgtagaccggctttaaacccggtattacctagagaacaagtgaacatagcggaatgggcaatggcgtggcagaaaaagggtctgctagatcaaatcatggacagtaacttaaccgggaaggtgaaccctgcctcgttgaagaaatttggagaaaccgcagagaaatgtttagcggaatacggtgtggaccggccttctatgggagatgtattgtggaatttggagtacgcgttacagctagaagaaacatcttcggctttgatggagcctgatgacaatagtacaaaccacattccagggattccaatggcgccaatggaaccgtttgataacagtatgagtataatcgatagaggaggagtaaattcggggaccgggactgatgatgatgcggaagacgcgactactagtgcggtgttttcgcagcttgttcatcctcgtggaaggtag

SEQ ID NO: 378 - protein, 855 aa, Arabidopsis thaliana
MVFTKSLLVLLWFLSCYTTTTSSALFNPPDNYLISCGSSQNITFQNRIFVPDSLHSSLVLKIGNSSVATSTTSNNSTNSIYQTARVFSSLASYRFKITSLGRHWIRLHFSPINNSTWNLTSASITVVTEDFVLLNNFSFNNFNGSYIFKEYTVNVTSEFLTLSFIPSNNSVVFVNAIEVVSVPDNLIPDQALALNPSTPFSGLSLLAFETVYRLNMGGPLLTSQNDTLGRQWDNDAEYLHVNSSVLVVTANPSSIKYSPSVTQETAPNMVYATADTMGDANVASPSFNVTWVLPVDPDFRYFVRVHFCDIVSQALNTLVFNLYVNDDLALGSLDLSTLTNGLKVPYFKDFISNGSVESSGVLTVSVGPDSQADITNATMNGLEVLKISNEAKSLSGVSSVKSLLPGGSGSKSKKKAVIIGSLVGAVTLILLIAVCCYCCLVASRKQRSTSPQEGGNGHPWLPLPLYGLSQTLTKSTASHKSATASCISLASTHLGRCFMFQEIMDATNKFDESSLLGVGGFGRVYKGTLEDGTKVAVKRGNPRSEQGMAEFRTEIEMLSKLRHRHLVSLIGYCDERSEMILVYEYMANGPLRSHLYGADLPPLSWKQRLEICIGAARGLHYLHTGASQSIIHRDVKTTNILLDENLVAKVADFGLSKTGPSLDQTHVSTAVKGSFGYLDPEYFRRQQLTEKSDVYSFGVVLMEVLCCRPALNPVLPREQVNIAEWAMAWQKKGLLDQIMDSNLTGKVNPASLKKFGETAEKCLAEYGVDRPSMGDVLWNLEYALQLEETSSALMEPDDNSTNHIPGIPMAPMEPFDNSMSIIDRGGVNSGTGTDDDAEDATTSAVFSQLVHPRGR

SEQ ID NO: 379 - DNA, 1446 bp, Arabidopsis thaliana
atggcttccgctgccgcaagttccgccttttcactccttaagtccaccggcgctgttgcttcctccgccggaactcgcgcacgtgcctcccttctgccaattccctctacctctgtttccgcgcgtcctctaggcttctccgccactctagattcccgtcgtttctctctccacgttgcttccaaagttgaatcggtgcgtgggaagggaagcagaggagtggtttctatggcgaagaagagcgtcggagatctgacctcagctgatttgaaggggaagaaggttttcgtgagagctgatctcaatgtacctctcgatgataatcagactatcactgacgataccagaatccgtgccgccattccaacgatcaagtatttgattgaaaatggtgctaaagttatcctctccactcatctgggaaggccaaagggagtcaccccaaagtttagtttggctcctcttgtccctaggctctccgagcttcttggtattgaggtcacgaaagctgatgattgtattggcccagaagtggaaagcttggtggcttctctacctgaaggtggagttttgcttcttgagaacgtcaggttttacaaggaggaagagaagaacgatcctgagtttgctaagaagcttgcttctctagctgacctttatgtcaatgatgctttcggaactgctcacagagctcatgcttctaccgaaggagtcactaagttcttgaagccttcagttgctggtttccttttgcaaaaggaactggactacctagttggtgctgtttcaaacccaaagagaccatttgcagccatagtgggtggttccaaagtctcatccaagattggagttattgaatcgcttctggagaagtgtgatattcttcttcttggtggtggaatgatcttcacattctacaaggcacagggtctttcagttggttcgtcccttgttgaagaagacaagcttgaattggctacagaactccttgccaaagctaaggccaaaggagtctctcttttgttgccaacagatgttgtagttgctgacaagtttgctcctgatgccaacagcaagattgtgcctgcatcaggcattgaggacggatggatgggactggacattggtccagactctatcaaaactttcaacgaagctctggacacaacacaaacagtcatttggaatggacctatgggagttttcgagatggaaaagtttgcggctggaacagaggcgatagcgaataaactagcagagctaagtgaaaaaggagtgacaacgataataggaggaggagactcagtggctgcagtggagaaagtaggagtagcaggagtcatgagtcacatctccactggtggtggagccagcttggagctgttggaaggaaaagtacttcccggtgtgatcgcccttgatgaagcaatcccagtcactgtttag

SEQ ID NO: 380 - protein, 481 aa, Arabidopsis thaliana
MASAAASSAFSLLKSTGAVASSAGTRARASLLPIPSTSVSARPLGFSATLDSRRFSLHVASKVESVRGKGSRGVVSMAKKSVGDLTSADLKGKKVFVRADLNVPLDDNQTITDDTRIRAAIPTIKYLIENGAKVILSTHLGRPKGVTPKFSLAPLVPRLSELLGIEVTKADDCIGPEVESLVASLPEGGVLLLENVRFYKEEEKNDPEFAKKLASLADLYVNDAFGTAHRAHASTEGVTKFLKPSVAGFLLQKELDYLVGAVSNPKRPFAAIVGGSKVSSKIGVIESLLEKCDILLLGGGMIFTFYKAQGLSVGSSLVEEDKLELATELLAKAKAKGVSLLLPTDVVVADKFAPDANSKIVPASGIEDGWMGLDIGPDSIKTFNEALDTTQTVIWNGPMGVFEMEKFAAGTEAIANKLAELSEKGVTTIIGGGDSVAAVEKVGVAGVMSHISTGGGASLELLEGKVLPGVIALDEAIPVTV

SEQ ID NO: 381 - DNA, 417 bp, Arabidopsis thaliana
atgaaaggcggcgaatccaaagctgaagcaacgagcactgatcagagactcaaaaccagaggtagaaaggctgggaagaagacgaagaaggatccaaatcaacctaagagacctccaagtgctttcttcgtcttccttgaggatttccgaaaagagtttaacctagcgaatcctaataacaaatccgtcgctactgttggtaaggctgctggagctagatggaaggcaatgactgatgaagataaagctccttacgtcgctaaggctgagagcagaaagactgaatatattaagaatgtgcaacagtacaacttgaaactggctagtggaaccaatagagaagaggatgactctgacaaatccaagtctgaagttgatgaagcagtaagcgaagaggaggcagaagacgacgattga

SEQ ID NO: 382 - protein, 138 aa, Arabidopsis thaliana
MKGGESKAEATSTDQRLKTRGRKAGKKTKKDPNQPKRPPSAFFVFLEDFRKEFNLANPNNKSVATVGKAAGARWKAMTDEDKAPYVAKAESRKTEYIKNVQQYNLKLASGTNREEDDSDKSKSEVDEAVSEEEAEDDD

SEQ ID NO: 383 - DNA, 516 bp, Arabidopsis thaliana
atggccgcaattacatcagctaccgtcaccatcccttctttcaccggcctaaagctcgccgtcagctcaaaacctaagacattatccaccatcagtagatccacttccgccaccagggcgccacctaagctcgctttgaagtcctctttgaaggatttcggtgtcatcgcagtggcaacagcagcttcgatcgttttagctggaaatgcgatggccatggaggttcttttaggatccgacgacggttcccttgctttcgtaccatctgaattcacggtggctaaaggagagaagatcgtgttcaagaacaacgcagggttcccacataacgtggtgttcgacgaagacgagatccctagtggtgtggacgcaagcaagatctcgatggatgagacagcgcttctaaatggtgcaggggagacttacgaggttactttgacagagccaggctcttacggtttctattgtgcgccgcaccagggtgctggtatggttgggaaactcaccgtcaagtaa

SEQ ID NO: 384 - protein, 171 aa, Arabidopsis thaliana
MAAITSATVTIPSFTGLKLAVSSKPKTLSTISRSTSATRAPPKLALKSSLKDFGVIAVATAASIVLAGNAMAMEVLLGSDDGSLAFVPSEFTVAKGEKIVFKNNAGFPHNVVFDEDEIPSGVDASKISMDETALLNGAGETYEVTLTEPGSYGFYCAPHQGAGMVGKLTVK

SEQ ID NO: 385 - DNA, 930 bp, Arabidopsis thaliana; identical to SEQ ID NO: 249

SEQ ID NO: 386 - protein, 309 aa, Arabidopsis thaliana; identical to SEQ ID NO: 250

SEQ ID NO: 387 - DNA, 1584 bp, Arabidopsis thaliana
atgccgatcgataagatcttcaaagatgatgctagtgaagagaagggagaacgtgcgaggatggcatcatttgttggtgcaatggctatcagtgatctggttaagtctactttagggccaaagggcatggataaaatcttgcaatctactggtagaggtcatgcggtcactgttactaacgatggtgctactattctcaagtcacttcacatagacaaccctgcagctaaagttcttgttgacatctcgaaagttcaagatgatgaggttggtgatggaactacctctgttgttgtcttggccggcgagcttctgagggaagcagaaaagcttgtggcttctaagattcaccctatgaccatcatagcaggttacagaatggcttcggaatgtgctcgtaatgctttactgaaaagagtcattgataacaaggacaatgcagagaagtttaggtcagacttgttgaagattgcgatgactactttatgttccaaaattctctcacaggacaaggaacattttgcagaaatggccgtggatgctgttttcaggctaaagggaagcacaaacttggaagctattcagatcatcaaaaaacctggagggtctctgaaggattcgtttttggatgaagggtttattcttgacaagaaaataggaattgggcagcctaagcgcatagagaatgcaaatatcttagtagctaatactgctatggataccgataaagtgaagatttacggtgcacgtgtccgtgtggattccatgaccaaggttgctgagattgaaggggctgagaaggaaaaaatgaaagacaaggtgaagaagatcataggccacggaatcaactgctttgttaacaggcagttgatctacaatttccctgaggaactctttgctgatgctggtatacttgctattgagcatgctgactttgagggaatagagcgtcttggtttggttactggtggtgaaattgcttcgacctttgacaacccagagtctgttaagcttgggcattgcaagcttatagaagaaatcatgattggtgaagacaagttgattcatttctctggttgtgaaatgggccaggcttgttcaattgtcctaagaggggccagtcaccatgtcctagatgaggctgaaagatcactccatgatgccttatgtgtactctctcaaacagtgaatgatactagagttttgcttggaggtggatggccagagatggtgatggcaaaggaagtagatgagcttgcaaggaaaactgctggcaaaaaatctcatgccattgaagctttctcacgtgctctagttgctataccgacaacaatcgctgacaacgctggtttagacagtgccgaattggttgctcagcttcgtgcagagcaccacactgaagggtgtaacgctgggatcgacgtcatcactggagctgtaggagatatggaagagagaggaatctatgaagcattcaaagtgaagcaagcggttctgctttcagccacagaagcatctgagatgatattgcgagtggatgaaatcattacatgtgctcctaggaggagagaagacaggatgtga

SEQ ID NO: 388 - protein, 527 aa, Arabidopsis thaliana
MPIDKIFKDDASEEKGERARMASFVGAMAISDLVKSTLGPKGMDKILQSTGRGHAVTVTNDGATILKSLHIDNPAAKVLVDISKVQDDEVGDGTTSVVVLAGELLREAEKLVASKIHPMTIIAGYRMASECARNALLKRVIDNKDNAEKFRSDLLKIAMTTLCSKILSQDKEHFAEMAVDAVFRLKGSTNLEAIQIIKKPGGSLKDSFLDEGFILDKKIGIGQPKRIENANILVANTAMDTDKVKIYGARVRVDSMTKVAEIEGAEKEKMKDKVKKIIGHGINCFVNRQLIYNFPEELFADAGILAIEHADFEGIERLGLVTGGEIASTFDNPESVKLGHCKLIEEIMIGEDKLIHFSGCEMGQACSIVLRGASHHVLDEAERSLHDALCVLSQTVNDTRVLLGGGWPEMVMAKEVDELARKTAGKKSHAIEAFSRALVAIPTTIADNAGLDSAELVAQLRAEHHTEGCNAGIDVITGAVGDMEERGIYEAFKVKQAVLLSATEASEMILRVDEIITCAPRRREDRM

SEQ ID NO: 389 - DNA, 1218 bp, Arabidopsis thaliana
atggtcgacctagggacgtgggtcatgagctctaaacttatggacgcttcggtgacgcgtggcatggttttagggcttgtgaaaagtacgttttatgaccatttttgcgccggtgaagatgccgacgcagccgctgagcgcgtgagaagcgtttatgaagctactggtcttaaagggatgcttgtctatggcgtcgaacacgccgatgacgctgtatcttgtgatgataacatgcaacaattcattcgaaccattgaagctgccaaatctttaccaacatctcactttagctcagtggttgtgaagataactgccatttgtccaattagtcttctgaaacgagtgagcgatctgctgcggtgggaatacaaaagtccgaacttcaaactctcatggaagctcaaatcgtttccggttttctccgaatcgagtcctctctaccacacaaactcagaaccggaaccgttaaccgcggaagaagaaagggagctcgaagcagctcatggaaggattcaagaaatctgtaggaaatgccaagagtccaatgtaccattgttgattgatgcggaagacacaatcctccaacccgcgatcgattacatggcttattcatcggcgatcatgttcaatgctgacaaagaccgaccaatcgtttacaacacgattcaggcgtacttgagagacgccggtgagagactgcatttggcagtacaaaatgctgagaaagagaatgttcctatggggttcaagttggtgagaggggcttacatgtctagcgaagctagcttggcggattccctgggttgcaagtcgccagtccacgacacaattcaggatactcactcttgttacaatgattgtatgacattcctgatggagaaagcatcaaacggttctggtttcggtgtcgttctcgcaacacataacgctgattcggggagacttgcgtcgaggaaagcgagtgacctcgggatcgataaacagaacgggaagatagagtttgcacagctatatggtatgtcagatgcattgtccttcgggttaaagagagcagggttcaatgttagcaagtacatgccgtttggacccgtcgcaaccgctataccgtatcttctccgacgcgcttatgagaaccggggaatgatggccaccggagctcatgaccgtcaactcatgaggatggaacttaagaggagattaatcgccgggattgcgtaa

SEQ ID NO: 390 - protein, 405 aa, Arabidopsis thaliana
MVDLGTWVMSSKLMDASVTRGMVLGLVKSTFYDHFCAGEDADAAAERVRSVYEATGLKGMLVYGVEHADDAVSCDDNMQQFIRTIEAAKSLPTSHFSSVVVKITAICPISLLKRVSDLLRWEYKSPNFKLSWKLKSFPVFSESSPLYHTNSEPEPLTAEEERELEAAHGRIQEICRKCQESNVPLLIDAEDTILQPAIDYMAYSSAIMFNADKDRPIVYNTIQAYLRDAGERLHLAVQNAEKENVPMGFKLVRGAYMSSEASLADSLGCKSPVHDTIQDTHSCYNDCMTFLMEKASNGSGFGVVLATHNADSGRLASRKASDLGIDKQNGKIEFAQLYGMSDALSFGLKRAGFNVSKYMPFGPVATAIPYLLRRAYENRGMMATGAHDRQLMRMELKRRLIAGIA

SEQ ID NO: 391 - DNA, 615 bp, Arabidopsis thaliana
atggccttcgatctccaccatggctcagcttcagatacgcattcatcagaacttccgtcgttttctctcccaccttatcctcagatgataatggaagcgattgagtccttgaacgataagaacggctgcaacaaaacgacgattgctaagcacatcgagtcgactcaacaaactctaccgccgtcacacatgacgctgctcagctaccatctcaaccagatgaagaaaaccggtcagctaatcatggtgaagaacaattatatgaaaccagatccagatgctcctcctaagcgtggtcgtggccgtcctccgaagcagaagactcaggccgaatctgacgccgctgctgctgctgttgttgctgccaccgtcgtctctacagatccgcctagatctcgtggccgtccaccgaagccgaaagatccatcggagcctccccaggagaaggtcattaccggatctggaaggccacgaggacgaccaccgaagagaccgagaacagattcggagacggttgctgcgccggaaccggcagctcaggcgacaggtgagcgtaggggacgtgggagacctccgaaggtgaagccgacggtggttgctccggttgggtgctga

SEQ ID NO: 392 - protein, 204 aa, Arabidopsis thaliana
MAFDLHHGSASDTHSSELPSFSLPPYPQMIMEAIESLNDKNGCNKTTIAKHIESTQQTLPPSHMTLLSYHLNQMKKTGQLIMVKNNYMKPDPDAPPKRGRGRPPKQKTQAESDAAAAAVVAATVVSTDPPRSRGRPPKPKDPSEPPQEKVITGSGRPRGRPPKRPRTDSETVAAPEPAAQATGERRGRGRPPKVKPTVVAPVGC

SEQ ID NO: 393 - DNA, 1953 bp, Arabidopsis thaliana
atggaaggagggtctgttaatgaatcgcattctaatgcggaccaaatgtttgacacaactatagaagagttatgtaagaatctctgcgaattgcagagttctaatcaatctccttcaaggcagagttttggatcatatggtgatgagtcaaagattgattctgatctacaacatcttgctttgggagagatgcgagatattgatatcttggaagatgaaggagatgaggacgaagtggcaaagccagaagagtttgatgtcaagtcaaattcttcaaacttggatttggaagtcatgcccagggatatggagaaacaaactggtaagaagaatgtgactaaatcgaacgttggagtcggtggaatgaggaagaagaaagtcggaggtaccaagttacaaaatggaaatgaagaaccatcatctgaaaatgtagagctggcacgttttttactgaaccaagcgagaaacttggttagttctggtgacagtacacacaaagctctcgagttaactcatcgagcagctaagttgtttgaggcttctgcagagaatgggaaaccatgtttggaatggatcatgtgtttgcatgttacagcagcagtccattgtaagttaaaagagtacaatgaggcaattccggttctacagcgctctgttgagattcctgttgttgaagaaggtgaagagcatgctctagctaaatttgctggtctgatgcagttaggtgacacttacgctatggtggggcagctagagagctcgatatcgtgttataccgagggattgaatatccagaagaaggttttgggagaaaatgacccaagagttggtgaaacatgcagatacctagcagaagctcttgtacaagcattacggtttgatgaggctcaacaggtctgcgaaacggctctttctatacatagagaaagcggtttaccaggttcaatcgcagaggccgcggatagaagactcatggggcttatatgtgagactaagggagatcatgagaatgcccttgagcatttggtattagccagtatggccatggcagcaaatggacaagagtctgaggttgcttttgttgatactagcattggtgactcgtacttgtctttgtctcggttcgatgaagcgatttgtgcataccagaaatctctcacagcactgaagacagcaaagggagagaaccatccagctgttggttcagtttatatccgtttagctgatctctataatcggacaggaaaagtgcgtgaagcaaagtcttattgtgaaaatgctcttcggatatacgagtctcataacctagagatttctcctgaagagattgcaagtggtcttacagatatctccgtgatatgcgagtctatgaacgaggtggaacaagctattaccttgctacaaaaggcgctgaagatatacgcggattctcctggccagaaaatcatgattgcagggattgaagctcaaatgggagtgttgtactatatgatggggaaatacatggagtcgtacaacacatttaagagcgctatctcaaaactacgggcgactggaaagaaacaatcaacgtttttcgggattgcacttaaccaaatgggtttagcatgcattcagctcgatgcaatagaagaggctgttgagttgtttgaagaagccaagtgtattttagaacaagagtgtggtccttatcacccggaaacacttggattgtacagtaaccttgcaggagcttatgatgcaattggcaggttggatgatgcgattaagctgctaggacatgtggttggggttcgggaggaaaagctcgggacagcgaatcctgtaacggaagacgagaagaggaggctggcccaactcttgaaagaagctggtaacgttacaggaaggaaagctaaatccctcaagactctaattgattccgatctcacttcttcttcagctcttcgttaa

SEQ ID NO: 394 - protein, 650 aa, Arabidopsis thaliana
MEGGSVNESHSNADQMFDTTIEELCKNLCELQSSNQSPSRQSFGSYGDESKIDSDLQHLALGEMRDIDILEDEGDEDEVAKPEEFDVKSNSSNLDLEVMPRDMEKQTGKKNVTKSNVGVGGMRKKKVGGTKLQNGNEEPSSENVELARFLLNQARNLVSSGDSTHKALELTHRAAKLFEASAENGKPCLEWIMCLHVTAAVHCKLKEYNEAIPVLQRSVEIPVVEEGEEHALAKFAGLMQLGDTYAMVGQLESSISCYTEGLNIQKKVLGENDPRVGETCRYLAEALVQALRFDEAQQVCETALSIHRESGLPGSIAEAADRRLMGLICETKGDHENALEHLVLASMAMAANGQESEVAFVDTSIGDSYLSLSRFDEAICAYQKSLTALKTAKGENHPAVGSVYIRLADLYNRTGKVREAKSYCENALRIYESHNLEISPEEIASGLTDISVICESMNEVEQAITLLQKALKIYADSPGQKIMIAGIEAQMGVLYYMMGKYMESYNTFKSAISKLRATGKKQSTFFGIALNQMGLACIQLDAIEEAVELFEEAKCILEQECGPYHPETLGLYSNLAGAYDAIGRLDDAIKLLGHVVGVREEKLGTANPVTEDEKRRLAQLLKEAGNVTGRKAKSLKTLIDSDLTSSSALR

SEQ ID NO: 395 - DNA, 1365 bp, Arabidopsis thaliana
atgcctaggcctaagaggcccagatcaaatatagcaccttcatctcctgactcttcgatgcttaccagagaaggtacaactaaggcaaacatggaccctttaccagcaagcggactttcaagggtcttgcaaggtcaagaatactcgaccttgaggacgaaacatactgagagtgtagagtgtgatgctcctgagaattctgttgtctggcaatcttcagcggatgatgataaggttgacgtggtttcgggttctagaagatatggatctgagaactggatgtcctcagccaggcatgaacctacttacacagatttgctctccggctttgggactaacatagatccatcccatggtcagcggatacctttttatgaccattcatcatcaccttctatgcctgcaaagagaatcttgagtgattcagaaggcaagttcgattatcttgctaaccagtggcagatgatacactctggtctctccctgaagttacatgaatctcctaaggtacctgcagcaactgatgcgtctctccaagggcgatgcaatgttaaatacagcgaatatcctgttcttaatggtctatcgactgagaatgctggtggtaactggccaatacgtccacgtgctttgaattattatgaggaagtggtcaatgctcaagcgcaagctcaggctagggagcaagtaacaaaacaacccttcacgatacaagaggagacagcaaagtcaagagaagggaactgcaggctctttggcattcctctgaccaacaacatgaatgggacagactcaaccatgtctcagagaaacaacttgaatgatgctgcggggcttacacagatagcatcaccaaaggttcaggacctttcagatcagtcaaaagggtcaaaatcaacaaacgatcatcgtgaacagggaagaccattccagactaataatcctcatccgaaggatgctcaaacgaaaaccaactcaagtaggagttgcacaaaggttcacaagcagggaattgcacttggccgttcagtggatctttcaaagttccaaaactatgaggagttagtcgctgagctggacaggctgtttgagttcaatggagagttgatggctcctaagaaagattggttgatagtttacacagatgaagagaatgatatgatgcttgttggtgacgatccttggcaggagttttgttgcatggttcgcaaaatcttcatatacacgaaagaggaagtgaggaagatgaacccggggactttaagctgtaggagcgaggaagaagcagttgttggggaaggatcagatgcaaaggacgccaagtctgcatcaaatccttcattgtccagcgctgggaactcttaa

SEQ ID NO: 396 - protein, 454 aa, Arabidopsis thaliana
MPRPKRPRSNIAPSSPDSSMLTREGTTKANMDPLPASGLSRVLQGQEYSTLRTKHTESVECDAPENSVVWQSSADDDKVDVVSGSRRYGSENWMSSARHEPTYTDLLSGFGTNIDPSHGQRIPFYDHSSSPSMPAKRILSDSEGKFDYLANQWQMIHSGLSLKLHESPKVPAATDASLQGRCNVKYSEYPVLNGLSTENAGGNWPIRPRALNYYEEVVNAQAQAQAREQVTKQPFTIQEETAKSREGNCRLFGIPLTNNMNGTDSTMSQRNNLNDAAGLTQIASPKVQDLSDQSKGSKSTNDHREQGRPFQTNNPHPKDAQTKTNSSRSCTKVHKQGIALGRSVDLSKFQNYEELVAELDRLFEFNGELMAPKKDWLIVYTDEENDMMLVGDDPWQEFCCMVRKIFIYTKEEVRKMNPGTLSCRSEEEAVVGEGSDAKDAKSASNPSLSSAGNS

SEQ ID NO: 397 - DNA, 3096 bp, Arabidopsis thaliana
atgttttattcgcagtttatattagctaagaaagggccacttgggacaatatggattgctgcccatttggagaggaagcttcgaaagaatcaggtcgctgatactgatattggagtctccgttgattctattctctttccggaagctccgattgcattgcgattgtctagtcatcttctgcttggtgttgtgcgtatatattcgagaaaggtgaattacctctttgatgattgcagtgaggcattgcttaaggtaaagcaagcttttcgctctgctgctgttgacctaccccctgaagaatctacagcgccgtatcactctattacgttgccagagacatttgatcttgatgactttgagcttccagacaatgagatctttcagggtaattacgttgatcatcatgttagtacaaaagagcagatcacccttcaggataccatggatggcgttgtatactcaacgtcacaatttggattagatgagcgatttggtgatggcgacacttctcaagctgctttggatcttgatgaggcagtattccaggacaaggatgttattggatccgacgatgagggagttccaggtattgatcacaacgcgtatctggatgcggcagcacccgggataaaggattcgatggaaggagtctctgaagccatgcccatggattttaatgaagagcaggttgaagatcttgctatgaataatgagttcatcgaagatgctcaagctcctcaaactcctggattagttgaggtgccaaactcgtctagtgtgagagagcagatggcatgcgatgatcacatggacgtagaggatctgaatgcagaagaaggtataaagtcctctggggagctgaatgctaatgagatgcctaaacgtggggaagacctgtcttctgaatataatgccccagaatcagcagttactcctgtggaggtagataagtcacagatagatgaaaatgtcaacacacaaaatgagccggaggaggagagggcagagcatgtacatgttacatctccatgttgttctcacatcaccaccgagatggaggatcctggtcaagtaatgaatgaggcaggagctaatgttgtacctgataaacccgatgctgttcctccacttgaaacccctggagaagagaaccgagatcattttgccattgccactgaggtcaatcaggaaacagattctagtttacaaggagatgagcaagcgtacagtagaccagatgggcagctgaataatgcacacgaaactgatgaacagttgggaaatttgactggatttaccgattctgatttccctccacctgagaaggtattagctgtacctaacagacagggggatggaaatgatttcatggttgaatctacaccagataaagaagaccctggcacatgtaatgatgatgcggggaataataacattactgggaaaaaacgcacttttactgagagcacactaactgcagaaagtttgaactctgtggagtcagttggactgattcagtcaaagagaactgcagattctgtccctgatgacgatgatttgttgtcttctatcttagttggaaagtcatcctttctgaagatgaggcctacccctgtgcttgaaccagcaactacaaaacggttacgatctgctccccgctctactgccacaaagaggaaggttctaatggatgaccctatggtcttgcatggcgacattatacgtcaacaactgacaaacactgaagatatacggcgcgtgcgaaagaaggcaccttgcaccgttcctgaaatcgtaatgcttcaaaggcaggctttggaggatggactctttaaggagccaatatttactggtatgtcagtggaattagtatctctgcacactgagccgtatgatctaagaggaatcatgataattgagaatgatgaccgtcatgcttctgttggagcggtggaagataatgaatgttctgttacggccgtggaagaaaataaaacggaagaaagctctgatccgcaagctcacccaaatgattgtgaggagcaacctggtacggctcatactcacccgcaggaggaacaaaccataaaccaacaggaagagctgaaagatgataatgagcttgctgaaaaatctgacttggaggttttgaaggaaggcaatggagctgctgatgaagtaaatcttgtagtgattgacgatgtcagtcaaataccgtctgaggaaaaactcgaccgtgtagaggatttacaggttgaagaatcccatgaaaaccatgatggagaaggcgggcaggatgtttgtgcggatcctaatgaaaaaagttgcactgacgttattgaaattgctgaaggcgatacagatatcaaccccattttcaatgagatggacttgaaagttgaagatgaacttccacatgaagatgagaaaacggatgcatcagctgaagttagcgagcttgggagagacgatcagactccatgcgataacacagttgggtctactgaaactggatgcctagaagctggtgatttgagtaacatggctttggaaaattgcaatgaacctctggtggaagcgaatagtgatgggttgaatccagagacagagtcttataacaaatacgaaccgcataatgagatgtctaatgaggaggcgtctatgcaaaatgcattagatggagagcatacttctcgtgatggtcttatgggagacaatgatgaaatggataccatggaaaatgcacatgacacaggatttttgaacgtcgatgatgatgaagtagatgaagatcatgaggaggatgacatacaatatgatgatgaaactcgtcttctagaaaacagtggatggtcttctcgtactagggctgtggcaaagtatctccagacgttatttgataaagaaaccgagaatgggaagaatgttcttgtggcagacaaacttttagctgggaaaacccgtaaagaagcatcgagaatgtttttcgaaaccctggttcttaaaacaagagattacatccaagtcgaacaagggaagccctatgaaagcatcatcataaaaccgcgaccaaagctcaccaaatccatcttctag

SEQ ID NO: 398 - protein, 1031 aa, Arabidopsis thaliana
MFYSQFILAKKGPLGTIWIAAHLERKLRKNQVADTDIGVSVDSILFPEAPIALRLSSHLLLGVVRIYSRKVNYLFDDCSEALLKVKQAFRSAAVDLPPEESTAPYHSITLPETFDLDDFELPDNEIFQGNYVDHHVSTKEQITLQDTMDGVVYSTSQFGLDERFGDGDTSQAALDLDEAVFQDKDVIGSDDEGVPGIDHNAYLDAAAPGIKDSMEGVSEAMPMDFNEEQVEDLAMNNEFIEDAQAPQTPGLVEVPNSSSVREQMACDDHMDVEDLNAEEGIKSSGELNANEMPKRGEDLSSEYNAPESAVTPVEVDKSQIDENVNTQNEPEEERAEHVHVTSPCCSHITTEMEDPGQVMNEAGANVVPDKPDAVPPLETPGEENRDHFAIATEVNQETDSSLQGDEQAYSRPDGQLNNAHETDEQLGNLTGFTDSDFPPPEKVLAVPNRQGDGNDFMVESTPDKEDPGTCNDDAGNNNITGKKRTFTESTLTAESLNSVESVGLIQSKRTADSVPDDDDLLSSILVGKSSFLKMRPTPVLEPATTKRLRSAPRSTATKRKVLMDDPMVLHGDIIRQQLTNTEDIRRVRKKAPCTVPEIVMLQRQALEDGLFKEPIFTGMSVELVSLHTEPYDLRGIMIIENDDRHASVGAVEDNECSVTAVEENKTEESSDPQAHPNDCEEQPGTAHTHPQEEQTINQQEELKDDNELAEKSDLEVLKEGNGAADEVNLVVIDDVSQIPSEEKLDRVEDLQVEESHENHDGEGGQDVCADPNEKSCTDVIEIAEGDTDINPIFNEMDLKVEDELPHEDEKTDASAEVSELGRDDQTPCDNTVGSTETGCLEAGDLSNMALENCNEPLVEANSDGLNPETESYNKYEPHNEMSNEEASMQNALDGEHTSRDGLMGDNDEMDTMENAHDTGFLNVDDDEVDEDHEEDDIQYDDETRLLENSGWSSRTRAVAKYLQTLFDKETENGKNVLVADKLLAGKTRKEASRMFFETLVLKTRDYIQVEQGKPYESIIIKPRPKLTKSIF

SEQ ID NO: 399 - DNA, 480 bp, Arabidopsis thaliana
atgactgccgaacagaaagtggagctcgccgccaaattggaagagcagaagatcgatcttgataaacctgaggttgaagatgatgatgacaatgatgaggatgattccgaggacgatgacgaggcggagggacatgatggggaggccggtggccggtcaaagcaaagcagaagtgagaaaaagagtcgtaaagctatgttgaagcttgggatgaaaccaatcactggtgttagccgtgtcaccgtcaaaaagagcaagaatatcttgtttgtgatatcaaaacctgatgtgttcaagagtccagcttcagatacatatgtgatctttggtgaggccaagatagaggatttgagctcgcagctgcagagtcaagccgcagagcagttcaaggctcccaacctcagcaacgtgatttcacaggagaaacatcgagtgctgcaactgcagctgctgttcaagatgatgatgatgaagaggtag

SEQ ID NO: 400 - protein, 159 aa, Arabidopsis thaliana
MTAEQKVELAAKLEEQKIDLDKPEVEDDDDNDEDDSEDDDEAEGHDGEAGGRSKQSRSEKKSRKAMLKLGMKPITGVSRVTVKKSKNILFVISKPDVFKSPASDTYVIFGEAKIEDLSSQLQSQAAEQFKAPNLSNVISQEKHRVLQLQLLFKMMMMKR

SEQ ID NO: 401 - DNA, 975 bp, Arabidopsis thaliana
atggagtgtagatcattggatctgacgattatatctgcggaggatctcaaagacgttcaattgatcggtaaacaagacttgtacgccgtcgtttccatcaacggcgacgctaggacgaagcagaagacaaaggttgataaagattgcggcaccaaacctaaatggaagcatcaaatgaagctcaccgtcgatgacgcagcggcgcgtgacaatcgtcttactcttgttttcgagatcgtggcggatcgtcccatcgctggtgataaacctgtcggtgaggttagcgttccggtgaaggagcttttggatcagaataaaggtgacgaggagaaaacggttacttacgccgtgaggttgcctaacgggaaggcgaaaggatctctcaaattctcgttcaaatttggggaaaagtatacttatggatcttcgagtggtcctcacgcgccggtcccttcggctatggatcataagactatggatcagcccgtcaccgcttacccgcccggacacggtgcaccgtctgcataccctgctcctcccgcgggtccttcttccggatatccaccacaaggacatgacgataagcacgatggtgtttatggatacccgcagcaggctggatatccagctggaaccggtggttatccgccacctggtgcatacccacaacagggaggttaccctggatatccgcctcagcaacagggtggatacccgggttatccgccacagggtccatatggttacccgcaacaaggttatccaccacagggtccatacggttacccgcaacagcaagctcatggtaaaccgcagaaaccgaagaagcatggtaaggctggagctggaatgggactaggacttgggcttggagctggtttattgggtgggttgttggttggtgaagcggtttctgacatcgctgatatgggtgacatgggtgacatgggtgacatgggtggtttcgatttctga

SEQ ID NO: 402 - protein, 324 aa, Arabidopsis thaliana
MECRSLDLTIISAEDLKDVQLIGKQDLYAVVSINGDARTKQKTKVDKDCGTKPKWKHQMKLTVDDAAARDNRLTLVFEIVADRPIAGDKPVGEVSVPVKELLDQNKGDEEKTVTYAVRLPNGKAKGSLKFSFKFGEKYTYGSSSGPHAPVPSAMDHKTMDQPVTAYPPGHGAPSAYPAPPAGPSSGYPPQGHDDKHDGVYGYPQQAGYPAGTGGYPPPGAYPQQGGYPGYPPQQQGGYPGYPPQGPYGYPQQGYPPQGPYGYPQQQAHGKPQKPKKHGKAGAGMGLGLGLGAGLLGGLLVGEAVSDIADMGDMGDMGDMGGFDF

SEQ ID NO: 403 - DNA, 666 bp, Arabidopsis thaliana
atggctctacctaaccaacaaaccgtagattatcctagcttcaagctcgtcatcgttggtgatggaggcacagggaaaacgacctttgtgaagagacatcttactggggagtttgagaagaagtatgaacctactattggtgtggaggttcatcctttggatttcttcacaaactgcggaaagatccgtttttactgctgggatactgctggacaagagaaatttggtggccttagggatggatactacatccatggtcaatgtgcgataataatgtttgacgtcacagcaaggctcacatacaagaatgttccgacatggcatcgtgatctttgcagggtgtgtgaaaacatcccgattgttctgtgtggaaacaaagtcgatgtgaagaacaggcaagtgaaggcaaagcaagtcacattccacaggaagaagaatctgcagtactatgagatatcagcaaagagcaactacaacttcgagaagcctttcttgtaccttgctaggaaactggctggagaccagaaccttcactttgtggagtcaccagctcttgctccaccagaggttcaccttgacattgctgctcagcagcagaatgaggccgatcttgcagctgctgcagctcagcctctccccgatgatgatgatgacgcatttgagtaa

SEQ ID NO: 404 - protein, 221 aa, Arabidopsis thaliana
MALPNQQTVDYPSFKLVIVGDGGTGKTTFVKRHLTGEFEKKYEPTIGVEVHPLDFFTNCGKIRFYCWDTAGQEKFGGLRDGYYIHGQCAIIMFDVTARLTYKNVPTWHRDLCRVCENIPIVLCGNKVDVKNRQVKAKQVTFHRKKNLQYYEISAKSNYNFEKPFLYLARKLAGDQNLHFVESPALAPPEVHLDIAAQQQNEADLAAAAAQPLPDDDDDAFE

SEQ ID NO: 405 - DNA, 918 bp, Arabidopsis thaliana
atgtcagacctagatcggcaaatagggcagcttaagcgatgcgaaccattgagcgaatcggaggtgaaggctctttgcctcaaagccatggaaattcttgttgaagagagtaatgttcagagagttgatgcccctgtcactttatgtggtgacatccatgggcagttctatgatatgatggagcttttcaaagttgggggtgattgtcctaagaccaactatttgtttatgggagattttgttgatcgtggatattattcggttgagacatttctacttctactcgcactcaaggttagatatccagaccgcataactctcatcagaggaaaccatgaaagcaggcaaatcacacaggtttatggattttatgatgagtgtttgcgtaaatatggctcttcaaatgtctggagatactgcaccgacatttttgactacatgagtctttcagctgttgtggagaacaagatattctgtgttcatggtggtctttctccagctattatgactcttgatcagattaggacaattgaccggaagcaagaagtaccacatgatggtgccatgtgtgatctcctatggtctgatcctgaagatattgttgatggctggggattgagccctcgtggtgccggattcctttttggtggcagtgttgtcacgtcttttaaccactcaaacaacatagactacatagcccgtgcccatcaactagttatggagggttacaaatggatgtttgatagccagattgtgacagtgtggtcagccccaaattactgttacagatgcggtaatgtggcttcaattctagagcttgacgagaatctaaataaagaattccgtgtgtttgatgcagcccagcaggactcgagagggcctcccgccaaaaagccggcccctgattacttcctataa

SEQ ID NO: 406 - protein, 305 aa, Arabidopsis thaliana
MSDLDRQIGQLKRCEPLSESEVKALCLKAMEILVEESNVQRVDAPVTLCGDIHGQFYDMMELFKVGGDCPKTNYLFMGDFVDRGYYSVETFLLLLALKVRYPDRITLIRGNHESRQITQVYGFYDECLRKYGSSNVWRYCTDIFDYMSLSAVVENKIFCVHGGLSPAIMTLDQIRTIDRKQEVPHDGAMCDLLWSDPEDIVDGWGLSPRGAGFLFGGSVVTSFNHSNNIDYIARAHQLVMEGYKWMFDSQIVTVWSAPNYCYRCGNVASILELDENLNKEFRVFDAAQQDSRGPPAKKPAPDYFL

SEQ ID NO: 407 - DNA, 3810 bp, Arabidopsis thaliana
atggcggatctagatccagagatcgctaaaactcaggaggaaagacggaagatggaagcagaccttgcttctctcacttctctgactttcgatcgcgatctatacggaggtaacgaccgtgcttcctactcgacttctattgcacctaacgaggaggatgatgcgaatctggacaccactggttctcttgtggctcagcgcctcgcgtcttatactgctcctaggtcaattcttaacgacgtggctcgtcctcacaacgaagatgacgatgtgggatttaaacctaggcagagtattgccgaacgtgagggtgaatataggaataggagactcaatcgggttctttctccggatagagttgatgcctttgctatgggcgacaaaacgccggatgcgagtgttcgtacttacacggaccatatgagggagacggctttgcagagggagaaagaggaaactatgagactcattgccaagaagaagaaagaggaagaagaagctgctgcgaagcatcagaaagattctgctcctcctcctcctgcttcctcttcttcttcctcttccaagaggagacacaggtgggatctccctgaagaagacggtgctgctgcaaagaaggctaaagcagcaagttcagattgggatttacctgatgcagctccagggattggacgatgggatgctcctactccagggagagtttctgatgccacaccatctgctggacgaaggaacaggtgggacgaaactcctacacctggtcgtgtgactgattctgatgcaacacctggtggtggtgttactcccggtgctactccttcaggtgttacttgggacgggcttgccacgcctaccccaaagcgtcaacgttcaaggtgggacgaaacaccagccactatggggagtgctacacctatgggtggagtcactcctggtgcagcttacactcctggtgttaccccaattggtgggattgatatggctactccgactccgggtcagcttattttccgtggtcctatgacccccgagcagctcaatatgcaaaggtgggagaaggatatcgaggaaagaaacagaccattgagtgatgaagagcttgatgccatgtttcctaaagatggatacaaggttttggatccgcctgctacgtatgttcccatcagaacccctgcgaggaaacttcaacaaaccccgacacccatggcaactcctggctatgttattcctgaggaaaaccgtgggcaacagtatgatgtgcccccagaagttcctggtggtttgccgtttatgaaaccagaggattatcagtattttggttctctgttaaatgaagagaacgaagaagagctgtctcctgaagagcagaaagaacgcaagataatgaaactgttgttaaaggttaaaaatggaactcctccccagaggaaaacagcgctgaggcagcttactgataaggctcgtgaacttggtgctggtcctttgttcaataaaattttgccattgctcatgcaacccactttggaagatcaagagaggcatcttttggtcaaagtgattgatagaattctgtacaaacttgatgagatggtaaggccttacgtccacaaaatccttgttgttattgagcctttgctgattgatgaagattattatgctcgtgtagaagggagagagattatttctaaccttagcaaagcagctggtttggcctctatgattgcagctatgcgtcctgatattgacaacatcgatgaatatgtgaggaacacaacagcgagagctttcagtgtggtggcttcagctcttggaatccctgcactcttgcctttcctgaaagctgtgtgccagagtaaaaggtcatggcaggcacggcatactggaatcaagattgttcagcagattgcgatactaattggttgtgctgtcctgcctcacttaaggtctttggtagagattatcgaacatggtcttagtgatgaaaaccagaaggttaggactattaccgcattgtcactggctgctcttgctgaagctgctgctccatatggtattgagagctttgattctgttctgaagcctttgtggaaaggtattaggtcgcaccgtggtaaagttttagctgctttcttgaaggcgatcggttttatcattcccttgatggatgctatatatgcgagctactatacaaaagaagtcatggttatcttgattcgtgagttccagtcgcctgatgaagagatgaagaagatcgtcctcaaggtggtgaaacagtgtgtaagtacagagggtgttgaaccggaatacattcgtagtgatattctgcccgagtttttcaggaatttctggacaaggaaaatggctctggagaggagaaactataagcagcttgttgaaactactgtggaggttgcgaacaaggttggtgttgcagatattgtgggaagagttgttgaagatctcaaggacgagagtgaacagtatcgacgtatggttatggaaaccattgataaggttgtcacaaacttaggagcatctgatattgatgcgaggttggaggaactgctcatagatggcattctttatgcttttcaagaacagactagtgacgatgctaatgtgatgcttaatggattcggtgctgtagtaaatgctcttggtcagcgagtaaagccttatcttccccagatctgtggtaccatcaagtggcgattgaacaacaagagtgcaaaggtaagacagcaagctgctgatctgatttctcgaattgcagttgttatgaagcaatgcggagaggaacagttgatgggacatctaggtgttgttttgtatgaatatcttggagaagagtacccagaagtcttgggatcgattcttggggctttaaaagctatagtcaatgtgattggtatgacgaagatgactcctcctattaaggatcttctaccaaggctgaccccgattttgaagaataggcatgagaaagtgcaagagaattgtatcgatcttgttggtaggattgctgatcgtggtgccgagtttgttccagcaagagaatggatgagaatctgtttcgagcttcttgaaatgcttaaagctcataagaaaggtattcgtcgtgctactgtcaacacttttgggtacattgccaaagccattgggccacaagacgttctagccacgttgcttaacaatctcaaagtccaagaacgtcagaaccgtgtttgcaccacagttgcaatcgccatagtcgctgaaacatgctctcccttcaccgtcttacctgctttgatgaatgagtaccgtgttccagagctaaacgtccaaaatggtgttctgaaatctctctccttcctcttcgagtacattggagagatgggcaaagattacatatacgcagttacaccgttgcttgaagacgctctcatggacagggatttggttcatagacaaacggctgcttcagctgtgaaacatatggctctaggtgtagctgggttgggatgcgaagacgccttggttcacttgcttaacttcatttggcccaacatttttgagacatctcctcacgtcattaacgcagtgatggaagccattgaaggaatgcgagtcgcattaggagcagctgtaattctgaactattgcttgcagggtttgtttcatccggcgcgcaaggtccgcgaagtgtactggaagatatacaattctttatacattggtgctcaggacacccttgttgctgcttacccggttcttgaagacgagcagaacaatgtgtatagccgaccggagttgacgatgtttgtgtga

SEQ ID NO: 408 - protein, 1269 aa, Arabidopsis thaliana
MADLDPEIAKTQEERRKMEADLASLTSLTFDRDLYGGNDRASYSTSIAPNEEDDANLDTTGSLVAQRLASYTAPRSILNDVARPHNEDDDVGFKPRQSIAEREGEYRNRRLNRVLSPDRVDAFAMGDKTPDASVRTYTDHMRETALQREKEETMRLIAKKKKEEEEAAAKHQKDSAPPPPASSSSSSSKRRHRWDLPEEDGAAAKKAKAASSDWDLPDAAPGIGRWDAPTPGRVSDATPSAGRRNRWDETPTPGRVTDSDATPGGGVTPGATPSGVTWDGLATPTPKRQRSRWDETPATMGSATPMGGVTPGAAYTPGVTPIGGIDMATPTPGQLIFRGPMTPEQLNMQRWEKDIEERNRPLSDEELDAMFPKDGYKVLDPPATYVPIRTPARKLQQTPTPMATPGYVIPEENRGQQYDVPPEVPGGLPFMKPEDYQYFGSLLNEENEEELSPEEQKERKIMKLLLKVKNGTPPQRKTALRQLTDKARELGAGPLFNKILPLLMQPTLEDQERHLLVKVIDRILYKLDEMVRPYVHKILVVIEPLLIDEDYYARVEGREIISNLSKAAGLASMIAAMRPDIDNIDEYVRNTTARAFSVVASALGIPALLPFLKAVCQSKRSWQARHTGIKIVQQIAILIGCAVLPHLRSLVEIIEHGLSDENQKVRTITALSLAALAEAAAPYGIESFDSVLKPLWKGIRSHRGKVLAAFLKAIGFIIPLMDAIYASYYTKEVMVILIREFQSPDEEMKKIVLKVVKQCVSTEGVEPEYIRSDILPEFFRNFWTRKMALERRNYKQLVETTVEVANKVGVADIVGRVVEDLKDESEQYRRMVMETIDKVVTNLGASDIDARLEELLIDGILYAFQEQTSDDANVMLNGFGAVVNALGQRVKPYLPQICGTIKWRLNNKSAKVRQQAADLISRIAVVMKQCGEEQLMGHLGVVLYEYLGEEYPEVLGSILGALKAIVNVIGMTKMTPPIKDLLPRLTPILKNRHEKVQENCIDLVGRIADRGAEFVPAREWMRICFELLEMLKAHKKGIRRATVNTFGYIAKAIGPQDVLATLLNNLKVQERQNRVCTTVAIAIVAETCSPFTVLPALMNEYRVPELNVQNGVLKSLSFLFEYIGEMGKDYIYAVTPLLEDALMDRDLVHRQTAASAVKHMALGVAGLGCEDALVHLLNFIWPNIFETSPHVINAVMEAIEGMRVALGAAVILNYCLQGLFHPARKVREVYWKIYNSLYIGAQDTLVAAYPVLEDEQNNVYSRPELTMFV

SEQ ID NO: 409 - DNA, 1128 bp, Arabidopsis thaliana
atggcggctgcaatggcttctcatgtttcgacggctcgatcaccggctctttccttctcttcttcgtcttcctccttcttccccggtactactcttcggagattctccgccgtttcactcccttctcctgctctccctcgccttcgtgtttcatgtcaagcctcctccgtcacttcgccttcttctccttccgatgtcaaaggaaaatctgacctgaaagactttctggcaatagatgattttgacacagccaccattaaaacgattttagacaaggcttcagaggttaaggccttgctgaaatcaggggagagaaattatctaccttttaaagggaagtctatgtctatgatctttgcaaaaccttccatgaggactcgggtttcgtttgagactggttttttcttgctcggtggccatgcgttatatctaggtcccaatgacattcagatgggtaagcgggaggaaactcgtgatgttgctcgtgttctttcacgctataatgacatcattatggctcgtgtatttgctcatcaggacattcttgatttggctaactactcgagtgtaccagttgtcaatggtctgactgatcataaccatccttgccaaatcatggccgatgccctcacaatgatagagcacattggtcaagttgaagggacaaaggttgtgtatgttggagatgggaacaacatggttcactcttggttagaattggcatccgttattccattccactttgtctgcgcttgcccaaaagggtatgaaccagacaaagaaagagtttcaaaggcaaagcaagctggattaagtaagatagagatcaccaatgatcctaaagaagctgttattggagcagatgttgtgtactcagacgtatgggccagtatgggtcaaaaggatgaagccgaagctcgccggaaagcattccaaggattccaggtggatgaagctctgatgaagttggcgggtcaaaaagcctatttcatgcattgtttgcctgcagagagaggagttgaggtgaccaatggagtcgtagaggctccttattccattgtctttccacaggcggagaatcgcatgcatgctcaaaatgctataatgcttcacttgctcggcttttaa

SEQ ID NO: 410 - protein, 375 aa, Arabidopsis thaliana
MAAAMASHVSTARSPALSFSSSSSSFFPGTTLRRFSAVSLPSPALPRLRVSCQASSVTSPSSPSDVKGKSDLKDFLAIDDFDTATIKTILDKASEVKALLKSGERNYLPFKGKSMSMIFAKPSMRTRVSFETGFFLLGGHALYLGPNDIQMGKREETRDVARVLSRYNDIIMARVFAHQDILDLANYSSVPVVNGLTDHNHPCQIMADALTMIEHIGQVEGTKVVYVGDGNNMVHSWLELASVIPFHFVCACPKGYEPDKERVSKAKQAGLSKIEITNDPKEAVIGADVVYSDVWASMGQKDEAEARRKAFQGFQVDEALMKLAGQKAYFMHCLPAERGVEVTNGVVEAPYSIVFPQAENRMHAQNAIMLHLLGF

SEQ ID NO: 411 - DNA, 201 bp, Arabidopsis thaliana
atggcggcagcgagcttgaatgcatctggaaaaggatcgaagaaaccaaatgggttgaaggagtttctggaaagtctagaagctctgaaggcagatcttaaaaccttgagtaaggaggagctgcttgaactggaaaagcggctgaaaaatgtggctcgtaaggcgagggaagagctggagaggcgtatggagcagccctaa

SEQ ID NO: 412 - protein, 66 aa, Arabidopsis thaliana
MAAASLNASGKGSKKPNGLKEFLESLEALKADLKTLSKEELLELEKRLKNVARKAREELERRMEQP

SEQ ID NO: 413 - DNA, 1299 bp, Arabidopsis thaliana
atggatcctcaagctttcattcgtctttcggttggctctcttgctttgagaattcccaaggtccttataaactctacttcaaaatctaatgagaagaagaacttttcttctcaatgctcttgcgaaataaaactacgaggctttcctgttcaaacaacatctatccctttgatgccgtcccttgatgcagctcctgaccatcacagtatttccactagcttttatcttgaagaatctgatttaagagctcttttgacacctggatgcttctatagtcctcatgctcacttggaaatctcggttttcacgggtaaaaagagtttgaattgcggtgttggtggcaaaagacagcagattgggatgtttaagttggaggtaggtcctgaatggggagaaggaaaaccaatgattcttttcaatggttggatcagtattggaaagaccaagcgggatggtgctgcagagcttcatttgaaagtgaaacttgatcctgatcctcgatatgtttttcagtttgaggatgttactaccttgagccctcagatagttcagctccgtggctcggtcaagcaacctatcttcagttgcaagtttagcagagacagggtgtcacaggtggatccgttgaatgggtactggtcaagttcaggcgatggaactgagcttgagagtgagagacgtgaaagaaaaggatggaaggtgaagatacatgatctctctggctctgcagttgctgctgctttcataacaactccttttgttccatccactggatgtgattgggtcgcaaagtccaacccgggtgcttggcttgtggtccggcctgacccatctcgaccaaacagctggcagccatggggaaagctcgaagcttggcgggaacgcgggatcagagactccgtgtgttgcagattccatcttctatcaaacggtctagaagttggagatgttttaatgtctgaaatcctcatcagcgctgagaaaggtggggaatttttaatcgacacggataaacagatgctaacagttgcagctacaccaattccaagcccgcagagtagtggagacttctcagggttgggacagtgtgtctctggaggtgggtttgtaatgagctcgagagtgcaaggggaagggaaaagcagcaagcccgttgtacaattagctatgagacatgtaacttgtgtggaagatgcagccattttcatggcacttgctgcagctgttgatcttagcattcttgcttgtaaaccttttaggagaacgagtcggagaaggttccggcattactcctggtga

SEQ ID NO: 414 - protein, 432 aa, Arabidopsis thaliana
MDPQAFIRLSVGSLALRIPKVLINSTSKSNEKKNFSSQCSCEIKLRGFPVQTTSIPLMPSLDAAPDHHSISTSFYLEESDLRALLTPGCFYSPHAHLEISVFTGKKSLNCGVGGKRQQIGMFKLEVGPEWGEGKPMILFNGWISIGKTKRDGAAELHLKVKLDPDPRYVFQFEDVTTLSPQIVQLRGSVKQPIFSCKFSRDRVSQVDPLNGYWSSSGDGTELESERRERKGWKVKIHDLSGSAVAAAFITTPFVPSTGCDWVAKSNPGAWLVVRPDPSRPNSWQPWGKLEAWRERGIRDSVCCRFHLLSNGLEVGDVLMSEILISAEKGGEFLIDTDKQMLTVAATPIPSPQSSGDFSGLGQCVSGGGFVMSSRVQGEGKSSKPVVQLAMRHVTCVEDAAIFMALAAAVDLSILACKPFRRTSRRRFRHYSW

SEQ ID NO: 415 - DNA, 1173 bp, Arabidopsis thaliana
atggagatgaccgaagcttccaaacagacaacagcagaaggatcagcaaatccagaaccagaccaaatcttgagtccgagaagatcgttggagctaaaacaaaagaaatggtggatctctgtttctttatgtattttcttagtcttgctcggagattctctagtcatgcttctcttgaacttcttctatgttcaagacaatcgagaagatagtgaccaagatctacaataccgaggaacatggttgcaagctctggtccaaaacgctgcgtttccactactcattcctctgtttttcattttcccttcaccaaaacaaaaccaagaaaccaccaatactcgtttcctctcttttcgtctcatcttactttacatctctcttggtgttcttgttgctgctcacagcaaattgtttgcacttgggaaattatacgcaaactttggcgtcttcacgctgatttccgcgactcagttgatatttaccgctattttcgcagccattattaaccgttttaagttcaccagatggattatcttatcgataatcggcagcattttgatttatgttttcggtagtcctgaatttggaggagagcctgatgaaaacgaagaattctacagcatccaagcttggttaactttcgctgcttcagttgctttcgcattatctctctgtttattccaactttgtttcgagaaagtgttggtaaagacaaagagatatggtaacaagaaagtgtttagaatggtcatagagatgcaaatttgtgtctcttttgtcgcaacggttgtttgtctcgtgggtttgtttgcgagtggcgagaataaggaactgcaaggcgatagccacaggtttaagaaaggagaaacgtattacgttttgagtttgatcgggttggcattgtcgtggcaggtttgggcggtcgggctgatgggtttggtgctttatgtttcgggtgtgtttggcgatgttgttcatatgtgtacttcaccacttgtggctttgtttgttgtgttggcatttgatttcatggatgatgagtttagttggcctagaattggtactttgatagcaacagttgtggctttaggatcttacttctacactctgcataagagaaacaagaagaagatggtggagctttaccaaacagagaacaatattgacgtttag

SEQ ID NO: 416 - protein, 390 aa, Arabidopsis thaliana
MEMTEASKQTTAEGSANPEPDQILSPRRSLELKQKKWWISVSLCIFLVLLGDSLVMLLLNFFYVQDNREDSDQDLQYRGTWLQALVQNAAFPLLIPLFFIFPSPKQNQETTNTRFLSFRLILLYISLGVLVAAHSKLFALGKLYANFGVFTLISATQLIFTAIFAAIINRFKFTRWIILSIIGSILIYVFGSPEFGGEPDENEEFYSIQAWLTFAASVAFALSLCLFQLCFEKVLVKTKRYGNKKVFRMVIEMQICVSFVATVVCLVGLFASGENKELQGDSHRFKKGETYYVLSLIGLALSWQVWAVGLMGLVLYVSGVFGDVVHMCTSPLVALFVVLAFDFMDDEFSWPRIGTLIATVVALGSYFYTLHKRNKKKMVELYQTENNIDV

SEQ ID NO: 417 - DNA, 1047 bp, Arabidopsis thaliana
atggttggagagcccttgatacagcttggcgttggtgatcgccttcgtctcaattcttctcttattcacaaggcacggaccatgttgattgagaatggaaaaaaacgagaattcgtttcaaatatagtagacgaagctcgttgtattaaaaggaacgatcttgttgaggccttatccgatgcccttccgaaaggaaccatccggttcggttctcatattgtttctattgagcaggacaaaactacgttgtttccggttgttcacttagccaatggaaatagcatcaaagccaaggtcctgattggatgcgatggtgccaattctatcgtcagtgattatttgcagttaaacccgaaaaaggcgtttgcttgtcgtgcggtgagagggtttactaagtacccaaacggccatggatttccacaagaggttctaaggataaagcaaggaaatgtcttaataggaaggcttcctttgacggataatcaagtcttttggtttctagtacatatgcaagacaataatcacaatggtaaagatcaagaatcgattgcgaatctgtgtcgaaaatgggccgatgacttgtctgaagattggaaagaaatggtaaaaatatgcaatgtggagtcattaacactcacacacttaaggtaccgagcgccatcggaaatcatgttagggaaatttcgtcgtgggacagtgactgtagccggcgatgcgatgcacgtgatgggtccgttcttggcacagggcggctcagcggcgctagaggatgcggttgttttagctaggtgtctagctaggaaagttggtccggaccacggagacttgttaaaggattgttcgatgaaaaacattgaagaagctattgatgagtatgtggatgaacgtaggatgagattactcgggctttcggtgcagacttatttgaccggacgttcgctacaaacgtcatcaaaggttctgaggctaatgtttatagctttgttgttacttttgtttggtcgtgatcaaattcgtcatactaggtacgactgtggccgtctctag

SEQ ID NO: 418 - protein, 348 aa, Arabidopsis thaliana
MVGEPLIQLGVGDRLRLNSSLIHKARTMLIENGKKREFVSNIVDEARCIKRNDLVEALSDALPKGTIRFGSHIVSIEQDKTTLFPVVHLANGNSIKAKVLIGCDGANSIVSDYLQLNPKKAFACRAVRGFTKYPNGHGFPQEVLRIKQGNVLIGRLPLTDNQVFWFLVHMQDNNHNGKDQESIANLCRKWADDLSEDWKEMVKICNVESLTLTHLRYRAPSEIMLGKFRRGTVTVAGDAMHVMGPFLAQGGSAALEDAVVLARCLARKVGPDHGDLLKDCSMKNIEEAIDEYVDERRMRLLGLSVQTYLTGRSLQTSSKVLRLMFIALLLLLFGRDQIRHTRYDCGRL

SEQ ID NO: 419 - DNA, 612 bp, Arabidopsis thaliana
atgagcggagacaacggcggtggtgagaggcgcaaaggctccgtcaagtggtttgatacccagaagggtttcggcttcatcactcctgacgacggtggcgacgatctcttcgttcaccagtcctccatcagatctgagggtttccgtagcctcgctgccgaagaagccgtagagttcgaggttgagatcgacaacaacaaccgtcccaaggccatcgatgtttctggacccgacggcgctcccgtccaaggaaacagcggtggtggttcatctggcggacgcggcggtttcggtggaggaagaggaggtggacgcggatctggaggtggatacggcggtggcggtggtggatacggaggaagaggaggtggtggtcgaggaggcagcgactgctacaagtgtggtgagcccggtcacatggcgagagactgttctgaaggcggtggaggttacggaggaggcggcggtggctacggaggtggaggcggatacggcggaggaggtggtggttacggaggtggtggccgtggaggtggtggcggcgggggaagctgctacagctgtggcgagtcgggacatttcgccagggattgcaccagcggtggacgttaa

SEQ ID NO: 420 - protein, 203 aa, Arabidopsis thaliana
MSGDNGGGERRKGSVKWFDTQKGFGFITPDDGGDDLFVHQSSIRSEGFRSLAAEEAVEFEVEIDNNNRPKAIDVSGPDGAPVQGNSGGGSSGGRGGFGGGRGGGRGSGGGYGGGGGGYGGRGGGGRGGSDCYKCGEPGHMARDCSEGGGGYGGGGGGYGGGGGYGGGGGGYGGGGRGGGGGGGSCYSCGESGHFARDCTSGGR

SEQ ID NO: 421 - DNA, 384 bp, Arabidopsis thaliana
atggacgacaagacggcgggtggtaagattgtcatgaataaggagcaactgcttttgtttatggaaaacaggcggaagcaggaggatcaccgtctcgctctcgccaaggaagccaccagatctgagatggttgaccggaaggccagcggtaagataatcatgaatcatgatcagcagcttatgtttaacgaggatcaccgtctcgccgtcaagaaagccagcagatctgagatggttgacctggaggggatgggttcggaggcgagtgtaataatgagtaatgttccacagccaacttcttttagcgaggatcacaagctcgccatcaagaacatcatatctaagattgtcaaggagatccgcgatagagatcaccccgcttag

SEQ ID NO: 422 - protein, 127 aa, Arabidopsis thaliana
MDDKTAGGKIVMNKEQLLLFMENRRKQEDHRLALAKEATRSEMVDRKASGKIIMNHDQQLMFNEDHRLAVKKASRSEMVDLEGMGSEASVIMSNVPQPTSFSEDHKLAIKNIISKIVKEIRDRDHPA

SEQ ID NO: 423 - DNA, 2886 bp, Arabidopsis thaliana
atgacgactacgcagagcgctatgagaatggttgagggtgatcatataaaaaattggcaggcttctagtgatagtgggatctttggttcacttgatatggctgttgaagatttaggattccttatgaaaagaaataggttggatagtggtgatcaaaccggtaaattccctagtagaagcgaaagcgcgccgcctagcatggaaggttcctttgcagctcttaggaatctcttgaaacaacaagaaggtagtagctctgaagttttaagtagggctattgagaattatgactcggaagaagagatacgtagtgatcctgcttatgtagcttactatttgtcgaacatcaacttgaatccgagactccctcctccgttaatctcacgggagaatcagcacttgttgcgtcattttggtgataataatcagagtccaacaacttcttgggataatatggggataagatcatctttgcattcttctagaactgctctttcaactcatagagaggagcccgaggatgaggcatcatcgggtgaacaacaatcttatgcttctttggctggtcgtcgtaagagcatagctgatatgattcaggaagatttccctcttacactttcttctgtgttcaagcggcctcattcggcaggaaatcgtccaatagcacaagacatccatgccatttcctctgatacatcttcagaacacgcaagaagattaccggagtccgatataaattcggttaatctgctgagggagacagattctctctccagcgatgctattgctagtgaagatccctttaccactgatttggcctcacaaagttttactaatgcacagacagagagattgaacgcgaggcaagcgagccatgaggacaacaatctatctgtttttggtgcttctcctccatcctctgttgcttcaagaatgaggaggaaccaagaagaccaacaatctcagggaaggagaatgcctccacaatacacaccttcatcgtatcaggttcaagctagttcgccacagcaaatgagctatccgaggataggtggtacacaggacatgatgcagagcttaccaaagattgcaactggcgaggtacattcgactttccaatctcctcacggtttggcaccgcctcctatgtatacatcaacagcagcatatatgacatctctgagtccattttaccatcaaaactttcagtcctcgggtatgttcgtcccgcaatataattatggtggttaccctcctgcttctggtattgtccctcaatatatgagtggatacccatctcatgaagcgactgttcctatgccatatgatatctcatctacttcttcgggctacaacaaccctcggctcctgcctggagtatcatcgagtggacaaaacattccttctcttgtggatccttttcagttgcaatattttcaacaggctcaagtggacgcgtatgctcctccgtttcagagcagcactgattcttttgggcagaaagaccaacaagctgttggctatatggcaaatcatgaacctctcaacagtccattgagtccgggttacgggttgcaaagtccgcggcacatgggaaactattttgcagtgccgcctggtgtaagagtaatgccgcagtatccaggatcacctcttgctagtccggtgatgccatcctcaccggttggtggaatgatgagccactttggaagacgaagtgaaacaaggtatcatcaacaagggccaagtagaaacactgggatctaccctggtggatggcaagggaacagagggggagccagcagcatcgttgatgatctaaaaagacattcttttcttgatgaacttaagtctccaaatgctcggaaactcgagctttctgatattgcagggcgtgttgttgaattcagcgtcgatcagcatggcagccggtttattcaacagaagttggagcactgctccgatgaggagaaggcatctgttttcagtgaggttcttccacaagcttcaaaattgatgactgacgtttttggaaattatgtcatccaaaaattcatagaacatggaactccggcacagagagaagaacttgtgaagcaacttgctggtcagatggtttcactaagcttacaaatgtatggatgccgtgtgatacaaaaggcccttgaagtgatagatgttgaccaaaagacagaactaattcgtgagctcgatgggaatgtgctgaagtgtgttagagatcaaaacggaaatcatgttatccaaaaatgtatcgagagtatgcctgctggtaggattggattcgtaattgctgctttccgtggtcaagtcgccactctttctactcatccttatggatgccgagttatccagagaatcttggagcattgctcagatgatgaggagactcattgtataatagatgaaatattggaatctgcgtttgctcttgctcatgatcagtatgggaattatgtcactcagcatgtcctggagagagggaagcccgatgaaaggagacagatcattgagaagttgacagggaatgttgttcagatgagtcagcacaaatacgcatctaacgttgtagagaagtgtttggaacacgctgatagtaccgaaagagagttcctgattgaagagataatgggcaaatccgaggaagacaatcacttgctagcgatgatgaaggatcagtttgcaaattacgtggtccagaaagtcttggagatcagtaaagatcagcaaagggagattctggtgcagaggatgaaaattcatctccaaagtttgcggaaatacacatacgggaaacacatagtagcccgattcgaacaactgtttggtgaagagagtgaagtctcagaagagggaacagaaggttag

SEQ ID NO: 424 - protein, 961 aa, Arabidopsis thaliana
MTTTQSAMRMVEGDHIKNWQASSDSGIFGSLDMAVEDLGFLMKRNRLDSGDQTGKFPSRSESAPPSMEGSFAALRNLLKQQEGSSSEVLSRAIENYDSEEEIRSDPAYVAYYLSNINLNPRLPPPLISRENQHLLRHFGDNNQSPTTSWDNMGIRSSLHSSRTALSTHREEPEDEASSGEQQSYASLAGRRKSIADMIQEDFPLTLSSVFKRPHSAGNRPIAQDIHAISSDTSSEHARRLPESDINSVNLLRETDSLSSDAIASEDPFTTDLASQSFTNAQTERLNARQASHEDNNLSVFGASPPSSVASRMRRNQEDQQSQGRRMPPQYTPSSYQVQASSPQQMSYPRIGGTQDMMQSLPKIATGEVHSTFQSPHGLAPPPMYTSTAAYMTSLSPFYHQNFQSSGMFVPQYNYGGYPPASGIVPQYMSGYPSHEATVPMPYDISSTSSGYNNPRLLPGVSSSGQNIPSLVDPFQLQYFQQAQVDAYAPPFQSSTDSFGQKDQQAVGYMANHEPLNSPLSPGYGLQSPRHMGNYFAVPPGVRVMPQYPGSPLASPVMPSSPVGGMMSHFGRRSETRYHQQGPSRNTGIYPGGWQGNRGGASSIVDDLKRHSFLDELKSPNARKLELSDIAGRVVEFSVDQHGSRFIQQKLEHCSDEEKASVFSEVLPQASKLMTDVFGNYVIQKFIEHGTPAQREELVKQLAGQMVSLSLQMYGCRVIQKALEVIDVDQKTELIRELDGNVLKCVRDQNGNHVIQKCIESMPAGRIGFVIAAFRGQVATLSTHPYGCRVIQRILEHCSDDEETHCIIDEILESAFALAHDQYGNYVTQHVLERGKPDERRQIIEKLTGNVVQMSQHKYASNVVEKCLEHADSTEREFLIEEIMGKSEEDNHLLAMMKDQFANYVVQKVLEISKDQQREILVQRMKIHLQSLRKYTYGKHIVARFEQLFGEESEVSEEGTEG

SEQ ID NO: 425 - DNA, 891 bp, Arabidopsis thaliana
atggacagcttctggcaattaggtgatgagctacgaggtcagacgagagcatcagaggatcacaaatggtctactgttgcaacgaagctagctgagcaaactagaatgaaaggggagaggatgaacaatcttgatctctccaaaggttacactgagtttagaccaagtgagaaattcagtttccaggagaacaatcttaacttcaacatgttgaatttggatggtaaatttggtgaaagcatcatggggaagacttcgatgcagagcaatgtttataatatgaatactgttttccagaagaatgactttaagagtggaggcaacatgaaagttaacaagtataatggtaatgttgttgctaacaaggagatgagcaacaacaaacataacaacaactgcaatgataatgggaatatgaatttggctgttgacaagaggtttaaaaccttgcctgcttcggagactcttccgaggaatgaagttcttggtggttacatctttgtttgcaacaatgatactatgcaggaggatatgaaacgtcacctctttggtttacctccaagatacagagactctgttcgagctataacacctggattgcctctgtttctttacaactacaccactcaccagcttcatggtatctttgaggcaacaacttttggaggtactaatattgatgctactgcttgggaagacaaaaagtgcaaaggagagtcaaggtttccggctcaggtaaggatcagagtgaggaaaatctgcaaagccttggaagaggactccttcaggccagtacttcaccactatgatggtccaaaattccgccttgagctctctgttcctgagacattggatctgctagatctttgcgaacaagctggttctgcataa

SEQ ID NO: 426 - protein, 296 aa, Arabidopsis thaliana
MDSFWQLGDELRGQTRASEDHKWSTVATKLAEQTRMKGERMNNLDLSKGYTEFRPSEKFSFQENNLNFNMLNLDGKFGESIMGKTSMQSNVYNMNTVFQKNDFKSGGNMKVNKYNGNVVANKEMSNNKHNNNCNDNGNMNLAVDKRFKTLPASETLPRNEVLGGYIFVCNNDTMQEDMKRHLFGLPPRYRDSVRAITPGLPLFLYNYTTHQLHGIFEATTFGGTNIDATAWEDKKCKGESRFPAQVRIRVRKICKALEEDSFRPVLHHYDGPKFRLELSVPETLDLLDLCEQAGSA

SEQ ID NO: 427 - DNA, 1755 bp, Arabidopsis thaliana
atgaccaaagaagtttgctccaacattggactttggttattgctcacgttacttattggtaactatgtcgtcaatcttgaagcctcgcaccatgtctacaagagacttacccaaagcactaacaccaaatctccttccgtaaaccagccctaccggaccggtttccatttccaaccccccaaaaattggatgaacgatcctaatgggcctatgatatacaaaggaatatatcatcttttctaccaatggaacccgaaaggagccgtgtggggtaacatcgtgtgggctcattccacgtcaacagacttaatcaattgggatccacatcctccagctatcttcccatctgcacccttcgatatcaacggatgctggtccggttcagctactattctccctaatggaaaaccggttatcctctataccggaatcgaccctaagaaccaacaggtccaaaacatagccgagcctaagaatctctccgatccttatctccgagaatggaaaaagtcgccgttaaatcctctcatggctcctgacgccgttaacggaatcaacgccagctcgttccgtgacccaaccaccgcgtggctaggccaagacaagaaatggagagtgatcatcggaagcaagattcaccgtcgtggactagccattacttacacgagtaaagactttctaaaatgggaaaaatctccagagccgttgcattacgacgacggaagtggaatgtgggaatgtcctgattttttcccggtcacgaggtttggttctaacggcgtggaaacgtcttcgtttggtgaacctaatgagattttgaagcacgtgttgaaaataagtttggacgacacgaaacatgattattacacgattggtacgtacgatcgggttaaagataaattcgtaccggacaatggtttcaagatggacggtacggctccgagatacgattacggaaagtattacgcgtctaaaacgttttttgactcggctaagaaccggagaatcttgtggggttggactaacgagtcatcgtcggttgaggatgatgttgagaaaggctggtccggtattcagacgattccaaggaaaatatggcttgatagatcagggaaacaattaattcagtggccggttagggaagttgaaagattacgtacaaaacaagtcaaaaacttacgcaacaaagttctaaagtcaggatctaggcttgaagtctatggtgtgacagctgcacaggcggatgtagaagtattgttcaaagtgagagacttggagaaagcggatgtgatagaaccaagttggactgatccgcagttgatttgtagcaagatgaatgtatcggttaagtctggtttaggtccattcggtttaatggttttggcatctaagaatttggaagagtacacatctgtttattttagaatcttcaaagcccgtcaaaacagcaataagtacgttgtgctcatgtgcagtgaccaaagcagatcttcgctgaaggaagataatgacaaaacgacatacggagcttttgtggatattaatcctcaccaaccactatccctcagagccttgattgatcattcagtagtggagagtttcggtggaaagggaagagcatgcattacctcaagagtgtatccaaaattggcaataggaaaaagttcacatctctttgcttttaattatggatatcaaagtgttgatgtcttaaacttaaatgcttggagcatgaactctgcccaaatcagttga

SEQ ID NO: 428 - protein, 584 aa, Arabidopsis thaliana
MTKEVCSNIGLWLLLTLLIGNYVVNLEASHHVYKRLTQSTNTKSPSVNQPYRTGFHFQPPKNWMNDPNGPMIYKGIYHLFYQWNPKGAVWGNIVWAHSTSTDLINWDPHPPAIFPSAPFDINGCWSGSATILPNGKPVILYTGIDPKNQQVQNIAEPKNLSDPYLREWKKSPLNPLMAPDAVNGINASSFRDPTTAWLGQDKKWRVIIGSKIHRRGLAITYTSKDFLKWEKSPEPLHYDDGSGMWECPDFFPVTRFGSNGVETSSFGEPNEILKHVLKISLDDTKHDYYTIGTYDRVKDKFVPDNGFKMDGTAPRYDYGKYYASKTFFDSAKNRRILWGWTNESSSVEDDVEKGWSGIQTIPRKIWLDRSGKQLIQWPVREVERLRTKQVKNLRNKVLKSGSRLEVYGVTAAQADVEVLFKVRDLEKADVIEPSWTDPQLICSKMNVSVKSGLGPFGLMVLASKNLEEYTSVYFRIFKARQNSNKYVVLMCSDQSRSSLKEDNDKTTYGAFVDINPHQPLSLRALIDHSVVESFGGKGRACITSRVYPKLAIGKSSHLFAFNYGYQSVDVLNLNAWSMNSAQIS

SEQ ID NO: 429 - DNA, 1332 bp, Arabidopsis thaliana
atgggacaaggaccatcgggaggattgaatcggcaaggagatcggaaacctgatggtggagataagaaagagaagaagtttgagccggcggcaccaccggctcgtgtagggaggaagcaaaggaagcagaaagggccagaggcggcggcgagacttccgacggtgactccgtctactaagtgtaagctccggttactgaaattggaacggatcaaggattatttgttgatggaggaagagtttgtggcgaatcaagagaggttgaaacctcaggaagagaaagctgaggaagatagatctaaggttgatgatcttcgtggtacacctatgagtgttgggaatttggaagagttgattgatgagaatcacgctattgtttcttcttctgttggacctgagtactacgttgggattttgtccttcgttgataaagatcagcttgaacctggatgttcgattttgatgcataataaggttctctctgttgttgggattctacaagatgaagtggatccaatggtgtctgtgatgaaagttgagaaagctcctttggagtcatatgctgatattggaggtttagaagctcagattcaggagattaaggaagctgttgagcttcctttgactcatcctgagttgtatgaagatattggtattaaaccaccaaagggtgtaattttgtatggtgagcctggaactgggaagacattgcttgctaaggcggttgcgaattcaacatcagctactttcttgagagttgttggtagtgagctgattcagaagtatttgggagatggtcctaagcttgtgagagaacttttcagagttgctgatgacctttcaccatcaatcgtcttcatagatgagattgatgctgttggtaccaagcggtatgacgctcactcaggaggtgaacgtgagatccaaagaactatgttggaacttctgaaccagcttgatggatttgattcaagaggagatgttaaggtcatccttgcaacaaacagaatcgagagtcttgacccagcactgcttcgacctggacggattgataggaaaatcgagttccctctcccagatatcaaaacaagaagacgtatcttccagatacacacatcgaagatgactctctcggaagatgtaaacctcgaagagtttgtgatgacgaaagacgagttctcaggagctgatataaaggctatatgcactgaggctggtctactagctctcagggagcgtcgtatgaaggtgacacatcctgatttcaagaaagcaaaggagaaggttatgttcaagaagaaagaaggcgtccctgaaggcctctacatgtaa

SEQ ID NO: 430 - protein, 443 aa, Arabidopsis thaliana
MGQGPSGGLNRQGDRKPDGGDKKEKKFEPAAPPARVGRKQRKQKGPEAAARLPTVTPSTKCKLRLLKLERIKDYLLMEEEFVANQERLKPQEEKAEEDRSKVDDLRGTPMSVGNLEELIDENHAIVSSSVGPEYYVGILSFVDKDQLEPGCSILMHNKVLSVVGILQDEVDPMVSVMKVEKAPLESYADIGGLEAQIQEIKEAVELPLTHPELYEDIGIKPPKGVILYGEPGTGKTLLAKAVANSTSATFLRVVGSELIQKYLGDGPKLVRELFRVADDLSPSIVFIDEIDAVGTKRYDAHSGGEREIQRTMLELLNQLDGFDSRGDVKVILATNRIESLDPALLRPGRIDRKIEFPLPDIKTRRRIFQIHTSKMTLSEDVNLEEFVMTKDEFSGADIKAICTEAGLLALRERRMKVTHPDFKKAKEKVMFKKKEGVPEGLYM

SEQ ID NO: 431 - DNA, 1449 bp, Arabidopsis thaliana
atgaaggaacctttgcagaagaagaaggtggttgttcgtcacttgccgccttctctttcacagtccgatctcttatctcaaattgatcctcgtttcgctgatcgttacaattgggtttcgtttcgtcctgggaagtccagctataaaaatcagaagtattcacgggcctatgtaagtttcaaggcaccagaagatgtttatgagttcgctgcatttttcaacgggcatgtgtttgttaatgaaaagggtgctcagtttaaggctatagttgaatatgcaccttctcagcgtgttccgaaaccgagtgataagaaagatcctcgtgaagggtctattagtaaagatcctgattatcttgagtttcttaaggtgattgcacaacctgttgagaatcttcctagtgctgaaatccagttggaaagaagagaagctgagcagtctggtgcttcaaaagcggctcccattgttacacctcttatggaattcatacgtcaaaaacgtgccactgtgatgggaccccagggtttatctgatattcgaagaggaggtagaagaaccagagtagtctctgcaaacaagccgagtccaaggccctcgaaacgtaactctgaaaagaaaaagtatgtggaaaaagaaagttcaaagaatgtgccccggaagactacagcagacgtcagcagctctaagccagattatcgtcagtcaaattcaagtggaaaggaactaccaggaaatgaaactgccgctatcattgatagctctccccctgggatagcattgactatggattctgggaagaaaaagattttgctcctgagatcaaaagaccgagacaatcctgataaccctccaccacaaccggaacagcatatagacactaatctttctagaaactccacggattcaagacaaaaccagaagagtgatgttggtgggaggttgatcaagggaatacttctgagaaatgactctcgaccgagccagtcttccacttttgtgcagtctgagcaaagagtggaaccctcagaagcagaaaactacaaacgaccttctcgaccagccaacactcgagcagggaaagattatcatacttctggtaccatcagtgagaagcaagagaggcgtacaagaaacaaggatagacctgatcgtgttatgtgggctcctcgtcgtgatggtagtgaggatcaaccactatcttcagcaggaaacaatggagaagtgaaagacaggatgttctctcaaagatcgggagaagtggtgaactcctctggtggtcacactcttgagaatggttctgccagacattctagtcgccgtgttggaggtcgcaatagaaaagaagaggtggtgattggcgagggtaaaacctcccggagaggaagtggtggtggtcccagttcacatgagaagcaaatgtggatccaaaaaccatcatccggtacttga

SEQ ID NO: 432 - protein, 482 aa, Arabidopsis thaliana
MKEPLQKKKVVVRHLPPSLSQSDLLSQIDPRFADRYNWVSFRPGKSSYKNQKYSRAYVSFKAPEDVYEFAAFFNGHVFVNEKGAQFKAIVEYAPSQRVPKPSDKKDPREGSISKDPDYLEFLKVIAQPVENLPSAEIQLERREAEQSGASKAAPIVTPLMEFIRQKRATVMGPQGLSDIRRGGRRTRVVSANKPSPRPSKRNSEKKKYVEKESSKNVPRKTTADVSSSKPDYRQSNSSGKELPGNETAAIIDSSPPGIALTMDSGKKKILLLRSKDRDNPDNPPPQPEQHIDTNLSRNSTDSRQNQKSDVGGRLIKGILLRNDSRPSQSSTFVQSEQRVEPSEAENYKRPSRPANTRAGKDYHTSGTISEKQERRTRNKDRPDRVMWAPRRDGSEDQPLSSAGNNGEVKDRMFSQRSGEVVNSSGGHTLENGSARHSSRRVGGRNRKEEVVIGEGKTSRRGSGGGPSSHEKQMWIQKPSSGT

SEQ ID NO: 433 - DNA, 1089 bp, Arabidopsis thaliana
atgcccctgacaaaattagttcccgatgcattcggcgttgtgacgatatgtctagtcgctctgctagttcttttgggtctcctttgcatcgcttactcgttctatttccagtctcacgttcgtaagcaaggctatattcaacttggttacttcagtggtccctggattatccgaatcactttcattctctttgctatctggtgggctgttggtgagatttttcgattgagtttgttgaggcgtcacagaaggttgttgagtgggttggatctgagatggcaagaaaacgtttgcaagtggtacatcgtttccaatctaggatttgcggagccttgtctctttctgactctcatgtttcttctgcgtgctcccttgaagatggaatcaggggctttgagcggaaaatggaacagggacacagcaggttatattattctttattgtctcccgatgcttgctcttcaacttgcggttgtgttgtccgagtcacgcctaaatggtggtagtggctcttatgtaaagctgccacacgacttcacaagaacgtattcccgagttattattgatcacgacgaggtggccttatgcacatatcctctactgagtaccatccttcttggtgtgtttgcagccgtcctaacagcttacttgttctggcttggaaggcagatactgaaacttgtcattaacaagcgtttacagaagagagtatacactttgatattctcggtctcgagtttccttccattaaggattgttatgctctgtttgtcggttctcacagcagcagacaagattatattcgaagccctttctttcttggccttcctctccctcttctgcttttgcgtggtatccatctgcttgcttgtctacttcccggtttcagattccatggccctgagaggtctaagagacacagatgatgaggatacggctgtgaccgaagaacgcagtggtgctctgttacttgcaccaaactcttcacaaactgatgagggattgagcttaagaggtcggagagactcgggatcgtctacacaggagaggtatgtggaactcagcctatttctggaagctgagaactaa

SEQ ID NO: 434 - protein, 362 aa, Arabidopsis thaliana; identical to SEQ ID NO: 2

SEQ ID NO: 435 - DNA, 1224 bp, Arabidopsis thaliana
atggttccgagcaacaatagatgcaaatggagttccattttcttgtttctgctcagtgtctccgttgccgtcttagtcgccgtcgctgacgacaagtctccggcggttgaggatggtttagtgatcaacggcgacttcgaaacatcaccgtcaagtggctttcctgacgacggagtaactgacggaccatccgatatcccaagctggaaatccaacggtacggtggagctaataaattccggtcaaaaacaaggcggaatgatcctcattgtcccacaaggccgtcacgccgtccgattagggaacgacgcagagatcagccaagatctaacggttgagaaaggttttgtctattcagtcacgttcagcgctgctcgcacgtgcgctcaactcgaatcgataaacgtgtcggtagcgtctgtgaacgcagacgcggacgatatgctggcgtcgcggaacgttgatttgcaaacgctttatagcgttcaagggtgggacccttatgcgtgggcgtttgaagcggaagatgatcatgtacggttggtttttaagaatccgggtatggaagatgatccgacttgtggaccaatcatcgatgacattgctattaagaagctctttactcctgataaacccaaagataatgcggtgattaatggagatttcgaagatggtccatggatgtttaggaacacgtctcttggtgttttacttccgacaaacctcgacgaagaaatctcgtctcttcctggttggactgttgaatcgaacagagcggttcggtttgttgactcggatcacttctctgttccaaagggcaaacgagccgtcgagctactctcaggcaaagaaggaattatttcacaaatggttgagaccaaagcagataagccgtacatattgtctttctcactaggccacgcaggtgataaatgcaaggaaccattggctattatggcattcgcaggtgatcaggcgcagaactttcattacatggcgcaagcgaactccagtttcgaaaaggccggtttgaatttcacggctaaggctgatcgaaccagagttgcgttctacagtgtttattacaatacgaggactgatgatatgagctccttgtgtggacctgtgatcgatgacgttagagtgtggttctccgggtcgaagagaatcggagctgggtttgggttttgggtttttgttcttctcgttgtcggtttggtttaa

SEQ ID NO: 436 - protein, 407 aa, Arabidopsis thaliana
MVPSNNRCKWSSIFLFLLSVSVAVLVAVADDKSPAVEDGLVINGDFETSPSSGFPDDGVTDGPSDIPSWKSNGTVELINSGQKQGGMILIVPQGRHAVRLGNDAEISQDLTVEKGFVYSVTFSAARTCAQLESINVSVASVNADADDMLASRNVDLQTLYSVQGWDPYAWAFEAEDDHVRLVFKNPGMEDDPTCGPIIDDIAIKKLFTPDKPKDNAVINGDFEDGPWMFRNTSLGVLLPTNLDEEISSLPGWTVESNRAVRFVDSDHFSVPKGKRAVELLSGKEGIISQMVETKADKPYILSFSLGHAGDKCKEPLAIMAFAGDQAQNFHYMAQANSSFEKAGLNFTAKADRTRVAFYSVYYNTRTDDMSSLCGPVIDDVRVWFSGSKRIGAGFGFWVFVLLVVGLV

SEQ ID NO: 437 - DNA, 1224 bp, Arabidopsis thaliana
atggttgcctcagccgccgcacgacctcttgtcaccgtccaaggacttgacggtgacatgagcaccgatcaatccaccaccgtcactttaccagacgtcatgactgctccagttcgacctgacattgtcaacttcgtccacgcccaaatctccaacaacagccgtcagccttacgcagtctccaaaaaggccggtcaccaaacctccgccgagtcctggggaaccggaagagccgtgtcacgtatccctcgtgttcctggtggtggaactcaccgtgccggtcaagcagcgttcggaaacatgtgtcgtggtggtcgtatgtttgctccgactaagatctggagacgctggcaccgtcgtgtcaatgtcaacatgaagaggcacgcgattgtttctgcaatcgctgctactgctgttccagctcttgtgatggctcgtggtcacaagatcgagaatgttcctgagatgcctcttgttgttagcgactcagctgaagctgtggagaagacatcagctgcgatcaaggtattgaagcagatcggtgcttacgacgatgcggagaaagctaagaacagtattggaattcgtcctggtaaaggtaaaatgaggaatcgtcgttacatttctaggaaaggtcctcttgttgtgtttggaactgaaggagccaagattgtgaaagcttttaggaatcttcctggtgttgagctttgtcacgttgagaggcttaacttgttgaaattagcccctggtggtcaccttggtaggtttgtgatttggactaagtctgcttttgagaagcttgaatctatctatggctcgtttgagaaaccatcagagaagaagaagggttacgtcttgcctcgtgcgaagatggtgaatgctgatcttgctaggattattaactccgatgaggtacagagtgtggtgaacccgattaaggatggttccaagagagcggttctgaagaagaatccattgaagaaccttaatgtgatgttcaagttgaatccttatgctaagaccgcaaagagaatgtctctgttggctgaagcttcaagggttaaggctaagaaggagaagctcgagaagaagaggaaagtcgtcactaaggaggaggcccaagcgatcaaagcagcaggcaaggcttggtatcagactatgatttcagacagtgactacaccgagttcgataacttcaccaagtggcttggcgctagtcagtaa

SEQ ID NO: 438 - protein, 407 aa, Arabidopsis thaliana
MVASAAARPLVTVQGLDGDMSTDQSTTVTLPDVMTAPVRPDIVNFVHAQISNNSRQPYAVSKKAGHQTSAESWGTGRAVSRIPRVPGGGTHRAGQAAFGNMCRGGRMFAPTKIWRRWHRRVNVNMKRHAIVSAIAATAVPALVMARGHKIENVPEMPLVVSDSAEAVEKTSAAIKVLKQIGAYDDAEKAKNSIGIRPGKGKMRNRRYISRKGPLVVFGTEGAKIVKAFRNLPGVELCHVERLNLLKLAPGGHLGRFVIWTKSAFEKLESIYGSFEKPSEKKKGYVLPRAKMVNADLARIINSDEVQSVVNPIKDGSKRAVLKKNPLKNLNVMFKLNPYAKTAKRMSLLAEASRVKAKKEKLEKKRKVVTKEEAQAIKAAGKAWYQTMISDSDYTEFDNFTKWLGASQ

SEQ ID NO: 439 - DNA, 2529 bp, Arabidopsis thaliana
atggagatggcggtggctaaccaccgtgagagaagcagtgacagtatgaatagacatttagatagtagcggtaagtacgttaggtacacagctgagcaagtcgaggctcttgagcgtgtctacgctgagtgtcctaagcctagctctctccgtcgacaacaattgatccgtgaatgttccattttggccaatattgagcctaagcagatcaaagtctggtttcagaaccgcaggtgtcgagataagcagaggaaagaggcgtcgaggctccagagcgtaaaccggaagctctctgcgatgaataaactgttgatggaggagaatgataggttgcagaagcaggtttctcagcttgtctgcgaaaatggatatatgaaacagcagctaactactgttgttaacgatccaagctgtgaatctgtggtcacaactcctcagcattcgcttagagatgcgaatagtcctgctggattgctctcaatcgcagaggagactttggcagagttcctatccaaggctacaggaactgctgttgattgggttcagatgcctgggatgaagcctggtccggattcggttggcatctttgccatttcgcaaagatgcaatggagtggcagctcgagcctgtggtcttgttagcttagaacctatgaagattgcagagatcctcaaagatcggccatcttggttccgtgactgtaggagccttgaagttttcactatgttcccggctggtaatggtggcacaatcgagcttgtttatatgcagacgtatgcaccaacgactctggctcctgcccgcgatttctggaccctgagatacacaacgagcctcgacaatgggagttttgtggtttgtgagaggtcgctatctggctctggagctgggcctaatgctgcttcagcttctcagtttgtgagagcagaaatgctttctagtgggtatttaataaggccttgtgatggtggtggttctattattcacattgtcgatcaccttaatcttgaggcttggagtgttccggatgtgcttcgacccctttatgagtcatccaaagtcgttgcacaaaaaatgaccatttccgcgttgcggtatatcaggcaattagcccaagagtctaatggtgaagtagtgtatggattaggaaggcagcctgctgttcttagaacctttagccaaagattaagcaggggcttcaatgatgcggttaatgggtttggtgacgacgggtggtctacgatgcattgtgatggagcggaagatattatcgttgctattaactctacaaagcatttgaataatatttctaattctctttcgttccttggaggcgtgctctgtgccaaggcttcaatgcttctccaaaatgttcctcctgcggttttgatccggttccttagagagcatcgatctgagtgggctgatttcaatgttgatgcatattccgctgctacacttaaagctggtagctttgcttatccgggaatgagaccaacaagattcactgggagtcagatcataatgccactaggacatacaattgaacacgaagaaatgctagaagttgttagactggaaggtcattctcttgctcaagaagatgcatttatgtcacgggatgtccatctccttcagatttgtaccgggattgacgagaatgccgttggagcttgttctgaactgatatttgctccgattaatgagatgttcccggatgatgctccacttgttccctctggattccgagtcatacccgttgatgctaaaacgggagatgtacaagatctgttaaccgctaatcaccgtacactagacttaacttctagccttgaagtcggtccatcacctgagaatgcttctggaaactctttttctagctcaagctcgagatgtattctcactatcgcgtttcaattcccttttgaaaacaacttgcaagaaaatgttgctggtatggcttgtcagtatgtgaggagcgtgatctcatcagttcaacgtgttgcaatggcgatctcaccgtctgggataagcccgagtctgggctccaaattgtccccaggatctcctgaagctgttactcttgctcagtggatctctcaaagttacagtcatcacttaggctcggagttgctgacgattgattcacttggaagcgacgactcggtactaaaacttctatgggatcaccaagatgccatcctgtgttgctcattaaagccacagccagtgttcatgtttgcgaaccaagctggtctagacatgctagagacaacacttgtagccttacaagatataacactcgaaaagatattcgatgaatcgggtcgtaaggctatctgttcggacttcgccaagctaatgcaacagggatttgcttgcttgccttcaggaatctgtgtgtcaacgatgggaagacatgtgagttatgaacaagctgttgcttggaaagtgtttgctgcatctgaagaaaacaacaacaatctgcattgtcttgccttctcctttgtaaactggtcttttgtgtga

SEQ ID NO: 440 - protein, 842 aa, Arabidopsis thaliana
MEMAVANHRERSSDSMNRHLDSSGKYVRYTAEQVEALERVYAECPKPSSLRRQQLIRECSILANIEPKQIKVWFQNRRCRDKQRKEASRLQSVNRKLSAMNKLLMEENDRLQKQVSQLVCENGYMKQQLTTVVNDPSCESVVTTPQHSLRDANSPAGLLSIAEETLAEFLSKATGTAVDWVQMPGMKPGPDSVGIFAISQRCNGVAARACGLVSLEPMKIAEILKDRPSWFRDCRSLEVFTMFPAGNGGTIELVYMQTYAPTTLAPARDFWTLRYTTSLDNGSFVVCERSLSGSGAGPNAASASQFVRAEMLSSGYLIRPCDGGGSIIHIVDHLNLEAWSVPDVLRPLYESSKVVAQKMTISALRYIRQLAQESNGEVVYGLGRQPAVLRTFSQRLSRGFNDAVNGFGDDGWSTMHCDGAEDIIVAINSTKHLNNISNSLSFLGGVLCAKASMLLQNVPPAVLIRFLREHRSEWADFNVDAYSAATLKAGSFAYPGMRPTRFTGSQIIMPLGHTIEHEEMLEVVRLEGHSLAQEDAFMSRDVHLLQICTGIDENAVGACSELIFAPINEMFPDDAPLVPSGFRVIPVDAKTGDVQDLLTANHRTLDLTSSLEVGPSPENASGNSFSSSSSRCILTIAFQFPFENNLQENVAGMACQYVRSVISSVQRVAMAISPSGISPSLGSKLSPGSPEAVTLAQWISQSYSHHLGSELLTIDSLGSDDSVLKLLWDHQDAILCCSLKPQPVFMFANQAGLDMLETTLVALQDITLEKIFDESGRKAICSDFAKLMQQGFACLPSGICVSTMGRHVSYEQAVAWKVFAASEENNNNLHCLAFSFVNWSFV

SEQ ID NO: 441 - DNA, 588 bp, Arabidopsis thaliana
atggcgtcaaggtttataaagtgtgtgaccgtcggagatggtgccgtcggaaaaacttgcatgctcatttcttacactagcaatacttttcctactgattatgtgccaactgttttcgacaacttcagtgctaatgtggttgttgatggcaacactgtcaatcttggattgtgggatactgctggtcaagaggactacaacaggttacgacctttgagttaccgtggtgctgatgttttcattcttgctttctctcttattagcaaggctagctatgagaatatagccaagaagtggattcctgagctcaggcattatgctcctggtgttcccattatccttgttgggacaaaactcgatcttcgagatgacaagcaattctttatagatcatcctggtgctgtgccaattactacaaaccagggagaggaactgaagaaactgattggatctgctgtctacattgaatgtagttcaaagacacagcagaacgtgaaggcagtgtttgatgcagctataaaagtggtgcttcagccaccaaagcagaagaagaagaaaaagaataagaaccgttgcgcgttcttgtga

SEQ ID NO: 442 - protein, 195 aa, Arabidopsis thaliana
MASRFIKCVTVGDGAVGKTCMLISYTSNTFPTDYVPTVFDNFSANVVVDGNTVNLGLWDTAGQEDYNRLRPLSYRGADVFILAFSLISKASYENIAKKWIPELRHYAPGVPIILVGTKLDLRDDKQFFIDHPGAVPITTNQGEELKKLIGSAVYIECSSKTQQNVKAVFDAAIKVVLQPPKQKKKKKNKNRCAFL

SEQ ID NO: 443 - DNA, 822 bp, Arabidopsis thaliana
atgtccctgtgtcttaaaatacctcttatcaaacaccaaaccacaccagaacagaactcagccatggcttcttcttcttcttctcttctaatcctagccgttgcttgtttcgtctcgctaatctcaccggcgatttcacaacaggcttgcaaatcacagaacttgaactccgccggtccgttcgatagttgcgaagaccttccggtactcaattcctacctccattacacctacaattcctcaaattcatctctctccgtcgctttcgtcgccactccatctcaagccaacggtggctgggtcgcttgggctattaaccctacggggactaagatggctggttctcaagccttcctcgcttacagatccggcggtggtgcggctccggtcgtgaagacgtacaacattagcagctacagcagtctcgtcgaaggtaaacttgcttttgatttttggaatctacgcgccgagtcgttaagcggcggtaggatcgccattttcacgacggttaaggttccggcgggagctgatagtgtgaatcaggtatggcagatcggcggcaatgttaccaacggtcgtcccggtgtacatcctttcggtcctgataatttgggctcccaccgtgtgttgagtttcacagaagatgcagcaccgggctctgctccttcgccgggatctgctccggcgccgggcaccagtggctcgactaccccaggaacagcggcgggaggtccagggaacgcggggtcattgacgaggaacgtaaattttggggtcaatttgggaattttggttttgttgggttctatttttattttctga

SEQ ID NO: 444 - protein, 273 aa, Arabidopsis thaliana
MSLCLKIPLIKHQTTPEQNSAMASSSSSLLILAVACFVSLISPAISQQACKSQNLNSAGPFDSCEDLPVLNSYLHYTYNSSNSSLSVAFVATPSQANGGWVAWAINPTGTKMAGSQAFLAYRSGGGAAPVVKTYNISSYSSLVEGKLAFDFWNLRAESLSGGRIAIFTTVKVPAGADSVNQVWQIGGNVTNGRPGVHPFGPDNLGSHRVLSFTEDAAPGSAPSPGSAPAPGTSGSTTPGTAAGGPGNAGSLTRNVNFGVNLGILVLLGSIFIF

SEQ ID NO: 445 - DNA, 411 bp, Arabidopsis thaliana
atggagaacactcaagatttctcgccaccacacatggatgcttctcggccgtcactaggattccctcttggcacagctctgcttcttatcatcattttcagcctctccggaatattctcttgttgttaccattgggacaaacatcgttctctccgccgctctttggccaatggtcgtccctccgccgacatcgagtctaatccttacaaacccaaacccccttttccggaaatgaagaaaccgcagaatctgagcgtaccggtgttaatgccaggagataatacacccaaattcatagcattgccgtgtccgtgtgcaccacctcgacctgaaaaactcaccgtagatgtccaaactccgccgcaatcaccgcctgttaagccggcgcgttttcctgttcctttgtattag

SEQ ID NO: 446 - protein, 136 aa, Arabidopsis thaliana
MENTQDFSPPHMDASRPSLGFPLGTALLLIIIFSLSGIFSCCYHWDKHRSLRRSLANGRPSADIESNPYKPKPPFPEMKKPQNLSVPVLMPGDNTPKFIALPCPCAPPRPEKLTVDVQTPPQSPPVKPARFPVPLY

SEQ ID NO: 447 - DNA, 1569 bp, Arabidopsis thaliana
atggacagccagcaattagcacttgactgtattgtggcaacgctttttgatggatcaaatgagtttgctggtggaagttctgaagttcattatgcattacgtggaatatttgagggattgcttcagcagcttctctctttgaaatggaatgaaccagaacttatgaaagtgcatgtccactatctggatgcaatgggtccctttctcaagtattttccagatgcagttggaagtctcatcaataaattatttgagcttctcacctctcttccacacgttgtgaaggatccagctactagtacatctagagctgcaagattgcagatttgcacatctttcataagaatagccaaagctgcagaaaaaagtgttctgcctcacatgaagggtattgctgatacaatggggtacttggcaaaagaaggaactttactccgtggggagcataacattctgggtgaagcatttcttgttatggcttcctcagcaggagctcaacagcagcaagaagttctggcttggttattggaaccattgagtcaacagtggatccaaccagagtggcagaacaattatctatcagacccgatgggtcttctactccgtgttcttcattccctttggtctccctctgtatttcaaacattacccccagaaatgagggcggcaatgacaatgactgatgctgagcgatacagtctccttggtgaagcaaatcctaaattgtcaaaaggcgtatcggtttatgctgatgggtcattcgaaggaactaaggaaggacaagccgaggcaagtgaatctgatatacgaaattggttgaaaggtatccgagattgtggatacaacgtgttgggcctatcaacaaccatcggagagacattctttaaatgcttagatgctaactatgttgcaatggcactcatggaaaatttgcagtcgatggaattcaggcacattcggctgtttattcatacctttataacttatatagtcaaatcttgtccggcggatatgtgggagtcatggctgggagtgcttctgcacccattgtttatacactgtcagcaagctctcagctccgcctggccaggtcttctacaagagggcagagcaaaggttccggacttgtttggcatacaaagtggatcagacatgaaacttgaagtgatggaggaaaaactgttaagagatctaactcgggagattgcgactctcttttcaacaatggcttctcctggactaaacacaggagttccagttttggaacattcaggacatgttggtcgtgtggacatgtccactctcacggatttgcatgcgttcagatccaactctatggttttgctttcgctcccgtgtctcactcccaacgacttgcatgcttttgaagaagctacagccaaaactagcagccccaaagaacaaaagcagcttatgaggagcttgttgttgctaggtactgggaacaacttaaaagcacttgctgctcaaaaaagtcagaatgttatcaccaatgtcacaggtaacaaagtttcacttcacgctcacgatatctctgtttttttttaa

SEQ ID NO: 448 - protein, 522 aa, Arabidopsis thaliana
MDSQQLALDCIVATLFDGSNEFAGGSSEVHYALRGIFEGLLQQLLSLKWNEPELMKVHVHYLDAMGPFLKYFPDAVGSLINKLFELLTSLPHVVKDPATSTSRAARLQICTSFIRIAKAAEKSVLPHMKGIADTMGYLAKEGTLLRGEHNILGEAFLVMASSAGAQQQQEVLAWLLEPLSQQWIQPEWQNNYLSDPMGLLLRVLHSLWSPSVFQTLPPEMRAAMTMTDAERYSLLGEANPKLSKGVSVYADGSFEGTKEGQAEASESDIRNWLKGIRDCGYNVLGLSTTIGETFFKCLDANYVAMALMENLQSMEFRHIRLFIHTFITYIVKSCPADMWESWLGVLLHPLFIHCQQALSSAWPGLLQEGRAKVPDLFGIQSGSDMKLEVMEEKLLRDLTREIATLFSTMASPGLNTGVPVLEHSGHVGRVDMSTLTDLHAFRSNSMVLLSLPCLTPNDLHAFEEATAKTSSPKEQKQLMRSLLLLGTGNNLKALAAQKSQNVITNVTGNKVSLHAHDISVFF

SEQ ID NO: 449 - DNA, 2853 bp, Arabidopsis thaliana
atgactccagtattatgccattccactgcttcaatccctaaccctaactctctcatgtctctctcctccactctccgtctctcttcctcccttcttcgccgctccttcttccgattccccctcaccgacccattatgccgtctccgccgcactgaaccctccgccacgcgtttcttctcctcccgtactcctcggtccggcaaattcgttgtcggtgctggtaagcgcggagatgagcaggtcaaggaagagtccggagctaacaatggcggtttggttgtttctggggacgaatctcgtattgtgccttttgagctacataaggaagctactgagtcgtatatgtcgtatgcgctctctgttttgcttggacgtgctttgcctgatgttagagacggactaaaaccagtacatcggagaattctctttgcaatgcatgagttggggatgtcatctaaaaaaccatacaagaaatgtgcaagagttgttggagaggttcttggtaaattccatccgcatggagatactgctgtttatgattctcttgttaggatggctcagagtttctccttgagatgtccacttatccaaggccatggaaattttggctcaatagatgcagatcctcctgctgctatgcgttacactgaatgcagactcgatccactggcagaggcagtactattgtctgatctggatcaagatacggtggattttgtggccaattttgataactcacaaaaagaaccagcagtgttgcctgctcgtcttcctgctttgttgttgaatggagcttctgggattgcggttggcatggcaacaaatattccccctcataatcttggggagttggtagacgtgctttgcgctttaatccataatccagaagcaacgctgcaagaactgctggaatacatgcctgcaccggattttccaactggaggaataataatgggaaaccttggggttttggatgcttaccgaactggccgagggcgagttgtagttagaggaaaagctgaagttgaattgttggatccaaagacaaagcggaatgcagttattatcacagagattccttaccagacaaacaaagctacacttgtccagaagattgccgaacttgttgaaaataagacgctagagggcataagtgacatacgtgacgagagtgatcgtaatgggatgcgtgtggttattgagctcaaaagaggaggggatcctgcacttgtgcttaataatctttaccggcatactgcccttcaatcaagcttcagctgcaacatggtgggtatctgcgatggagaacccaagctaatgggattaaaagaactacttcaggcatttatagatttcaggtgttctgtcgtcgaaaggcgtgcaagattcaagctttcacatgcacaacaacgaaagcatattattgagggtattgtggttgggcttgacaatgtggacgaagtaatcgaactcatcacgaaggcctcaagtcattcctctgctactgctgctttacaaagtgaatatggtctttctgagaaacaagctgaggctatactggagataactcttcgaaggctaactgctcttgagcggaaaaagtttactgatgaaagtagttcactaacagagcaaattacaaagttggagcagctattatcaacccgaacaaacatcctaaagttaatcgaacaagaagcaatagagctgaaggacagattctcaagtcccaggcgttcaatgttggaggattctgacagtggtgatctagaagatatagatgttattccaaatgaagagatgctgatggcagtcagcgaaaagggctatgtgaagagaatgaaggccgatacattcaatcttcagcatcgtggaacaattggcaaatctgttgggaaactaagagttgatgatgcaatgtctgactttcttgtttgtcatgcacatgaccatgtcctctttttcagtgaccggggtatagtttactcaacccgtgcatataaaattccagaatgctctcgcaatgcagctggtacacctttggttcagatattatccatgtcggaaggtgaaagagtaacctccattgttcctgttagcgagtttgctgaagatcgctacctcctgatgcttacagtgaatggctgcatcaagaaagtatctttgaaattattttcaggaatacgctcaactggaatcatagcaattcagttgaattctggtgatgaactgaaatgggttcgttgttgctcaagcgacgatcttgtagccatggcatcccaaaatggaatggtcgccttgagtacatgtgatggtgttcgcacactgagcagaaatacaaagggagtgactgccatgagactcaagaatgaggataagatagcgagcatggacatcatacctgcatctctgcggaaagatatggaagagaagtcggaagatgcttcacttgtgaaacaatccacgggtccatggctattattcgtgtgtgagaatggctatggaaagcgtgttcctctgagtagcttccggcgttcgcgtctgaacagagttggtttatctggatacaagtttgctgaggatgatcgtttggctgctgttttcgttgttggttactccttggctgaggatggggagagtgatgagcaagtagttctggtgagccaaagcggaactgtgaaccggatcaaagtcagggatatctcaatccaatctcgcagagcacggggagtgattcttatgcggctagatcatgccggcaaaatccaatctgcatctctgatctctgcagcagatgaagaagaaacagaaggaactctaagtaatgaagccgtagaagccgttagcctgtaa

SEQ ID NO: 450 - protein, 950 aa, Arabidopsis thaliana
MTPVLCHSTASIPNPNSLMSLSSTLRLSSSLLRRSFFRFPLTDPLCRLRRTEPSATRFFSSRTPRSGKFVVGAGKRGDEQVKEESGANNGGLVVSGDESRIVPFELHKEATESYMSYALSVLLGRALPDVRDGLKPVHRRILFAMHELGMSSKKPYKKCARVVGEVLGKFHPHGDTAVYDSLVRMAQSFSLRCPLIQGHGNFGSIDADPPAAMRYTECRLDPLAEAVLLSDLDQDTVDFVANFDNSQKEPAVLPARLPALLLNGASGIAVGMATNIPPHNLGELVDVLCALIHNPEATLQELLEYMPAPDFPTGGIIMGNLGVLDAYRTGRGRVVVRGKAEVELLDPKTKRNAVIITEIPYQTNKATLVQKIAELVENKTLEGISDIRDESDRNGMRVVIELKRGGDPALVLNNLYRHTALQSSFSCNMVGICDGEPKLMGLKELLQAFIDFRCSVVERRARFKLSHAQQRKHIIEGIVVGLDNVDEVIELITKASSHSSATAALQSEYGLSEKQAEAILEITLRRLTALERKKFTDESSSLTEQITKLEQLLSTRTNILKLIEQEAIELKDRFSSPRRSMLEDSDSGDLEDIDVIPNEEMLMAVSEKGYVKRMKADTFNLQHRGTIGKSVGKLRVDDAMSDFLVCHAHDHVLFFSDRGIVYSTRAYKIPECSRNAAGTPLVQILSMSEGERVTSIVPVSEFAEDRYLLMLTVNGCIKKVSLKLFSGIRSTGIIAIQLNSGDELKWVRCCSSDDLVAMASQNGMVALSTCDGVRTLSRNTKGVTAMRLKNEDKIASMDIIPASLRKDMEEKSEDASLVKQSTGPWLLFVCENGYGKRVPLSSFRRSRLNRVGLSGYKFAEDDRLAAVFVVGYSLAEDGESDEQVVLVSQSGTVNRIKVRDISIQSRRARGVILMRLDHAGKIQSASLISAADEEETEGTLSNEAVEAVSL

SEQ ID NO: 451 - DNA, 2553 bp, Arabidopsis thaliana
atggcgatgataagcttttcgtttccatctcccgccaaacttccgattaaatctcaaccgtccgtttcaaatcggatcaacgtcgccgaccgtttgattctccgtcatctcaatgccggagatcttcgtggagcggtttcagctcttgatctcatggctcgtgatgggattcgtcctatggactcagtcactttctcttcacttctcaaatcttgtatccgagcacgcgattttcgtctcgggaaactcgtacacgctcgattaatcgagtttgatatcgagcctgattcggttctctacaattcgttgattagcttgtattcgaaatctggagattcggcgaaagctgaagatgtgtttgagactatgagaagatttggtaagcgagatgttgtttcgtggagtgcgatgatggcttgttacggtaacaacggaagagaattagatgcaattaaggtttttgttgagtttctggagttaggtttggtgcctaatgattattgttacacggcggtgatacgagcttgttcgaattcggattttgttggagttgggagagtgactttagggtttttgatgaagactgggcattttgaatctgatgtgtgtgtgggttgttctttgattgacatgtttgtgaaaggagagaatagctttgagaatgcgtataaggtgtttgataaaatgtctgaactaaatgttgttacttggactttgatgattactcggtgtatgcagatggggtttcctagggaagcgattaggtttttcttggatatggttttaagtggatttgaatcagataagttcacactaagctctgtgttttcggcttgtgctgagttggagaacttgtctttgggaaagcagttgcattcttgggctattagatcagggcttgtggatgatgttgaatgtagtttagttgatatgtatgcgaaatgttctgcggatggttcggtagatgattgcaggaaggtgtttgatagaatggaggatcatagtgttatgtcgtggacggcattgatcactggttatatgaaaaactgtaatctcgctacagaggctattaatctctttagtgaaatgataacgcaaggtcatgttgagccaaatcatttcactttctcgagtgcattcaaggcgtgtggaaatctttcggatccacgggtaggtaaacaggttcttggtcaagctttcaaaagagggcttgcttcgaatagcagtgttgcaaactcggttatcagcatgtttgttaaatctgacaggatggaagatgctcagagagcttttgagtcactttctgagaagaacttggtttcgtataatacatttcttgacggaacatgcaggaacttgaattttgagcaagcatttaagcttttaagtgagatcactgagagagaattaggtgttagcgctttcacatttgctagcttgttgagtggagttgcaaatgttggttcaataagaaaaggcgagcaaatccattctcaggtggttaaactcgggctctcgtgcaatcaacccgtctgcaatgctttgatctctatgtattccaaatgtggaagcattgacacagcttcccgagtcttcaattttatggaaaatcgtaatgtcatctcgtggacttcaatgatcacaggtttcgctaaacacggattcgctataagggtactcgaaacattcaaccaaatgatagaagaaggggtgaagccaaatgaggtcacttatgttgcaatcttatcggcatgcagccatgttggtttggtctccgaaggatggagacatttcaattcaatgtatgaagaccacaagatcaaacctaagatggaacactatgcttgtatggttgatcttctatgtcgagccgggcttctcacagacgcatttgagttcattaacacaatgcccttccaagccgatgttttagtatggcgtacgtttcttggagcttgcagagttcacagtaacacagaactcggaaagttggctgcgaggaagatcttagaacttgatccgaatgagcctgcagcttatatacagctctcaaacatatacgcttgtgcagggaaatgggaagaatctacggagatgaggaggaagatgaaagagagaaacttggttaaagaaggaggttgcagttggatagaagtgggagataaaattcataagttctacgtaggtgatacagctcacccgaatgctcaccaaatatatgatgaattggatcggttaattacagaaataaaacgctgcggatatgttcctgatacggatcttgttcttcacaagctagaggaggagaatgatgaggcggagaaggagaggttactatatcagcacagcgagaaaattgcggttgcgtttgggcttataagcacgtcgaaatctagaccggttagggtgttcaagaacttacgggtctgcggagattgccataacgcgatgaaatatatatcgacagtctctggtagagagattgtgttgagggatttgaatcgttttcatcattttaaagatgggaaatgttcttgtaatgattattggtga

SEQ ID NO: 452 - protein, 850 aa, Arabidopsis thaliana
MAMISFSFPSPAKLPIKSQPSVSNRINVADRLILRHLNAGDLRGAVSALDLMARDGIRPMDSVTFSSLLKSCIRARDFRLGKLVHARLIEFDIEPDSVLYNSLISLYSKSGDSAKAEDVFETMRRFGKRDVVSWSAMMACYGNNGRELDAIKVFVEFLELGLVPNDYCYTAVIRACSNSDFVGVGRVTLGFLMKTGHFESDVCVGCSLIDMFVKGENSFENAYKVFDKMSELNVVTWTLMITRCMQMGFPREAIRFFLDMVLSGFESDKFTLSSVFSACAELENLSLGKQLHSWAIRSGLVDDVECSLVDMYAKCSADGSVDDCRKVFDRMEDHSVMSWTALITGYMKNCNLATEAINLFSEMITQGHVEPNHFTFSSAFKACGNLSDPRVGKQVLGQAFKRGLASNSSVANSVISMFVKSDRMEDAQRAFESLSEKNLVSYNTFLDGTCRNLNFEQAFKLLSEITERELGVSAFTFASLLSGVANVGSIRKGEQIHSQVVKLGLSCNQPVCNALISMYSKCGSIDTASRVFNFMENRNVISWTSMITGFAKHGFAIRVLETFNQMIEEGVKPNEVTYVAILSACSHVGLVSEGWRHFNSMYEDHKIKPKMEHYACMVDLLCRAGLLTDAFEFINTMPFQADVLVWRTFLGACRVHSNTELGKLAARKILELDPNEPAAYIQLSNIYACAGKWEESTEMRRKMKERNLVKEGGCSWIEVGDKIHKFYVGDTAHPNAHQIYDELDRLITEIKRCGYVPDTDLVLHKLEEENDEAEKERLLYQHSEKIAVAFGLISTSKSRPVRVFKNLRVCGDCHNAMKYISTVSGREIVLRDLNRFHHFKDGKCSCNDYW

SEQ ID NO: 453 - DNA, 666 bp, Arabidopsis thaliana
atggaggttttggataggagagacgatgagatcagggactcgggaaacatggacagcatcaagtcacactatgttaccgactctgtttccgaggaacgccgctctcgtgagctcaaggatggagaccatcctttacggtacaagttttcgatatggtacactcgtcgcacaccaggggttcggaaccagtcttatgaagataacatcaagaagatggtagaattcagcacggttgaaggattttgggcctgctactgtcaccttgctcgttcttctctcttgcctagtccaacagatcttcatttctttaaggatgggattcgtccattgtgggaggatggtgccaactgcaatggaggaaagtggatcatacgtttctcaaaagttgtatctgctcgcttctgggaggatctgcttcttgcgttggtaggcgaccagcttgatgatgctgataacatatgtggggcagtactgagtgtccgtttcaacgaggacatcattagtgtatggaatcgcaatgcttctgaccatcaggcagtgatgggtttgagagactcaatcaagcggcatttgaagttgcctcatgcatatgtcatggaatacaagccacacgatgcttctctccgcgacaactcttcctacagaaacacatggctgagaggatag

SEQ ID NO: 454 - protein, 221 aa, Arabidopsis thaliana
MEVLDRRDDEIRDSGNMDSIKSHYVTDSVSEERRSRELKDGDHPLRYKFSIWYTRRTPGVRNQSYEDNIKKMVEFSTVEGFWACYCHLARSSLLPSPTDLHFFKDGIRPLWEDGANCNGGKWIIRFSKVVSARFWEDLLLALVGDQLDDADNICGAVLSVRFNEDIISVWNRNASDHQAVMGLRDSIKRHLKLPHAYVMEYKPHDASLRDNSSYRNTWLRG

SEQ ID NO: 455 - DNA, 1668 bp, Arabidopsis thaliana
atggtcggcgaagaagatagcgagagagctcagtccagtaagatggagatcgagcgagaatcgaatttgggatctgcgagtgtgctgatgcagtcgaaggtcatctccgtctcgaatttcttctctattcatagatttcattaccctcgtgaaaaaatcgtctcttttttgtttcctagtgtgttctcaaggataatggcttcgtatggcgaggagcgtgaaatccaaaagaattactggaaagagcattcagtgggattgagtgttgaagctatgatgcttgattccaaagcttctgacctcgacaaagaagaacgtcctgagatacttgcgtttcttccacctattgaagggacaacagtgctagagtttggtgctggaattggtcgttttactactgaattagctcagaaggccggccaggtcattgcggttgacttcattgaaagtgttatcaaaaagaatgagaacattaacggtcactacaagaacgtcaaatttctgtgcgctgatgtcacatcaccaaatatgaactttccaaatgagtctatggatctgatattctccaactggctgctaatgtatctctctgatcaagaggttgaagatttggcgaaaaagatgttacaatggacaaaggttggcgggtatattttctttcgggagtcttgtttccatcagtctggtgataacaagcggaagtacaacccaacacactaccgtgaacctaaattttacacaaagcttttcaaagaatgccatatgaatgacgaagatgggaattcgtatgaactctctttggttagctgtaaatgcattggagcttatgtgagaaacaaaaagaaccagaaccagatatgctggctttggcagaaagtcagttcggataatgataggggcttccaacgcttcttggacaatgtccagtataagtctagtggtatcttacgctatgagcgtgtctttggagaagggtttgttagcacagggggactcgagacaacaaaggaattcgtggatatgctggatctgaaacctggccaaaaagttctagacgttgggtgcggaataggaggaggggacttctacatggctgagaactttgacgtggatgttgtgggcattgatctatctgtaaacatgatctcttttgcgcttgaacacgcaataggactcaaatgctctgtagaattcgaagtagctgattgcaccaagaaggagtatcctgataacacctttgatgttatttatagcagagacaccattctacatatccaagacaagccagcattgttcagaagattctacaaatggttgaagccgggagggaaagttctcatcactgattactgcagaagccccaaaaccccatctccagactttgcaatctacatcaagaaacgaggttatgatcttcatgatgtacaagcatacggtcagatgctgagagatgctggtttcgaggaggtaatcgcggaggatagaaccgatcagttcatgaaagtcctgaaacgggaactggatgcagtggagaaggagaaggaagaattcatcagtgacttctcgaaagaggattacgaggatattataggcgggtggaagtcaaagctacttaggagctcaagtggtgagcagaagtggggtttgttcatcgccaagagaaactga

SEQ ID NO: 456 - protein, 555 aa, Arabidopsis thaliana
MVGEEDSERAQSSKMEIERESNLGSASVLMQSKVISVSNFFSIHRFHYPREKIVSFLFPSVFSRIMASYGEEREIQKNYWKEHSVGLSVEAMMLDSKASDLDKEERPEILAFLPPIEGTTVLEFGAGIGRFTTELAQKAGQVIAVDFIESVIKKNENINGHYKNVKFLCADVTSPNMNFPNESMDLIFSNWLLMYLSDQEVEDLAKKMLQWTKVGGYIFFRESCFHQSGDNKRKYNPTHYREPKFYTKLFKECHMNDEDGNSYELSLVSCKCIGAYVRNKKNQNQICWLWQKVSSDNDRGFQRFLDNVQYKSSGILRYERVFGEGFVSTGGLETTKEFVDMLDLKPGQKVLDVGCGIGGGDFYMAENFDVDVVGIDLSVNMISFALEHAIGLKCSVEFEVADCTKKEYPDNTFDVIYSRDTILHIQDKPALFRRFYKWLKPGGKVLITDYCRSPKTPSPDFAIYIKKRGYDLHDVQAYGQMLRDAGFEEVIAEDRTDQFMKVLKRELDAVEKEKEEFISDFSKEDYEDIIGGWKSKLLRSSSGEQKWGLFIAKRN

SEQ ID NO: 457 - DNA, 1143 bp, Arabidopsis thaliana
atggaggagatagaaggaacaaacagagcagctgttgagagttgtcatagagttcttaatcttttacatagatcacagcaacaagatcatgttggttttgaaaagaatttagtatctgaaactagagaagctgtgattaggttcaagagagttgggagtttgttaagcagtagtgttggtcatgctaggtttagaagagctaagaaacttcagagtcatgtctctcaaagtctcttacttgatccatgtcaacaaaggacaacagaagttccatcatcatcttctcagaaaacaccggtactccggtctggtttccaggaattgagcttgagacaaccttcagattcactcactttagggactcgctcttttagtttaaactcaaatgctaaagctcctctccttcagcttaatcagcagacaatgcctccttcgaattatcctactttgtttccagtacaacaacaacaacaacaacaacaacaacaacaacagcaggagcagcagcagcagcagcagcagcaacagcaacagtttcatgaacggttacaagctcaccatcttcatcagcaacagcagctacagaaacatcaagctgagcttatgcttaggaaatgcaatggtgggataagtttgagtttcgataactctagttgtactccaactatgtcatccactaggtcctttgtttcttcacttagcatagatggtagtgttgctaatatagagggaaagaactccttccattttggggttcctagttcaactgatcagaattcactacattctaagaggaaatgccccttgaaaggagatgaacatggaagcttaaaatgcgggagctctagccgatgccactgcgctaagaagaggaaacatcgggttaggagatcgattagagtaccggctataagtaacaaggttgcagatatccctcctgatgattattcatggcgaaaatatggtcagaagcccatcaagggctctccttatcccagaggatattacaaatgtagtagcatgagaggttgtccagcgaggaagcatgttgagagatgtttggaagatccggcaatgcttattgttacttatgaagcagagcataaccacccgaaattgccatctcaagctataacaacttaa

SEQ ID NO: 458 - protein, 380 aa, Arabidopsis thaliana; identical to SEQ ID NO: 16

SEQ ID NO: 459 - DNA, 666 bp, Arabidopsis thaliana
atggctctacctaaccagcaaaccgtagattatcccagcttcaagcttgtcattgttggtgatggaggcacagggaagactacttttgttaagagacatcttactggggagtttgagaagaagtatgaacctactattggtgtggaggttcatccattagatttcttcacaaactgtggcaagatccgtttttactgctgggacactgctggacaagagaaatttggtggccttagggatggatactacatccatggtcaatgtgctataataatgtttgacgtcacagcacggctcacatacaagaatgttccgacatggcaccgtgatctctgcagggtgtgtgaaaacatcccgattgttctgtgtgggaacaaagttgatgtgaagaacaggcaagtgaaggcaaagcaggttacattccacaggaagaagaatctgcagtactatgagatatcagcaaagagcaactacaactttgagaagcctttcttgtaccttgctagaaaactggctggagaccaaaaccttcactttgtggagacaccagcgcttgctccaccagaggttcacattgacattgctgatcagcagaagaacgaggccgagctcttacaggctgcagctcaacccctccccgatgacgatgatgatatctttgagtaa

SEQ ID NO: 460 - protein, 221 aa, Arabidopsis thaliana
MALPNQQTVDYPSFKLVIVGDGGTGKTTFVKRHLTGEFEKKYEPTIGVEVHPLDFFTNCGKIRFYCWDTAGQEKFGGLRDGYYIHGQCAIIMFDVTARLTYKNVPTWHRDLCRVCENIPIVLCGNKVDVKNRQVKAKQVTFHRKKNLQYYEISAKSNYNFEKPFLYLARKLAGDQNLHFVETPALAPPEVHIDIADQQKNEAELLQAAAQPLPDDDDDIFE

SEQ ID NO: 461 - DNA, 1053 bp, Arabidopsis thaliana
atggctcttcggctaccagcttctaaagcagctgaagttgcgattggatctattggctgtggttatgatctagctattgatttacggttgaagtattgcaaaggaggttccaaagattctagattacttgacattaaagaaggtgatgataattgtgagattgttttacctggtggaatctccattcctaatgtttccaagtctatcaaatgcgataaaggggagcgtatgcggtttaggtccgatattcttcctttccaacagatggcagagcagttcaaccaggaactatctttggctgggaaaatcccgtcaggtctcttcaatgccatgtttgaattctcgagctgttggcagaaagacgcagcctacaccaaaaaccttgcttttgatggggttttcatctcattatactcggtggctttggacaaatctcaagtgttactccgtgagcatgttaagcaggctgttccatcaacatgggaccctgctgcattggcaaggtttatagatatttatgggacgcatataattgttagtgttaagatgggaggaaaagatgtgatttatgcaaaacaacaacactcctcaaaacttcagcctgaggatctgcagaaaaggttaaaagaggtggcagataagaggttcgtggaagctagcgtagtgcataatacgggttcagaaagagtacaagcaagtagtaaggtggaaacaaaggagcaacgcctgagatttgcagataccagttctttgggctcttatgcaaataaggaggactatgtcttcatgtgcaagaggcgaggtggaaacgataacagaaatctaatgcataatgaatggctgcaaacagttcagatggagcctgatgttatctccatgtcttttattccaattacgtctttgcttaatggagttccaggaagtggattcttaagccatgccataaatctgtatctaagatgtaagcctataaatcatttgcgctttgtgcatttctttctggagttattcttcatactagtggtttcttttacctttagattagaagtttga

SEQ ID NO: 462 - protein, 350 aa, Arabidopsis thaliana
MALRLPASKAAEVAIGSIGCGYDLAIDLRLKYCKGGSKDSRLLDIKEGDDNCEIVLPGGISIPNVSKSIKCDKGERMRFRSDILPFQQMAEQFNQELSLAGKIPSGLFNAMFEFSSCWQKDAAYTKNLAFDGVFISLYSVALDKSQVLLREHVKQAVPSTWDPAALARFIDIYGTHIIVSVKMGGKDVIYAKQQHSSKLQPEDLQKRLKEVADKRFVEASVVHNTGSERVQASSKVETKEQRLRFADTSSLGSYANKEDYVFMCKRRGGNDNRNLMHNEWLQTVQMEPDVISMSFIPITSLLNGVPGSGFLSHAINLYLRCKPINHLRFVHFFLELFFILVVSFTFRLEV

SEQ ID NO: 463 - DNA, 489 bp, Arabidopsis thaliana
atgaggaagatcatagggtttagaatcgggagacgagtctcaagatggatctttcgcaaaacccggatccaacgttcaggatacaaccggatacactcgacccagcaagcttgcatgctgatgagaccattagccaaactcaaaagttggggccaacgtctcaagcaaagtttcagacgcaggtctacgagaagatccgcatacatacccgttgatcataagaaagccgacccggttccaaggggacacttagctatctacgtgggtcaaaaagacggcgactgtcatagagttttggtacccatcgtttactttaaccatcctttgttcggtgagctgcttcgagaagccgaaaaagagtacggattttgccacgaaggaggtatcactattccttgtctgtattcagatttcgaacgggtcaagacccggatcgcatcggggtcaagttctcgggtatttccatggggccgtcattgccgcaattga

SEQ ID NO: 464 - protein, 162 aa, Arabidopsis thaliana
MRKIIGFRIGRRVSRWIFRKTRIQRSGYNRIHSTQQACMLMRPLAKLKSWGQRLKQSFRRRSTRRSAYIPVDHKKADPVPRGHLAIYVGQKDGDCHRVLVPIVYFNHPLFGELLREAEKEYGFCHEGGITIPCLYSDFERVKTRIASGSSSRVFPWGRHCRN

SEQ ID NO: 465 - DNA, 1473 bp, Arabidopsis thaliana
atgtctctctcttccctcactctcgactccaatccaagattcgctgttggtggaccttatcaccgccgttatcctcctcttcaccaccctcgaagcttcgtctcttgctctgctaaacgtccagctgtctccgcttcactgagcgtcgccgctgattcagccgccactgagtctcttggacggattggatcactgagtcaagtatctggtgtactcggttgccaatggggagatgaaggtaaaggcaaactcgttgacatcttagcccaacactttgacatcgttgctcgttgtcagggtggagctaatgctggacacactatatacaattcagagggaaagaaatttgcacttcaccttgtgccttcaggtatcctgaatgaggatactacttgtgtcattggaaacggagttgtggtgcatttgccaggtctcttcaaagagattgatggtttggagtccaatggtgtctcctgtaaaggaaggattttggtctctgatcgcgctcacttgttattcgatttccatcaagaggttgatgggctcagggaatctgagcttgccaagtcgttcattggcaccaccaagaggggaattggtcctgcctactctagtaaagtgataaggaatggtattagagtaggtgatctcaggcacatggatactttacctcaaaagcttgaccttttactatcagatgcagcggcaaggtttcaagggttcaagtatactcctgaaatgcttcgggaagaagttgaagcatacaagagatacgctgacagattggagccctacattactgacactgtccatttcatcaatgactcgatttcgcagaagaaaaaggttttggtcgaaggtggtcaagctacaatgttggacattgactttgggacttatccttttgttacttcctccagcccctcagccggtgggatctgcacaggtcttggtattgcaccaagtgttgttggtgatctaattggagtggtaaaagcatacactacaagagttggttcaggtccattcccgacagaaaatttgggcacaggtggtgaccttcttaggttagctggacaggagtttggcactacaactggtcgtcctcgtcggtgtggctggcttgacattgttgccctgaaattttcttgccaaatcaatggatttgcatcacttaatctcactaagcttgatgtactttcggatctgaacgaaatccagctgggtgtggcttacaagaggagtgacggcacccctgttaaatcattccctggtgatcttcgtcttctcgaagaactgcatgtggagtatgaagtcttacctgggtggaagtctgacatatcctcggtcagaaactactctgatcttccaaaggctgctcagcaatatgttgagaggattgaagaactcgtgggtgtgcccattcattacattggtattgggcccggtcgtgatgcccttatatataaatga

SEQ ID NO: 466 - protein, 490 aa, Arabidopsis thaliana
MSLSSLTLDSNPRFAVGGPYHRRYPPLHHPRSFVSCSAKRPAVSASLSVAADSAATESLGRIGSLSQVSGVLGCQWGDEGKGKLVDILAQHFDIVARCQGGANAGHTIYNSEGKKFALHLVPSGILNEDTTCVIGNGVVVHLPGLFKEIDGLESNGVSCKGRILVSDRAHLLFDFHQEVDGLRESELAKSFIGTTKRGIGPAYSSKVIRNGIRVGDLRHMDTLPQKLDLLLSDAAARFQGFKYTPEMLREEVEAYKRYADRLEPYITDTVHFINDSISQKKKVLVEGGQATMLDIDFGTYPFVTSSSPSAGGICTGLGIAPSVVGDLIGVVKAYTTRVGSGPFPTENLGTGGDLLRLAGQEFGTTTGRPRRCGWLDIVALKFSCQINGFASLNLTKLDVLSDLNEIQLGVAYKRSDGTPVKSFPGDLRLLEELHVEYEVLPGWKSDISSVRNYSDLPKAAQQYVERIEELVGVPIHYIGIGPGRDALIYK

SEQ ID NO: 467 - DNA, 993 bp, Arabidopsis thaliana
atgtcgttgacggagctagacgacggactggttcgcaggatggccatgggcgcagtcttctctgattttggagggaagatacattcggtgggtttccataggactgatgatctattggtcacatccagcgaagatgattcacttcgcctcttcgatatcgccaacgctaaacagctgaagattacataccataagaaacatggcaccgatcgtgtatgctttacccatcatcctagctctctaatttgctcttctcgatacaatttggagtccactggtgaatccttgagatatctctcaatgtatgataatcggatcctacgctactttaaagggcataaagacagggttgtatcactttgtatgtctcctataaatgatagcttcatgtctggttctctcgaccgaagtgttagactctgggatcttcgtgtaaatgcctgccagggaattctacatctacgtggtagacctgcagttgcgtatgaccaacaaggccttgtgtttgcaattgcaatggaaggaggtgctgttaaattatttgattccaggtgttatgacaagggtccctttgacacatttctggtgggtggggatactgctgaggttaacgatataaaattcagcaacgatgggaaatccatgctcctaacgactacaaataacaatatctacgttcttgatgcatatcgtggagagaagaaatgtggttttagtttggagccttcacagggtacacccatagaggccaccttcacaccagatggcaagtatgttctgtcaggttcaggtgatggaaccttacatgcgtggaacatcgagaacccatctgaggtggcgaggtgggagaacaacataggagtagtgtcgtgtctgaaatgggcaccacgtagagccatgttcgttgctgcttctacggttctcacattctggatcccaaacgacggtgaatcaccagcccccgccgatcctcctaccgatcaacaacagtga

SEQ ID NO: 468 - protein, 330 aa, Arabidopsis thaliana
MSLTELDDGLVRRMAMGAVFSDFGGKIHSVGFHRTDDLLVTSSEDDSLRLFDIANAKQLKITYHKKHGTDRVCFTHHPSSLICSSRYNLESTGESLRYLSMYDNRILRYFKGHKDRVVSLCMSPINDSFMSGSLDRSVRLWDLRVNACQGILHLRGRPAVAYDQQGLVFAIAMEGGAVKLFDSRCYDKGPFDTFLVGGDTAEVNDIKFSNDGKSMLLTTTNNNIYVLDAYRGEKKCGFSLEPSQGTPIEATFTPDGKYVLSGSGDGTLHAWNIENPSEVARWENNIGVVSCLKWAPRRAMFVAASTVLTFWIPNDGESPAPADPPTDQQQ

SEQ ID NO: 469 - DNA, 1365 bp, Arabidopsis thaliana
atggctgatctcgatgttcctcctcaagttcctcaaagtaaaactagagaccttgacaagcttcttctccgtcatgggaatctcgttgaccccggcttcgtacccggacccggcctgagggatgacataagggattatgtgagaatcttggtgattggtgcgggtgggttgggttgtgagcttctcaaggatttagctctttctggttttcgtaatctcgaagtgattgatatggaccgtattgaggttactaatctcaatcgccagttcctgttcaggattgaagatgtaggaaagcctaaggcagaggtagcagcaaagcgtgtaatggagagagtgagtggagtagagattgtgccgcatttttcacgtatagaagacaaagagattgagttttataacgattttaatatcattgctcttggtcttgattctatcgaagctcgcaaatacatcaatggggtagcttgtgggtttcttgagtataatgaagatgatactccgaaaagagaaacgatcaagccaatggtagatgggggaactgaaggtttcaagggtcatgctagagttatcttgcctggagttacaccctgttttgagtgcactatttatcttttcccacctcaagtgaagtttccgttgtgcactcttgcagaaacccctaggaatgcagctcattgcattgaatatgctcatcttattcagtgggaaacggttcatcgtgggaaaacctttgatcctgatgaaccagaacatatgaagtgggtttatgatgaggctatcaggagagctgagctttttggaattccaggtgtcacatactctctcacacaaggtgtggttaaaaacataataccggcgattgcttccaccaatgcgataatatctgcagcttgtgcacttgaaaccttgaagattgtgtctgcatgcagcaaaacacttgtaaattatttgacgtataacggtggagagggtctttacactgaagtgacaaagttcgagagggacaccgaatgtcttgtatgtggtccgggcattctgattgagctggacacctcagtcactttatcaaagttcattgagatgcttgaagatcacccgaagcttctattgtcaaaagcaagtgttaaacagggggaaaacactctctacatgcaggcacctccggttctagaagagtttcacagaccaaagctaagcaagccgctttatgacctcatgggaagagtccagaaggacactatccacgtgtttggacaaagagccctcaagaacaatgagaaagagtcgtgcacaacgaaggtaagagttgtattcaaaggagccgatggtgttgcagacatggatacagccattggagcatga

SEQ ID NO: 470 - protein, 454 aa, Arabidopsis thaliana
MADLDVPPQVPQSKTRDLDKLLLRHGNLVDPGFVPGPGLRDDIRDYVRILVIGAGGLGCELLKDLALSGFRNLEVIDMDRIEVTNLNRQFLFRIEDVGKPKAEVAAKRVMERVSGVEIVPHFSRIEDKEIEFYNDFNIIALGLDSIEARKYINGVACGFLEYNEDDTPKRETIKPMVDGGTEGFKGHARVILPGVTPCFECTIYLFPPQVKFPLCTLAETPRNAAHCIEYAHLIQWETVHRGKTFDPDEPEHMKWVYDEAIRRAELFGIPGVTYSLTQGVVKNIIPAIASTNAIISAACALETLKIVSACSKTLVNYLTYNGGEGLYTEVTKFERDTECLVCGPGILIELDTSVTLSKFIEMLEDHPKLLLSKASVKQGENTLYMQAPPVLEEFHRPKLSKPLYDLMGRVQKDTIHVFGQRALKNNEKESCTTKVRVVFKGADGVADMDTAIGA

SEQ ID NO: 471 - DNA, 1596 bp, Arabidopsis thaliana
atggcgatgaagaatctactgtccctagctcgccgatctcagaggcgtttattcctcactcaagccacacgatcttcctcttcgttttcagctatcgattcggtgccggcttccgcatctccgacggctctatctccaccgccgccgcatcttatgccatacgaccacgcggctgagattataaaaaataagatcaagaagctcgagaatcctgataagaggttccttaaatacgcatctccacatccgatcctcgcttcccacaatcacatcttgtcagctccggagactcgtgtcactaccttgcccaatggtctacgagtcgctactgagtcaaatctctcggctaagaccgccaccgttggagtctggatcgacgctggatctcggtttgagtccgatgagaccaacggaacggctcattttttggagcatatgatattcaaaggcacggataggcgtacagtgagagcgttggaggaagagatcgaagatattggtggtcacctgaacgcgtatacatcgagggaacagaccacttattatgctaaggttttggattccaatgtgaaccaggctttggatgtcttggctgatatcctacagaattctaagttcgaggaacagagaattaaccgcgaacgagatgtcatcctcagggaaatgcaagaggtggagggacaaaccgatgaagtggttcttgaccatttacatgccactgcattccaatacacaccccttggaagaactattttgggacctgctcagaacgtcaaatcgatcaccagagaggatctacagaactacattaagactcactacactgcttccaggatggtgattgctgctgcaggagctgttaagcatgaggaagttgttgagcaagtgaagaagctatttaccaagttgtcgtctgatccaacaactacttctcaactggttgccaatgaacctgctagttttactggttctgaggtccgaatgattgatgacgacctaccccttgcacaatttgctgttgcctttgagggagcatcttggactgatccagattccgttgctcttatggttatgcaaactatgttgggttcgtggaacaaaaatgttggtggtggaaaacacgtgggttctgacctgacccagagggttgccattaatgaaatagcagaaagcataatggcattcaacactaactacaaggatactggactgttcggcgtttatgcagttgccaaggccgattgcttggatgatttatcatatgccattatgtatgaggtaaccaagctggcctaccgagtttcagacgctgatgtgacacgtgcacgaaatcagctgaaatcatcattgttacttcacatggatggaaccagcccaattgctgaagatattggtcgtcagctgctgacctatgggcgtagaatcccaaccgctgaactctttgctaggatcgatgctgttgatgccagcacggtaaaacgtgttgccaacaaatatatctatgacaaagacattgcaatctcagctattggtccaatccaagatttgccagactacaacaaattcagacgcagaacctactggaaccggtactaa

SEQ ID NO: 472 - protein, 531 aa, Arabidopsis thaliana
MAMKNLLSLARRSQRRLFLTQATRSSSSFSAIDSVPASASPTALSPPPPHLMPYDHAAEIIKNKIKKLENPDKRFLKYASPHPILASHNHILSAPETRVTTLPNGLRVATESNLSAKTATVGVWIDAGSRFESDETNGTAHFLEHMIFKGTDRRTVRALEEEIEDIGGHLNAYTSREQTTYYAKVLDSNVNQALDVLADILQNSKFEEQRINRERDVILREMQEVEGQTDEVVLDHLHATAFQYTPLGRTILGPAQNVKSITREDLQNYIKTHYTASRMVIAAAGAVKHEEVVEQVKKLFTKLSSDPTTTSQLVANEPASFTGSEVRMIDDDLPLAQFAVAFEGASWTDPDSVALMVMQTMLGSWNKNVGGGKHVGSDLTQRVAINEIAESIMAFNTNYKDTGLFGVYAVAKADCLDDLSYAIMYEVTKLAYRVSDADVTRARNQLKSSLLLHMDGTSPIAEDIGRQLLTYGRRIPTAELFARIDAVDASTVKRVANKYIYDKDIAISAIGPIQDLPDYNKFRRRTYWNRY

SEQ ID NO: 473 - DNA, 1275 bp, Arabidopsis thaliana
atggcgactgttccggagataaagataatgagaagcgagagcttaggtcatcggagtgacgtgtcgagcccggaagctaagctagggatgcgtgtggaagatctctgggatgagcagaaaccacagctcagtcctaacgagaagctcaacgcttgctttgagagcatccctgtctctgctttccctctctcttctgattcacaagatattgagataagatcagacacaagtttggctgaagctgttcagacactatcgaaattcaaggtcttgagcgcgcctgttgtagatgttgatgcgcctgaagatgccagttggattgatcgctacatcggtattgtggaatttccaggcattgttgtctggcttttgcatcagttggagccaccatctccaaggagccctgctgttgcagcttcaaatggattttctcatgatttcaccaccgatgttctggataacggagattcagcagtaacttctggaaacttctttgaggtccttacttcttcagagctatacaagaacaccaaggttcgagatatctctggaacattccgctgggcaccgttcctggctctgcagaaagagaactcctttttgaccatgctgttacttctttctaaatacaaaatgaagagcatcccggtggttgatttaggtgtagcaaagatcgagaacattatcacacaatcaggagttatacatatgctggcagaatgcgcggggcttctctggtttgaggattggggaatcaaaactctctctgaagtcggtcttcccattatgtcaaaggaccatatcataaagatctatgaggatgaaccagttcttcaggcattcaagctgatgaggagaaagagaatcggaggcatacctgtcattgaaaggaatagcgagaagccagtaggcaacataagccttagagatgttcaatttctcctcactgcacctgagatctaccatgactacaggtcaatcacaacgaagaacttcttagtatctgttagagagcatcttgagaagtgcggggatacatcagctcctatcatgagtggtgtgattgcttgcacgaagaaccatacactaaaggaactgatcttgatgttagacgcggagaagatccataggatatatgttgtggatgattttggtaaccttgaaggactcatcactcttagagacatcattgcaagacttgtccatgagccatccggctattttggagatttctttgatggtgttatgcctcttcccgaaaactaccgagtctga

SEQ ID NO: 474 - protein, 424 aa, Arabidopsis thaliana
MATVPEIKIMRSESLGHRSDVSSPEAKLGMRVEDLWDEQKPQLSPNEKLNACFESIPVSAFPLSSDSQDIEIRSDTSLAEAVQTLSKFKVLSAPVVDVDAPEDASWIDRYIGIVEFPGIVVWLLHQLEPPSPRSPAVAASNGFSHDFTTDVLDNGDSAVTSGNFFEVLTSSELYKNTKVRDISGTFRWAPFLALQKENSFLTMLLLLSKYKMKSIPVVDLGVAKIENIITQSGVIHMLAECAGLLWFEDWGIKTLSEVGLPIMSKDHIIKIYEDEPVLQAFKLMRRKRIGGIPVIERNSEKPVGNISLRDVQFLLTAPEIYHDYRSITTKNFLVSVREHLEKCGDTSAPIMSGVIACTKNHTLKELILMLDAEKIHRIYVVDDFGNLEGLITLRDIIARLVHEPSGYFGDFFDGVMPLPENYRV

SEQ ID NO: 475 - DNA, 1086 bp, Arabidopsis thaliana
atggactctttaacactcttcttcaccggtgcactcgtcgccgtcggtatctactggttcctctgcgttctcggtccagcagagcgtaaaggcaaacgagccgtagatctctctggtggctcaatctccgccgagaaagtccaagacaactacaaacagtactggtctttcttccgccgtccaaaagaaatcgaaaccgccgagaaagttccagacttcgtcgacacattctacaatctcgtcaccgacatatacgagtggggatggggacaatccttccacttctcaccatcaatccccggaaaatctcacaaagacgccacgcgcctccacgaagagatggccgtagatctgatccaagtcaaacctggtcaaaagatcctagacgtcggatgcggtgtcggcggtccgatgcgagcgattgcatctcactcgcgagctaacgtagtcgggattacaataaacgagtatcaggtgaacagagctcgtctccacaataagaaagctggtctcgacgcgctttgcgaggtcgtgtgtggtaacttcctccagatgccgttcgatgacaacagtttcgacggtgcttattccatcgaagccacgtgtcacgcgccgaagctggaagaagtgtacgcagagatctacagggtgttgaaacccggatctatgtatgtgtcgtacgagtgggttacgacggagaaatttaaggcggaggatgacgaacacgtggaggtaatccaagggattgagagaggcgatgcgttaccagggcttagggcttacgtggatatagctgagacggctaaaaaggttgggtttgagatagtgaaggagaaggatctggcgagtccaccggctgagccgtggtggactaggcttaagatgggtaggcttgcttattggaggaatcacattgtggttcagattttgtcagcggttggagttgctcctaaaggaactgttgatgttcatgagatgttgtttaagactgctgattatttgaccagaggaggtgaaaccggaatattctctccgatgcatatgattctctgcagaaaaccggagtcaccggaggagagttcttga

SEQ ID NO: 476 - protein, 361 aa, Arabidopsis thaliana
MDSLTLFFTGALVAVGIYWFLCVLGPAERKGKRAVDLSGGSISAEKVQDNYKQYWSFFRRPKEIETAEKVPDFVDTFYNLVTDIYEWGWGQSFHFSPSIPGKSHKDATRLHEEMAVDLIQVKPGQKILDVGCGVGGPMRAIASHSRANVVGITINEYQVNRARLHNKKAGLDALCEVVCGNFLQMPFDDNSFDGAYSIEATCHAPKLEEVYAEIYRVLKPGSMYVSYEWVTTEKFKAEDDEHVEVIQGIERGDALPGLRAYVDIAETAKKVGFEIVKEKDLASPPAEPWWTRLKMGRLAYWRNHIVVQILSAVGVAPKGTVDVHEMLFKTADYLTRGGETGIFSPMHMILCRKPESPEESS

SEQ ID NO: 477 - DNA, 933 bp, Arabidopsis thaliana
atggctagtaacaaccctcacgacaacctttctgaccaaactccttctgatgatttcttcgagcaaatcctcggccttcctaacttctcagcctcttctgccgccggtttatctggagttgacggaggattaggtggtggagcaccgcctatgatgctgcagttgggttccggagaagaaggaagtcacatgggtggcttaggaggaagtggaccaactgggtttcacaatcagatgtttcctttggggttaagtcttgatcaagggaaaggacctgggtttcttagacctgaaggaggacatggaagtgggaaaagattctcagatgatgttgttgataatcgatgttcttctatgaaacctgttttccacgggcagcctatgcaacagccacctccatcggccccacatcagcctacttcaatccgtcccagggttcgagctaggcgtggtcaggctactgatccacatagcatcgctgagcggctacgtagagaaagaatagcagaacggatcagggcgctgcaggaacttgtacctactgtgaacaagaccgatagagctgctatgatcgatgagattgtcgattatgtaaagtttctcaggctccaagtcaaggttttgagcatgagccgacttggtggagccggtgcggttgctccacttgttactgatatgcctctttcatcatcagttgaggatgaaacgggtgagggtggaaggactccgcaaccagcgtgggagaaatggtctaacgatgggactgaacgtcaagtggctaaactgatggaagagaacgttggagccgcgatgcagcttcttcaatcaaaggctctttgtatgatgccaatctcattggcaatggcaatttaccattctcaacctccggatacatcttcagtggtcaagcctgagaacaatcctccacagtag

SEQ ID NO: 478 - protein, 310 aa, Arabidopsis thaliana
MASNNPHDNLSDQTPSDDFFEQILGLPNFSASSAAGLSGVDGGLGGGAPPMMLQLGSGEEGSHMGGLGGSGPTGFHNQMFPLGLSLDQGKGPGFLRPEGGHGSGKRFSDDVVDNRCSSMKPVFHGQPMQQPPPSAPHQPTSIRPRVRARRGQATDPHSIAERLRRERIAERIRALQELVPTVNKTDRAAMIDEIVDYVKFLRLQVKVLSMSRLGGAGAVAPLVTDMPLSSSVEDETGEGGRTPQPAWEKWSNDGTERQVAKLMEENVGAAMQLLQSKALCMMPISLAMAIYHSQPPDTSSVVKPENNPPQ

SEQ ID NO: 479 - DNA, 1701 bp, Arabidopsis thaliana
atggcccctgctctcgccgttacacgagatctcaccgccgtcggatctccggagaatgctcctgcgaaaggacgtgcttcggtttacagtgaagttcaatcaagccgtattaacaacactcttcctttgccttctgttctcaaaggagctttcaaaatcgtcgaaggtcccgctagttccgccgccgggaatccagatgagatagcgaagttgtttccgggtctatatggccagccatcagtagcagtggttccagatcaggatgcaccttcgtcggcaccgaaattgaagattggtgttgttttgtctggaggtcaggcacctggtgggcacaatgttatttctggactgtttgattacctgcaagagcgtgcgaaaggtagcacattttacgggttcaagggtggtccagctggtatcatgaaatgcaaatatgttgagttgaatgctgaatatattcagccttacagaaaccagggtggttttgacatgatctgcagtggaagagacaagattgaaacacctgaccagtttaaacaagctgaagaaacagcaaagaagcttgatttggatgggttggtggttatcggtggagatgattccaacaccaatgcttgccttcttgctgaaaacttcaggagtaagaacttgaaaacccgagtcattgggtgccccaagaccattgatggtgatttgaaatgcaaagaggttcctactagttttgggtttgatacagcttgcaagatttactctgaaatgatcggaaacgtcatgattgatgcaaggtcgactggaaagtactatcattttgtaagacttatgggtcgtgctgcttcccacattacgcttgagtgtgctttacaaactcacccaaacataaccattattggagaagaggtttctgcccagaagcagactttgaagaatgtcacagactacatggtggatgttatctgcaaacgtgctgaacttggttacaactacggtgtcatactgattccagaaggtctgatcgactttattcctgaggtccaagagctcattgctgaactgaatgaaattctggcaaatgaggttgtcgatgaaaatggtttgtggaagaagaagctcaccgagcaatccctgaagctgtttgatcttctgcctgaagcaattcaggaacagctgatgcttgagagagacccacacggaaatgtccaggttgctaagattgagactgagaagatgcttattcaaatggttgaaactgaattggagaaaagaaagcaagctggtgcatacaagggacaattcatgggacagtcacatttcttcgggtatgaaggaagatgcggcttgcccacaaattttgatgccacatactgttatgcacttggttatggcgctggagtactcctcaacagtgggaagaccggactaatttcttcggttgggaacttggctgctcctgtggaagaatggactgtaggtgggactgctctcacagccttgatggatgtcgagaggagacacggtaagttcaagcctgtgatcaagaaagcaatggtggaacttgaaggtgcaccatttaagaaattcgcatcactgcgtgaagaatgggcattgaagaaccgatacatcagcccaggtccgatccaattcactggacctggttcagactctctcagccacactctacttcttgaactcggggctcaatag

SEQ ID NO: 480 - protein, 566 aa, Arabidopsis thaliana
MAPALAVTRDLTAVGSPENAPAKGRASVYSEVQSSRINNTLPLPSVLKGAFKIVEGPASSAAGNPDEIAKLFPGLYGQPSVAVVPDQDAPSSAPKLKIGVVLSGGQAPGGHNVISGLFDYLQERAKGSTFYGFKGGPAGIMKCKYVELNAEYIQPYRNQGGFDMICSGRDKIETPDQFKQAEETAKKLDLDGLVVIGGDDSNTNACLLAENFRSKNLKTRVIGCPKTIDGDLKCKEVPTSFGFDTACKIYSEMIGNVMIDARSTGKYYHFVRLMGRAASHITLECALQTHPNITIIGEEVSAQKQTLKNVTDYMVDVICKRAELGYNYGVILIPEGLIDFIPEVQELIAELNEILANEVVDENGLWKKKLTEQSLKLFDLLPEAIQEQLMLERDPHGNVQVAKIETEKMLIQMVETELEKRKQAGAYKGQFMGQSHFFGYEGRCGLPTNFDATYCYALGYGAGVLLNSGKTGLISSVGNLAAPVEEWTVGGTALTALMDVERRHGKFKPVIKKAMVELEGAPFKKFASLREEWALKNRYISPGPIQFTGPGSDSLSHTLLLELGAQ

SEQ ID NO: 481 - DNA, 3027 bp, Arabidopsis thaliana
atgcgtgttcatcgtttttgtgtgatcgtcatcttcctcacagagttactatgtttcttctattcctcggaatctcagaccacctccaggtgccatccacatgacctcgaagccttacgtgacttcatagcacatctcgaaccaaaaccagatggttggatcaattcttcttcttctacagactgctgcaactggaccggaatcacctgcaattcaaacaacaccggaagagttattagattggagcttgggaacaaaaagctgtcggggaagttgtctgaatctctcgggaagctagatgagattagggttcttaatctctctcgaaacttcatcaaagattcgatccctctttcgattttcaacttgaagaatctacaaactcttgatttgagctctaatgatctctccggcggaatcccaacaagtataaatctcccagctctgcaaagttttgatctttcttcaaataaattcaatgggtcgcttccgtctcatatctgccataactctactcaaattagggttgtgaaacttgcggtgaactacttcgccggaaacttcacttccgggtttgggaaatgtgtcttgcttgagcatctctgtcttggtatgaacgatcttactggtaacatccctgaggatttgtttcatctcaaaagattgaatcttttagggattcaagagaatcgtctctctggttcgttgagtcgtgagattaggaatctctcaagtcttgttcgtcttgatgtttcttggaatttgttttccggtgaaatccctgatgtgttcgacgaattgcctcagttaaagtttttcttaggtcagaccaatggattcattggaggaatacctaaatcgttggcgaattcaccgagtttgaatctgcttaacttgaggaacaattctttatcgggtcgtttgatgttgaattgtacggcgatgattgctttgaactctcttgatttaggtaccaatagattcaatgggaggttacctgagaatctaccggattgcaagcggttaaagaacgttaacctcgcgaggaacaccttccatggacaagtaccagagagtttcaagaacttcgagagcttatcttacttctcgttatcgaattcgagtttggctaatatctcttcagcgcttgggatacttcagcattgcaagaacttgacgactttggttcttacattgaatttccatggagaggctttacccgatgattcaagtcttcatttcgagaagcttaaggtgcttgtagtggcgaattgtaggcttactggttcgatgccgaggtggttaagctcgagtaatgaacttcagttgttggatctttcttggaaccgtttaaccggcgctatcccgagctggattggtgacttcaaggctctgttctacttggatttatctaacaactcgtttacaggagagatccctaagagcttaactaagttagagagtctcactagccgtaatatctcagtcaatgagccatctcctgatttcccgttctttatgaaaagaaacgagagcgcgagagcgttgcaatacaatcagattttcgggttcccgccaacgattgagcttggtcataacaatctctctggacctatttgggaggagtttggtaatctgaagaagcttcatgtgtttgatttgaaatggaatgcattatctggatcaatacctagctcgctttctggtatgacgagcttggaagctcttgatctctctaataaccgtctttcgggttcgatcccggtttctctgcaacagctctcgtttctgtcgaagttcagtgttgcttataacaatctctcgggagtaataccttccggtggtcagtttcagacgtttccaaactcgagctttgagagtaaccatctctgcggggaacacagattcccctgttctgaaggtactgagagtgcattgatcaaacggtcaagaagaagcagaggaggtgacattggaatggcgattgggatagcgtttggttcggtttttcttttgactcttctctcgttgattgtgttgcgtgctcgtagacggtcaggagaagttgatccggagatagaagaatccgagagcatgaatcgtaaagaactcggagagattggatctaagcttgtggttttgtttcagagcaatgataaagagctctcttatgatgaccttttggactcaacaaatagttttgatcaagctaacatcattggctgtggcgggtttggtatggtttacaaagcaacgttaccagacggtaagaaagttgcgatcaagaagttatccggtgattgcggtcaaatcgaaagagaattcgaagcagaagttgaaacactctcaagagcacagcatccaaatcttgttcttctccgaggattctgtttctacaaaaacgaccggcttttaatctactcgtatatggaaaacggaagcttagactattggctacacgagcgtaacgacggtccagcgttgttgaagtggaaaacacgtcttagaatcgctcaaggtgctgcaaaagggttactttacttgcatgaagggtgtgatcctcatatcttacaccgcgatattaaatcgagtaatattcttctcgacgagaatttcaactctcatttagcggatttcggactcgcaaggctgatgagtccttacgagacgcatgtaagtactgatttggttggaactttaggttacattcctccggaatacgggcaagcttcggttgctacttacaaaggcgatgtgtatagtttcggagttgtgcttctcgagcttttaaccgataaaagaccggtggatatgtgtaaaccgaaagggtgtagggatctgatctcgtgggtcgtcaagatgaagcatgagagtcgagcaagcgaggttttcgatccgttaatatacagtaaagagaatgataaagagatgtttcgggttctcgagattgcttgtttatgtttaagcgaaaacccgaaacagaggccaacgactcaacagttagtctcttggcttgatgatgtctag

SEQ ID NO: 482 - protein, 1008 aa, Arabidopsis thaliana
MRVHRFCVIVIFLTELLCFFYSSESQTTSRCHPHDLEALRDFIAHLEPKPDGWINSSSSTDCCNWTGITCNSNNTGRVIRLELGNKKLSGKLSESLGKLDEIRVLNLSRNFIKDSIPLSIFNLKNLQTLDLSSNDLSGGIPTSINLPALQSFDLSSNKFNGSLPSHICHNSTQIRVVKLAVNYFAGNFTSGFGKCVLLEHLCLGMNDLTGNIPEDLFHLKRLNLLGIQENRLSGSLSREIRNLSSLVRLDVSWNLFSGEIPDVFDELPQLKFFLGQTNGFIGGIPKSLANSPSLNLLNLRNNSLSGRLMLNCTAMIALNSLDLGTNRFNGRLPENLPDCKRLKNVNLARNTFHGQVPESFKNFESLSYFSLSNSSLANISSALGILQHCKNLTTLVLTLNFHGEALPDDSSLHFEKLKVLVVANCRLTGSMPRWLSSSNELQLLDLSWNRLTGAIPSWIGDFKALFYLDLSNNSFTGEIPKSLTKLESLTSRNISVNEPSPDFPFFMKRNESARALQYNQIFGFPPTIELGHNNLSGPIWEEFGNLKKLHVFDLKWNALSGSIPSSLSGMTSLEALDLSNNRLSGSIPVSLQQLSFLSKFSVAYNNLSGVIPSGGQFQTFPNSSFESNHLCGEHRFPCSEGTESALIKRSRRSRGGDIGMAIGIAFGSVFLLTLLSLIVLRARRRSGEVDPEIEESESMNRKELGEIGSKLVVLFQSNDKELSYDDLLDSTNSFDQANIIGCGGFGMVYKATLPDGKKVAIKKLSGDCGQIEREFEAEVETLSRAQHPNLVLLRGFCFYKNDRLLIYSYMENGSLDYWLHERNDGPALLKWKTRLRIAQGAAKGLLYLHEGCDPHILHRDIKSSNILLDENFNSHLADFGLARLMSPYETHVSTDLVGTLGYIPPEYGQASVATYKGDVYSFGVVLLELLTDKRPVDMCKPKGCRDLISWVVKMKHESRASEVFDPLIYSKENDKEMFRVLEIACLCLSENPKQRPTTQQLVSWLDDV

SEQ ID NO: 483 - DNA, 1011 bp, Arabidopsis thaliana
atggcggaatctgtcttctcttgtataccagaagacgtagtcttcaacatcttcttcaagctccaagatgatccaagaaactgggctcgtctcgcttgcgtctgcaccaaattctcctcaattgttcgaaacgtttgttgtaaaactcagtgctactccgctatccccaccgtcatctccgatctcctccctcttcctccctccgccgccgcatccgcttcttcatccaccgcggcggattcgtctcttactcctcccggtggttgggcttctttatacaaactcgctgtttgttgtcctggtctcttccacgctggaattctcctcgaaaactccgatttcggtttagaacgtgagctaggtcccgatcaaaacctcgatccgaaacctactacgacggatctagctcttaacgacgaagaagtttcgaaaccagttggatctggtttagaaacgacttcgttttggtctctatatgatgatctctacacagatactattcccgctcctcctcccgaagattcaatcgacgatcaagaagaagaaatcgaaacgagtgagatcagacctggacgagatcttccggtaaggaaacgaaggaagatttgtcgatctctaggatctcatttagcttccggtggctggaaccttagccgtgaacaaggcaacaagcttctcgcgagtagattccgaggtgattgtctctacatttgcaattggcctgggtgtattcacgtagaagagaaacgaaattacatgttgtttagaggagtcttcaaggatttcaaaaggtctagagtttggagaacgataaacgacggtaatcggagtaagacctcgggtttgaaatgcgcgttttgtttgtgcgatgagacttgggatttgcattcatcgttttgtttgagaagagtgtttgggtttcatgatgatggtgaaccagttgtgagagcttatgtttgtgagaatggtcatgtctctggtgcttggactgctttacctctctacacttga

SEQ ID NO: 484 - protein, 336 aa, Arabidopsis thaliana
MAESVFSCIPEDVVFNIFFKLQDDPRNWARLACVCTKFSSIVRNVCCKTQCYSAIPTVISDLLPLPPSAAASASSSTAADSSLTPPGGWASLYKLAVCCPGLFHAGILLENSDFGLERELGPDQNLDPKPTTTDLALNDEEVSKPVGSGLETTSFWSLYDDLYTDTIPAPPPEDSIDDQEEEIETSEIRPGRDLPVRKRRKICRSLGSHLASGGWNLSREQGNKLLASRFRGDCLYICNWPGCIHVEEKRNYMLFRGVFKDFKRSRVWRTINDGNRSKTSGLKCAFCLCDETWDLHSSFCLRRVFGFHDDGEPVVRAYVCENGHVSGAWTALPLYT

SEQ ID NO: 485 - DNA, 1998 bp, Arabidopsis thaliana
atggcttgcatgaagctgggatccaaatctgatgctttccagagacaaggccaggcttggttttgcacaactggacttcctagtgatattgtcgttgaagttggggagatgtcttttcatctccacaagtttcccttgctctctagaagtggagtcatggaaagaaggattgcagaagcatcaaaagaaggcgatgataaatgtctcattgaaatctctgatcttcctggtggagacaaaacgtttgaactagtcgctaagttctgctatggtgtgaagcttgaactcactgcttctaacgttgtatatctcagatgcgctgctgagcatctcgaaatgactgaagaacatggggaaggaaatcttatttctcaaactgaaacatttttcaatcaagtagtcctcaaaagctggaaagattcaataaaagcgcttcatagctgcgatgaggtcctcgagtatgctgatgaattgaacattaccaagaaatgcattgagtcactagccatgagagcatcgacagacccaaacttgtttggatggccagttgtggagcatggtgggcccatgcagagtccaggtggcagtgttttatggaatgggataagcaccggggctagacctaaacatactagttcagactggtggtacgaggatgcatcgatgctaagttttcccctttttaagagacttatcacggtgatggagtcccgcggcattagagaagacatcatcgctggctccctaacctattacacacgaaaacacttgcctggcttaaaaagacgacgtggtggacctgaatctagtggtcgtttcagcacacctttgggctcagggaatgtactgtccgaggaagagcagaagaacttgcttgaagagatccaggagcttcttcgtatgcaaaaaggtttagttccaaccaagtttttcgttgacatgcttcgaatcgccaagattttaaaagcaagtccggattgcatagccaatttggagaagaggatagggatgcagcttgaccaggctgcgttggaagatcttgtaatgcctagcttttctcatactatggagaccctatacgatgttgactctgtgcaaaggatcttggaccattttcttgggacagatcagattatgcctggtggggttggctctccttgttcttcagtagatgacgggaatttaatcggatccccacagtcaataacaccaatgacagcggttgcaaagctgattgatgggtatcttgctgaagttgctcctgatgtcaatcttaagcttccaaagttccaagctttagctgcttctattcctgaatacgccagactcttagatgacggactctatcgtgcaatagacatttatctaaagcatcatccatggttggcggaaacagaaagagagaatctgtgccggttgttagattgtcagaaactctctttagaagcttgtacacatgcggcgcagaacgagagattaccgctaagaataatcgtccaagtgctcttctttgagcagctacagctcagaacctctgtagctggatgcttcctggtctcagacaacctcgatggcggatcaagacagttaagaagcggaggatatgtaggaggaccaaacgaaggaggcggaggaggaggaggatgggcaaccgcggtaagagagaatcaagtcctgaaagttggaatggacagtatgagaatgcgagtttgtgagttagagaaagaatgttccaacatgagacaagagattgagaaactcggtaagacgacaaaaggtggtggttctgcaagcaatggagtcggtagcaagacttgggaaaacgtttctaagaaactcgggttcggttttaagctgaagtcgcatcaaatgtgcagtgctcaggaaggttctgtgtctaagtctaacaacgagaatgtgaagatagagaagctaaaggatgttaaagagcgtcgtgggaagcataagaaagcttcgagcattagttctgagaggtga

SEQ ID NO: 486 - protein, 665 aa, Arabidopsis thaliana
MACMKLGSKSDAFQRQGQAWFCTTGLPSDIVVEVGEMSFHLHKFPLLSRSGVMERRIAEASKEGDDKCLIEISDLPGGDKTFELVAKFCYGVKLELTASNVVYLRCAAEHLEMTEEHGEGNLISQTETFFNQVVLKSWKDSIKALHSCDEVLEYADELNITKKCIESLAMRASTDPNLFGWPVVEHGGPMQSPGGSVLWNGISTGARPKHTSSDWWYEDASMLSFPLFKRLITVMESRGIREDIIAGSLTYYTRKHLPGLKRRRGGPESSGRFSTPLGSGNVLSEEEQKNLLEEIQELLRMQKGLVPTKFFVDMLRIAKILKASPDCIANLEKRIGMQLDQAALEDLVMPSFSHTMETLYDVDSVQRILDHFLGTDQIMPGGVGSPCSSVDDGNLIGSPQSITPMTAVAKLIDGYLAEVAPDVNLKLPKFQALAASIPEYARLLDDGLYRAIDIYLKHHPWLAETERENLCRLLDCQKLSLEACTHAAQNERLPLRIIVQVLFFEQLQLRTSVAGCFLVSDNLDGGSRQLRSGGYVGGPNEGGGGGGGWATAVRENQVLKVGMDSMRMRVCELEKECSNMRQEIEKLGKTTKGGGSASNGVGSKTWENVSKKLGFGFKLKSHQMCSAQEGSVSKSNNENVKIEKLKDVKERRGKHKKASSISSER

SEQ ID NO: 487 - DNA, 1416 bp, Arabidopsis thaliana
atggaggcagacgaaagcggcatctctctgccgtcgggacccgacggacgtaagcggcgagtcagttacttctacgagccgacgatcggagactactactacggtcaaggccacccgatgaagcctcaccggatccgtatggctcatagcctaatcattcactatcacctccaccgtcgcttagaaatcagtcgccctagcctcgctgacgcctccgatatcggccgattccattcgccggagtatgttgacttcctcgcttccgtttcgccggaatctatgggcgatccttccgctgcacgaaacctaaggcgattcaatgtcggtgaggattgtcctgtcttcgacggactttttgatttttgccgtgcttccgccggaggttctattggtgctgccgtcaaattaaacagacaggacgctgatatcgctatcaattggggcggtgggcttcaccatgctaagaaaagcgaggcttctgggttttgctatgtaaacgacatcgtgctagggattctggagttgctcaagatgtttaagcgggttctctacatagatattgatgtccaccatggagatggagtggaagaagcgttttacaccactgatagagttatgactgtttctttccacaaatttggggactttttcccaggaactggtcacataagagatgttggcgctgaaaaagggaaatactatgctctaaatgttccactaaacgatggtatggacgatgaaagtttccgcagcttgtttagacctcttatccagaaggttatggaagtgtatcagccagaggcagttgttcttcagtgtggtgctgactccttaagtggtgatcggttgggttgcttcaacttatcagtcaagggtcacgctgattgccttcggttcttaagatcttacaacgttcctctcatggtgttgggtggtggagggtatactattcgaaatgttgcccgttgctggtgttatgagactgcagttgctgttggagtagagccggacaacaaactcccttacaatgagtattttgagtatttcggcccagattatacgcttcatgtcgacccaagtcctatggagaatttaaacacgcccaaagatatggagaggataaggaacacgttgctggaacaactttcgggactaatacacgcacctagcgtccagtttcagcacacaccaccagtcaatcgagttttggacgagccggaagatgacatggagacaagaccaaaacctcgcatctggagtggaactgcgacttatgaatcagacagtgacgatgatgataaacctcttcatggttactcatgtcgtggtggcgcaactacggacagggactctaccggtgaagatgaaatggatgacgataacccagagccagacgtgaatcctccatcgtcttaa

SEQ ID NO: 488 - protein, 471 aa, Arabidopsis thaliana
MEADESGISLPSGPDGRKRRVSYFYEPTIGDYYYGQGHPMKPHRIRMAHSLIIHYHLHRRLEISRPSLADASDIGRFHSPEYVDFLASVSPESMGDPSAARNLRRFNVGEDCPVFDGLFDFCRASAGGSIGAAVKLNRQDADIAINWGGGLHHAKKSEASGFCYVNDIVLGILELLKMFKRVLYIDIDVHHGDGVEEAFYTTDRVMTVSFHKFGDFFPGTGHIRDVGAEKGKYYALNVPLNDGMDDESFRSLFRPLIQKVMEVYQPEAVVLQCGADSLSGDRLGCFNLSVKGHADCLRFLRSYNVPLMVLGGGGYTIRNVARCWCYETAVAVGVEPDNKLPYNEYFEYFGPDYTLHVDPSPMENLNTPKDMERIRNTLLEQLSGLIHAPSVQFQHTPPVNRVLDEPEDDMETRPKPRIWSGTATYESDSDDDDKPLHGYSCRGGATTDRDSTGEDEMDDDNPEPDVNPPSS

SEQ ID NO: 489 - DNA, 471 bp, Arabidopsis thaliana
atgggagcgtgcgcttcacgtgaatctttgaggagtgattcagcgaagctgatattactcgacggtactttacaggagttctcatctccggtcaaagtttggcagattttgcaaaagaaccctacgagtttcgtctgtaactcagacgaaatggacttcgacgacgcagtttcagctgtcgccggcaacgaagagctccgatcagggcagctctattttgtcttacctctgacgtggctcaaccatccgttaagggcggaggaaatggcggccttggccgtgaaagctagttcggcgttgaccaagagcggtggcgtcggttgggtttccggcgacgacgatgtaacgacatcggaaaaaacttaccaaaagaaaaacattgccggagttaagacaaacggtggtggcggaagaggttgcggtaaagggaagaggcgattcacggctaatttgagcacgatcgccgagtag

SEQ ID NO: 490 - protein, 156 aa, Arabidopsis thaliana
MGACASRESLRSDSAKLILLDGTLQEFSSPVKVWQILQKNPTSFVCNSDEMDFDDAVSAVAGNEELRSGQLYFVLPLTWLNHPLRAEEMAALAVKASSALTKSGGVGWVSGDDDVTTSEKTYQKKNIAGVKTNGGGGRGCGKGKRRFTANLSTIAE

SEQ ID NO: 491 - DNA, 702 bp, Arabidopsis thaliana
atggatctcaatctcgatgcacctcactccatgggaacgaccatcatcggcgtcacttacaatggaggtgtcgtcctcggagccgactcacgtaccagcaccggtatgtacgtagcgaatcgagcttctgataagattacacaactgacagataatgtctacgtctgccgctctggatcggctgctgattctcaagttgtatctgactatgtccgctacttccttcaccagcatacaattcagcatggacaacccgcaactgttaaggtttctgccaaccttatcaggatgctcgcatataataacaagaacatgctccaaactggtctcatcgttggaggatgggataaatatgagggtgggaagatctacgggatcccactcggtggaactgtagtcgagcaaccgtttgccattggaggctctggttcgagctatctctacgggttcttcgaccaggcttggaaagataacatgaccaaagaagaagcagagcaacttgttgtgaaggcggtttcactagccatcgcccgtgatggagccagtggtggtgtcgtacggactgtcataatcaactcagagggagtgacgagaaacttttaccctggagataagttgcagctttggcacgaagaattggagccccaaaactcactcttagacattctgaacgctgctggtcctgaaccaatggccatgtga

SEQ ID NO: 492 - protein, 233 aa, Arabidopsis thaliana
MDLNLDAPHSMGTTIIGVTYNGGVVLGADSRTSTGMYVANRASDKITQLTDNVYVCRSGSAADSQVVSDYVRYFLHQHTIQHGQPATVKVSANLIRMLAYNNKNMLQTGLIVGGWDKYEGGKIYGIPLGGTVVEQPFAIGGSGSSYLYGFFDQAWKDNMTKEEAEQLVVKAVSLAIARDGASGGVVRTVIINSEGVTRNFYPGDKLQLWHEELEPQNSLLDILNAAGPEPMAM

SEQ ID NO: 493 - DNA, 963 bp, Arabidopsis thaliana
atgagacctcctctaactggaagtggtggtgggttcagtggtggaagagggcgtggtggatacagtggtggtagaggtgacggtggattcagtggtggtcgaggtggcggtggtagaggaggaggaagaggtttcagcgaccgtggtggtcgcggcagaggaagaggaccaccacgtggtggtgctcgcggcggcagaggaccagctggccgtggaggcatgaaaggaggaagcaaagtgattgtggaacctcacagacacgcaggagtgttcattgcaaagggtaaagaagatgcccttgttaccaagaatttggttcctggtgaagctgtctacaacgagaagagaatctctgttcagaacgaagatggaaccaagactgaatacagagtttggaatcctttccgttcgaagttggctgctgctattcttggtggtgttgataacatctggattaaacctggtgctaaagttctataccttggtgctgcttctggaaccacagtctctcatgtgtctgatcttgttggccctgaggggtgtgtgtacgcggttgagttttctcatagaagtggtagagatttggtgaacatggcaaagaagagaaccaatgttattccaatcatcgaggatgctagacacccagctaaatacagaatgcttgtaggcatggttgatgttatcttctctgatgttgctcagccagatcaggctaggatcttggctttgaatgcatcatacttcctcaagtcaggaggacactttgtgatctcaataaaggcaaactgtatcgactccaccgttccagcagaagctgtgttccagactgaagtgaagaagcttcaacaggagcaattcaaaccagctgagcaagtgacgcttgagccatttgagcgtgaccatgcatgtgtcgttggtggctaccgtatgcctaagaagccaaaggctgctactgctgcttag

SEQ ID NO: 494 - protein, 320 aa, Arabidopsis thaliana
MRPPLTGSGGGFSGGRGRGGYSGGRGDGGFSGGRGGGGRGGGRGFSDRGGRGRGRGPPRGGARGGRGPAGRGGMKGGSKVIVEPHRHAGVFIAKGKEDALVTKNLVPGEAVYNEKRISVQNEDGTKTEYRVWNPFRSKLAAAILGGVDNIWIKPGAKVLYLGAASGTTVSHVSDLVGPEGCVYAVEFSHRSGRDLVNMAKKRTNVIPIIEDARHPAKYRMLVGMVDVIFSDVAQPDQARILALNASYFLKSGGHFVISIKANCIDSTVPAEAVFQTEVKKLQQEQFKPAEQVTLEPFERDHACVVGGYRMPKKPKAATAA

SEQ ID NO: 495 - DNA, 1152 bp, Arabidopsis thaliana
atggaggacgacgacgagattcagtcaattccatctccgggagattcttccctttcaccacaagctcctccttctccgccgattttgccaacaaacgacgtgacggtggccgtcgtgaagaaaccacaaccggggctttcttctcaatctccgtccatgaacgctttagcgttagtggttcatactccttctgtaaccggtggtggtggtagcggaaacagaaacggacgaggaggaggaggaggaagcggtggtggtggaggaggaagagatgattgttggagcgaagaagctacaaaggttctaatcgaagcttggggagatcgattctctgaaccaggtaaaggaactttgaagcaacaacattggaaagaagtagctgagattgtgaacaagagtcgtcaatgcaaataccctaaaactgatattcagtgtaagaacagaattgatacggtgaagaagaagtataagcaagagaaagctaagattgcttctggtgatggacctagtaaatgggttttcttcaagaagcttgagagtttgattggtggtactacaacattcattgcttcttcaaaagcttcagagaaggctcctatgggaggagctcttgggaatagccgttcgagtatgtttaaacggcaaactaaaggtaatcagattgtgcagcaacaacaagagaagagaggctctgattcgatgcggtggcattttaggaaacgtagtgcttctgagactgagtctgagtctgatcctgaacctgaggcttctcctgaggaatctgctgagagtctcccacctttgcaaccgattcaaccgctttcgtttcatatgccaaagcggttgaaggtggataagagtggaggtggagggagtggagttggagatgtggcgagggcgatacttggatttacggaagcttatgagaaggcggaaactgctaagcttaagttaatggcggaactggaaaaggagaggatgaaatttgctaaagagatggagttgcagagaatgcagttcttgaaaactcaattggagataacacagaacaatcaagaagaggaagagaggagcaggcagcgaggagaaaggaggatcgttgatgatgatgatgatcgcaatggcaagaataacggcaatgtaagtagctga

SEQ ID NO: 496 - protein, 383 aa, Arabidopsis thaliana
MEDDDEIQSIPSPGDSSLSPQAPPSPPILPTNDVTVAVVKKPQPGLSSQSPSMNALALVVHTPSVTGGGGSGNRNGRGGGGGSGGGGGGRDDCWSEEATKVLIEAWGDRFSEPGKGTLKQQHWKEVAEIVNKSRQCKYPKTDIQCKNRIDTVKKKYKQEKAKIASGDGPSKWVFFKKLESLIGGTTTFIASSKASEKAPMGGALGNSRSSMFKRQTKGNQIVQQQQEKRGSDSMRWHFRKRSASETESESDPEPEASPEESAESLPPLQPIQPLSFHMPKRLKVDKSGGGGSGVGDVARAILGFTEAYEKAETAKLKLMAELEKERMKFAKEMELQRMQFLKTQLEITQNNQEEEERSRQRGERRIVDDDDDRNGKNNGNVSS

SEQ ID NO: 497 - DNA, 822 bp, Arabidopsis thaliana
atgtctatagaggaagaaaacgttccaacgactgttgactcaggagctgccgatacaacggtgaaatctccggagaagaaaccggcggcgaaaggtggtaaatctaagaagacgacgacggctaaagcaacgaagaagcctgtgaaagctgctgctccaacgaagaagaaaacaacttcctctcaccctacctatgaagagatgattaaagatgcgattgtaacgttgaaggagagaactggatctagtcaatacgcgattcagaaattcatagaggagaaacataaatcactgcctcctacttttaggaagcttttgcttgtgaatctcaagagacttgttgcttctgagaaattggttaaagtcaaagcttcttttaagattccttctgctagatccgcagcaacacctaaaccggctgctccggttaagaagaaggcaactgtagtagctaaacctaagggtaaggttgctgctgctgttgctcctgctaaagctaaagcggcggctaaaggaactaagaagcctgcggctaaagttgttgctaaggctaaggttactgctaaacctaaggctaaggttactgctgctaaacctaagtctaagtctgttgctgctgtttccaagactaaagctgttgctgctaagcctaaggctaaggagagaccagctaaagcttctaggacttcgactagaacatctccagggaaaaaagttgctgctcctgctaagaaagtggctgtgactaagaaggctccggctaagagtgtgaaggtgaagtctccggcgaagagagcttcgactaggaaggctaagaagtga

SEQ ID NO: 498 - protein, 273 aa, Arabidopsis thaliana
MSIEEENVPTTVDSGAADTTVKSPEKKPAAKGGKSKKTTTAKATKKPVKAAAPTKKKTTSSHPTYEEMIKDAIVTLKERTGSSQYAIQKFIEEKHKSLPPTFRKLLLVNLKRLVASEKLVKVKASFKIPSARSAATPKPAAPVKKKATVVAKPKGKVAAAVAPAKAKAAAKGTKKPAAKVVAKAKVTAKPKAKVTAAKPKSKSVAAVSKTKAVAAKPKAKERPAKASRTSTRTSPGKKVAAPAKKVAVTKKAPAKSVKVKSPAKRASTRKAKK

SEQ ID NO: 499 - DNA, 1383 bp, Arabidopsis thaliana
atggtggtttccgatggcggcaaacgagtgaagctcaacgtcggcggcgagatcttcgaaaccaacgcgtcgaccattcaatcatcttgcccagactctctcctcgcagctctatcgacttcaacctcccatggatcgaatccggttttcatcgatcgtgacccggagattttcgccgtcattctcaatctcctccgtactggtcgactcccagctaattcctccggcgttttttccaagcaagagctactagatgaggctatgtattacggcgtcgaatcactcctcagattggcgatgttaccgccgccgctgctaggtttcgatgcgtctcttgtctccacaatcgtaccggctgctgatggagtcccgtctgctttaaccgctactgctggagacgcctctctgtggatcgctcacggtggtcagatctccgtctacgattggagtctttcccatgctggaaccgtccgtacacatctcaacgatatcacatcgatctgccgtgtctggggcgaagctgctgcaattggatctggatccgcgtcgggacttcatttctacgatctctctggaggtcgatacatcggatctacgcactggacggatccggaagatccgaggatccataaggcacgcgtcgccgccgttgctgattcggaaggtggagtattcgcatcctttgattgcctgcacagagagaacagtgttctccagatcgacaaatccactcttcaagtcgccgccgtgatcggtcagcaatctggaaactcggctaaaaccacagtaccggagaaactccggtggctgccagcgaaaggtcttttggtgggatcagccgttcaacgtggagtgtttggttgctctggctacatccggatttgggacccaaggtccaggaacatcgtatgggaaacgaacgagccaggatcgggacgaagcactaggtttggagacgccttagctgatatggacgtggacgttgaagactcgatccttttcaaggtatgttccaagtcaggagacctcggaatggcagacattcgtaaattaggtgaagatccatgggtatatatgtcagacgagaatcccggtgcctggaaagccggcgacggaggtggttacagcgtggtacattgttacagaaagcaagtgttggccgccagaggtggtgcattagaggtatggtcaagtgttaaggagaagacaagtggtgatccaattcgcaggagaaactttgtagacaaggaagatgattccaagagagggatgatttcgaaaattgaagcaggaggtgaccggctctttgtttctcgggaatgtatggaaggtgtggaggtctgggaaacttctagtttctccggtgtggtatccgtcgagtaa

SEQ ID NO: 500 - protein, 460 aa, Arabidopsis thaliana
MVVSDGGKRVKLNVGGEIFETNASTIQSSCPDSLLAALSTSTSHGSNPVFIDRDPEIFAVILNLLRTGRLPANSSGVFSKQELLDEAMYYGVESLLRLAMLPPPLLGFDASLVSTIVPAADGVPSALTATAGDASLWIAHGGQISVYDWSLSHAGTVRTHLNDITSICRVWGEAAAIGSGSASGLHFYDLSGGRYIGSTHWTDPEDPRIHKARVAAVADSEGGVFASFDCLHRENSVLQIDKSTLQVAAVIGQQSGNSAKTTVPEKLRWLPAKGLLVGSAVQRGVFGCSGYIRIWDPRSRNIVWETNEPGSGRSTRFGDALADMDVDVEDSILFKVCSKSGDLGMADIRKLGEDPWVYMSDENPGAWKAGDGGGYSVVHCYRKQVLAARGGALEVWSSVKEKTSGDPIRRRNFVDKEDDSKRGMISKIEAGGDRLFVSRECMEGVEVWETSSFSGVVSVE

SEQ ID NO: 501 - DNA, 1230 bp, Arabidopsis thaliana
atgcaaacagtgaaagctttgaggagagtgagtgaacccttacaatgggttcggtctgtttcttatggaagacgcttttctgctctcccaaactattccgcatcagatgcagatttcgaagaccaggttctggtggaaggaaaagctaaatcaagagctgccattctcaataacccatcttctctcaatgctctttctgcgcctatggttggtcggttaaagaggctatacgaatcatgggaagagaacccagctatttcctttgttttgatgaagggtagcggtaaaactttctgctctggtgcagatgtcttgtctctttatcactcgatcaatgaaggaaatactgaagaatctaaactctttttcgagaacttgtacaagtttgtatacctccaaggaacgtatttaaaaccaaatatagcaataatggatggtgtgaccatgggttgtggtggtggaatttcacttccagggatgtttcgtgtggctacagataaaactgtgttggcccatccagaggtccaaattggttttcatcctgatgcaggagcttcctattatctttcacggcttcctggttatttaggggaatacttggctctaacggggcagaaacttaatggtgtcgaaatgatagcatgtggccttgccacccactattgcttaaacgcgagacttccgttgattgaagagaggattggtaaactgttgaccgatgatcctgctgtcattgaggattctcttgctcaatatggtgatcttgtttaccctgacagtagcagcgtactgcacaagatagagttgattgataaatattttgggcttgataccgttgaagaaatcattgaagctatggaaaatgaagctgctaattcgtgcaatgaatggtgcaagaaaactctcaaacagatcaaagaagcttcacctttgagcttaaagattactttgcaatctatacgagaaggtagattccaaacccttgatcaatgtctcacacatgaataccgtatatccatttgtggagtctcaaaagtagtctctggcgacttttgcgagggtattcgagcccgtttggtagataaagactttgctccaaagtgggatcctccacgcctagaagatgtgagcaaagacatggtggattgctacttcacgccagcctcagagctcgatgattcagattctgagttgaagctgccaacagctcaacgagagccttatttttga

SEQ ID NO: 502 - protein, 409 aa, Arabidopsis thaliana
MQTVKALRRVSEPLQWVRSVSYGRRFSALPNYSASDADFEDQVLVEGKAKSRAAILNNPSSLNALSAPMVGRLKRLYESWEENPAISFVLMKGSGKTFCSGADVLSLYHSINEGNTEESKLFFENLYKFVYLQGTYLKPNIAIMDGVTMGCGGGISLPGMFRVATDKTVLAHPEVQIGFHPDAGASYYLSRLPGYLGEYLALTGQKLNGVEMIACGLATHYCLNARLPLIEERIGKLLTDDPAVIEDSLAQYGDLVYPDSSSVLHKIELIDKYFGLDTVEEIIEAMENEAANSCNEWCKKTLKQIKEASPLSLKITLQSIREGRFQTLDQCLTHEYRISICGVSKVVSGDFCEGIRARLVDKDFAPKWDPPRLEDVSKDMVDCYFTPASELDDSDSELKLPTAQREPYF

SEQ ID NO: 503 - DNA, 783 bp, Arabidopsis thaliana
atggctgaacgagtctatcccgccgattcaccaccacaaagcggacaattctccggcaacttcagctccggcgaattccccaaaaaaccagcaccaccaccatcaacatacgtaatccaagtcccaaaagatcaaatctaccgtataccaccgccggaaaacgcacaccgctttgaacaactctctcgtaaaaaaaccaaccgcagtaactgtagatgctgcttctgctcattcctcgccgcggttttcatcttaatcgtcctcgccggaatatccttcgcggttctctacctaatctaccgtcccgaagctcctaaatactccatcgaaggattctctgtttccggtatcaatctgaattcaacatctccgatttcgccgagttttaacgttaccgttagatcacgtaacggtaacggtaaaatcggggtttactacgagaaagaaagctctgttgatgtgtattacaacgacgttgatataagtaacggtgttatgccggtgttttatcagccggcgaagaatgtaacggtcgttaagttggttttaagtggttctaaaatacagttgactagtggtatgaggaaggagatgcgtaatgaggtgagtaagaaaacggtgccgtttaagttgaagattaaagctccggtgaagattaagtttggttctgttaagacgtggactatgattgttaatgttgactgtgatgtaacggtggataaattgacggcgccgtcgaggattgtgtcgagaaaatgcagtcatgacgtggatctttggtga

SEQ ID NO: 504 - protein, 260 aa, Arabidopsis thaliana
MAERVYPADSPPQSGQFSGNFSSGEFPKKPAPPPSTYVIQVPKDQIYRIPPPENAHRFEQLSRKKTNRSNCRCCFCSFLAAVFILIVLAGISFAVLYLIYRPEAPKYSIEGFSVSGINLNSTSPISPSFNVTVRSRNGNGKIGVYYEKESSVDVYYNDVDISNGVMPVFYQPAKNVTVVKLVLSGSKIQLTSGMRKEMRNEVSKKTVPFKLKIKAPVKIKFGSVKTWTMIVNVDCDVTVDKLTAPSRIVSRKCSHDVDLW

SEQ ID NO: 505 - DNA, 858 bp, Arabidopsis thaliana
atgggaagagctccatgctgtgagaagatggggttgaagagaggaccatggacacctgaagaagatcaaatcttggtctcttttatcctcaaccatggacatagtaactggcgagccctccctaagcaagctggtcttttgagatgtggaaaaagctgtagacttaggtggatgaactatttaaagcctgatattaaacgtggcaatttcaccaaagaagaggaagatgctatcatcagcttacaccaaatacttggcaatagatggtcagcgattgcagcaaaactgcctggaagaaccgataacgagatcaagaacgtatggcacactcacttgaagaagagactcgaagattatcaaccagctaaacctaagaccagcaacaaaaagaagggtactaaaccaaaatctgaatccgtaataacgagctcgaacagtactagaagcgaatcggagctagcagattcatcaaacccttctggagaaagcttattttcgacatcgccttcgacaagtgaggtttcttcgatgacactcataagccacgacggctatagcaacgagattaatatggataacaaaccgggagatatcagtactatcgatcaagaatgtgtttctttcgaaacttttggtgcggatatcgatgaaagcttctggaaagagacactgtatagccaagatgaacacaactacgtatcgaatgacctagaagtggctggtttagttgagatacaacaagagtttcaaaacttgggctccgctaataatgagatgatttttgacagtgagatggacttctggttcgatgtattggctagaaccggcggggaacaagatctcttagccgggctctag

SEQ ID NO: 506 - protein, 285 aa, Arabidopsis thaliana
MGRAPCCEKMGLKRGPWTPEEDQILVSFILNHGHSNWRALPKQAGLLRCGKSCRLRWMNYLKPDIKRGNFTKEEEDAIISLHQILGNRWSAIAAKLPGRTDNEIKNVWHTHLKKRLEDYQPAKPKTSNKKKGTKPKSESVITSSNSTRSESELADSSNPSGESLFSTSPSTSEVSSMTLISHDGYSNEINMDNKPGDISTIDQECVSFETFGADIDESFWKETLYSQDEHNYVSNDLEVAGLVEIQQEFQNLGSANNEMIFDSEMDFWFDVLARTGGEQDLLAGL

SEQ ID NO: 507 - DNA, 1140 bp, Arabidopsis thaliana
atgtctaccaccggacagattattcgatgcaaagctgctgtggcatgggaagccggaaagccactggtgatcgaggaagtggaggttgctccaccgcagaaacacgaagttcgtatcaagattctcttcacttctctctgtcacaccgatgtttacttctgggaagctaagggacaaacaccgttgtttccacgtatcttcggccatgaagctggagggattgttgagagtgttggagaaggagtgactgatcttcagccaggagatcatgtgttgccgatctttaccggagaatgtggggagtgtcgtcattgccactcggaggaatcaaacatgtgtgatcttctcaggatcaacaccgagcgaggagggatgattcacgatggtgaatcaagattctccattaatggcaaaccaatttaccatttccttgggacttccacgttcagtgagtacacagtggttcactctggtcaggttgctaagatcaatccggatgctcctcttgacaaggtctgtattgtcagttgtggtttgtctactgggttaggagcaactttgaatgtggctaaacccaagaaaggtcaaagtgttgccatttttggtcttggtgctgttggtttaggcgctgcagaaggtgctagaatcgctggtgcttctaggatcatcggtgttgattttaactctaaaagattcgaccaagctaaggaattcggtgtgaccgagtgtgtgaacccgaaagaccatgacaagccaattcaacaggtgatcgctgagatgacggatggtggggtggacaggagtgtggaatgcaccggaagcgttcaggccatgattcaagcatttgaatgtgtccacgatggctggggtgttgcagtgctggtgggtgtgccaagcaaagacgatgccttcaagactcatccgatgaatttcttgaatgagaggactcttaagggtactttcttcgggaactacaaacccaaaactgacattcccggggttgtggaaaagtacatgaacaaggagctggagcttgagaaattcatcactcacacagtgccattctcggaaatcaacaaggcctttgattacatgctgaagggagagagtattcgttgcatcatcaccatgggtgcttga

SEQ ID NO: 508 - protein, 379 aa, Arabidopsis thaliana
MSTTGQIIRCKAAVAWEAGKPLVIEEVEVAPPQKHEVRIKILFTSLCHTDVYFWEAKGQTPLFPRIFGHEAGGIVESVGEGVTDLQPGDHVLPIFTGECGECRHCHSEESNMCDLLRINTERGGMIHDGESRFSINGKPIYHFLGTSTFSEYTVVHSGQVAKINPDAPLDKVCIVSCGLSTGLGATLNVAKPKKGQSVAIFGLGAVGLGAAEGARIAGASRIIGVDFNSKRFDQAKEFGVTECVNPKDHDKPIQQVIAEMTDGGVDRSVECTGSVQAMIQAFECVHDGWGVAVLVGVPSKDDAFKTHPMNFLNERTLKGTFFGNYKPKTDIPGVVEKYMNKELELEKFITHTVPFSEINKAFDYMLKGESIRCIITMGA

SEQ ID NO: 509 - DNA, 795 bp, Arabidopsis thaliana
atggcggctccggctgccgcgacagcgagggcacaggcgctctctctcctcgccgctgctaataaccacggcgatttggcagtgaagctctcgtctcttagacaggtgaaggagattttgctgtcactggagccgtctttgtctgctgagattttcccctatctcgcagaactccacttgtcccgtgaaattctagttcgcaaatcccttatcgagatcattgaagaggttggtttgcggatgctggatcattcttatgttctagtgagtgtcttactagtcttatcaagggacgaggatccaactgttgcaaagaaatctatttctgttggcacaactttcttttgcaccatcttggaggagatggcaatgcagttccatcaccgtgggaaagttgatcgttggtgtggggaactgtggacatggatggttaagttcaaagatactgtctttgccactgcattggagcctggttgtgtaggggtgaaagttcttgctctaaagtttatggagacttttattttactctttactcctgatgcatctgatcctgagaaagcttccagcgaaggaagtagacatatgttcaatatttcctggcttgctggcggtcaccccattctgaatccagcaacgctcatgtctgaagcaaataggacatttggcatcttagtagatttcatacagtcagctaatcgtttaccgggtgcattgacgatatctgttattagttggtatgtttctgaatccatcccactatgcttgtgtaggtacttttctttatattcatcatga

SEQ ID NO: 510 - protein, 264 aa, Arabidopsis thaliana
MAAPAAATARAQALSLLAAANNHGDLAVKLSSLRQVKEILLSLEPSLSAEIFPYLAELHLSREILVRKSLIEIIEEVGLRMLDHSYVLVSVLLVLSRDEDPTVAKKSISVGTTFFCTILEEMAMQFHHRGKVDRWCGELWTWMVKFKDTVFATALEPGCVGVKVLALKFMETFILLFTPDASDPEKASSEGSRHMFNISWLAGGHPILNPATLMSEANRTFGILVDFIQSANRLPGALTISVISWYVSESIPLCLCRYFSLYSS

SEQ ID NO: 511 - DNA, 1806 bp, Arabidopsis thaliana
atggcaatgccaccacctggaaatgttactactccgtctgagaaattgcagtttcctcctccggcaaattggatcccagacgagcgagatgggtttatctcctggcttcgtgcggagttcgctgcggctaacgcgatcatcgattcgctttgtcagcatctacaagcggttggggatcacaacgagtacgaatccgtgatcggaagcattcatcatcgtcgcttagcctggtctcaagtgcttactatgcagcagtttttcccagttgcagatgtttcttacaatcttcagcagattgcttggaaaaggcaacagcaaatgccacctcaaaggcattacaattctgatcaagttgggaaatttggagcaaggagatcagggcctgggtttaacaagcatcatggtggtggtgggggttacagaggagctgattcgatggcgagaaatgggcataatttcaatggcgttaacagtgatcgtgttgagcatcgggaggaagctaagttggcaagtgatgttaaggcattgtctgttgcagaagagaagagagatggtagcgagaaaccgaggagtgatagtaaagttgagaaaaaattggaagaatctgaaactcaagaggagatagtgaagaaccataagtgtaactcgggttctaaagataacagtctcatttctgagcaaaagcaggaggagaacgataaagagtgtcctgcaagcatggcaaagacttttgtggttcaagagatgtatgatgcaaaaatggttaatgttgtcgaaggattgaagctatacgacaaaatgcttgacgcaaacgaagtttctcaactcgtttctcttgtaaccaatctgagacttgctggaagaagaggtcaacttcaaagtgaggcatatgtgggttataaacggccaaatagaggacatggacgtgagatgatccaactcggtcttcctatagctgatacgccgcctgatgatgatagtatcaaagatcgaagaatagagccaatcccatcagctctttcagacatcattgaacgtttggtctcaaagcaaatcatacctgtgaaaccagacgcatgcatcattgatttcttcagcgagggagatcactcgcagcctcatatgtttgttccctggtttggacgacccatcagtgtcttgtccttgtctgaatgtgattatacatttggaagagtcattgtctctgaaaatcccggcgactacaaaggctctctcaagctgtctctcactcccggatcggttcttttggtggaaggcaaatccgcaaatcttgctaagtatgcaattcacgcaacccgaaagcaacggatactcattagcttcatcaaatctaaaccgagaaactctaactggggaccaccgccgagcagatcgccaaatcagcacatccgtcacccaaccggcccacctaaacactaccctgttgttatcccgtccactggtgtcttgcccactccgtctcaccgcccaccaaacggagctgttcaaccgattttcatccctccttctcctccacttgcctctccaatgccgttcccaggtggtgtaccaaccgggccgcctgtctggccactgctgccacctcatccacgacaccagacagcaccacaacctcgaatgcccatcccaggcactggtgtgttcctcccacccggttcaaatcaagaactggctgacaacagcaacggaacagaaggaaaattagatttgaaggcgaaagaagaagctcgtaacggatttggtgaaggggaatgcgatggcagtaacggtaaacagagcaattag

SEQ ID NO: 512 - protein, 601 aa, Arabidopsis thaliana
MAMPPPGNVTTPSEKLQFPPPANWIPDERDGFISWLRAEFAAANAIIDSLCQHLQAVGDHNEYESVIGSIHHRRLAWSQVLTMQQFFPVADVSYNLQQIAWKRQQQMPPQRHYNSDQVGKFGARRSGPGFNKHHGGGGGYRGADSMARNGHNFNGVNSDRVEHREEAKLASDVKALSVAEEKRDGSEKPRSDSKVEKKLEESETQEEIVKNHKCNSGSKDNSLISEQKQEENDKECPASMAKTFVVQEMYDAKMVNVVEGLKLYDKMLDANEVSQLVSLVTNLRLAGRRGQLQSEAYVGYKRPNRGHGREMIQLGLPIADTPPDDDSIKDRRIEPIPSALSDIIERLVSKQIIPVKPDACIIDFFSEGDHSQPHMFVPWFGRPISVLSLSECDYTFGRVIVSENPGDYKGSLKLSLTPGSVLLVEGKSANLAKYAIHATRKQRILISFIKSKPRNSNWGPPPSRSPNQHIRHPTGPPKHYPVVIPSTGVLPTPSHRPPNGAVQPIFIPPSPPLASPMPFPGGVPTGPPVWPLLPPHPRHQTAPQPRMPIPGTGVFLPPGSNQELADNSNGTEGKLDLKAKEEARNGFGEGECDGSNGKQSN

SEQ ID NO: 513 - DNA, 1863 bp, Arabidopsis thaliana
atgacaagttcaaaaatggaacaaagatcactcctttgcttcctttatctgctcctactattcaatttcactctcagagtcgctggaaacgctgaaggtgatgctttgactcagctgaaaaacagtttgtcatcaggtgaccctgcaaacaatgtactccaaagctgggatgctactcttgttactccatgtacttggtttcatgttacttgcaatcctgagaataaagttactcgtgttgaccttgggaatgcaaaactatctggaaagttggttccagaacttggtcagcttttaaacttgcagtacttggagctttatagcaataacattacaggggagatacctgaggagcttggcgacttggtggaactagtaagcttggatctttacgcaaacagcataagcggtcccatcccttcgtctcttggcaaactaggaaaactccggttcttgcgtcttaacaacaatagcttatcaggggaaattccaatgactttgacttctgtgcagctgcaagttctggatatctcaaacaatcggctcagtggagatattcctgttaatggttctttttcgctcttcactcctatcagttttgcgaataatagcttaacggatcttcccgaacctccgcctacttctacctctcctacgccaccaccaccttcaggggggcaaatgactgcagcaatagcagggggagttgctgcaggtgcagcacttctatttgctgttccagccattgcgtttgcttggtggctcagaagaaaaccacaggaccacttttttgatgtacctgctgaagaagacccagaggttcatttaggacaactcaaaaggtttaccttgcgtgaactgttagttgctactgataactttagcaataaaaatgtattgggtagaggtggttttggtaaagtgtataaaggacgtttagccgatggcaatctagtggctgtcaaaaggctaaaagaagaacgtaccaagggtggggaactgcagtttcaaaccgaagttgagatgatcagtatggccgttcataggaacttgcttcggcttcgtggcttttgcatgactccaactgaaagattacttgtttatccctacatggctaatggaagtgttgcttcttgtttaagagagcgtcctgaaggcaatccagcacttgattggccaaaaagaaagcatattgctctgggatcagcaagggggcttgcgtatttacatgatcattgcgaccaaaaaatcattcaccgggatgttaaagctgctaatatattgttagatgaagagtttgaagctgttgttggagattttgggctcgcaaaattaatgaattataatgactcccatgtgacaactgctgtacgcggtacaattggccatatagcgcccgagtacctctcgacaggaaaatcttctgagaagactgatgtttttgggtacggggtcatgcttctcgagctcatcactggacaaaaggctttcgatcttgctcggcttgcaaatgatgatgatatcatgttactcgactgggtgaaagaggttttgaaagagaagaagttggaaagccttgtggatgcagaactcgaaggaaagtacgtggaaacagaagtggagcagctgatacaaatggctctgctctgcactcaaagttctgcaatggaacgtccaaagatgtcagaagtagtgagaatgctggaaggagatggtttagctgagagatgggaagaatggcaaaaggaggagatgccaatacatgattttaactatcaagcctatcctcatgctggcactgactggctcatcccctattccaattcccttatcgaaaacgattacccctcgggtccaagataa

SEQ ID NO: 514 - protein, 620 aa, Arabidopsis thaliana
MTSSKMEQRSLLCFLYLLLLFNFTLRVAGNAEGDALTQLKNSLSSGDPANNVLQSWDATLVTPCTWFHVTCNPENKVTRVDLGNAKLSGKLVPELGQLLNLQYLELYSNNITGEIPEELGDLVELVSLDLYANSISGPIPSSLGKLGKLRFLRLNNNSLSGEIPMTLTSVQLQVLDISNNRLSGDIPVNGSFSLFTPISFANNSLTDLPEPPPTSTSPTPPPPSGGQMTAAIAGGVAAGAALLFAVPAIAFAWWLRRKPQDHFFDVPAEEDPEVHLGQLKRFTLRELLVATDNFSNKNVLGRGGFGKVYKGRLADGNLVAVKRLKEERTKGGELQFQTEVEMISMAVHRNLLRLRGFCMTPTERLLVYPYMANGSVASCLRERPEGNPALDWPKRKHIALGSARGLAYLHDHCDQKIIHRDVKAANILLDEEFEAVVGDFGLAKLMNYNDSHVTTAVRGTIGHIAPEYLSTGKSSEKTDVFGYGVMLLELITGQKAFDLARLANDDDIMLLDWVKEVLKEKKLESLVDAELEGKYVETEVEQLIQMALLCTQSSAMERPKMSEVVRMLEGDGLAERWEEWQKEEMPIHDFNYQAYPHAGTDWLIPYSNSLIENDYPSGPR

SEQ ID NO: 515 - DNA, 1095 bp, Arabidopsis thaliana
atgaagaagaaggtgtctcagcagaagttactgtacagatggaagaggaaggtatacgccacgttgatgttcgctttctgctttgggactttcgtatttatacaagctcgtttcgcatctatacaagctcgtttcaatcgaatctctgcgtctctcgattcgcttaaaaagcctcgtctagatcagagaccacagattgccttcctcttcattgcccggaatcgactccctctcgagtttgtctgggatgctttctttaagggtgaggatggaaagttctcaatatatgttcattctagacctggatttgttctcaacgaggctacaacgcgatccaagtactttttggatcggcaacttaatgacagtatacaggtagattggggtgaatcaaccatgattgaagcagaacgtgtattgcttagacatgcacttagagattcatttaatcaccgctttgtttttctttctgatagctgcatacctctgtacagtttcagctacacgtataactacatcatgtcaacaccaactagtttcgttgatagctttgcagatacaaaagatagccgttataatcctagaatgaatcccattattcctgttcgtaactggagaaaaggatcacagtgggtcgttctgaatagaaaacacgcagaaattgtggtgaatgatacctctgtctttcctatgtttcagcagcattgcaggccagctgaaggttggaaggaacacaactgtatacctgatgagcactatgttcagacattgctatctcaaaagggtgtagatagcgaactcacacgaagatcactgacacactcagcttgggacctttcatcctcgaaaagtaatgaacgtcgtggatggcatcctatgacttacaagttttctgatgctactcctgatcttatacagtccattaagggaatcgacaatatcaactacgagactgaataccggcgagaatggtgtagcagtaaagggaaaccatcaccgtgcttcctcttcgccaggaagttcactcgtcccgccgctctccgcctactccgtgaaactatcttgttagagggcaaagagcatgacaataagtag

SEQ ID NO: 516 - protein, 364 aa, Arabidopsis thaliana
MKKKVSQQKLLYRWKRKVYATLMFAFCFGTFVFIQARFASIQARFNRISASLDSLKKPRLDQRPQIAFLFIARNRLPLEFVWDAFFKGEDGKFSIYVHSRPGFVLNEATTRSKYFLDRQLNDSIQVDWGESTMIEAERVLLRHALRDSFNHRFVFLSDSCIPLYSFSYTYNYIMSTPTSFVDSFADTKDSRYNPRMNPIIPVRNWRKGSQWVVLNRKHAEIVVNDTSVFPMFQQHCRPAEGWKEHNCIPDEHYVQTLLSQKGVDSELTRRSLTHSAWDLSSSKSNERRGWHPMTYKFSDATPDLIQSIKGIDNINYETEYRREWCSSKGKPSPCFLFARKFTRPAALRLLRETILLEGKEHDNK

SEQ ID NO: 517 - DNA, 1182 bp, Arabidopsis thaliana
atggcgtttcataacaatcactttaatcatttcaccgaccaacaacaacatcagcctcctcctccgccgcaacagcagcagcaacaacattttcaagaatcagcaccccctaattggctcctccgctccgacaacaacttcctcaatctccacacagctgcctctgccgccgctacaagctccgattctccttcttccgccgccgctaaccagtggctctcacgatcctcatccttcctccaacgaggcaacaccgcaaacaacaacaacaacgaaacatccggtgacgtcatcgaagacgttcccggcggagaggagtcaatgatcggagagaagaaggaggcggagaggtggcagaatgcgagacacaaggcggagatactgtctcatccactatacgagcaacttttgtcggcacacgtggcgtgcctgaggatcgcaacgccggtggatcagcttccgaggatagacgcacagcttgctcagtctcaaaacgtcgtggctaagtactcaactttagaagccgctcaaggactcctcgccggcgatgacaaggagcttgaccacttcatgacgcattatgtactattgctttgctctttcaaagaacaactgcaacagcatgttcgtgttcatgcaatggaagctgttatggcctgttgggagattgaacagtcgcttcaaagttttacaggggtatctcctggtgaaggcacaggagcaacaatgtctgaggatgaagatgagcaagtagagagtgatgctcatttgtttgatggaagcttagatgggttagggtttggtcctctagttcccactgagagcgagagatctttgatggaacgagtcagacaagaactcaaacatgaactcaagcagggttacaaggagaaaattgtggacataagagaggagatactgaggaagagaagagctggaaaattaccaggagacaccacctctgttctcaaatcatggtggcaatctcattctaagtggccttaccctactgaggaagataaggcgaggttggtgcaggagacgggtttgcagctcaaacagataaacaattggttcatcaatcaaagaaagaggaattggcatagcaatccatcttcttctaccgtctcaaagaataaacgccgaagcaatgcaggtgaaaacagcggaagagaccgttga

SEQ ID NO: 518 - protein, 393 aa, Arabidopsis thaliana
MAFHNNHFNHFTDQQQHQPPPPPQQQQQQHFQESAPPNWLLRSDNNFLNLHTAASAAATSSDSPSSAAANQWLSRSSSFLQRGNTANNNNNETSGDVIEDVPGGEESMIGEKKEAERWQNARHKAEILSHPLYEQLLSAHVACLRIATPVDQLPRIDAQLAQSQNVVAKYSTLEAAQGLLAGDDKELDHFMTHYVLLLCSFKEQLQQHVRVHAMEAVMACWEIEQSLQSFTGVSPGEGTGATMSEDEDEQVESDAHLFDGSLDGLGFGPLVPTESERSLMERVRQELKHELKQGYKEKIVDIREEILRKRRAGKLPGDTTSVLKSWWQSHSKWPYPTEEDKARLVQETGLQLKQINNWFINQRKRNWHSNPSSSTVSKNKRRSNAGENSGRDR

SEQ ID NO: 519 - DNA, 5268 bp, Arabidopsis thaliana
atgagcaatccaagcagttccggcttgggttcaagttcaggtttgactcatttcgggatcggtttggctaatactgttcagtcggaagttactccttacttgccgctaccgtcgttacctatattctgcggtgcggccgaacctggagagttcaagttgttcgatgaggttggccaaggtagtggctacaggtcgttggatcgcagtgagattctcgcgcaatctagtagaatcgcaaatatgcttcatgagactgacgtttcttacctggatcttagaaacgaggctagggcgcccgattgtaattctggggagcattttcagttatatgacctagttctacgatgcaatcctggagcatttgagtatgttacccccggtccgacctgcgatccactctttaccaatgaagggcctcaaaagataatttctgaaccaagtgttcctgtcaagatgcagcgacagacggatactcatttagctaggagtatcgaacctgaacctgtgaaaagggtattacgaccaaatcatgttgaagatcatagttggcagcacgaaactctgacaaaccagtcaccgaaagatgttactgcatatgactctcggcctgaaacgatcaccatgaatgaactttctgcttccaaaaagccaaagggaaagaagaaacgtaaagatgacttgtcatcagttcaaccagatccatctgtgctgcaagagtccatcgtacaaaacttttgtgagatgttggaggacttctgtggcagagctgaagtccctggtgatgatagggatgaagcagagtggtcatcagtgcccgttgatgaagttcgtgttcttataaatgaattgatgactatacggtcaaaaatgcttctgcatatggtacctgttgatattctatcaaggttactgcgcactctggatcatcagatacacagggcagaaggcttgtccatttatagtgaacattcagattcagattcagtgttgttggttcttggtgcccttgagtcaatccatgcatcgctagcagtgatggccaacagtgatatgccaaagcagctctacaaggaggagataattgagagaattctggagttttctaggcaccaaatgatggctgttatgtctgcttatgatccatcataccgcactggaagtaaaccggcagaaaatttggcatttgaaggtgatgatgatgatgataatccagatcatgacatggggtcagccagcaaaaggcggcgcatagtaaaaaacagcaaagtaaagaaggcgtcagtaaacagtaaatactgcactacagaaactttgcactattcttggcttactcaaggacctgttgttggtagaaagttaccttcctcgaaacgagcattgagagcgtatcttctccctgatgaagaacagaggcagattcaaatggtcactgctttgctcattcagttggttcacaacagcacaagccttcctgaaacctcgagacaggctgccagtggaaactctatactagagacctcagttgatgttggctaccttactaagtgtcatgaagcggctacagaaacatgttgcctcttctggactcgtgtccttgaacgatttaccagttttaagggtcaggacgcttctgagataaaattgattattgagaatcttgttatggacttactgacagcattaaatcttcctgaatatccgtctgtgtctcctattcttgaggttctctgtgtcatactgctacataatgcagggttgaaatcaaaagatgtctctgctcgaataatggccattgagttgctaggtacaatagctgcaaggttgaaacgtgatgctgtcctctgcagtaaagacagattctggacgttactagagtcagatagtgaaattagcgttgatcaagaactagacatttcaagtcgaaattggcactgtccgctttgtgtatgcaagaggcaacttcttgtactacagtcttattgcaagactgacaccaagggtactggtaagttggaatcagaagaaagcatcgaaaatccaagtatgattacaaagaccgaagttgtgcaacagatgctcttgaattaccttcaggatgtaggatcagctgatgatgtgcatactttcatttgctggttttatctgtgcctttggtataaagatgtcccaaaatctcagaataaattcaaatattacattgccagactgaaagcaaagtcaataatccgtaactctggagcaactacttcgttcttgacaagagatgctatcaagcagattactttagcccttggaatgaatagttccttttccagaggatttgataagattctgaacatgctcctggctagtttaagagagaacgctcccaacattagggctaaagctttgcgagcagttagtataattgttgaagctgatccagaggtactgtgtgataagcgtgttcagttggctgttgagggaaggttttgtgattctgcaatatctgttagagaagcagcactggaacttgttggtaggcatattgcatcacatcctgatgttggtataaagtactttgagaaggtcgctgagaggattaaggatactggagtgagtgttcgaaaacgagccatcaagataatacgtgacatgtgtacttcaaatcccaacttctctgaatttacaagtgcgtgcgctgagatattatctcgtatcagtgatgatgagtctagtgttcaggatcttgtgtgcaaaactttctatgaattttggtttgaggaacctccagggcatcatactcagtttgctagtgatgctagctccattccactggaactggagaagaaaaccaagcaaatggtagggttgttaagcaggaccccaaatcaacagctgcttgtaacaattattaagcgtgccctggccctggatttttttcctcaagcagctaaagctgctggtattaacccagttgctcttgcatcagtacgcaggcgctgcgagctgatgtgcaagtgcttactggaaaaaatattacaggtagaagaaatgagccgtgaagaaggagaggtgcaagtacttccttatgtacttgttttgcatgctttctgtctggtggatcctgggctgtgtacaccggcttcagaccctactaagtttgtcatcaccctacagccatatctgaagagtcaggctgatagtagaacaggagcacagttactggagagtattattttcattatcgattctgtcctacccttgatccgcaagctgcctctaagtgtcacagaagatctggaacaggatctaaagcatatgattgttcggcattcgtttctaactgttgtgcatgcttgcgttagtaaattggcggggaaaggtgttagcatagttgagcatcttcttcagttcttttttaagcggctggaggcccaaggttccgataacacacagattgctgggcggtcccttttttgtcttggcttgcttattcgccatggaaactctcttattagtacctcaggtggcaagaatttcaatctctctggctgtcttaatttgtttaaacgacatctccgaacggaagatattgctttgaaagtcaggtcgctgcaggctttaggattcatcctaattgcacgacctgagtacatgttggaagaagacattggaaagataatcgagactacattagcagatgaagcaaatgggcgtatgaagatgcaagcattacaaaacatgtatgaataccttcttgatgcggaaaaacaattgggatcagagaaagccagtgataacacggttaactcagttgaacaaggtggccataatgtacctgtggccgctggtgcaggtgacaccaacatttgcggaggcattgtgcagttgttttgggataaaatattaggtagatgcttggactttgatgatcaaattcgccagacctctctcaagatagtggaagttgtactacgtcaaggcctagtgcatcctattacgtgtgttccttatttgattgccctcgagacagatcctcaagaggccaaccaaaagctggcccatcatttactaatgaatatgcatgagaagtatccggctttttttgagagccgtcttggtgacggacttcaaatgtcgtttatcttcatgcaatccatcagccaggtcacttcagaaccaaatcaaagtcttcagcaaaagggttcaacaaacatgttgggcaaaaatgatcatgctagtagtactctcacccaagctagacttggagtctctaggatctacaagcttatccgtggaaaccgggtttctcgaaacaaatttatgacttcgattgttcgcaagtttgataatccaacctggaatggctcagtaatatcgtttctgaagtattgcactgaaacccttgctttacttccattcacatcacctgatgaaccactctatcttgtatattccataaaccgagttatgcagattcgggctggagcagttgagtcaaatttgaaggctttgttacataaagattccgcaaagactcagcatggaaatggagcataccaacaagatccgattcccggacatatgaacatgatggatctaaacacaagaatccaagaagaaccaagacattggaattcctatggccatgcaactctaattgacctcaatggatcagtataccaagattcaagggatcagttcacttcatatcaagtccataatgggaaagcagatgtgcacaagatgacctcatctgatcctcctgaattatccactgatgatctgcagaaaattcaggtagtcttcatggctttttcccctgtgatgcttagggttgattgcttagcagctatagctatacaacttcttttgaagctcaagagatacctaaaagtcacgtacagcttaaatgatgaccggtgccaagcctattctccaacggaaccattgaagccaggagatcctctctccagacaaagcgttgcctttgacctcagcgaaactcgcactgacttaccttcaacatatcaagacttagttcagagatatcaggagtttaagaacgcaatgagagaagatacggttgacttcaccatctattcaacaaacgtcaagagaaaacgcccaacgccaaggaaaacttcaagatctgctaaaaaaacagtggcctacaacgaagatgatgatgatgacgacaatgatgacagaggatggcatggaggaggaggaagaggagctgctcggagactaaattacagcaccagaagtagcaacagaaggtaa

SEQ ID NO: 520 - protein, 1755 aa, Arabidopsis thaliana
MSNPSSSGLGSSSGLTHFGIGLANTVQSEVTPYLPLPSLPIFCGAAEPGEFKLFDEVGQGSGYRSLDRSEILAQSSRIANMLHETDVSYLDLRNEARAPDCNSGEHFQLYDLVLRCNPGAFEYVTPGPTCDPLFTNEGPQKIISEPSVPVKMQRQTDTHLARSIEPEPVKRVLRPNHVEDHSWQHETLTNQSPKDVTAYDSRPETITMNELSASKKPKGKKKRKDDLSSVQPDPSVLQESIVQNFCEMLEDFCGRAEVPGDDRDEAEWSSVPVDEVRVLINELMTIRSKMLLHMVPVDILSRLLRTLDHQIHRAEGLSIYSEHSDSDSVLLVLGALESIHASLAVMANSDMPKQLYKEEIIERILEFSRHQMMAVMSAYDPSYRTGSKPAENLAFEGDDDDDNPDHDMGSASKRRRIVKNSKVKKASVNSKYCTTETLHYSWLTQGPVVGRKLPSSKRALRAYLLPDEEQRQIQMVTALLIQLVHNSTSLPETSRQAASGNSILETSVDVGYLTKCHEAATETCCLFWTRVLERFTSFKGQDASEIKLIIENLVMDLLTALNLPEYPSVSPILEVLCVILLHNAGLKSKDVSARIMAIELLGTIAARLKRDAVLCSKDRFWTLLESDSEISVDQELDISSRNWHCPLCVCKRQLLVLQSYCKTDTKGTGKLESEESIENPSMITKTEVVQQMLLNYLQDVGSADDVHTFICWFYLCLWYKDVPKSQNKFKYYIARLKAKSIIRNSGATTSFLTRDAIKQITLALGMNSSFSRGFDKILNMLLASLRENAPNIRAKALRAVSIIVEADPEVLCDKRVQLAVEGRFCDSAISVREAALELVGRHIASHPDVGIKYFEKVAERIKDTGVSVRKRAIKIIRDMCTSNPNFSEFTSACAEILSRISDDESSVQDLVCKTFYEFWFEEPPGHHTQFASDASSIPLELEKKTKQMVGLLSRTPNQQLLVTIIKRALALDFFPQAAKAAGINPVALASVRRRCELMCKCLLEKILQVEEMSREEGEVQVLPYVLVLHAFCLVDPGLCTPASDPTKFVITLQPYLKSQADSRTGAQLLESIIFIIDSVLPLIRKLPLSVTEDLEQDLKHMIVRHSFLTVVHACVSKLAGKGVSIVEHLLQFFFKRLEAQGSDNTQIAGRSLFCLGLLIRHGNSLISTSGGKNFNLSGCLNLFKRHLRTEDIALKVRSLQALGFILIARPEYMLEEDIGKIIETTLADEANGRMKMQALQNMYEYLLDAEKQLGSEKASDNTVNSVEQGGHNVPVAAGAGDTNICGGIVQLFWDKILGRCLDFDDQIRQTSLKIVEVVLRQGLVHPITCVPYLIALETDPQEANQKLAHHLLMNMHEKYPAFFESRLGDGLQMSFIFMQSISQVTSEPNQSLQQKGSTNMLGKNDHASSTLTQARLGVSRIYKLIRGNRVSRNKFMTSIVRKFDNPTWNGSVISFLKYCTETLALLPFTSPDEPLYLVYSINRVMQIRAGAVESNLKALLHKDSAKTQHGNGAYQQDPIPGHMNMMDLNTRIQEEPRHWNSYGHATLIDLNGSVYQDSRDQFTSYQVHNGKADVHKMTSSDPPELSTDDLQKIQVVFMAFSPVMLRVDCLAAIAIQLLLKLKRYLKVTYSLNDDRCQAYSPTEPLKPGDPLSRQSVAFDLSETRTDLPSTYQDLVQRYQEFKNAMREDTVDFTIYSTNVKRKRPTPRKTSRSAKKTVAYNEDDDDDDNDDRGWHGGGGRGAARRLNYSTRSSNRR

SEQ ID NO: 521 - DNA, 945 bp, Arabidopsis thaliana
atggtaggaagcaaagaaaaatcgaaagagaaacgagataagagactccaagagatctccctccttcgtactattccctattctgatcaccagaggtggtggacctctgaaaccgtggcggtggtaacaggtgcgaatagaggaataggatttgagatggtgagacaattggctggacatggactaacagttattctaacatcaagagacgagaatgtaggcgtcgaagccgccaagatccttcaagaaggtggattcaatgttgatttccaccgcctcgatatcttggactcttcctcaatccaagagttttgcgaatggattaaagaaaaatatggatttattgatgttttaattaataatgcaggagtaaactacaatgttggatcagataactctgttgaattctcgcatatggttatatctaccaactactatggcaccaagaacataatcaacgccatgattccactaatgagacatgcttgtcaaggagctcgtattgtcaatgtcacttcaaggctcggtagattaaaaggccgacacagtaaacttgagaatgaagacgtgagagccaagcttatggatgtggactctctaactgaagaaatcgttgacaaaacagtatcagagtttttgaaacaagtggaagaaggaacatgggaatctggaggttggccacattccttcacagactactctgtctccaaaatggcggtgaacgcatacacaagagtactagctaaagaactatccgagagaccagagggagagaagatatatgcaaactgtttttgtcccggttgggtgaaaaccgcaatgacaggctatgcagggaacgtttcagcagaagatggagctgacactggagtctggcttgcattgcttcctgatcaagctatcaccggaaagttcttcgccgagagacgtgagatcagtttctaa

SEQ ID NO: 522 - protein, 314 aa, Arabidopsis thaliana
MVGSKEKSKEKRDKRLQEISLLRTIPYSDHQRWWTSETVAVVTGANRGIGFEMVRQLAGHGLTVILTSRDENVGVEAAKILQEGGFNVDFHRLDILDSSSIQEFCEWIKEKYGFIDVLINNAGVNYNVGSDNSVEFSHMVISTNYYGTKNIINAMIPLMRHACQGARIVNVTSRLGRLKGRHSKLENEDVRAKLMDVDSLTEEIVDKTVSEFLKQVEEGTWESGGWPHSFTDYSVSKMAVNAYTRVLAKELSERPEGEKIYANCFCPGWVKTAMTGYAGNVSAEDGADTGVWLALLPDQAITGKFFAERREISF

SEQ ID NO: 523 - DNA, 1914 bp, Arabidopsis thaliana
atggtgaagattcatcctgacaaggcgtttcctgtggattttagcgtgggagaaggcaagacttcgccgtacttaacgacggagaaagagagtttcacgatttggatgagatctcttgtgtttcatagtaaaggctgcacagtttttgattccaaaggaaacttaatctatcgagtggataattataactccaagagttgtagtgaagtttaccttatggacttatacggcaaaatcttgtttacattacgtcaaaagaaattgggattattcaaatcttggaaaggatataactcaaccgggacaagatttcaactaagaaaaaacttcaagatattgccaaagggttcatcttcatcatacaaagttgtaatgggatcgcgtatagttgatggtgatcatcaatcttgttataagattgtaaaacgcaaatcggttttcacaatcgaggatggatcaggaagattattggcagaagttaaaaagaaacaatcaaatatcaaaagtttagatcttgggaaagatgtattaacaatgatggtggagccacaacttgaaactgagattttcgaagaattcatcaaaatgtggagagaatcggcttcgtttatcctcgataagcatcagaacaacaaacccatttctctaactcattcaattgattctcctccaccaccatctgcttcaatggcggatgaaaaccctaaccctaatcctatttcggcttattaccaaaccagagcggcgcatcatggaattgtgactagcgagtggttggagcaggctcaagccgcggttcgacgttaccctgatcgtgattccttagtttcgggaagaccctttagcgtgattgaggactttaatagttggagacagcaacctgatttggcggaggctgttgcggcgattcgtgctcttgcggctgttattagggctagtgaagctactactatgatggaacttgaaattgaactcaagaaagcttctgatactctgaaatattttggttcatgccctgacgataacttaggattagcttgcggcgtaaatggtagatgtgatcatcatcgtggcattgcattgacttgtcgagttgtgaattttgcttggcattatatgtccgaactctctggtggctctaaagggaaagataggttgaaagttttatctttcctggatgatgtgtttatgtcatgggacacaacgtcgatatccttaacagcgggatgtgatctattcatgcgctatgtgactcgaacatctgctttagaatttgaggacttcaactctgcgaaatcccgtgtgcttgaacgtgctgagaaatttggggaaatatcttgcaaggcccgaacgataattgcaatgcttagtcaagatttcatatttgatgggtgtactattctggtccatggtttctccagagttgtgtttgaaatactaaagacatcagcgcaaaacaagaaactctttcgagtgttgtgcacaggtgtactgctagctaacgagcttgcaaaacttgatattcctgtgaagcttctgatcgattcagccgtggcctatagcatggatgaagtagacatggtgtttgttggagctgatggagtagttgaaagtggcgggataattaacatgatgggaacttaccaaatcgccctagtcgcacagagtatgaataaaccagtctatgtagctgcagagagttacaagtttgcacggctctacccgttggatcaaaaggacttagaaccagccttgcgacctattgatttcagtgttcctgttcctcctaaggttgaggtagaaagatctgcaagggactacactcctcctcagtacttgactctactcttcactgatcttggtgttctcactccatctgtagtaagtgacgagcttattcagctttacttgtaa

SEQ ID NO: 524 - protein, 637 aa, Arabidopsis thaliana
MVKIHPDKAFPVDFSVGEGKTSPYLTTEKESFTIWMRSLVFHSKGCTVFDSKGNLIYRVDNYNSKSCSEVYLMDLYGKILFTLRQKKLGLFKSWKGYNSTGTRFQLRKNFKILPKGSSSSYKVVMGSRIVDGDHQSCYKIVKRKSVFTIEDGSGRLLAEVKKKQSNIKSLDLGKDVLTMMVEPQLETEIFEEFIKMWRESASFILDKHQNNKPISLTHSIDSPPPPSASMADENPNPNPISAYYQTRAAHHGIVTSEWLEQAQAAVRRYPDRDSLVSGRPFSVIEDFNSWRQQPDLAEAVAAIRALAAVIRASEATTMMELEIELKKASDTLKYFGSCPDDNLGLACGVNGRCDHHRGIALTCRVVNFAWHYMSELSGGSKGKDRLKVLSFLDDVFMSWDTTSISLTAGCDLFMRYVTRTSALEFEDFNSAKSRVLERAEKFGEISCKARTIIAMLSQDFIFDGCTILVHGFSRVVFEILKTSAQNKKLFRVLCTGVLLANELAKLDIPVKLLIDSAVAYSMDEVDMVFVGADGVVESGGIINMMGTYQIALVAQSMNKPVYVAAESYKFARLYPLDQKDLEPALRPIDFSVPVPPKVEVERSARDYTPPQYLTLLFTDLGVLTPSVVSDELIQLYL

SEQ ID NO: 525 - DNA, 1677 bp, Arabidopsis thaliana
atgtcgtcggaatctgaaatcccgccgttgtcgtcatcaaccgccgcagcggaggaatctggagagaagaccagcaagaaagcggctaagaaggaagctgccaagctagagaagttaagacgtcgtcaagaacaagaggaagcaacgcgtcgaacagcttcgatctctctggaagagaatgacgagttttccaataactacggcgacgtgactcttaccgagttgcaatcgtcggcggatccgaaagccgggaagtggatagaggctgttgagggaaaggagtggaccgatgtgagcgatttggtggaagagatgttggaatcagaggttctgatcagaggccgagtgcacacgaatcgtccaacgtctaacaaattggggtttgtggtcttgagggagagcggatcaactgttcagtgcgtggttagccaatcagagaagaccaaagtaggtgccaacatggttaaatacctcaagcagctgagtcgcgaatcctttgtcgatgttatcggtgtcgtcactctccccaaggagccgctgacgggaactacgcagcaggttgaaattcaagtgagaaaagtgtactgcatcaacaaatccttggccaaattaccacttagtgtggaggatgctgctcggagtgaagcagatatcgaagcatctcttcagactccatctccagctgctcgtgtcaatcaggatacacgtttgaactatagggtgctcgacctcagaacaccggctaatcaagccatcttccagcttcagtacgaagtcgaatatgccttcagagaaaaattacgatttaagaattttgttggaatccacacaccaaaactgatggctggtagtagtgaaggaggttctgctgtatttaggttggaatacaaagggcaacctgcttgtctagctcagtctcctcagctccacaagcaaatggcaatatgtggtgacttgcgacgtgtctttgaggtaggtcctgttttcagggccgaagactccttcactcatagacacctgtgtgaattcgttggtcttgatgtggagatggagattcggaaacactattctgagataatggatcttgtggacgagttatttgtgtttatattcactagtttgaatgagaggtgcaaaaaagaactgcaagctgttggaaagcaatacccatttgaacctttgaagtttctaccaaaaacattgaggttaacgtttgaagaaggggttcaaatgcttaaggaagctggtgtggaggttgatcctcttggcgatctaaacactgaatctgagagaaaactaggccagcttgtattggaaaagtacaacactgagttctatattctgcatcggtatcctaaggcagttaggcctttctacacaatgacttgtgccgataatcctctttacagcaactcttttgatgtcttcatcagaggtgaggagatcatatcaggagctcaacgtgtccatatcccagaagtcttggagcaacgtgcaggagaatgtggcattgatgtcaagacaatatccacatacattgattcattcaggtacggtgcgcctctacacggtggatttggagtggggctggagcgagtggtcatgcttttctgtgcactgaacaacattcggaaaacatccctcttccctcgtgaccctcaaaggctttcaccctaa

SEQ ID NO: 526 - protein, 558 aa, Arabidopsis thaliana
MSSESEIPPLSSSTAAAEESGEKTSKKAAKKEAAKLEKLRRRQEQEEATRRTASISLEENDEFSNNYGDVTLTELQSSADPKAGKWIEAVEGKEWTDVSDLVEEMLESEVLIRGRVHTNRPTSNKLGFVVLRESGSTVQCVVSQSEKTKVGANMVKYLKQLSRESFVDVIGVVTLPKEPLTGTTQQVEIQVRKVYCINKSLAKLPLSVEDAARSEADIEASLQTPSPAARVNQDTRLNYRVLDLRTPANQAIFQLQYEVEYAFREKLRFKNFVGIHTPKLMAGSSEGGSAVFRLEYKGQPACLAQSPQLHKQMAICGDLRRVFEVGPVFRAEDSFTHRHLCEFVGLDVEMEIRKHYSEIMDLVDELFVFIFTSLNERCKKELQAVGKQYPFEPLKFLPKTLRLTFEEGVQMLKEAGVEVDPLGDLNTESERKLGQLVLEKYNTEFYILHRYPKAVRPFYTMTCADNPLYSNSFDVFIRGEEIISGAQRVHIPEVLEQRAGECGIDVKTISTYIDSFRYGAPLHGGFGVGLERVVMLFCALNNIRKTSLFPRDPQRLSP

SEQ ID NO: 527 - DNA, 1785 bp, Arabidopsis thaliana
atgccggagaaaggaatgattttcccgccggtaccgagccaattggtgattttacggccaagccctcttcttcaatggcggcttggtgctcttacagcactcgtctgcttccttatgttagtcgtttggagtattgacggttgttcgattcaaagcttcgttcagccatggagattcaatgcttactctgttcgaatcagtccttctccgtcgccgtttatgtcaacgaaacccaatctagtatcagagaaacctcaccgccaaaatctcaccttgatgatggctccacgaaatctggttccgaagaagacgaatctcacttcaaactcgacccgggtccagttcgagtggataaccgctggatctcagaagaatttcacggcgaatttgatgagaggttggttggctccgggaggagcgccgtgtagagaagcgaagaccgtcgagatttcagttcccggtgtcgacgggattgattctgtggagttaaccgccggagagattcatgaattcaaatttcaagccatagacgaatctggaaaaaacgtttgcattggtggggactatttcgagactgatatatccggcgagaactggaaatcgagaccaccggtgaaagatttcggcaacggaacttactctttctctttacaggttcatcctgagttcgccggagatttcaatctcaccgtcattttactcttccgtcattaccaaggtcttaagtttagtacctcacgtttaggctttgaccgaaagcttcgcaatgttagattacgctttgttaagacgcctgacgttactctgccggagctccggtcatgtaaaaaatctgattttaacagagatgcttggtctggacgatggactaggcttgggaagaatgatgagtgtcagattagcaatgacgggcgttaccgctgcctcgctgcggatttcccttgccggaaaccgtggtgcgacggtgcggttggagctatagagagtaatggttgggtttactctagccattgctctttcaagctcttctctgcggaaaaggcttgggattgcttgaaaggcaaatggattttcttctggggagattcgaatcatgttgattcgatcagaaacttgctgaatttcgtcttgggtcatcctgaaatccccgctgtcccgaggaggttcgatatgaagttttcgaatccgaagaacccttcggagactgttaggatcacgagtatctttaacggtcattggaacgagaccaagaactatcagggccttgattcgcttaaagacagggactttagagaattgctcaagaagtacttcaacgaagaaacaaaccgtgttcccgacgtgatgatcgtgaactcgggtctacacgacgggattcactggactagtcttagagcctttgcgaaaggtgctgaaaccgcagctgcgttttggagagaagtttttgacggggtcaaaagcagaggattgcaaccgccagaagtgattttcaggaacacaatcgcgacaggcgggtacgcgagaatgctagcgtttaacccgagcaaaatggaggcgtttaacggagtgtttctcgagaaaatgagggatgcgggattggtcacgagcgtagttgataacttcgatatgacgtatccgtggcactacgataaccgttgcaacgatggagttcattacggaagagctccagcgaaaatgcggtggagggacggtgagattggacatcagtactttgtggacttgatgctcgttcacgtattgctgaatgcattgtgtgtaagatag

SEQ ID NO: 528 - protein, 594 aa, Arabidopsis thaliana
MPEKGMIFPPVPSQLVILRPSPLLQWRLGALTALVCFLMLVVWSIDGCSIQSFVQPWRFNAYSVRISPSPSPFMSTKPNLVSEKPHRQNLTLMMAPRNLVPKKTNLTSNSTRVQFEWITAGSQKNFTANLMRGWLAPGGAPCREAKTVEISVPGVDGIDSVELTAGEIHEFKFQAIDESGKNVCIGGDYFETDISGENWKSRPPVKDFGNGTYSFSLQVHPEFAGDFNLTVILLFRHYQGLKFSTSRLGFDRKLRNVRLRFVKTPDVTLPELRSCKKSDFNRDAWSGRWTRLGKNDECQISNDGRYRCLAADFPCRKPWCDGAVGAIESNGWVYSSHCSFKLFSAEKAWDCLKGKWIFFWGDSNHVDSIRNLLNFVLGHPEIPAVPRRFDMKFSNPKNPSETVRITSIFNGHWNETKNYQGLDSLKDRDFRELLKKYFNEETNRVPDVMIVNSGLHDGIHWTSLRAFAKGAETAAAFWREVFDGVKSRGLQPPEVIFRNTIATGGYARMLAFNPSKMEAFNGVFLEKMRDAGLVTSVVDNFDMTYPWHYDNRCNDGVHYGRAPAKMRWRDGEIGHQYFVDLMLVHVLLNALCVR

SEQ ID NO: 529 - DNA, 1284 bp, Arabidopsis thaliana
atgaggtacgatcaggaagcgggatcgtcctcccattcgctgccttcgggatcatcctcccattcgctgccgccgacggaagacactcctcttttggggcctcgaacattgtcgtcgcagccaaaaacctttgcaaatgtcttcatcgccatcgtcggcgccggcgtgctcggacttccgtacaccttcaagaagactggatggctcttgggcctcctcacactcctcttcgtatcctccctcaccttcttctgtatgatgctcctcgtccacacccgccggaaactcgagtccctctccggcttcaacagcatcacttctttcggagatctcggcgaatccgtctgcggccctgccggtcgtctcgtcgtcgatgttatgcttgtcctttcccaatctggcttctgcgtcagttaccttatcttcgtcgccaccacaatggctaatctcctcagccgcggcaccgaacatattctaggcctcgatgctgcttccatttacctctggggatgtttcccctttcagctgggtctcaactccatcccatcgctcacccatctcgcccctttgagtatattcgccgatatcgtggacgtagccgccaccttagtggttatggtgcaggatgttttcatcttcctgaaacgaagacctcctttgagagtctttggaggtgtctctgttttcttctacggattgggagttgcggtgtacgcatttgaagggatcggaatggttctgccactggaactagaggctaaatacaaagacaagttcggtagagcgctggggctagccatgggcttaatctcgatcatgtacggtgcgttcgggctgctagggtacatggcttacggagaggagacgaaagacatcatcaccaccaacctggggacaggagtggtgagcactctggtgcagctgggcttagcaatcaacctcttcttcacattcccccttatgatgcaacctgtctacgaggtcgtggaacgccgcctttgcagctcccgttactctgtatgggtgcgctgggccactgtgctggtggtcacgctcgtggccctgctcgtcccaaattttgcagacttcttatctctggtggggagcagcgtctgcgtggtgctgggctttgtcttgccatcactatttcacttgcaggctttcaaaaacgagttgagcatcacaagaatagtggtagacgttctcgttttcctcattggtgttatgatagccattaccgggacctggactgcagtacatgagatcctgacatccaaggcctga

SEQ ID NO: 530 - protein, 427 aa, Arabidopsis thaliana
MRYDQEAGSSSHSLPSGSSSHSLPPTEDTPLLGPRTLSSQPKTFANVFIAIVGAGVLGLPYTFKKTGWLLGLLTLLFVSSLTFFCMMLLVHTRRKLESLSGFNSITSFGDLGESVCGPAGRLVVDVMLVLSQSGFCVSYLIFVATTMANLLSRGTEHILGLDAASIYLWGCFPFQLGLNSIPSLTHLAPLSIFADIVDVAATLVVMVQDVFIFLKRRPPLRVFGGVSVFFYGLGVAVYAFEGIGMVLPLELEAKYKDKFGRALGLAMGLISIMYGAFGLLGYMAYGEETKDIITTNLGTGVVSTLVQLGLAINLFFTFPLMMQPVYEVVERRLCSSRYSVWVRWATVLVVTLVALLVPNFADFLSLVGSSVCVVLGFVLPSLFHLQAFKNELSITRIVVDVLVFLIGVMIAITGTWTAVHEILTSKA

SEQ ID NO: 531 - DNA, 1119 bp, Arabidopsis thaliana
atggaaaacggagaagcaaaacagagtgtacctcttctcactccctataagatgggaagattcaatctttcccatagggttgttctagcaccattgacgagacagagatcgtacggaaacgttcctcagcctcacgctgccatatattactctcagagaacgactccaggaggttttctcatcactgaagccactggagtttcagatacagctcaaggatatcaagatactcctgggatatggactaaagagcatgtggaggcatggaagccaatcgttgatgctgtacatgccaaaggtggtatcttcttctgtcagatctggcatgttggccgcgtttctaatagcgggtttcagccaaatggaaaagctcctatctcttgttcggataagccattgatgcctcaaattcgctctaatggcatcgatgaagctctctttacccctccaagacggcttggtatcgaagaaatccccggcattgtcaatgattttaggcttgctgcaagaaatgctatggaagctggttttgatggagttgagattcatggagctaatggctatctgattgaccagttcatgaaggatacggtgaatgatagaactgatgaatacggtggatcattgcaaaaccgttgcaaatttcctctagaaatagtcgatgcagttgctaaggagatcggaccagaccgtgttggaatcaggctctctccatttgctgactacatggaatctggagacactaatccaggagcattagggctttatatggcggaatctttgaacaaatacggaatcctctactgtcatgtgattgaagcgagaatgaaaacaatgggagaagtacatgcttgtcctcacacactaatgccgatgaggaaagcgtttaaggggacttttatctccgcaggaggtttcacgagggaagatgggaatgaggctgtgtcaaagggaagaactgatttggtggcttatggtcgatggtttctagccaacccggacctgccaaagaggttccaagtggatgcaccgctgaataagtacgatagaccaacgttttacacttctgatccagtcgtcggttacaccgattaccctttcctcgaatcaacagcttaa

SEQ ID NO: 532 - protein, 372 aa, Arabidopsis thaliana
MENGEAKQSVPLLTPYKMGRFNLSHRVVLAPLTRQRSYGNVPQPHAAIYYSQRTTPGGFLITEATGVSDTAQGYQDTPGIWTKEHVEAWKPIVDAVHAKGGIFFCQIWHVGRVSNSGFQPNGKAPISCSDKPLMPQIRSNGIDEALFTPPRRLGIEEIPGIVNDFRLAARNAMEAGFDGVEIHGANGYLIDQFMKDTVNDRTDEYGGSLQNRCKFPLEIVDAVAKEIGPDRVGIRLSPFADYMESGDTNPGALGLYMAESLNKYGILYCHVIEARMKTMGEVHACPHTLMPMRKAFKGTFISAGGFTREDGNEAVSKGRTDLVAYGRWFLANPDLPKRFQVDAPLNKYDRPTFYTSDPVVGYTDYPFLESTA

SEQ ID NO: 533 - DNA, 1599 bp, Arabidopsis thaliana
atgagagaacggattattacattcgtttcgctgcttcttgtagctttgctttcgtttcccagtgttagctactgtgacgaccaaacgatcctgtatgaatcgtttgacgagccttttgatggtcgctgggtcgtttcagagaaagctgaataccaaggtgtgtggaagcacgagaagagtgaagggcatgatgattatggacttctagtgagtgagaaagctaagaagtacggaatagttaaagagcttgatgttgatgagcctctaaaccttaacgaaggaactgttgttcttcaatacgaggctcgtttccaagaagggcttgagtgtggtggtgcttacttaaagtatcttcgtcctcaagaagctggatgggttcctcaagggtttgataatgattctccttactctatcatgtttggacctgataagtgtggtgctaccaacaaggttcatttcatcttgaagcataagaatcccaagagtggcgagtttgttgagcaccatctcaagttccctccttctgttccgtttgacatgctttctcatgtctacactgcggtcttgaaatctgataatgaggtgaggattttggtcgatggtgaggagaagaagaagggtaatttactgtctgctgaagactttgagcctccgttgattccttccaagaccatccctgatccagaggacaagaagccagaagactgggatgagagagccaagattcctgatcctaatgctgtgaagcctgatgactgggatgaggatgcacccatggagattgaagatgaggaagctgagaaacccgaaggatggttggatgatgagcctgtagaggttgaagaccccgaggcaagcaagccagaagattgggatgacgaggaagatggtgagtgggaggctcctaaggtttccaacaccaagtgtgaggcagcacccggatgtggcgaatggaagagaccgatgaagaggaaccctgcttacaagggcaaatggagctcacctctcatagataacccagcttacaagggaatctggaaaccaagagacattccaaatcctgattattttgagcttgagaggccgaatttggagcccattgctgccattggtattgagatatggacaatgcaagacggtatcttatttgacaacatcttgatatctaaagacgagaaggttgctgaaacttacagacaaagcacttggaagcccaagtttgatgtggagaaagagaaacaaaaggcagaggatgaagctgctggtgaggcagatggtctcaagagttaccagaagaaggtgttcgacctcttgtacaaggttgcagacatttctttccttagtgcgtacaagtcaaagattatggaacttattgagaaagctgaaacacagccaaacttaaccatcggtgtgctcatttccatcgtgatcgtcttcctctctctcttcttcaagctcatatttggtggtgcaaaggctaaggtagaaaagaagaaaccggaaacagctgcagagacctcgacaagcgaggcaaagacagaggagaaagcagaagcggtggctgcaccacgaaagaggcagacgaggcgtgagagttag

SEQ ID NO: 534 - protein, 532 aa, Arabidopsis thaliana
MRERIITFVSLLLVALLSFPSVSYCDDQTILYESFDEPFDGRWVVSEKAEYQGVWKHEKSEGHDDYGLLVSEKAKKYGIVKELDVDEPLNLNEGTVVLQYEARFQEGLECGGAYLKYLRPQEAGWVPQGFDNDSPYSIMFGPDKCGATNKVHFILKHKNPKSGEFVEHHLKFPPSVPFDMLSHVYTAVLKSDNEVRILVDGEEKKKGNLLSAEDFEPPLIPSKTIPDPEDKKPEDWDERAKIPDPNAVKPDDWDEDAPMEIEDEEAEKPEGWLDDEPVEVEDPEASKPEDWDDEEDGEWEAPKVSNTKCEAAPGCGEWKRPMKRNPAYKGKWSSPLIDNPAYKGIWKPRDIPNPDYFELERPNLEPIAAIGIEIWTMQDGILFDNILISKDEKVAETYRQSTWKPKFDVEKEKQKAEDEAAGEADGLKSYQKKVFDLLYKVADISFLSAYKSKIMELIEKAETQPNLTIGVLISIVIVFLSLFFKLIFGGAKAKVEKKKPETAAETSTSEAKTEEKAEAVAAPRKRQTRRES

SEQ ID NO: 535 - DNA, 2427 bp, Arabidopsis thaliana
atggattctagagctattctcgattccgctttgtttcaactcactcctactcgcactagattcgatctggttctattctgtgggagtaagaaggagaagctagcttcagggatttttgaaccattcgtctctcatcttaagttcgctagagatcagatctctaaaggcggttactccatttctctgactcctccttcttctcactcttcttggttcaccaaatccacttttgatcggtttgtgagatttgtaaacacgcctgcgattatcgaaagatttgcgactctggagaaagagattttgcagattgagaattctattcaagctaatgaaattgccaatgctgctgatgctctgcaattacaagacgggagtaattctggagatagcagtaatctaaagaagtcgaatgagtcctctaagaaggaatctgagaatggcaatgaggtggtaggagaggaaacctctaagattcaacttcaacgtcttcttgaaactagaagaacattgcttcgaagagagcaagcaatggcttatgcacgaggggttgttgctggttatgaaattgatagtattgatgatctcattttatttgctgatgctttcggggcttcaaggttaagagaagcatgcataatgtataaagaactatggaagaagaagcacggtgatgggctttggatggcggaattagcagctgtgaaagcgtgtgctccagtggacatgtcattgttgggttcctcaggcatcatcctcactaatgaaggtgctgctctatcactaaatgggacagactcaatgccatctaatacagatgacaagtcagttaatttagagcaacatccgtccggtgttccaaactttcaagcaccaatgggatggccaaaccatatgcctcaatacttttacccgtctccataccaaggctatccgtaccctcctatgcaacacatgccaaatcaaaaccaaggaaacatgccatggccttcaaggggcaaaacatccaagaaaaaagggaagggggattctgatggagatgagtctagtgaatcaagtgaatctagtgaatctgaatcggccagcgatgattctgcttcatctttggaagatcaaggtaaaagacactctcgtacaagtaaaaactcacgccgatcaaagaaaaaccggaagaagtcatctaaaactgttatcatccgtaatattaactatataaccccggagggaagaaatggagacatggagggaaatgagtttacggacaacggttccatcaaagagactgtagatgctgctgttggaatgctcaacgaaaaaagagctcatgagggagaagtttctggtgaagaaaaacgaagcaacgagaattgggattcatttcagaatattttgatgaggcacgatgatggctcagatgtgcattcaatggatgtcatcggtcaggagcatttcacacatagaggcgctagtgtgggtgcaaattctaatggcttgcaaacaaagaacactgcctcgggtgattccatcatcacaacgcataagtacatagaagatggaggagatagctttgatcattttgaaagtgaggatagtgctcgcaggcttccaagaacgagggactcgactgaagaatgtatgttactgcttaagagatcagaaatgttaggagatgaaagcaaagacatgtataatgctacaaggggtgaatcgttggtgaagaagtcagggagtggagaggattggtttactgcttcgggtaatcgtgctgggaaaccggaaatcaactacgggagaatgtcatttgatgacagcattttgacatctcaaggttctgataagagcaagaaacaagaattcgttgatgattctttcatggtccattcatcatcgcttgctgctgatgatctttatgactctcggtggagaccagacatggctgctgatattgttttagcctctgacgttgacaacgggcatgctaatgaaaaacacgattcatgggaaccaaatgatctttgtatgattcctgaacgcaattcaggagactctttggctaatgattattcgattgatttctctgctgaagcaaatgcaaggctatccagtaacggaacagctcaggagaaagaagataagagcggcgagaagaaaaacaatgtgaagaacccggaaactcgtaagtctaaaactccaagtagaaccagagcggaaacaatgtccaagactgcaaagaaaccaacagtagctagcagaacaatggcacagaagaacaagtttgaaaaggaagaagagatgcggaagagaatagaaaaccttgtaatggaaaggcaaaaaagaatcgcagagagatcagccatgactgcatctcgtaaagtttctctagacaaaggttcgagcagagctcctttggttcgcgaaagggctacataa

SEQ ID NO: 536 - protein, 808 aa, Arabidopsis thaliana
MDSRAILDSALFQLTPTRTRFDLVLFCGSKKEKLASGIFEPFVSHLKFARDQISKGGYSISLTPPSSHSSWFTKSTFDRFVRFVNTPAIIERFATLEKEILQIENSIQANEIANAADALQLQDGSNSGDSSNLKKSNESSKKESENGNEVVGEETSKIQLQRLLETRRTLLRREQAMAYARGVVAGYEIDSIDDLILFADAFGASRLREACIMYKELWKKKHGDGLWMAELAAVKACAPVDMSLLGSSGIILTNEGAALSLNGTDSMPSNTDDKSVNLEQHPSGVPNFQAPMGWPNHMPQYFYPSPYQGYPYPPMQHMPNQNQGNMPWPSRGKTSKKKGKGDSDGDESSESSESSESESASDDSASSLEDQGKRHSRTSKNSRRSKKNRKKSSKTVIIRNINYITPEGRNGDMEGNEFTDNGSIKETVDAAVGMLNEKRAHEGEVSGEEKRSNENWDSFQNILMRHDDGSDVHSMDVIGQEHFTHRGASVGANSNGLQTKNTASGDSIITTHKYIEDGGDSFDHFESEDSARRLPRTRDSTEECMLLLKRSEMLGDESKDMYNATRGESLVKKSGSGEDWFTASGNRAGKPEINYGRMSFDDSILTSQGSDKSKKQEFVDDSFMVHSSSLAADDLYDSRWRPDMAADIVLASDVDNGHANEKHDSWEPNDLCMIPERNSGDSLANDYSIDFSAEANARLSSNGTAQEKEDKSGEKKNNVKNPETRKSKTPSRTRAETMSKTAKKPTVASRTMAQKNKFEKEEEMRKRIENLVMERQKRIAERSAMTASRKVSLDKGSSRAPLVRERAT

SEQ ID NO: 537 - DNA, 1386 bp, Arabidopsis thaliana
atggaagagaagaagaaggagcttgaagagttgaagtatcaatcaggttttggtaaccacttctcatcggaagcaatcgccggagctttaccgttagatcagaacagtcctcttctttgtccttacggtctttacgccgaacagatctccggtacttctttcacttctcctcgcaagctcaatcaaagaagttggttgtaccgggttaaaccatcggttacacatgaaccgttcaagcctcgtgtaccagctcataagaagcttgtgagtgagtttgatgcatcaaatagtcgtacgaatccgactcagcttcggtggagacctgaggatattcctgattcggagattgatttcgttgatgggttatttaccatttgtggagctggaagctcgtttcttcgccatggcttcgctattcacatgtatgtggctaacacaggaatgaaagactccgcattttgcaacgctgatggtgacttcttgttagttcctcaaacaggaaggctatggattgaaactgagtgtggaaggcttttggtaactcctggtgagattgctgttataccacaaggtttccgtttctccatagatttaccggatgggaagtctcgtggttatgttgctgaaatctatggggctcattttcagcttcctgatcttggaccaataggtgctaatggtcttgctgcatcaagagattttcttgcaccaacagcatggtttgaggatggattgcggcctgaatacacaattgttcagaagtttggcggtgaactctttactgctaaacaagatttctctccattcaatgtggttgcctggcatggcaattacgtgccttataagtatgacctgaagaagttctgtccatacaacactgtgcttttagatcatggagatccatctataaatacagtccttacagcaccaactgataaacctggtgtggccttgcttgattttgtcatatttcctcctcgatggttggttgctgagcatacttttcgacctccttactatcatcgtaactgcatgagtgaatttatgggcttaatctacggtgcatacgaggcgaaagctgatggatttctccctggcggtgcaagtcttcatagctgtatgacacctcatggtccagatactaccacgtacgaggcgacaattgctcgagtaaatgcaatggctccttctaaactcacaggtacgatggctttcatgttcgaatcagcattgatccctagagtctgtcattgggctctggagtctcctttcctggatcacgactactaccagtgttggattggcctcaagtctcatttctcgcgcataagcttggacaagacaaatgttgaatcaacagagaaagaaccaggagcttcggagtaa

SEQ ID NO: 538 - protein, 461 aa, Arabidopsis thaliana
MEEKKKELEELKYQSGFGNHFSSEAIAGALPLDQNSPLLCPYGLYAEQISGTSFTSPRKLNQRSWLYRVKPSVTHEPFKPRVPAHKKLVSEFDASNSRTNPTQLRWRPEDIPDSEIDFVDGLFTICGAGSSFLRHGFAIHMYVANTGMKDSAFCNADGDFLLVPQTGRLWIETECGRLLVTPGEIAVIPQGFRFSIDLPDGKSRGYVAEIYGAHFQLPDLGPIGANGLAASRDFLAPTAWFEDGLRPEYTIVQKFGGELFTAKQDFSPFNVVAWHGNYVPYKYDLKKFCPYNTVLLDHGDPSINTVLTAPTDKPGVALLDFVIFPPRWLVAEHTFRPPYYHRNCMSEFMGLIYGAYEAKADGFLPGGASLHSCMTPHGPDTTTYEATIARVNAMAPSKLTGTMAFMFESALIPRVCHWALESPFLDHDYYQCWIGLKSHFSRISLDKTNVESTEKEPGASE

SEQ ID NO: 539 - DNA, 1446 bp, Arabidopsis thaliana
atgagtagtgatcctcatcgtaagctccatgttgtgttcttccctttcatggcttatggtcacatgataccaactctagacatggctaagcttttctctagcagaggagccaaatctacaatcctcaccacacctctcaactccaagatcttccaaaaacccatcgaaagattcaagaacctgaatccgagtttcgaaatcgacatccagatcttcgatttcccttgcgtggatctcgggttaccagaaggatgcgaaaacgtcgatttcttcacctcaaacaacaatgatgatagacagtatctgaccttgaagttctttaagtcgacaaggtttttcaaagatcagcttgagaagctcctcgagacaacgagaccagactgtcttatcgccgacatgttcttcccctgggctacggaagctgctgagaagttcaatgtgccaagacttgtgttccacggtactggctacttttctttatgctctgaatattgcatcagagtgcataacccacaaaacatagtagcttcaaggtacgagccatttgtgattcctgatctcccggggaacatagtgataactcaagaacagatagcagaccgtgacgaagaaagcgagatggggaagtttatgattgaggtcaaagaatctgatgtgaagagctcaggtgttattgtaaacagcttctacgagcttgaacctgattacgccgacttttacaagagtgttgtactgaagagagcgtggcatatcggtccgctttcggtttacaacagaggatttgaggagaaggctgagagaggaaagaaagcaagcattaatgaggttgaatgcctcaaatggcttgactccaagaaaccagattcagtcatttacatttcttttgggagcgtggcttgcttcaagaacgagcagctattcgagatcgctgcaggattagaaacttctggagcaaatttcatctgggttgttaggaaaaacataggtattgaaaaagaagaatggttaccagaagggttcgaagagagggtgaaaggaaaagggatgattataagaggatgggcaccacaggtgctcatacttgatcatcaagcaacttgtgggtttgtgacccattgcggctggaactcgcttctggaaggagtggctgcagggctaccaatggtgacatggcctgtagcagcggagcaattctacaatgagaaattggttacgcaagtgctcagaacaggagtgagcgtgggagcgaaaaagaatgtaagaactacgggagatttcattagcagagagaaagtggttaaagcggtgagggaggtgttggttggggaagaggcggatgagaggcgggagagggcaaagaagttggcagagatggctaaagctgccgtggaaggagggtcttctttcaacgatctaaacagcttcatagaagagtttacctcgtaa

SEQ ID NO: 540 - protein, 481 aa, Arabidopsis thaliana
MSSDPHRKLHVVFFPFMAYGHMIPTLDMAKLFSSRGAKSTILTTPLNSKIFQKPIERFKNLNPSFEIDIQIFDFPCVDLGLPEGCENVDFFTSNNNDDRQYLTLKFFKSTRFFKDQLEKLLETTRPDCLIADMFFPWATEAAEKFNVPRLVFHGTGYFSLCSEYCIRVHNPQNIVASRYEPFVIPDLPGNIVITQEQIADRDEESEMGKFMIEVKESDVKSSGVIVNSFYELEPDYADFYKSVVLKRAWHIGPLSVYNRGFEEKAERGKKASINEVECLKWLDSKKPDSVIYISFGSVACFKNEQLFEIAAGLETSGANFIWVVRKNIGIEKEEWLPEGFEERVKGKGMIIRGWAPQVLILDHQATCGFVTHCGWNSLLEGVAAGLPMVTWPVAAEQFYNEKLVTQVLRTGVSVGAKKNVRTTGDFISREKVVKAVREVLVGEEADERRERAKKLAEMAKAAVEGGSSFNDLNSFIEEFTS

SEQ ID NO: 541 - DNA, 1077 bp, Arabidopsis thaliana
atgctttcaattcgcagaagcttaactctagcaaaagagccaaaagatttgtttttgtttttgtgtaatctccgagctcgatgtgtatctacagatgactatgatccaccattttcgcctctctctaaacccactaaacctccaaaagagaagaagaagcagaagacgaagaagcaagaccagtcgtcggagctggtaaatgacctgaagattccagtgatttcagacctccctttcgattttaggtattcgtattcagaaactaacccggaaattgaaccgattggattccgtgaaccgaaacggttctctccatttggaccgggtcgattggaccggaaatggactgggactaccgcactggcgtcgccggagattgatcagagtcaatgggtggaggagagagcaagagttctcggcgagactttgacagaggatgaagttacagagcttattgaacggtatcggcatagtgactgtacacgacagattaatctcgggaaaggtggtgtgactcacaatatgatagatgatattcataaccattggaagaaagctgaggcagtgaggatcaaatgcttgggagtaccaactcttgacatggacaacatatgtttccacctcgaggaaaaatccggtggaaagattgtatacagaaacataaacattctagttttgtaccggggaaggaattatgatccgaagagtcgtcccatcattccactcatgttatggaagcctcatccgccaatatacccaagacttgtaaagaatgtggctgatgggttagaatttgaagagaccaaggagatgagaaatcgtgggcttcattctcctgccttaatgaaacttactaggaatggtgtttatgttaatgtcgttggaagagtgagggaagagtttgaaacagaagagattgtgagactagattgcactcatgttgggatgagtgactgcaaacgaattggtgtgaaactaaaggagatggttccatgtgttcccatattgttcaaagatgagcagatcatactctggagagggaagaggactggtgaagaagagcttgttactctatga

SEQ ID NO: 542 - protein, 358 aa, Arabidopsis thaliana
MLSIRRSLTLAKEPKDLFLFLCNLRARCVSTDDYDPPFSPLSKPTKPPKEKKKQKTKKQDQSSELVNDLKIPVISDLPFDFRYSYSETNPEIEPIGFREPKRFSPFGPGRLDRKWTGTTALASPEIDQSQWVEERARVLGETLTEDEVTELIERYRHSDCTRQINLGKGGVTHNMIDDIHNHWKKAEAVRIKCLGVPTLDMDNICFHLEEKSGGKIVYRNINILVLYRGRNYDPKSRPIIPLMLWKPHPPIYPRLVKNVADGLEFEETKEMRNRGLHSPALMKLTRNGVYVNVVGRVREEFETEEIVRLDCTHVGMSDCKRIGVKLKEMVPCVPILFKDEQIILWRGKRTGEEELVTL

SEQ ID NO: 543 - DNA, 819 bp, Arabidopsis thaliana
atggacattaagcatcatacttcaacttcaaaacctaagaacaagaacaagcttttgaagatgcttcctaaagcgatgtcgtttggacatcgagttccaccgtttagtcccggaagagatctccaccacaacaaccaccataattacacggcggctaacaaaatgtttttctctggtcctatggttcctttggtacctaacgcggctcgggttagaagaaacaaaagcgacgctgtttgggacgaacctacttcacctaaagtctcttgtatcggtcagatcaagcttggtaagtctaaatgcccaaccggtaaaaagaacaaagcaccttcatctctgattcctaaaatctccaaaacgtcaacgtcgtctttaacaaaagaagatgaaaaaggtcgtctttcgaagatcaagagtatcttctcgttctcgccggcgagtggacgaaacacatcaagaaaatcccatcctaccgccgtctccgccgcggatgaacatccagttacggtggtttccaccgcggcggtgccttcgttaggtcagatgaagaaattcgctagcagtcgtgatgctttaggtgattttgattgggcggttgagatgaaacatgaagaagaatcacccgctgatcatcaccgtggttactattctgacgacgacaccagaggagcttacttgagatacgatgatgacgaggatgaagatgacataataatccctttttcagctcctttagggttaaaaccaaagaaagaagttaacttgtggaagagaagaaccatggatccaccaaaaccacttcatcttcaaaccatttga

SEQ ID NO: 544 - protein, 272 aa, Arabidopsis thaliana
MDIKHHTSTSKPKNKNKLLKMLPKAMSFGHRVPPFSPGRDLHHNNHHNYTAANKMFFSGPMVPLVPNAARVRRNKSDAVWDEPTSPKVSCIGQIKLGKSKCPTGKKNKAPSSLIPKISKTSTSSLTKEDEKGRLSKIKSIFSFSPASGRNTSRKSHPTAVSAADEHPVTVVSTAAVPSLGQMKKFASSRDALGDFDWAVEMKHEEESPADHHRGYYSDDDTRGAYLRYDDDEDEDDIIIPFSAPLGLKPKKEVNLWKRRTMDPPKPLHLQTI

SEQ ID NO: 545 - DNA, 420 bp, Arabidopsis thaliana
atggctcatgggagatatgatacttacaagaagaaaagtggacagattcctcggtttggagaatgggaagaagcaaatgagatgccaataacacaatactttgagaatccaagacaagctgaagccttaaagcttgcttctcaccatccccgtccacgtcacctccacgctcaaagacagacggcggggacgaaggagaaaagaggaccacaaaggcgtgtgcgtgacgtcagtgcacagtcggacaagtattacattgacgtcaacggtgttaagcagttcaaaaacgacgttgctctgacttgtaagccacctaagcccgttgatgaagatctctacaagattcctcctgagtttatccattcttcaacaaggaagagaaggcctagctttttagcttgtttggttccatgcgcatga

SEQ ID NO: 546 - protein, 139 aa, Arabidopsis thaliana
MAHGRYDTYKKKSGQIPRFGEWEEANEMPITQYFENPRQAEALKLASHHPRPRHLHAQRQTAGTKEKRGPQRRVRDVSAQSDKYYIDVNGVKQFKNDVALTCKPPKPVDEDLYKIPPEFIHSSTRKRRPSFLACLVPCA

SEQ ID NO: 547 - DNA, 1278 bp, Arabidopsis thaliana
atggcgatgatgcatcctccgcagccgccgcaaggctcctatcaccatcctcagacgctcgaagaagttcgaactctttggattggtgatttgcagtactgggtcgacgaaaattacctcacttcctgcttctcccaaaccggcgagctcgtttctgtcaaggtaatacgtaacaagatcacgggacagccagaggggtatggttttatagagtttatatctcatgcagcagcagagagaactctgcagacgtacaatgggacacagatgcctggaactgagttaacttttcggttaaattgggcttcttttggttcaggacagaaagttgatgctggacctgatcattctatctttgttggagatttagcacctgatgttacagattatcttcttcaagagacattccgtgttcattattcttctgttagaggtgccaaggttgttactgatccaagtactggacgatcaaagggttatggatttgtaaaatttgcagaggaaagtgaaaggaatcgggctatggctgaaatgaatggtttgtattgctcaacaaggcctatgcgtattagcgcagcaacacctaaaaaaaacgtcggtgtgcagcaacaatatgtcaccaaagctgtttacccagttacagtcccatctgcagttgctgcaccagtccaagcatacgttgctccacctgaaagtgatgtcacctgtacaacgatttcagttgccaatttggaccaaaatgttacagaggaagagctgaagaaagcattctcccaattaggagaggttatttatgtcaaaatacctgcaacaaagggatatggttatgttcaattcaaaaccaggccttctgcagaagaagctgttcaaagaatgcagggacaagtgattggtcaacaagcagttcgcatctcttggagtaaaaatccaggacaggatggttgggttacacaagcagatccgaatcagtggaatgggtattatggttatgggcaaggctatgatgcatatgcttatggggcaactcaagatccatccgtgtacgcatatggtggatatggctatccccagtatccgcaacagggagagggtacacaagacatttcgaactctgcggcgggtggagtagcaggtgcagagcaagagttgtatgatcctctggccactcctgatgtagacaagttaaatgctgcttacctttcggttcatgcaagtgccatattaggaaggccaatgtggcagcggacctcatcgctcacatcacaattgggcaaatga

SEQ ID NO: 548 - protein, 425 aa, Arabidopsis thaliana
MAMMHPPQPPQGSYHHPQTLEEVRTLWIGDLQYWVDENYLTSCFSQTGELVSVKVIRNKITGQPEGYGFIEFISHAAAERTLQTYNGTQMPGTELTFRLNWASFGSGQKVDAGPDHSIFVGDLAPDVTDYLLQETFRVHYSSVRGAKVVTDPSTGRSKGYGFVKFAEESERNRAMAEMNGLYCSTRPMRISAATPKKNVGVQQQYVTKAVYPVTVPSAVAAPVQAYVAPPESDVTCTTISVANLDQNVTEEELKKAFSQLGEVIYVKIPATKGYGYVQFKTRPSAEEAVQRMQGQVIGQQAVRISWSKNPGQDGWVTQADPNQWNGYYGYGQGYDAYAYGATQDPSVYAYGGYGYPQYPQQGEGTQDISNSAAGGVAGAEQELYDPLATPDVDKLNAAYLSVHASAILGRPMWQRTSSLTSQLGK

SEQ ID NO: 549 - DNA, 2877 bp, Arabidopsis thaliana
atgaaggaagaggatgtgagctcgcagaacgtaaaccctagaagtaatcggaacagtgtagcctcagcttctgcttccgcctctgctactcccgttgataggttccgacgacgtgctagatcgccttctcctcctcaaactgctgctgctagctctgcaggggcatcatctccagctgttctggtaaacgctggcagtgttgactggacaggtcatggactggcattatcagtgcgttcgtgtagaacatgggatagaggagatttacttcgacgtcttgccactttcaagccttcaaattggcttgggaagcccaaaacagctagttctttggcttgtgctcagaaaggctgggttagtgttgatctggacaaacttcaatgtgaatactgtgggtccattctacaatactcccctccacaagattcgttgaatcctcccgaagctgataccaccggagaaaaattctctaagcagcttgatgatgcacatgagagctcttgtccttgggtaggaaaaagttgttcagaaagcttagttcagtttcctccaactcctccatcagccttgattggaggttacaaggatcgttgtgatgggctcctacaattctattctctaccaattgtttcgccatctgcaattgaccagatgcgtgcttcaagacgaccacaaattgaccgccttttggcacatgccaatgatgatctcagtttcagaatggacaatatatcagctgcagaaacgtacaaagaagaggctttcagtaattactctcgcgctcaaaagctgataagcctatgtggatgggagcctagatggcttccaaatatccaagattgtgaagaacattctgcccaatcagctagaaatgggtgcccttctggaccggctagaaatcaaagtcgtctgcaagatcctggtccaagcaggaaacaattctcggcttcatcccgaaaagcctctggaaattatgaagttttgggtccagaatataagtcagaatccagattacctttactggattgtagtttatgtggtgtaaccgtcagaatttgtgatttcatgaccacttctcggccggttccgtttgctgctataaatgccaatcttcctgaaacgagtaagaaaatgggagtgacacgtggcactagcgcaacaagtggaatcaatggatggtttgctaatgaaggcatgggacagcagcaaaatgaagatgttgacgaggctgaaacttcagttaagagaagattagtatcaaatgtaggtctaagcttttatcaaaatgcagctggtgcatcatcctctgcgcagctgaacatgtctgtgacccgtgataattaccaatttagtgatagaggaaaggaagtgttgtggaggcagccttcaggaagtgaggttggtgatcgtgctgcttcatatgaatcacgagggcctagtactcgtaaacggagcctggatgatggtggaagcactgttgataggccttatctacgaatacaacgtgcagatagtgttgaaggcactgttgtcgaccgtgacggtgacgaggttaatgatgattcagcagggccttcaaagcgtacccgaggttctgatgcgcatgaagcttatcctttcttgtatgggcgagatttatcagtaggggggccaagtcactcactggatgctgaaaacgagagggaagtaaatagaagtgacccatttagtgaaggaaatgaacaagttatggcttttccaggtgccagagactccacacgtgcttcctctgtcattgcaatggatacaatttgccacagtgccaatgacgattctatggaaagtgtggaaaaccatccaggggattttgatgacataaattatccctctgtggcgacagctcaaagtgctgacttcaatgatccttcggaactgaatttcagcaatcaagctcagcagagtgcatgcttccaaccagctcctgttcggtttaatgctgaacaaggcattagcagcataaatgacggtgaggaagtactcaacacagagactgtcactgcccagggaagagatggaccaagtttaggtgtcagtgggggtagtgtcggaatgggtgcaagtcacgaggcagaaatacacggagctgacgtttcagtccataggggagatagcgttgtgggagacatggaaccagttgcagaagtcatagagaatctaggacaaagcggtgaattcgcaccagaccaaggccttactgatgattttgttcctgcagaaatggatcgagaaggtaggcttggggatagtcaagatagggtgtctcagtctgttgtaagggcggatagtggttctaaaatagttgattcattgaaggctgaatctgttgaaagtggtgaaaagatgagtaacataaatgtgttgatcaacgatgacagtgttcatccatctttgtcttgcaatgcgatagtgtgttctggttatgaagcatctaaagaagaagtgacccagacttgggagtctcccctcaacgctggctttgcactccccggatctagttacactgccaatgatcaagggccacaaaacggagacagcaatgatgatattgtggagtttgatccaataaagtatcataactgttactgtccttgggttaatgaaaatgtggctgctgctggatgtagcagcaatagctcgggttcttcaggttttgctgaggcagtttgtgggtggcaactaactcttgatgcccttgattcgttccagtcgcttgaaaaccctcaaaaccagacaatggaatcagaatcagctgcatctctgtgcaaggatgatcaccgaactccttcccagaagctcttgaaacgccactcttttatcagcagccatgggaaaaagtaa

SEQ ID NO: 550 - protein, 958 aa, Arabidopsis thaliana
MKEEDVSSQNVNPRSNRNSVASASASASATPVDRFRRRARSPSPPQTAAASSAGASSPAVLVNAGSVDWTGHGLALSVRSCRTWDRGDLLRRLATFKPSNWLGKPKTASSLACAQKGWVSVDLDKLQCEYCGSILQYSPPQDSLNPPEADTTGEKFSKQLDDAHESSCPWVGKSCSESLVQFPPTPPSALIGGYKDRCDGLLQFYSLPIVSPSAIDQMRASRRPQIDRLLAHANDDLSFRMDNISAAETYKEEAFSNYSRAQKLISLCGWEPRWLPNIQDCEEHSAQSARNGCPSGPARNQSRLQDPGPSRKQFSASSRKASGNYEVLGPEYKSESRLPLLDCSLCGVTVRICDFMTTSRPVPFAAINANLPETSKKMGVTRGTSATSGINGWFANEGMGQQQNEDVDEAETSVKRRLVSNVGLSFYQNAAGASSSAQLNMSVTRDNYQFSDRGKEVLWRQPSGSEVGDRAASYESRGPSTRKRSLDDGGSTVDRPYLRIQRADSVEGTVVDRDGDEVNDDSAGPSKRTRGSDAHEAYPFLYGRDLSVGGPSHSLDAENEREVNRSDPFSEGNEQVMAFPGARDSTRASSVIAMDTICHSANDDSMESVENHPGDFDDINYPSVATAQSADFNDPSELNFSNQAQQSACFQPAPVRFNAEQGISSINDGEEVLNTETVTAQGRDGPSLGVSGGSVGMGASHEAEIHGADVSVHRGDSVVGDMEPVAEVIENLGQSGEFAPDQGLTDDFVPAEMDREGRLGDSQDRVSQSVVRADSGSKIVDSLKAESVESGEKMSNINVLINDDSVHPSLSCNAIVCSGYEASKEEVTQTWESPLNAGFALPGSSYTANDQGPQNGDSNDDIVEFDPIKYHNCYCPWVNENVAAAGCSSNSSGSSGFAEAVCGWQLTLDALDSFQSLENPQNQTMESESAASLCKDDHRTPSQKLLKRHSFISSHGKK

SEQ ID NO: 551 - DNA, 846 bp, Arabidopsis thaliana
atgttgcccagattagctcgagtcgtcactcaaacctcaaagcttcgatctttgaccactaatggatcgatgaaaaatctctcctttttctcccgatatgggtacgcgactgttgcgccggcggcagctgatcctccgtcgcagaaggatttccccagtaaatctccgataaacttggataagatgttttggtcaaagccatgttcattggctctgcctaaagactctcctctcagaattgatgaaccagactatgtagggattcgtcgtttcatactaaagatgatgatgttctatagcaaacagagcatgtctatccgtggggctaacgtgatctacaagcggatcattgcacaagttgataaacctgcaatatatgatgtattcaacttggagaaaacattcaaaataacgtattcgctgcttgtccttcatatgtggcttgttttacgccgcttgaaggaagatggacaggaaggtgttgaccttggtcaatacgtctatgagatctacaatcatgatgttgaactcagggtatctaaagccggggttaacttgctgctagccaagtggatgaaggagttggagagaatattttatggaaatgttgttgcctatgatgctgcgctacttccggaagctaaaccaaatgacctacaaatcaaattatggaggaacgtattttctgatgatggaacaacaacacctgataacacagatttaaaaacagcacaggcaatggcaagatatgtccggagagaacttggttctctttctttaacagataaagagtccatattctccggcaatttctccttcacccctttggagaacaagcccctgtga

SEQ ID NO: 552 - protein, 281 aa, Arabidopsis thaliana
MLPRLARVVTQTSKLRSLTTNGSMKNLSFFSRYGYATVAPAAADPPSQKDFPSKSPINLDKMFWSKPCSLALPKDSPLRIDEPDYVGIRRFILKMMMFYSKQSMSIRGANVIYKRIIAQVDKPAIYDVFNLEKTFKITYSLLVLHMWLVLRRLKEDGQEGVDLGQYVYEIYNHDVELRVSKAGVNLLLAKWMKELERIFYGNVVAYDAALLPEAKPNDLQIKLWRNVFSDDGTTTPDNTDLKTAQAMARYVRRELGSLSLTDKESIFSGNFSFTPLENKPL

SEQ ID NO: 553 - DNA, 513 bp, Arabidopsis thaliana
atgggctttcccgtaggttacacagaggttttcttaccgaagcttttcgtacaaacgctttcgattctcggattcatcagaaccatcgtcttctctatcttccgcttcttgggtctctcagattttctcgaaatggatcaaacctggcccgattacacatcgtacccgacccgaatacccgaaacccgctcacctttctccgcactcctaattagagagatcctaccggttatcaaattcgaagagttaacgaattccggcgaagatctaccggaaaactgcgccgtttgtctatacgaattcgaaggagaacaagagatccggtggctgagaaattgcagacatatatttcaccggagctgtcttgaccgttggatggatcatgatcagaagacgtgtccactttgtagaacaccgtttgttccagatgagatgcaagaagagtttaatcaacggctatgggctgcttctggtgttcatgattttcactgtcccgtgaccgaattattatag

SEQ ID NO: 554 - protein, 170 aa, Arabidopsis thaliana
MGFPVGYTEVFLPKLFVQTLSILGFIRTIVFSIFRFLGLSDFLEMDQTWPDYTSYPTRIPETRSPFSALLIREILPVIKFEELTNSGEDLPENCAVCLYEFEGEQEIRWLRNCRHIFHRSCLDRWMDHDQKTCPLCRTPFVPDEMQEEFNQRLWAASGVHDFHCPVTELL

SEQ ID NO: 555 - DNA, 1443 bp, Arabidopsis thaliana
atgtatagcggatctagcgatggtgagagtcatgatacatcgacgcagaggaagatcccaccggcgtcttcgatgctttgggttagaaatctacgacgatatattggttccggtgccggattaggatccgaagctctaatggagcttgagacgaagagaatcttgctcgagatttttaaagagaagcaacagaaaagccaagaagcaggcacaataccgagtttctacaagaagaaaccagaagaaggatctattagtcaaagggtccagaagcttgcaaagtaccgtttcttgaagaaacaatcggatcttttgttaaacgctgatgatttggctgctatgtgggtttgtttgagagaaaattgtgtgattgatgatgccactggtgctgaaaagatgaactatgaagacttctgtcacattgcctctgtatgcactgaacaaatcggtcccaaatgtcgccggttttttagcccatccaatttcatgaaatttgagaaggatgaggctgggaggattgccattttaccgttttatctttatgtgatgcgcacggtgtcgcttacacaagctaggattgatatgagtgagcttgacgaagactctgatggtttccttcattctgatgaaatggagtcctatattggtggtctaatccctaatctggcacaactgagagacatgcctccggcctttaatcaaatgtattgccgcatagcttcacaaaagtttttcttcttctgtgatccccataggcgaggaagagcctgcattaaaaagatactgctcagtaactgtctgcaggaactaatggaattgcatcaggaaagcgaggaggaagtcacagacactgaacaggcagaaaattggttctctttgacttcagcccaacgcatatgtgatatgttcctcgcacttgataaagatatgagtggatcgctgtgcaaacaagaacttaaagaatatgctgatgggaccctaactgagattttcattgaaagagtgttcgatgagcatgtccgccgtggtaaaatcgtggcaggcaattcccgggaaatggactttgacagtttcctcgattttgttcttgctttggagaacaaagatactccagagggtttgacgtatttattccgttgccttgatctccaagggagaggctttctcactactgctgatattcactctcttttcagagatgttcaccagaaatggatagaaggtgggaactatgaactgtgcatagaagatgttcgagacgagatctgggacatggtgaaaccgtctgacccattaaagatcactctgggtgatctcttgggatgtaaacaaggtggaaccgttgcgagcatgcttatagatgtgcgtggcttctgggctcatgacaaccgtgagaaccttcttcaagaagaagaagaaccacctgaggaagagtctcagtga

SEQ ID NO: 556 - protein, 480 aa, Arabidopsis thaliana
MYSGSSDGESHDTSTQRKIPPASSMLWVRNLRRYIGSGAGLGSEALMELETKRILLEIFKEKQQKSQEAGTIPSFYKKKPEEGSISQRVQKLAKYRFLKKQSDLLLNADDLAAMWVCLRENCVIDDATGAEKMNYEDFCHIASVCTEQIGPKCRRFFSPSNFMKFEKDEAGRIAILPFYLYVMRTVSLTQARIDMSELDEDSDGFLHSDEMESYIGGLIPNLAQLRDMPPAFNQMYCRIASQKFFFFCDPHRRGRACIKKILLSNCLQELMELHQESEEEVTDTEQAENWFSLTSAQRICDMFLALDKDMSGSLCKQELKEYADGTLTEIFIERVFDEHVRRGKIVAGNSREMDFDSFLDFVLALENKDTPEGLTYLFRCLDLQGRGFLTTADIHSLFRDVHQKWIEGGNYELCIEDVRDEIWDMVKPSDPLKITLGDLLGCKQGGTVASMLIDVRGFWAHDNRENLLQEEEEPPEEESQ

SEQ ID NO: 557 - DNA, 939 bp, Arabidopsis thaliana
atgtcattgccctcatctccccatgcttacaggtgtcaaacatttggacgaagagggccttcagaatttgccgtgaaggatacatggaataaagtggttgagtcttccacattgcagaatcagcctttattaccctatcaagaatgggacattgacttctcagagctgactgttggaactcgggtggggattggtttttttggtgaagtttttcgtggagtatggaatgggacagatgttgcaatcaaattgtttctggagcaagatcttactgccgaaaacatggaagatttctgcaatgagatatcaattctcagccgtgttcgccacccaaatgttgtactatttttgggtgcatgcacaaaacctccacgcttatccatgatcacggagtacatggagctgggatcgttgtattatttgatccacatgagtggtcagaagaagaaacttagctggcacagaaggctcaggatgcttagagacatctgcaggggtttgatgtgcatacaccggatgaagatagtccaccgcgacctaaagagtgccaactgtctagtggacaaacattggacagtcaagatctgtgattttgggctgtcaagaataatgactgatgaaaacatgaaggacacttcatctgctgggacaccagagtggatggctccagagctcattcgcaacaggccttttacagagaaatgtgatatctttagtcttggggtcataatgtgggaactttcaactttacgtaaaccatgggaaggagttccacctgagaaggttgtctttgctgttgcacatgaagggtcacgtttggagattcctgatggtccactcagcaaactaattgcagattgttgggcagagcctgaagaacgcccaaattgtgaagagatacttagaggcttactcgattgtgagtacacactgtgctaa

SEQ ID NO: 558 - protein, 312 aa, Arabidopsis thaliana
MSLPSSPHAYRCQTFGRRGPSEFAVKDTWNKVVESSTLQNQPLLPYQEWDIDFSELTVGTRVGIGFFGEVFRGVWNGTDVAIKLFLEQDLTAENMEDFCNEISILSRVRHPNVVLFLGACTKPPRLSMITEYMELGSLYYLIHMSGQKKKLSWHRRLRMLRDICRGLMCIHRMKIVHRDLKSANCLVDKHWTVKICDFGLSRIMTDENMKDTSSAGTPEWMAPELIRNRPFTEKCDIFSLGVIMWELSTLRKPWEGVPPEKVVFAVAHEGSRLEIPDGPLSKLIADCWAEPEERPNCEEILRGLLDCEYTLC

SEQ ID NO: 559 - DNA, 1458 bp, Arabidopsis thaliana
atggtaggaagaagaaaagctttactcttttctctctgtttcttcttcctctctcttccttccttctcttcccttccatccttccaaaccctattccccaattctcattcccttccttgtgcttctcccgtctcattccaacccgactccgactccgagtcactgctagaatccgaatttgaatccggatccgactccgagtcttcttcttccattactctaaacctcgaccacatcgatgctctctcctccaacaaaacacccgacgagctattcagctcccgtctccaacgtgactcccggcgcgtgaaatctatcgccacactcgccgctcaaatccccggaagaaacgtgactcacgcgccacgacccggtggattcagcagctcagtcgtctctggtctctctcaaggaagcggtgaatacttcacgcgcctcggtgtcggcactccggcgagatatgtttacatggtgctcgacaccggcagcgacatcgtctggctacaatgcgctccttgtcggagatgctactctcaatccgacccgatattcgacccgagaaaatccaagacctatgccacaatcccctgttcttcacctcactgccgccgattagactccgccggatgcaacacccgtcgtaagacttgtctctaccaagtctcttacggagatggttctttcaccgtcggcgatttctccaccgaaacgctaactttccggcgaaatcgcgttaaaggcgttgctctcggatgtggccacgacaacgaaggtctcttcgtcggagccgccggtttattaggactcggtaaaggtaaattatcgttccccggtcaaaccggtcaccggtttaatcagaaattctcttactgtttagtcgacagatccgcttcttcgaaaccttcctcggtcgtcttcggaaacgccgccgtatcacgaatcgcgagattcacgccacttttgtcaaacccaaaactcgacactttctactacgtcgggcttctgggaattagcgtcggagggacacgtgtccccggcgtaacggcttctctttttaaacttgaccagatcggtaacggtggagttattatcgattcgggtacgtctgtgacccggttgatccgaccagcttatattgctatgagagacgcgttccgggtcggagctaagacattgaaaagagctccggatttctcactcttcgacacgtgtttcgatctctccaatatgaacgaggttaaagtaccgacggtggttttacatttccgtggagctgacgtatcacttccggcgacgaattacctgatccctgtggataccaacggcaagttctgttttgcgtttgccggtacgatgggcggactatccataattgggaatatccagcaacagggtttccgggttgtatacgacttagcgagttcccgggtcgggtttgctccaggaggatgcgcttaa

SEQ ID NO: 560 - protein, 485 aa, Arabidopsis thaliana
MVGRRKALLFSLCFFFLSLPSFSSLPSFQTLFPNSHSLPCASPVSFQPDSDSESLLESEFESGSDSESSSSITLNLDHIDALSSNKTPDELFSSRLQRDSRRVKSIATLAAQIPGRNVTHAPRPGGFSSSVVSGLSQGSGEYFTRLGVGTPARYVYMVLDTGSDIVWLQCAPCRRCYSQSDPIFDPRKSKTYATIPCSSPHCRRLDSAGCNTRRKTCLYQVSYGDGSFTVGDFSTETLTFRRNRVKGVALGCGHDNEGLFVGAAGLLGLGKGKLSFPGQTGHRFNQKFSYCLVDRSASSKPSSVVFGNAAVSRIARFTPLLSNPKLDTFYYVGLLGISVGGTRVPGVTASLFKLDQIGNGGVIIDSGTSVTRLIRPAYIAMRDAFRVGAKTLKRAPDFSLFDTCFDLSNMNEVKVPTVVLHFRGADVSLPATNYLIPVDTNGKFCFAFAGTMGGLSIIGNIQQQGFRVVYDLASSRVGFAPGGCA

SEQ ID NO: 561 - DNA, 966 bp, Arabidopsis thaliana
atggatctccaaccagaagagcttcaattcttgacaatacctcaactacttcaagaatcaatctcaatcaagaaacgatctccaagaaccttctacctcataaccctctccttcatcttccctctctccttcgctatcctcgctcactcactcttcactcaaccaatcttagccaaactcgacaaatccgacccaccaaactcagatcgttcacgtcatgattggactgttcttctaatcttccagttcagttacttgatcttcctctttgccttctctcttctctcaaccgctgctgttgtcttcaccgtcgcttctctttacaccggaaagcctgtttctttctcgtcaactctctctgcgattcccaaagtctttaaacgactctttataactttcctttgggttgctctgttgatgtttgcttataacgcagtcttctttgtcttcctcgtgatgcttctcgtagctcttgatttgaatagtttaggtttagctattgtagccggggttataatctctgttctatactttggtgttcatgtttatttcactgctttatggcatttaggtagtgtaatctctgttcttgaaccggtttacggaatcgccgctatgagaaaagcttatgagttgcttaaagggaagactaagatggctatggggttaatctttgtttatcttttcctctgtggattgattggagttgtttttggtgctgttgtggttcatggtggtgggaagtatggaacttttactaggactttggttggtggattgttagttggtgttcttgtgatggttaatcttgtgggtttgttggttcagagtgtgttttactatgtttgtaagagttatcatcatcagactattgataagaccgctttgtatgatcaacttggtgggtatcttggagattatgtgcctcttaagagcaacattcagttggaggatttagatatttga

SEQ ID NO: 562 - protein, 321 aa, Arabidopsis thaliana
MDLQPEELQFLTIPQLLQESISIKKRSPRTFYLITLSFIFPLSFAILAHSLFTQPILAKLDKSDPPNSDRSRHDWTVLLIFQFSYLIFLFAFSLLSTAAVVFTVASLYTGKPVSFSSTLSAIPKVFKRLFITFLWVALLMFAYNAVFFVFLVMLLVALDLNSLGLAIVAGVIISVLYFGVHVYFTALWHLGSVISVLEPVYGIAAMRKAYELLKGKTKMAMGLIFVYLFLCGLIGVVFGAVVVHGGGKYGTFTRTLVGGLLVGVLVMVNLVGLLVQSVFYYVCKSYHHQTIDKTALYDQLGGYLGDYVPLKSNIQLEDLDI

SEQ ID NO: 563 - DNA, 2358 bp, Arabidopsis thaliana
atgttcagctcgatgcagatactgccactggaggctcctcctacggatgggaagttaggtccacttcctccgtcgcaattaacagatcaggaagtcgaagagagggagttgcaagcagagcaaaataattcaaatctagctcctccggcggctgttgctactcacacgaggactatcggaatcattcatccacctccagatatcagaactattgttgagaaaacggctcagtttgtctccaaaaacggtttggagtttgaaaagaggattattgttagtaatgaaaagaatgctaagttcaactttttgaagagctcagatccttatcatgccttttaccagcacaagctcactgaataccgtgctcagaataaagacggagctcagggtactgatgattcagatggtactacagatccccaacttgatactggagctgctgatgagtctgaagctggtgatacacaacccgaccttcaggctcaatttaggattccttctaagcctttggaagctccggaacctgagaagtatacagttagacttcctgaagggatcacgggtgaagagcttgatattattaagctcacagcacagtttgtggcacggaatgggaaatcgtttctaacgggattgtcgaatagagagaacaacaatcctcagtttcattttatgaagccaacacacagcatgttcactttttttacttctctggttgatgcgtattcggaagtattaatgcctcccaaagatttgaaagaaaagctgagaaagagtgctgctgatttgacgactgttcttgagcgttgtttgcatcgtttggaatgggatcgttcccaggagcagcagaagaagaaagaagaggatgagaaagagcttgagcgagtgcagatggctatgattgattggcatgattttgtggttgttgagtcgatagattttgcggacgaggaagatgaagagttgccaccgcctatgacacttgacgaggttataaggaggagcaaagcatcagccatggaagaagatgaaattgttgagcctggaaaggaggtcgaaatggaaatggacgaagaagaagttaagcttgttgcagaaggaatgagagcagcaaacctagaagagaatgttaagattgaaaatgtacatgatgaagaagcacctatgagaattgttaagaactggaagaggccagaagacaggatcccaacagagagagatccaactaaagttgttatatcaccaattactggagagctgattcccattaacgagatgtctgagcacatgaggatttctcttattgatcctaagttcaaagaacagaaggatcggatgtttgctaagattcgtgagaccactcttgcacaagatgatgagattgctaaaaacatagtcgggttggcccgcctgcgtcctgatatctttggaacaaccgaagaagaagtctcaaatgctgtaaaagcagagattgagaagaagaaagatgagcagcccaagcaagtgatatgggatggtcacacaggaagtattggtcgcacagcaaaccaagccttgagtcagaacgctaatggagaggagcaaggtgatggcgtttacggagatcccaatagcttccctggtccagctgctcttccacctcctcgaccaggtgtcccaatagtccgaccattgccaccacctcctaatctcgccttgaacctccctcgtcctcccccttctgctcagtaccccggtgcaccaaggccactaggtgttccgatgatgcagcccatgcatcaacaacaccagctcacaatgccagggccaccaggacacccgcagatgatgatgaaccgaccaccacagatgcagcctggtatgcatgtgccacctccaccgggatctcagtttgctcatcatatgcaaattcctagaccttatggtcagcttccaccatctgcaatggggatgatgcaaccaccacctatgcctgggatggctcctcctccaccacccgaggaggctccaccacctcttcctgaggaaccagaggcaaagagacaaaagttcgatgagtcagcccttgttccagaagaccagtttcttgctcagcatccgggtccggctacaatcagggtttctaagccaaacgagaatgatggacaatttatggagatcacagtgcagtcgttatctgaaaacgtgggaagtttgaaggagaaaatagctggggagattcaaatcccagcaaacaaacagaagttgagtggaaaagcagggttcttaaaggacaacatgtcgcttgcacattacaatgtcggagcaggagaaatcctaacattgtctttgagggaacgtggtgggagaaagagatag

SEQ ID NO: 564 - protein, 785 aa, Arabidopsis thaliana
MFSSMQILPLEAPPTDGKLGPLPPSQLTDQEVEERELQAEQNNSNLAPPAAVATHTRTIGIIHPPPDIRTIVEKTAQFVSKNGLEFEKRIIVSNEKNAKFNFLKSSDPYHAFYQHKLTEYRAQNKDGAQGTDDSDGTTDPQLDTGAADESEAGDTQPDLQAQFRIPSKPLEAPEPEKYTVRLPEGITGEELDIIKLTAQFVARNGKSFLTGLSNRENNNPQFHFMKPTHSMFTFFTSLVDAYSEVLMPPKDLKEKLRKSAADLTTVLERCLHRLEWDRSQEQQKKKEEDEKELERVQMAMIDWHDFVVVESIDFADEEDEELPPPMTLDEVIRRSKASAMEEDEIVEPGKEVEMEMDEEEVKLVAEGMRAANLEENVKIENVHDEEAPMRIVKNWKRPEDRIPTERDPTKVVISPITGELIPINEMSEHMRISLIDPKFKEQKDRMFAKIRETTLAQDDEIAKNIVGLARLRPDIFGTTEEEVSNAVKAEIEKKKDEQPKQVIWDGHTGSIGRTANQALSQNANGEEQGDGVYGDPNSFPGPAALPPPRPGVPIVRPLPPPPNLALNLPRPPPSAQYPGAPRPLGVPMMQPMHQQHQLTMPGPPGHPQMMMNRPPQMQPGMHVPPPPGSQFAHHMQIPRPYGQLPPSAMGMMQPPPMPGMAPPPPPEEAPPPLPEEPEAKRQKFDESALVPEDQFLAQHPGPATIRVSKPNENDGQFMEITVQSLSENVGSLKEKIAGEIQIPANKQKLSGKAGFLKDNMSLAHYNVGAGEILTLSLRERGGRKR

SEQ ID NO: 565 - DNA, 1176 bp, Arabidopsis thaliana
atggcaccagataacgaccatttcttagattctccgtcgccgcctcttctagagatgagacaccaccaatcagcgacggagaacggtggtggttgcggcgagattgtggaggtacaaggaggtcacattgttcggtcaacaggaagaaaagacagacatagtaaagtatgtacagcgaaaggaccacgtgaccggcgcgtgagactctcagctccgacggcgattcaattctacgatgttcaagatagacttggttttgatcgaccaagtaaagctgttgattggcttattactaaagctaaatccgccattgatgatcttgctcagcttcctccttggaaccccgccgatactcttcgtcaacacgccgccgctgctgctaacgctaaacccagaaaaaccaaaactttaatttctccgccaccgccacaaccggaagaaacagagcatcatcgaatcggagaagaagaagataacgaatcgagttttcttccggcgtcaatggattctgattcgatagctgacactataaagtcgttttttccggtagcttcaacgcaacagagctatcatcatcagccaccgtcacgaggcaatacacagaaccaagatcttcttcgtctctcgcttcaatctttccaaaatggtccaccttttcctaatcaaacagaacctgctctgttctccggccagagcaataatcagttagcgtttgactcatcgacggcaagctgggaacagagtcatcagtcaccggaatttggaaagatacagagactagtgtcatggaacaacgtcggagcagctgaatccgccggaagtaccggaggatttgtgtttgcttctccgtcgtcgttgcatccagtttatagccaaagtcagcttttatcacagaggggtccccttcagtccattaacacacctatgattcgtgcttggtttgatcctcaccatcatcatcatcatcatcagcagtccatgaccactgacgatctccaccatcatcatccctaccatatccctcccgggattcaccaatctgctattccaggcattgcatttgcttcaagtggtgaattctccggttttcgtataccagcacggtttcaaggcgaacaagaggagcacggcggcgacaacaagccgtcctctgcttcatccgattctcgccattaa

SEQ ID NO: 566 - protein, 391 aa, Arabidopsis thaliana
MAPDNDHFLDSPSPPLLEMRHHQSATENGGGCGEIVEVQGGHIVRSTGRKDRHSKVCTAKGPRDRRVRLSAPTAIQFYDVQDRLGFDRPSKAVDWLITKAKSAIDDLAQLPPWNPADTLRQHAAAAANAKPRKTKTLISPPPPQPEETEHHRIGEEEDNESSFLPASMDSDSIADTIKSFFPVASTQQSYHHQPPSRGNTQNQDLLRLSLQSFQNGPPFPNQTEPALFSGQSNNQLAFDSSTASWEQSHQSPEFGKIQRLVSWNNVGAAESAGSTGGFVFASPSSLHPVYSQSQLLSQRGPLQSINTPMIRAWFDPHHHHHHHQQSMTTDDLHHHHPYHIPPGIHQSAIPGIAFASSGEFSGFRIPARFQGEQEEHGGDNKPSSASSDSRH

SEQ ID NO: 567 - DNA, 1686 bp, Arabidopsis thaliana
atggaagaagatgatggagacgcgtctacgccgttttggcttcaatcacgccgcaataacacttacttccgccgcactgcaagtctcggtggccgtacaaccaccatcgccactcaaatattcttcgccggaacagctgcaatcctcatagtcgtcttcattatccctcctttcttctcctctgtttctcagattttccgacctcatttagtccgtaaaagctgggattatctcaacttcgttctcgtccttttcgccgtcctttgcggcttcctcagccgcaacaccaataatgacgaatccaatcatcacaaagaagaagacattcgtaacaaattctcgacttcaccatcgattattgatcgaagaagtcgtgtatctaacagtggtacaacgccgcgttattggaacgatgatcgcggtggtggcggcggtgatcaaacggtgtacaagaggtttagtagattacgaagtgttagctcgtatccagatctgaggctccgggaatacgaagccgatgaacggtggagattctacgatgatacacgtgtaagtcaatgccgttatgaagatgtagatccgatctatccaaatcaaagttacagaaactggcatgaggaaggtaaaccaccgccggaagatgtagatcaaacagaggacggtgataatggagaaggaagtaaggtccgtaacggcggttcggaaactgagaaagttgaggtggttgcgacggcggaagctgaagtagtagaagagctaaaagtgccttctgctccgccgtatattccgtctcctccgccgtctccgccacgtcctccaccagcgaagcaagcgaagagaaagactaatagagtgtaccaagatgtttctccacaggaagagaagaaagaaagagatgattttgtagcgacgacgacgccgattccacctccggcgactgtgtatcaaaagagcaataaacaggagaagaagaaaggaggagcaacgaaagactttctgattgcgttacggagaaagaagaagaagcagagacaacagagcatcgatggcctcgatctcctcttcggctccgatcctccattggtctattcaccaccaccgccgccgcctcctccaccacctttcttccaagggcttttctcatccaaaaaaggtaaaagcaaaaaaaacaattcaaatccaccgcctcctcctcctccaccaccacctgaacggagatatgaatcacgcgcatcaacctcgaagctccgaaaagctccggtggaatcacggacatccaaaccaaatccgccagctaaagtaactcaatacgtaggcacaggaagcgaatcaccactaatgccgatcccgccgccgcctcctcctccgccgtttaaaatgccggcttggaaattcgtgaagcgtggagattacgtcaggatggctagtgacatcagcataagctccgacgaacctgatgatccggatgtagctcaatcagctggaagtaaggaggccgccgggagtatgttctgtccgagccccgacgtagataccaaagccgatgatttcatcgcaagattcagagccggactcaaattggagaagatgaactctgtgaaaagagggagatccaatttaggacccgaacccggacttcatgaatccggatcttcaacgggttataggcccagcccaagcgtatag

SEQ ID NO: 568 - protein, 561 aa, Arabidopsis thaliana
MEEDDGDASTPFWLQSRRNNTYFRRTASLGGRTTTIATQIFFAGTAAILIVVFIIPPFFSSVSQIFRPHLVRKSWDYLNFVLVLFAVLCGFLSRNTNNDESNHHKEEDIRNKFSTSPSIIDRRSRVSNSGTTPRYWNDDRGGGGGDQTVYKRFSRLRSVSSYPDLRLREYEADERWRFYDDTRVSQCRYEDVDPIYPNQSYRNWHEEGKPPPEDVDQTEDGDNGEGSKVRNGGSETEKVEVVATAEAEVVEELKVPSAPPYIPSPPPSPPRPPPAKQAKRKTNRVYQDVSPQEEKKERDDFVATTTPIPPPATVYQKSNKQEKKKGGATKDFLIALRRKKKKQRQQSIDGLDLLFGSDPPLVYSPPPPPPPPPPFFQGLFSSKKGKSKKNNSNPPPPPPPPPPERRYESRASTSKLRKAPVESRTSKPNPPAKVTQYVGTGSESPLMPIPPPPPPPPFKMPAWKFVKRGDYVRMASDISISSDEPDDPDVAQSAGSKEAAGSMFCPSPDVDTKADDFIARFRAGLKLEKMNSVKRGRSNLGPEPGLHESGSSTGYRPSPSV

SEQ ID NO: 569 - DNA, 753 bp, Arabidopsis thaliana
atgaagttcaacgttgcgaatccaactactggatgccagaagaagctcgagatcgacgatgaccagaaactacgtgcgttttacgacaagagaatctctcaagaagtcagtggagatgctttgggcgaggagttcaaaggatacgttttcaagatcaagggtggttgcgataagcaaggtttcccaatgaagcagggagttttgactccaggccgtgttcgccttttgcttcaccgaggaactccttgcttcagaggacatggaaggagaactggtgagaggagaagaaagtctgttcgtggttgcattgtgagccctgatctctctgttctgaaccttgtcattgtgaagaagggtgagaacgatcttcctgggcttaccgatactgagaagccaagaatgagaggaccaaagagagcctccaagatccgtaaactgtttaacctcaagaaggaagatgatgtcaggacctatgtcaacacttaccgccgcaagttcacaaacaagaagggcaaggaagttagcaaagcccctaagatccagaggcttgtgaccccattgactcttcagaggaagagagctagaattgctgacaagaagaagaaaattgctaaggctaattctgatgctgctgattaccagaagcttctcgcctcgaggttgaaggaacagcgtgacaggaggagtgagagtttggcaaagaagaggtcgagactctcttctgctgctgccaagccctctgtcacagcttaa

SEQ ID NO: 570 - protein, 250 aa, Arabidopsis thaliana
MKFNVANPTTGCQKKLEIDDDQKLRAFYDKRISQEVSGDALGEEFKGYVFKIKGGCDKQGFPMKQGVLTPGRVRLLLHRGTPCFRGHGRRTGERRRKSVRGCIVSPDLSVLNLVIVKKGENDLPGLTDTEKPRMRGPKRASKIRKLFNLKKEDDVRTYVNTYRRKFTNKKGKEVSKAPKIQRLVTPLTLQRKRARIADKKKKIAKANSDAADYQKLLASRLKEQRDRRSESLAKKRSRLSSAAAKPSVTA

SEQ ID NO: 571 - DNA, 1623 bp, Arabidopsis thaliana
atgcaagcagtaaaaagatccaggagacatgttgaagaagagccaacaatggtagaacctaaaaccaagtacgatcgtcagctcaggatttggggggaggtaggtcaagcggccttggaagaagcgagtatctgtttactcaattgtggccctactggttccgaggctttgaagaatctcgtacttggtggtgttggtagcatcaccgttgttgatggatctaaggttcaatttggtgaccttgggaacaatttcatggtcgatgcgaagagtgttggccaatcaaaagccaaatctgtttgtgcgtttctccaagagcttaatgattctgttaacgccaagtttattgaggagaatccagacacgttgattactactaacccatctttcttctctcagttcactctcgttatagccactcagctggtggaagattcaatgttgaaacttgatagaatctgtcgagatgcaaacgttaagttggttttggttcgctcttatggccttgctgggtttgttcgcatctctgtaaaggagcaccccataattgactcaaaacctgatcattttcttgacgacctccgcctgaataatccatggcctgaactcaagagttttgtggagaccattgatctgaatgtatcagagccggccgctgcacataagcacataccttacgtcgtcattcttgtaaagatggctgaggagtgggctcaatcccatagtggtaatcttccctcaaccagggaagagaaaaaagagtttaaggatttggttaagtccaagatggtatctacggatgaagataactacaaagaagccattgaagccgctttcaaagtttttgctcctcgaggaatcagctcagaggttcaaaaattaattaatgatagttgtgctgaagtgaattcaaactcctcagctttttgggtgatggtagcggctctgaaggagtttgttttaaatgaaggtggtggagaggcaccccttgaaggttctataccagatatgacctcttcaacagaacactatatcaatttgcagaaaatctatttagccaaagccgaggctgattttcttgtcattgaggaacgagttaaaaacattttaaagaaaatcggtcgagatccgagcagcatcccaaaaccaacaatcaagagcttctgcaagaatgcaaggaaacttaaattgtgcagatatcgtatggtagaggacgagttcagaaatccttctgtaactgaaattcaaaagtatttagcggacgaggattacagtggtgcaatgggattttatattcttcttagagctgcggacagatttgctgccaactataacaagtttcctgggcagtttgatggaggaatggatgaggacatttctcgattaaaaactactgccttgagtcttcttaccgacttgggctgtaacggctcagtactcccagatgaccttatccatgagatgtgtcgctttggtgcctcagagattcatgtggtttctgcctttgttggaggaatcgcatctcaagaagtcatcaagcttgtcacaaagcagtttgttccgatgttggggacttacatcttcaatggcattgatcacaagtctcagttattgaaattgtag

SEQ ID NO: 572 - protein, 540 aa, Arabidopsis thaliana
MQAVKRSRRHVEEEPTMVEPKTKYDRQLRIWGEVGQAALEEASICLLNCGPTGSEALKNLVLGGVGSITVVDGSKVQFGDLGNNFMVDAKSVGQSKAKSVCAFLQELNDSVNAKFIEENPDTLITTNPSFFSQFTLVIATQLVEDSMLKLDRICRDANVKLVLVRSYGLAGFVRISVKEHPIIDSKPDHFLDDLRLNNPWPELKSFVETIDLNVSEPAAAHKHIPYVVILVKMAEEWAQSHSGNLPSTREEKKEFKDLVKSKMVSTDEDNYKEAIEAAFKVFAPRGISSEVQKLINDSCAEVNSNSSAFWVMVAALKEFVLNEGGGEAPLEGSIPDMTSSTEHYINLQKIYLAKAEADFLVIEERVKNILKKIGRDPSSIPKPTIKSFCKNARKLKLCRYRMVEDEFRNPSVTEIQKYLADEDYSGAMGFYILLRAADRFAANYNKFPGQFDGGMDEDISRLKTTALSLLTDLGCNGSVLPDDLIHEMCRFGASEIHVVSAFVGGIASQEVIKLVTKQFVPMLGTYIFNGIDHKSQLLKL

SEQ ID NO: 573 - DNA, 1881 bp, Arabidopsis thaliana
atggttaaattcgcgattattaatactctcactgtgaacgaaacttgggcgaaattgaaaagttttggcgttatggaatcgtccattgaagggagctccgagtcaactactgtcactacttctccttcgcgtcgtgtacgagaacttttagctttgtgtttcagttcagttgaagaagccggaggatttcaagactttgagagttttgtgacagaacttgtcagctgtttggattctttgtatgagaacgtagctttggatgctaacaatgaactggagaacgatgttattgaagaagtattagatgaaattttgaaagttttatcatctcctcaaatggatcaggatgttatagatgcactgtcatttcacttgccaaaagtaacttccaagtttgcagacatatcaagcagatgtttacagttagttgaggaaatcgttgatcggtttgtggaagcatgcaatccacgggatatgctttcaattctttgtgaggcactcgatgctgcacggtgctatcattcagcctccacttgttctactcctttattgcatgggctctctaaagtatttattttgatccagaggcgtcactacgagcaattaaaggttgcagttccaattgtcctgaacgttttgaaggacatttcattggaaacagacgtgcaagttgaagatttatttgataaggctctaggcattgcctcttcaattcgagacgtttcttcaaaactgaataacgaagaagaagcaaaagtccgttgtctactttgtctctatgtgatacagataacggctattatttcagttagcatcagagacaaagcggcctcttgtattcctctggtgattcagttagaaccgttcttgacatcctgtggtttaacacatcttggtttaatcacggggaatgacactgaaaaattaatgagcacggttgctggagatgatgatgagtttatcacctctttccctgacatcagcttgggtgcatcgcttttattcatctgtgcaaagatctcccatgaggttgcagaggcggctaatgcggttttaggaagtgttgttgatgagcttcaaaacaatccagtgaaaaggtggcaagcttatgggatgttgaaatatatactttcctctggagatctgctctgggaattcaaaagacatgctatcgagttcttgcttgacataacaaaaggagttacttcatctcaatgcaatgatgagcaaatagattgttcggactacacgcctggcatctacgctactttacaggctgttacattactgatcatgtatgcgccagacgcagatctgaggaaaaagacatttgaggcactgaagagggttctttctgatatcccagctcctcataggtttgacgttttaagagcccttgtcacaaattcccggtctccttcaatgacagcaatccttctgggtctagttaaagacagcatgagcaaaagcagtttgcaagatacagattgtgcggctgttgatacgcatgttattgagctagtggagttggtcttaaggcctccacagggaggtcctccactccttccggaccagagtgatgcgatcctggcggcacttaacctctacaggtttgcactgttatttgaatcgagagaatgtgaagcaggtaaagagagaagcaaagtcggcagtgatattttgtcaaagaagaatctggagaaagcgtataaggaatggcttctgcctcttcgaactcttgtgagctgcagcatcgctgagaacctcaaggaggatcatggccaagaatcttcactcgacgatgtagggcttctgaacccaattgaattggttctatatcgatgcatcgagctcgtggaagaaaagttgaaaagtcattag

SEQ ID NO: 574 - protein, 626 aa, Arabidopsis thaliana
MVKFAIINTLTVNETWAKLKSFGVMESSIEGSSESTTVTTSPSRRVRELLALCFSSVEEAGGFQDFESFVTELVSCLDSLYENVALDANNELENDVIEEVLDEILKVLSSPQMDQDVIDALSFHLPKVTSKFADISSRCLQLVEEIVDRFVEACNPRDMLSILCEALDAARCYHSASTCSTPLLHGLSKVFILIQRRHYEQLKVAVPIVLNVLKDISLETDVQVEDLFDKALGIASSIRDVSSKLNNEEEAKVRCLLCLYVIQITAIISVSIRDKAASCIPLVIQLEPFLTSCGLTHLGLITGNDTEKLMSTVAGDDDEFITSFPDISLGASLLFICAKISHEVAEAANAVLGSVVDELQNNPVKRWQAYGMLKYILSSGDLLWEFKRHAIEFLLDITKGVTSSQCNDEQIDCSDYTPGIYATLQAVTLLIMYAPDADLRKKTFEALKRVLSDIPAPHRFDVLRALVTNSRSPSMTAILLGLVKDSMSKSSLQDTDCAAVDTHVIELVELVLRPPQGGPPLLPDQSDAILAALNLYRFALLFESRECEAGKERSKVGSDILSKKNLEKAYKEWLLPLRTLVSCSIAENLKEDHGQESSLDDVGLLNPIELVLYRCIELVEEKLKSH

SEQ ID NO: 575 - DNA, 963 bp, Arabidopsis thaliana
atggtgaaagcaactaaggcagagaagaagatcgcctacgataccaagctatgtcagcttatcgatgagtacacccagatcttggtcgttgcggccgataacgtcggatcaactcagcttcagaacatcagaaagggtcttcgtggagactccgtcgtgcttatggggaagaacactatgatgaagcgttccgttaggattcactctgagaacaccggaaacactgcaatcctgaatctgcttcctctccttcagggaaacgttggtttgatctttaccaaaggtgacctcaaggaagtgagcgaggaggttgctaagtacaaggttggtgcccctgctcgtgtgggtttggtggctccaattgatgtggttgtccaacctggcaacactggtctcgacccatcccaaacatctttcttccaggtgcttaacatcccaaccaagattaacaagggtaccgtcgaaatcatcaccccagttgagcttatcaagcaaggtgacaaggtcgggtcttctgaggctgcgcttctagccaagcttggcatcaggccgttctcatatggtcttgttgtccagtctgtctatgacaatggctcagtcttcagcccagaggttcttgatcttactgaagaccaacttgtggagaagtttgcttctggtatctccatggtcacttccttggctcttgctgtgtcgtaccctacccttgctgctgcaccgcatatgttcatcaatgcgtacaagaatgccttggctattgctgttgccactgagtacaccttccctcaagcagagaaggtcaaggaatacttgaaggatccaagcaagtttgctgttgcttcagtagctgcggtgtctgctgatgcaggtggtggtgccccagctgctgctaaggtagaggagaaggaagagtccgacgaagaagactatggaggtgatttcggtttgttcgatgaagagtag

SEQ ID NO: 576 - protein, 320 aa, Arabidopsis thaliana
MVKATKAEKKIAYDTKLCQLIDEYTQILVVAADNVGSTQLQNIRKGLRGDSVVLMGKNTMMKRSVRIHSENTGNTAILNLLPLLQGNVGLIFTKGDLKEVSEEVAKYKVGAPARVGLVAPIDVVVQPGNTGLDPSQTSFFQVLNIPTKINKGTVEIITPVELIKQGDKVGSSEAALLAKLGIRPFSYGLVVQSVYDNGSVFSPEVLDLTEDQLVEKFASGISMVTSLALAVSYPTLAAAPHMFINAYKNALAIAVATEYTFPQAEKVKEYLKDPSKFAVASVAAVSADAGGGAPAAAKVEEKEESDEEDYGGDFGLFDEE

SEQ ID NO: 577 - DNA, 3069 bp, Arabidopsis thaliana
atgtacaccaatttacttggtttggaccctagcttgaggaatggaagtttaaaagatggaaacctcaactgggagatgttgcagtttaagtcaaggtttccacgcgaagttttgctctgcagagtaggagaattttatgaggctattggaatagatgcttgtatacttgttgaatatgctggtctcaatccttttggtggtcttcgatcagatagtattccaaaggctggctgcccaattatgaatcttcgacagactttggatgacctgacacgcaatggttattcagtgtgtattgtggaggaagttcaggggccaacaccagcacgctcccgtaaaggtcgatttatttcagggcatgcacatccaggaagtccttatgtatatgggcttgtcggtgttgaccatgatcttgactttcctgatcctatgcctgttgttgggatatctcgttcagcaagggggtattgtatgatatctattttcgagactatgaaagcatattcgctagatgatggtctaacagaagaagccttagttaccaagctccgcactcgtcgctgtcatcatcttttcttacatgcatcgttgaggcacaatgcatcagggacgtgccgctggggagagtttggggaagggggtctactctggggagaatgcagtagcaggaattttgaatggtttgaaggagatactctttccgagctcttatcaagggtcaaagatgtttatggtcttgatgatgaagtttcctttagaaatgtcaatgtaccttcaaaaaatcggccacgtccgttgcatcttggaacggctacacaaattggtgccttacctactgaaggaataccttgtttgttgaaggtgttacttccatctacgtgcagtggtctgccttctttgtatgttagggatcttcttctgaaccctcctgcttacgatattgctctgaaaattcaagaaacgtgcaagctcatgagcacagtaacatgttcaattccagagtttacctgcgtctcttctgctaagcttgtgaagcttcttgagcaacgggaagccaactacattgagttctgtcgaataaaaaatgtgcttgatgatgtattacatatgcatagacatgctgagcttgtggaaatcctgaaattattgatggatcctacctgggtggctactggtttgaaaattgactttgacacttttgtcaacgaatgtcattgggcgtctgatacaattggtgaaatgatctctttagatgagaatgaaagtcatcagaatgtaagtaaatgtgacaatgtcccgaacgaattcttttatgatatggagtcttcatggcgaggtcgcgttaagggaattcatatagaggaagaaatcactcaagtagaaaaatcagctgaggctttatctttagcagtagctgaggattttcaccctattatatcaagaattaaggccaccactgcttcacttggtggcccgaaaggcgaaatcgcatatgcaagagagcatgagtctgtttggttcaaggggaaacggtttacgccatctatctgggctggtactgcaggggaagaccaaataaaacagctgaaacctgccttagactcgaaaggaaaaaaggttggagaagaatggtttacgaccccaaaggtggaaattgctttagtcagataccatgaagctagtgagaatgcaaaagctcgggtgttggaactgttgcgcgagttatccgttaaattgcaaacaaaaataaatgttcttgtctttgcatctatgcttctggtcatttcaaaagcattattttcccatgcttgtactgtgcacaactacagtgaagggagaaggcgaaagtgggtttttccaacgcttgtcggattcagtttagatgagggcgcaaaaccattagatggtgccagtcgaatgaagctgacaggcctgtcaccttattggtttgatgtatcttctggaaccgctgttcacaataccgttgacatgcaatcactgtttcttctaactggacctaacggtggtggtaaatcgagtttgctcagatcaatatgcgcagctgctctacttggaatttccggtttaatggttccagctgaatcagcttgtattcctcactttgattccatcatgcttcacatgaaatcatatgacagccctgtagacggaaaaagttctttccaggtagaaatgtcggaaatacgatctattgtaagccaggctacttcgagaagcctagtgcttatagatgagatatgccgagggacagagacagcaaaaggcacctgtatcgctggtagtgtggtagagagtcttgacacaagtggttgtttgggtattgtatctactcatctccatggaatcttcagtttacctcttacagcgaaaaacatcacatataaagcaatgggagccgaaaatgtcgaagggcaaaccaagccaacttggaaattgacagatggagtctgcagagagagtcttgcgtttgaaacagctaagagggaaggtgttcccgagtcagttatccaaagagctgaagctctttacctctcggtctatgcaaaagacgcatcagctgaagttgtcaaacccgaccaaatcataacttcatccaacaatgaccagcagatccaaaaaccagtcagctctgagagaagtttggagaaggacttagcaaaagctatcgtcaaaatctgtgggaaaaagatgattgagcctgaagcaatagaatgtctttcaattggtgctcgtgagcttccacctccatctacagttggttcttcatgcgtgtatgtgatgcggagacccgataagagattgtacattggacagaccgatgatcttgaaggacgaatacgtgcgcatcgagcaaaggaaggactgcaagggtcaagttttctataccttatggttcaaggtaagagcatggcttgtcagttagagactctattgattaatcaactccatgaacaaggctactctctggctaacctagccgatggaaagcaccgtaatttcggaacgtcctcaagcttgagtacatcagacgtagtcagcatcttatag

SEQ ID NO: 578 - protein, 1022 aa, Arabidopsis thaliana
MYTNLLGLDPSLRNGSLKDGNLNWEMLQFKSRFPREVLLCRVGEFYEAIGIDACILVEYAGLNPFGGLRSDSIPKAGCPIMNLRQTLDDLTRNGYSVCIVEEVQGPTPARSRKGRFISGHAHPGSPYVYGLVGVDHDLDFPDPMPVVGISRSARGYCMISIFETMKAYSLDDGLTEEALVTKLRTRRCHHLFLHASLRHNASGTCRWGEFGEGGLLWGECSSRNFEWFEGDTLSELLSRVKDVYGLDDEVSFRNVNVPSKNRPRPLHLGTATQIGALPTEGIPCLLKVLLPSTCSGLPSLYVRDLLLNPPAYDIALKIQETCKLMSTVTCSIPEFTCVSSAKLVKLLEQREANYIEFCRIKNVLDDVLHMHRHAELVEILKLLMDPTWVATGLKIDFDTFVNECHWASDTIGEMISLDENESHQNVSKCDNVPNEFFYDMESSWRGRVKGIHIEEEITQVEKSAEALSLAVAEDFHPIISRIKATTASLGGPKGEIAYAREHESVWFKGKRFTPSIWAGTAGEDQIKQLKPALDSKGKKVGEEWFTTPKVEIALVRYHEASENAKARVLELLRELSVKLQTKINVLVFASMLLVISKALFSHACTVHNYSEGRRRKWVFPTLVGFSLDEGAKPLDGASRMKLTGLSPYWFDVSSGTAVHNTVDMQSLFLLTGPNGGGKSSLLRSICAAALLGISGLMVPAESACIPHFDSIMLHMKSYDSPVDGKSSFQVEMSEIRSIVSQATSRSLVLIDEICRGTETAKGTCIAGSVVESLDTSGCLGIVSTHLHGIFSLPLTAKNITYKAMGAENVEGQTKPTWKLTDGVCRESLAFETAKREGVPESVIQRAEALYLSVYAKDASAEVVKPDQIITSSNNDQQIQKPVSSERSLEKDLAKAIVKICGKKMIEPEAIECLSIGARELPPPSTVGSSCVYVMRRPDKRLYIGQTDDLEGRIRAHRAKEGLQGSSFLYLMVQGKSMACQLETLLINQLHEQGYSLANLADGKHRNFGTSSSLSTSDVVSIL

SEQ ID NO: 579 - DNA, 1608 bp, Arabidopsis thaliana
atggcgctggcgttcgatgagttcgggcgtccgttcattatactgagagagcaagatcaaaagactcgtcttagaggaatcgatgctcagaaagccaatatcgccgctggtaaagccgtggctcggatccttcgatcctctcttggacccaaaggaatggataagatgcttcaaggacctgacggagacatcaccatcacaaacgatggtgctacgatattggagcaaatggatgttgacaaccagattgcgaaactaatggtggaactgtcgcggagtcaggattatgaaattggtgatggaacaacaggtgttgttgttatggctggtgcacttcttgagcaagctgaacgtcagttagatagaggaattcatcccattcgtattgctgaaggatatgagatggcttctagggtggctgttgagcatttggagcgtattgcccaaaagtttgaattcgatgttaataattatgagcctctggttcagacttgcatgactactctgtcctcgaagattgtgaatcgatgcaagcgcagcttagctgagattgctgttaaagcggttcttgctgttgctgatttagagaggagggatgttaacttagatctgatcaaagtagaggggaaagttgggggaaagttggaggacactgagcttatttatggaatactgattgacaaagatatgagtcatccgcaaatgccaaagcagattgaagatgcccacattgccattttgacttgtccctttgagccaccgaagccgaagactaagcataaggtggacattgatacagtggaaaagtttgagacattgcgcaagcaagagcagcaatatttcgatgagatggtacaaaagtgcaaggatgttggtgctacgctggttatttgccaatggggattcgatgatgaggcaaaccatctattgatgcacaggaatttgcctgctgtcagatgggtagggggtgttgaattagaacttatcgcaatagccacaggcggtagaattgttccaagattccaggagttgaccccagagaagttagggaaggctggcgtggttcgtgagaaatcttttggcacaacaaaagaacgaatgctgtatattgagcactgtgcgaactcaaaagctgtcactgttttcatccgtggaggtaacaaaatgatgatagaagagacgaaacgtagtatccacgatgctctgtgtgtggctaggaatctcatccgcaacaaatcaattgtttatggaggtggggcagctgaaatcgcttgctcacttgcggttgatgcagctgctgataaataccctggcgtggagcagtatgcaattagggcgtttgcagaagctttggactctgtccctatggctcttgcagagaacagtggattacagcccattgagacactctctgcggttaaatctcagcaaattaaggagaatattcccttctatggaatagattgcaatgacgtgggaacaaacgatatgagggagcaaaatgtgtttgaaacattgatcgggaaacagcaacaaattttgctagctacgcaagtcgttaagatgattctaaagatcgacgatgtcatctccaattctgaatactga

SEQ ID NO: 580 - protein, 535 aa, Arabidopsis thaliana
MALAFDEFGRPFIILREQDQKTRLRGIDAQKANIAAGKAVARILRSSLGPKGMDKMLQGPDGDITITNDGATILEQMDVDNQIAKLMVELSRSQDYEIGDGTTGVVVMAGALLEQAERQLDRGIHPIRIAEGYEMASRVAVEHLERIAQKFEFDVNNYEPLVQTCMTTLSSKIVNRCKRSLAEIAVKAVLAVADLERRDVNLDLIKVEGKVGGKLEDTELIYGILIDKDMSHPQMPKQIEDAHIAILTCPFEPPKPKTKHKVDIDTVEKFETLRKQEQQYFDEMVQKCKDVGATLVICQWGFDDEANHLLMHRNLPAVRWVGGVELELIAIATGGRIVPRFQELTPEKLGKAGVVREKSFGTTKERMLYIEHCANSKAVTVFIRGGNKMMIEETKRSIHDALCVARNLIRNKSIVYGGGAAEIACSLAVDAAADKYPGVEQYAIRAFAEALDSVPMALAENSGLQPIETLSAVKSQQIKENIPFYGIDCNDVGTNDMREQNVFETLIGKQQQILLATQVVKMILKIDDVISNSEY

SEQ ID NO: 581 - DNA, 1998 bp, Arabidopsis thaliana
atgaagagagaaggagaagaagaagaagacaacaatcaactttcactgcaagaagaagaaccagatacagaggaagagatgtctgggaggacaatcgaaccgtggacgaagcagataacggtgagaggagtgttcgtgagcatagtgatcggagttgtgttcagtgtgattgctcagaagctaaatctcacgacaggaattgttccaaatctcaacagctctgcagctttacttgcttttgtctttgtccagacttggactaagattctcaagaaatcaggatttgttgcgaaaccattcacaagacaagagaacacaatgattcagacatctgctgttgcttgttacggcatcgctgtcggaggtgggtttgcttcatatcttctggggttaaaccataagacatatgtgttgtctggtgtgaacttggaaggtaactctccaaagagtgtgaaagaacctggccttggttggatgactgcttatctctttgttgtctgtttcatcggtctttttgtcctaatccctctccgaaaggttatgattgttgaccttaaattaacatatccgagtggtttagctactgcggttctcatcaatggcttccacacacaaggagatgcacaggccaagaaacaagtgcgtggtttcatgaaatacttctcatttagtttcttgtggggtttcttccagtggtttttctctggtattgaagattgtggctttgctcaattcccaacctttggtttgaaagcttggaaacaaacgttcttctttgatttcagcatgacatttgtgggagcaggaatgatttgttcacatttggttaacctttctttgcttttaggagctatcctctcttatggcttaatgtggcctcttcttgataaacttaagggctcttggttccctgataatctcgacgaacacaacatgaagagcatttacggctacaaagtcttcttatccgtagctctaatcctcggcgacggtctttacactttcgttaagatcctctttgtgaccattgccaatgtcaacgcaagattgaagaacaaacctaatgatctagatgacgtaggtcacaagaaacaacggaaagatctcaaggaagatgagaatttcctcagagataaaatcccaatgtggttcgcagtttccggatatcttacattcgctgcggtctcaaccgtcgtggttcctctgatatttcctcagctcaaatggtattacgttattgtagcttacattttcgcgccttctctggccttctgtaacgcttatggagctggacttacagacattaacatggcttataactacggcaaaattggtctttttgtcatcgcggctgtgacgggaagagagaacggagttgtagccggactcgccggttgtggactgatcaaatccgttgtttcggtttcttgtattttgatgcaagatttcaagacggctcattacacgatgacgtcacctaaggctatgtttgctagccaaatgattggaacggtcgttggatgcatcgtgacgccgttaagtttctttttgttctacaaagcgttcgacattggaaaccctaacggagaattcaaggctccttacgctttgatttacagaaatatggcgattcttggggtgcaaggcttctctgctctgcctcttcactgtctccaaatgtgttacgggtttttcgggtttgctgttttggtcaacgtcgtcagagatcttactccggcgaagattggaagattcatgccacttccgacggcgatggctgttccgtttcttgtcggagcttatttcgcaatcgacatgtgtgttgggactttgattgtgtttgtttgggagaagatgaatcggaagaaagcagagtttatggttccggcggtggcttcagggctaatctgtggcgaagggctttggactttacctgcggcggtgcttgccctcgccggagtaaaacctccgatatgtatgaagttcttagcttcatag

SEQ ID NO: 582 - protein, 665 aa, Arabidopsis thaliana
MKREGEEEEDNNQLSLQEEEPDTEEEMSGRTIEPWTKQITVRGVFVSIVIGVVFSVIAQKLNLTTGIVPNLNSSAALLAFVFVQTWTKILKKSGFVAKPFTRQENTMIQTSAVACYGIAVGGGFASYLLGLNHKTYVLSGVNLEGNSPKSVKEPGLGWMTAYLFVVCFIGLFVLIPLRKVMIVDLKLTYPSGLATAVLINGFHTQGDAQAKKQVRGFMKYFSFSFLWGFFQWFFSGIEDCGFAQFPTFGLKAWKQTFFFDFSMTFVGAGMICSHLVNLSLLLGAILSYGLMWPLLDKLKGSWFPDNLDEHNMKSIYGYKVFLSVALILGDGLYTFVKILFVTIANVNARLKNKPNDLDDVGHKKQRKDLKEDENFLRDKIPMWFAVSGYLTFAAVSTVVVPLIFPQLKWYYVIVAYIFAPSLAFCNAYGAGLTDINMAYNYGKIGLFVIAAVTGRENGVVAGLAGCGLIKSVVSVSCILMQDFKTAHYTMTSPKAMFASQMIGTVVGCIVTPLSFFLFYKAFDIGNPNGEFKAPYALIYRNMAILGVQGFSALPLHCLQMCYGFFGFAVLVNVVRDLTPAKIGRFMPLPTAMAVPFLVGAYFAIDMCVGTLIVFVWEKMNRKKAEFMVPAVASGLICGEGLWTLPAAVLALAGVKPPICMKFLAS

SEQ ID NO: 583 - DNA, 798 bp, Arabidopsis thaliana
atgggtaaagttgcttctgataaatgtcacaagtgggttttcaaagaaccatctgaatctgaaccaaatcttgctaattactggcaaagttcttttgatgctcttcctccagaatggaccgaccaattcgaatcaggcattcagacaattgctgtgattcaagctggacatggtctgttacagctaggttcttgcaagattattccagaagatcttcattttgtgctaaggatgaggcaaatgtttgaatcaattggttacagatcaggtttttacctctcacagctcttctcttcaaaccgaaccgcgactccatcttcttccacggttccaaaccagatacctcagtctcaaggttttaactggggatcacactcacctttgttaccttcccctagctttcagaaccaactacctgcttcagctagattcggtttccttcaagataacaatgttcctcctcagatgcttcctccaatggaagagcatgaagacgacatcaaatggcctaatggtttgtcgttgttcaatgcgttgactggacgtgcagatgaagctagtaggcttttgtttaaccaggagcagaacccgatgaatgtcgaaaaccagaacgagttcttgaaccttgaaggtcatcatcctaacaagtttagaagaagctatacattgccagctcgaatggattcttcgtcatcatcaacctcgcttgatcagcaacaaccactggagtttaggaacaataactctggaagcaactcgggtttgttccctgacgttatggagacgtttttgaggtga

SEQ ID NO: 584 - protein, 265 aa, Arabidopsis thaliana
MGKVASDKCHKWVFKEPSESEPNLANYWQSSFDALPPEWTDQFESGIQTIAVIQAGHGLLQLGSCKIIPEDLHFVLRMRQMFESIGYRSGFYLSQLFSSNRTATPSSSTVPNQIPQSQGFNWGSHSPLLPSPSFQNQLPASARFGFLQDNNVPPQMLPPMEEHEDDIKWPNGLSLFNALTGRADEASRLLFNQEQNPMNVENQNEFLNLEGHHPNKFRRSYTLPARMDSSSSSTSLDQQQPLEFRNNNSGSNSGLFPDVMETFLR

SEQ ID NO: 585 - DNA, 1758 bp, Arabidopsis thaliana
atgggttccatcgaagaagaagcaagacctctcatcgaagaaggtttaattttacaggaagtgaaattgtatgctgaagatggttcagtggactttaatggaaacccaccattgaaggagaaaacaggaaactggaaagcttgtccttttattcttggtaatgaatgttgtgagaggctagcttactatggtattgctgggaatttaatcacttacctcaccactaagcttcaccaaggaaatgtttctgctgctacaaacgttaccacatggcaagggacttgttatctcactcctctcattggagctgttctggctgatgcttactggggacgttactggaccatcgcttgtttctccgggatttatttcatcgggatgtctgcgttaactctttcagcttcagttccggcattgaagccagcggaatgtattggtgacttttgtccatctgcaacgccagctcagtatgcgatgttctttggtgggctttacctgatcgctcttggaactggaggtatcaaaccgtgtgtctcatccttcggtgccgatcagtttgatgacacggactctcgggaacgagttagaaaagcttcgttctttaactggttttacttctccatcaatattggagcacttgtgtcatctagtcttctagtttggattcaagagaatcgcgggtggggtttagggtttgggataccaacagtgttcatgggactagccattgcaagtttcttctttggcacacctctttataggtttcagaaacctggaggaagccctataactcggatttcccaagtcgtggttgcttcgttccggaaatcgtctgtcaaagtccctgaagacgccacacttctgtatgaaactcaagacaagaactctgctattgctggaagtagaaaaatcgagcataccgatgattgccagtatcttgacaaagccgctgttatctcagaagaagaatcgaaatccggagattattccaactcgtggagactatgcacggttacgcaagtcgaagaactcaagattctgatccgaatgttcccaatctgggcttctggtatcattttctcagctgtatacgcacaaatgtccacaatgtttgttcaacaaggccgagccatgaactgcaaaattggatcattccagcttcctcctgcagcactcgggacattcgacacagcaagcgtcatcatctgggtgccgctctacgaccggttcatcgttcccttagcaagaaagttcacaggagtagacaaaggattcactgagatacaaagaatgggaattggtctgtttgtctctgttctctgtatggcagctgcagctatcgtcgaaatcatccgtctccatatggccaacgatcttggattagtcgagtcaggagccccagttcccatatccgtcttgtggcagattccacagtacttcattctcggtgcagccgaagtattctacttcatcggtcagctcgagttcttctacgaccaatctccagatgcaatgagaagcttgtgcagtgccttggctcttttgaccaatgcacttggtaactacttgagctcgttgatcctcacgctcgtgacttattttacaacaagaaatgggcaagaaggttggatttcggataatctcaattcaggtcatctcgattacttcttctggctcttggctggtcttagccttgtgaacatggcggtttacttcttctctgctgctaggtataagcaaaagaaagcttcgtcgtag

SEQ ID NO: 586 - protein, 585 aa, Arabidopsis thaliana
MGSIEEEARPLIEEGLILQEVKLYAEDGSVDFNGNPPLKEKTGNWKACPFILGNECCERLAYYGIAGNLITYLTTKLHQGNVSAATNVTTWQGTCYLTPLIGAVLADAYWGRYWTIACFSGIYFIGMSALTLSASVPALKPAECIGDFCPSATPAQYAMFFGGLYLIALGTGGIKPCVSSFGADQFDDTDSRERVRKASFFNWFYFSINIGALVSSSLLVWIQENRGWGLGFGIPTVFMGLAIASFFFGTPLYRFQKPGGSPITRISQVVVASFRKSSVKVPEDATLLYETQDKNSAIAGSRKIEHTDDCQYLDKAAVISEEESKSGDYSNSWRLCTVTQVEELKILIRMFPIWASGIIFSAVYAQMSTMFVQQGRAMNCKIGSFQLPPAALGTFDTASVIIWVPLYDRFIVPLARKFTGVDKGFTEIQRMGIGLFVSVLCMAAAAIVEIIRLHMANDLGLVESGAPVPISVLWQIPQYFILGAAEVFYFIGQLEFFYDQSPDAMRSLCSALALLTNALGNYLSSLILTLVTYFTTRNGQEGWISDNLNSGHLDYFFWLLAGLSLVNMAVYFFSAARYKQKKASS

SEQ ID NO: 587 - DNA, 717 bp, Arabidopsis thaliana
atgggtcgcgaatctgtggctgttgtgactgcgccgccctcggcgactgctccgggtactgcttcggtggcgacctcgcttgctcctggcttccgatttcatccgactgatgaggaactcgtgagctattacttgaagaggaaggttctgggccaacctgtacgcttcgatgcgattggagaggtcgatatatacaagcatgagccctgggatttagcagtgttttcgagattgaagacaagggaccaagaatggtacttctacagtgcattagataagaagtatggaaacggtgctaggatgaaccgagcaactaacagagggtactggaaagctactggaaaagacagagaaatccgccgtgacattctgcttctcggtatgaaaaagacacttgttttccacagtgggcgtgcaccagacgggcttcggactaattgggttatgcatgagtatcgccttgtggaatatgaaaccgagaaaaacggaaacctggtgcaagatgcatatgtgttgtgtagagtcttccacaagaataacattgggccaccaagtgggaacagatatgctccgttcatggaagaggaatgggctgatgatgaaggagctctgattccaggaatagacgttaagctcaggctagagccgccgccagtagccaatggaaacgaccagatggaccagataatttatgcgtcgtctggggttcacttgtaa

SEQ ID NO: 588 - protein, 238 aa, Arabidopsis thaliana
MGRESVAVVTAPPSATAPGTASVATSLAPGFRFHPTDEELVSYYLKRKVLGQPVRFDAIGEVDIYKHEPWDLAVFSRLKTRDQEWYFYSALDKKYGNGARMNRATNRGYWKATGKDREIRRDILLLGMKKTLVFHSGRAPDGLRTNWVMHEYRLVEYETEKNGNLVQDAYVLCRVFHKNNIGPPSGNRYAPFMEEEWADDEGALIPGIDVKLRLEPPPVANGNDQMDQIIYASSGVHL

SEQ ID NO: 589 - DNA, 1353 bp, Arabidopsis thaliana
atgcgagaaatcataagcattcacatcggacaagctgggatccaggtcggaaattcgtgttgggagctttactgtctcgaacatggaatccagccggacggaatgatgccgagtgatactacagttggtgttgcacacgatgcgttcaatactttctttagcgagactggtgctgggaagcatgtccctagggctgtcttcgttgatctcgagcctaccgttatcgacgaagttcgtactggtacttaccgtcaacttttccatccagagcagctcatttctgggaaagaagatgctgctaacaacttcgctagaggacattacactgttgggaaggaaattgtggatctatgtcttgaccgtgtgaggaaacttgccgacaactgtactggcttacaagggtttttggtgttcaatgctgttggtggtggaactggttctggattgggttctctgttgctagagcgtttgtctgtagattatggaaagaagtctaagcttggttttaccatatacccttctcctcaggtttctactgctgttgtagaaccttacaacagtgttctctcaacgcattcccttcttgaacatacggatgtagctgtcctcttggataacgaagccatctatgacatttgccgcagatccctagatatcgagaggccaacctacacaaacttgaacaggttgatatcacagatcatttcatccttgacaacatctttgaggtttgatggtgccatcaacgtggatatcactgagttccagaccaatcttgtcccatatccccgtatccatttcatgctgtcatcttatgcaccagtcatctcagccgccaaggcttaccacgagcagctatcagtccctgagatcaccaatgccgtttttgagccagctagcatgatggcaaagtgtgacccgagacacggaaagtacatggcctgttgtttgatgtaccgaggagatgttgttcccaaagatgttaatgctgctgttggcaccatcaagacaaagaggactgttcagtttgttgactggtgcccaactgggttcaaatgtggaatcaactaccaacctccaacagttgttccaggtggtgacctcgctaaggttcagagagctgtatgtatgatcagtaacaacacagcagttgcagaggtgttctcacggatcgaccacaagtttgatctcatgtatgcgaagagggcatttgtccactggtacgttggtgaaggaatggaggaaggtgaattctctgaggcacgtgaagacttggccgcactggagaaagattacgaagaagttggtgctgaaggtggagacgatgaagaagatgaaggtgaagactattga

SEQ ID NO: 590 - protein, 450 aa, Arabidopsis thaliana
MREIISIHIGQAGIQVGNSCWELYCLEHGIQPDGMMPSDTTVGVAHDAFNTFFSETGAGKHVPRAVFVDLEPTVIDEVRTGTYRQLFHPEQLISGKEDAANNFARGHYTVGKEIVDLCLDRVRKLADNCTGLQGFLVFNAVGGGTGSGLGSLLLERLSVDYGKKSKLGFTIYPSPQVSTAVVEPYNSVLSTHSLLEHTDVAVLLDNEAIYDICRRSLDIERPTYTNLNRLISQIISSLTTSLRFDGAINVDITEFQTNLVPYPRIHFMLSSYAPVISAAKAYHEQLSVPEITNAVFEPASMMAKCDPRHGKYMACCLMYRGDVVPKDVNAAVGTIKTKRTVQFVDWCPTGFKCGINYQPPTVVPGGDLAKVQRAVCMISNNTAVAEVFSRIDHKFDLMYAKRAFVHWYVGEGMEEGEFSEAREDLAALEKDYEEVGAEGGDDEEDEGEDY

SEQ ID NO: 591 - DNA, 3417 bp, Arabidopsis thaliana
atggaaaccaagaattgtagtaatgtagtagtagatcttcaagaatggctcggttatgatcgtgtgtacacagtgaacccggttggtctcagtgggggtttagctctgttttggaagaagggtgtaaatatcgatgtaagatatgcggataagaaccttattgattttcaaatacaatttggctcttatgatttctttgtctcctgtgtttatggagatccggcttttagtaacaagcatttggtttgggaaaagatttcaaagattggactcaacagaaaagaaccttggtgcatgttaggggattttaacgttattcttcacaatggggagaaaagaggaggcccaaggcgtggggactcatcttttatctctttcaaagacatgttggaatgctgtgatatgttggagcttccaagtaagggtaatccattctcgtggggagggaaaagaaacagcttgtggattcagtgccgtttggatagatgctttggcaacaaaaactggtttcggcattttccagtttctaatcaggagtttctggataagagaggctctgatcgtaggccagtcttggtgaggttatcaaagaccaaggaagagtacaaaggtaatttcaggtttgacaaaaggttgttcaaccaacccctggttaaagaggcaattcagcaggcctggaatggaaatcaaagggtcgggggcatgcaggttttggaaagattgaaaaagtgcagatcagctctaagtcgttggaagcaggagaataacagcaactctttaacttgtatttctcaagctagagcagctttagagctggaacaatcttcaggttttcccaggtctaaggtggtttttactctgaaaaatgatctttgcaaggctaaccaagatgaagaaaccttctggagtcagaagagtagagccaaatggatgcatgggggagataaaaacacttctttcttccatgcttcagttaaagacaacagagatgaagtgtcaaaaggggctattgctgaatcctacttcaaggatctcttcaagtcttcagagggaagtaattttgctgacttgtttgccggttttcagccaagggtaacagaggttatgaacagggtcctcaccgccactgtctctaagaatgaagttagagatgcggtcttcgcaataagaagctcaagtgccccgggggcagacggttttactggacaatcattggactccaagtcactcaagaggttcaaaagttctggacaatcattggactccaagtcactcaagaggttgcagatggtttcttctttcagaacgtttgtggcggaaaggctgatatctgataatatacttattgctcatgaggtggtgcatggtctgagaacacacaagacaatctctaaggatttcattgccattaaatctgatatgtctaaggcatttgatcgggtagagtggaactatgttaaagccttgctcgttgctcttggttttcattctagcttgtttatgtgtaaagctgagaaggaagaagtctcagttcttaagaacatcttcaaagtctatggtgatgctacgggtcaaagaataaactacgagaaatctagcattacttttggtgctttgatcttagactacatcaaagataaactcaaatccaggttgtcgggttggtttgctaggactctgtcacttgggggtaaggaaattttgctaaaagcagtggctatggcaatgcaagtctatgcgatgtcgtgttttaaactgacaaagactacctgcaagaatctcacaagtgcaatgtcagatttctggtggaatgccttagaacacaagaggaagacccattgggttagctgggagaaattgtgtcttgccaaagagagtggaggccttggttttagagacatagaaagcttcaaccaggctctgctggcaaagcaaagctggagaatacttcaatatccttcttttctcttcgcaagattctttaaaagtcgatactttgatgatgaagagtttctagaagcagatttgggagtccggccatcatatgcttgttgcagcattttgtttggcagagaattattagctaaagggttaagaaaagaagtgggcaatggaaaatccttaaatgtttggatggacccttggatttttgacattgcaccaagacttccccttcagaggcatttttctgtcaacctggatttaaaagtcaatgacctcattaattttgaagatcgttgctggaagagggacttactggaggaattgttttacccgactgacgttgagctaataaccaaaagaaacccggtggtgaacatggatgatttctgggtttggcttcacgcaaagactggggagtactctgtgaaatcgggttattggctagccttccaatccaataagctcgatctaatccagcaggctaatctccttccgtcaaccaacggccttaaggaacaggtttggtccactaaatcctctccaaaaataaaaatgtttctctggagaattttaagtgcagctctgcctgtggcggaccaaatcattagaagaggcatgtccattgacccaagatgccaaatttgcggcgacgagggagagtctacaaatcatgtcctattcacttgttctatggcaagacaagtatgggctttatcaggcgttcctactccggagtttggatttcaaaatgcgtcaatctttgcaaatattcagttcctctttgagctgaaaaagatgattttggttccagatttggtaaagaggtcttggccttgggtgctttggagattatggaagaacagaaacaagctgttttttgatggcatcactttctgtcctttgaattccattgtcaagattcaagaagatactctagaatggtttcaggcacaatcacagattcgtgtctctgaatctgaggagggacagagagtgataccttttactcacagctgggaaccgccacctgaaggttgggtgaaatgtaacattggttcagcctggtctgggaagaaaaaggtttgtggtggagcttgggttctcagagatgaacatgggtctgtcattttacatagtagaagggcttttaatgggtgttctaacaaaaaagaagccagcctgcgatgtattttttgggctattgatagtatgcgtagccatagagtttcaagggtgttgttcgcttttgagccaggagacttgttgtctgcttttactaggccgaaagcgtggccctctcttgcatataatgttggagaactaacttattttttggacaaggttgaagagtggaaggtagtggaagaaaaagtggtttccaataggggagcttctcttatagctcaaagtgtggtacagatttcagtcgtacgtcgcttccggtcctccacgttggctttctcagctctttga

SEQ ID NO: 592 - protein, 1138 aa, Arabidopsis thaliana
METKNCSNVVVDLQEWLGYDRVYTVNPVGLSGGLALFWKKGVNIDVRYADKNLIDFQIQFGSYDFFVSCVYGDPAFSNKHLVWEKISKIGLNRKEPWCMLGDFNVILHNGEKRGGPRRGDSSFISFKDMLECCDMLELPSKGNPFSWGGKRNSLWIQCRLDRCFGNKNWFRHFPVSNQEFLDKRGSDRRPVLVRLSKTKEEYKGNFRFDKRLFNQPLVKEAIQQAWNGNQRVGGMQVLERLKKCRSALSRWKQENNSNSLTCISQARAALELEQSSGFPRSKVVFTLKNDLCKANQDEETFWSQKSRAKWMHGGDKNTSFFHASVKDNRDEVSKGAIAESYFKDLFKSSEGSNFADLFAGFQPRVTEVMNRVLTATVSKNEVRDAVFAIRSSSAPGADGFTGQSLDSKSLKRFKSSGQSLDSKSLKRLQMVSSFRTFVAERLISDNILIAHEVVHGLRTHKTISKDFIAIKSDMSKAFDRVEWNYVKALLVALGFHSSLFMCKAEKEEVSVLKNIFKVYGDATGQRINYEKSSITFGALILDYIKDKLKSRLSGWFARTLSLGGKEILLKAVAMAMQVYAMSCFKLTKTTCKNLTSAMSDFWWNALEHKRKTHWVSWEKLCLAKESGGLGFRDIESFNQALLAKQSWRILQYPSFLFARFFKSRYFDDEEFLEADLGVRPSYACCSILFGRELLAKGLRKEVGNGKSLNVWMDPWIFDIAPRLPLQRHFSVNLDLKVNDLINFEDRCWKRDLLEELFYPTDVELITKRNPVVNMDDFWVWLHAKTGEYSVKSGYWLAFQSNKLDLIQQANLLPSTNGLKEQVWSTKSSPKIKMFLWRILSAALPVADQIIRRGMSIDPRCQICGDEGESTNHVLFTCSMARQVWALSGVPTPEFGFQNASIFANIQFLFELKKMILVPDLVKRSWPWVLWRLWKNRNKLFFDGITFCPLNSIVKIQEDTLEWFQAQSQIRVSESEEGQRVIPFTHSWEPPPEGWVKCNIGSAWSGKKKVCGGAWVLRDEHGSVILHSRRAFNGCSNKKEASLRCIFWAIDSMRSHRVSRVLFAFEPGDLLSAFTRPKAWPSLAYNVGELTYFLDKVEEWKVVEEKVVSNRGASLIAQSVVQISVVRRFRSSTLAFSAL

SEQ ID NO: 593 - DNA, 717 bp, Arabidopsis thaliana
atggtgacttcggagggattagcaagcgttgattcttggttatatcgccaaggtttcaacgttgattcatggttgctttctgataccttctctcacgacaacgatttgctcgcaagagctctccataccaccgtcacagcccctcatactctcactccttcctctgctttcttcgattcctccgctgtttctcacccttcttccactaacacactctcctctaccgtctccggtgcttctgatccagaaatcatcggcggaggagctaaacggaaacgtaactgccttcttaccgacggtaaagccgccaagcgccgcgctcgtgcttccaagaaatctcagactactttcataacggcggatccgtccaactttcgtcagatggttcagcaagtgactggcgccaagtacatcgatgactcttcttcctttggtattttcgatccgattgtcaagccggagccgcttaggttcgttaacaaactgccttgtggtccttcggatcgatccacggcggttccaatgctcgacacatcagcatttttgtctaatcatcaccaggagaatctcgcagtgggaaatgctttctccggtaacagcagcagtgtaggattaccgtcggggaagccaagtgcaacggccgaccccggtggttctgccgtggagtttgataattacccaacatttccaacgcttgaatcgtggaaggttatgtga

SEQ ID NO: 594 - protein, 238 aa, Arabidopsis thaliana
MVTSEGLASVDSWLYRQGFNVDSWLLSDTFSHDNDLLARALHTTVTAPHTLTPSSAFFDSSAVSHPSSTNTLSSTVSGASDPEIIGGGAKRKRNCLLTDGKAAKRRARASKKSQTTFITADPSNFRQMVQQVTGAKYIDDSSSFGIFDPIVKPEPLRFVNKLPCGPSDRSTAVPMLDTSAFLSNHHQENLAVGNAFSGNSSSVGLPSGKPSATADPGGSAVEFDNYPTFPTLESWKVM

SEQ ID NO: 595 - DNA, 4512 bp, Arabidopsis thaliana
atggactcaaagtcggttactccagaaccaaccaaccccttctacgcttcttcggggcaatcaggaaaaacctatgcttctgttgtcgccgccgctgctgctgcagccgccgataaggaggatggtggtgctgtgagtagtgccaaggagttggattcctcatcggaggctgtgtctggtaattcggataaggttggagctgatgatttatctgactccgagaaggagaagccgaatttggtgggtgatgggaaggtttccgacgaggtggatggttctttaaaggaggattctactactcctgaggctactccgaagcctgaggtggtttctggtgagacaattggtgtagatgatgtttcatcgttatctccgaagccggaggctgtttctgatggtgtaggggttgtggaggagaataagaaggttaaggaggacgtggaggatattaaagacgatggtgagagtaagattgaaaatgggagtgttgatgttgatgtgaaacaggcttccacagatggggagagtgagagtaaagtgaaggatgtggaagaagaagatgttggaacaaaaaaagatgatgagggggagagtgagttgggtggaaaagttgatgttgacgataaaagtgataatgttattgaagaagagggtgtggagttaactgataaaggagacgtcattgtgaactcgtcccctgtagaatcagtgcatgttgatgtggcaaaaccaggggtggttgttgtaggagacgcagagggaagtgaggagttgaagattaatgctgatgctgaaactcttgaagtggctaataagtttgatcaaattggggatgatgatagtggtgaatttgaacctgtgtctgacaaggccattgaggaggtagaagaaaaatttactagcgaatcagactctattgcagactcctctaagttagaatctgtggataccagtgctgtagagccagaggttgtagctgccgagagtgggagtgaaccaaaggatgtggaaaaagccaacggattggagaagggtatgacttatgctgaagtaatcaaggcagctagtgcagtagctgacaatggaaccaaagaggaggagagtgtgctcggtggcatagtcgatgatgcagaagaaggtgttaagttaaacaacaaaggagactttgtggtggactcatctgctattgaagctgtgaatgtagatgtggcaaagccaggggttgttgttgttggagacgtagaggtgagtgaggtgctggaaactgatggcaacatccctgatgtgcataataagtttgatccaattggccaaggtgaaggtggtgaagttgaacttgaatccgataaagccacagaggagggaggaggaaagttggttagtgaaggagactctatggttgactcctctgtggtggactctgttgatgctgatatcaatgttgcagagccaggggttgtggttgtcggggcggctaaggaggctgtaattaaggaagatgataaagatgatgaggttgacaagaccatctcaaatattgaggaacctgatgacctgactgctgcatatgatggaaattttgaattggctgttaaggaaatatcagaggctgccaaagtagagccagacgaaccaaaagtaggtgtggaagtagaagaattgcctgtttctgaaagtttaaaagtgggttcagttgatgcagaagaggattcaattcctgcagctgagtcacagtttgaggttcggaaagttgtcgaaggggacagtgctgaagaggatgaaaacaagctcccagtcgaagacattgtttcttctcgtgagtttagctttggaggcaaggaagtggaccaggaaccttctggcgaaggtgttaccagggttgatgggtctgaaagtgaagaagaaactgaagagatgatatttgggagttctgaagctgcaaaacagttcttagcagagttggaaaaggcttcttctggtatagaggcacattctgatgaagcaaacatttctaacaatatgtcagataggattgatggccagattgtcaccgattctgacgaggatgtagacacagaggatgaaggtgaggagaaaatgtttgatactgcagctttggctgcgcttttgaaggcagccactggtggtggaagttcagaaggtggcaattttaccataacatctcaggatggcacgaagcttttctctatggatcgacctgctggtttgagttcatcgttaaggcccttgaagcctgcagcagctccacgtgcaaaccgttccaacatcttttccaattctaatgtcacaatggcagatgagactgagattaacttgagcgaggaagagaaacagaaattagaaaagttgcaaagcctccgtgtgaagtttttgcggcttttgcaaaggttgggtcattcggcagaagattcaattgcagcgcaggttctttaccgtcttgcactacttgctgggagacaagcagggcagttattcagtcttgatgctgcaaagaagaaggctgtggagtctgaggctgagggcaacgaagaattgatcttctccctaaacatactggtccttggaaaagccggggtgggaaaaagtgctactataaattccattttgggaaaccagattgcgtccattgatgcttttgggctctcaaccacttcggttagagaaatttctggaacggtgaatggtgtcaagattacctttattgatactccgggtttgaagtctgctgcgatggatcaaagtacaaatgcaaaaatgttgtcctctgtaaagaaggtaatgaagaagtgtccccctgatattgtactatatgtagatcgtcttgacacccagaccagggacttgaacaatttgcccttgctaaggacgattactgcttctcttggtacatccatatggaaaaacgctatagtgacattgacccatgcggcttctgcccctcctgatggcccatctggcaccccattgagctatgatgtgtttgtagcgcagtgctcacatattgtgcaacagtctataggacaggctgttggagatctacgcttgatgaatccaagtctgatgaatccagtttcacttgttgagaatcaccccttgtgtaggaagaaccgggagggagtgaaggttctcccgaatggccaaacttggagatctcagctgttgctattgtgttactccctgaaggttttgtcagaaacaaattctctattgaggcctcaagaaccattggaccatcgtaaagtatttggtttccgagttagatccccgcctctcccttacttgttgtcttggctgttgcagtcccgtgcacatcctaagctccctggagaccaaggtggtgatagtgttgactctgatatcgaaattgatgatgtgtctgattctgagcaggaagatggggaagatgatgagtatgaccagctgccaccatttaagcctcttcgaaaaacccaacttgcaaagctctcaaatgaacagagaaaggcatatttcgaggagtatgattaccgtgtaaagctcctgcagaagaagcaatggagagaggaattaaagaggatgaaagaaatgaagaaaaacgggaagaagctgggtgaaagtgagtttggttatccgggagaagaagatgatccagaaaacggggctccagctgcagtgccagttccattacccgatatggttttgccaccttcatttgatagtgataactcagcttaccgataccgatatctggaacccacttcacaactcctaaccaggccagtgttggatacccatggttgggaccatgactgtggatatgacggcgtcaatgcagaacacagtcttgctctagctagccggttccctgccacagctactgtccaagtcaccaaggacaagaaagagttcaacattcatctggactcctctgtgtctgctaagcacggggagaatggatccaccatggcagggttcgatattcagaatgtaggcaagcagctggcatatgtggtcagaggagaaaccaaattcaagaatttgaggaagaacaagacaactgttggagggtcagtgacattcttgggagagaacatcgccactggggtcaaactcgaggaccaaatagcactggggaaaaggttggtgcttgtgggcagcactgggacaatgcgatcacagggagattcggcctatggtgcgaacctcgaggtcaggcttagggaagctgatttcccaattggacaggaccaatcttcttttgggctgtctctggtaaagtggagaggcgatttagcccttggagccaatctccaatctcaagtctctgttggaaggaactcaaagattgcgcttcgtgcaggacttaacaacaagatgagcggacagatcacagtcagaaccagcagctcggatcagttgcaaatcgctctcacagccattcttccaattgccatgtccatctacaagagcattcgacccgaagcgacgaacgacaagtacagcatgtactaa

SEQ ID NO: 596 - protein, 1503 aa, Arabidopsis thaliana
MDSKSVTPEPTNPFYASSGQSGKTYASVVAAAAAAAADKEDGGAVSSAKELDSSSEAVSGNSDKVGADDLSDSEKEKPNLVGDGKVSDEVDGSLKEDSTTPEATPKPEVVSGETIGVDDVSSLSPKPEAVSDGVGVVEENKKVKEDVEDIKDDGESKIENGSVDVDVKQASTDGESESKVKDVEEEDVGTKKDDEGESELGGKVDVDDKSDNVIEEEGVELTDKGDVIVNSSPVESVHVDVAKPGVVVVGDAEGSEELKINADAETLEVANKFDQIGDDDSGEFEPVSDKAIEEVEEKFTSESDSIADSSKLESVDTSAVEPEVVAAESGSEPKDVEKANGLEKGMTYAEVIKAASAVADNGTKEEESVLGGIVDDAEEGVKLNNKGDFVVDSSAIEAVNVDVAKPGVVVVGDVEVSEVLETDGNIPDVHNKFDPIGQGEGGEVELESDKATEEGGGKLVSEGDSMVDSSVVDSVDADINVAEPGVVVVGAAKEAVIKEDDKDDEVDKTISNIEEPDDLTAAYDGNFELAVKEISEAAKVEPDEPKVGVEVEELPVSESLKVGSVDAEEDSIPAAESQFEVRKVVEGDSAEEDENKLPVEDIVSSREFSFGGKEVDQEPSGEGVTRVDGSESEEETEEMIFGSSEAAKQFLAELEKASSGIEAHSDEANISNNMSDRIDGQIVTDSDEDVDTEDEGEEKMFDTAALAALLKAATGGGSSEGGNFTITSQDGTKLFSMDRPAGLSSSLRPLKPAAAPRANRSNIFSNSNVTMADETEINLSEEEKQKLEKLQSLRVKFLRLLQRLGHSAEDSIAAQVLYRLALLAGRQAGQLFSLDAAKKKAVESEAEGNEELIFSLNILVLGKAGVGKSATINSILGNQIASIDAFGLSTTSVREISGTVNGVKITFIDTPGLKSAAMDQSTNAKMLSSVKKVMKKCPPDIVLYVDRLDTQTRDLNNLPLLRTITASLGTSIWKNAIVTLTHAASAPPDGPSGTPLSYDVFVAQCSHIVQQSIGQAVGDLRLMNPSLMNPVSLVENHPLCRKNREGVKVLPNGQTWRSQLLLLCYSLKVLSETNSLLRPQEPLDHRKVFGFRVRSPPLPYLLSWLLQSRAHPKLPGDQGGDSVDSDIEIDDVSDSEQEDGEDDEYDQLPPFKPLRKTQLAKLSNEQRKAYFEEYDYRVKLLQKKQWREELKRMKEMKKNGKKLGESEFGYPGEEDDPENGAPAAVPVPLPDMVLPPSFDSDNSAYRYRYLEPTSQLLTRPVLDTHGWDHDCGYDGVNAEHSLALASRFPATATVQVTKDKKEFNIHLDSSVSAKHGENGSTMAGFDIQNVGKQLAYVVRGETKFKNLRKNKTTVGGSVTFLGENIATGVKLEDQIALGKRLVLVGSTGTMRSQGDSAYGANLEVRLREADFPIGQDQSSFGLSLVKWRGDLALGANLQSQVSVGRNSKIALRAGLNNKMSGQITVRTSSSDQLQIALTAILPIAMSIYKSIRPEATNDKYSMY

SEQ ID NO: 597 - DNA, 1170 bp, Arabidopsis thaliana
atgggaggttgtttcagcaatcggattaaaacagatattgcttccagtacatggctaagttcgaaattcttgagtagagatgggagcaagggctcgtcgaccgcttccttctcttatatgcctcgaacagaaggcgagatcttgcaaaatgctaatctcaagaactttagtctcagtgaactgaaatctgcaactaggaatttccggcctgatagtgtggttggtgaaggtggatttggttgcgttttcaaaggctggatcgatgagtcctctctcgctccttctaaaccggggaccgggattgtcattgctgtgaaaagacttaaccaagaagggtttcaaggtcatcgagagtggctggctgagatcaattatttaggccagctggatcatcctaaccttgtgaaactgattggatactgcttggaagaggagcacaggcttcttgtttacgagtttatgactcgtggtagtcttgagaatcacttattcagaagaggaacattctatcagccactttcatggaacacgcgggttcgtatggctcttggtgcagctagaggacttgcttttcttcacaatgctcaaccgcaagttatataccgagacttcaaagcatctaacatcttgctagattcgaactacaacgcaaagctttcggatttcggtttggctagagatggtccaatgggtgacaacagccatgtttctaccagagtcatgggaactcagggatacgctgctccagaatatctagctacaggtcatttatcggtgaagagcgatgtatacagttttggggttgtgttactggagttgttatcaggaagacgagcaattgacaagaatcaaccagtaggagaacacaatctcgtggattgggcaagaccctacttaacaaacaagagaagacttctgcgagtgatggatcctcgtctccaaggtcaatactcactaacccgagctttgaaaattgcagttcttgcactcgattgcatatctatagatgccaagagtagaccgaccatgaacgaaatcgtcaagacaatggaagaacttcatatccagaaggaagcatcaaaagagcagcagaatcctcaaatcagcattgacaacatcatcaacaaatctccacaagctgtgaattatcctaggccttcaattatgtaa

SEQ ID NO: 598 - protein, 389 aa, Arabidopsis thaliana
MGGCFSNRIKTDIASSTWLSSKFLSRDGSKGSSTASFSYMPRTEGEILQNANLKNFSLSELKSATRNFRPDSVVGEGGFGCVFKGWIDESSLAPSKPGTGIVIAVKRLNQEGFQGHREWLAEINYLGQLDHPNLVKLIGYCLEEEHRLLVYEFMTRGSLENHLFRRGTFYQPLSWNTRVRMALGAARGLAFLHNAQPQVIYRDFKASNILLDSNYNAKLSDFGLARDGPMGDNSHVSTRVMGTQGYAAPEYLATGHLSVKSDVYSFGVVLLELLSGRRAIDKNQPVGEHNLVDWARPYLTNKRRLLRVMDPRLQGQYSLTRALKIAVLALDCISIDAKSRPTMNEIVKTMEELHIQKEASKEQQNPQISIDNIINKSPQAVNYPRPSIM

SEQ ID NO: 599 - DNA, 4986 bp, Arabidopsis thaliana
atggaggaagtagcagctaaggttgaggaagaaactgtggaaaccaatgtagatgcagtgaaagaggacaatgcaactatagctaatgaaagcagaagcccagagagtgtttctgcagtgtctgtggtgtcaaatcgagctgcttctactaaaaagaaaccagttattagttcgaatttaataaagccaactgcgtcttcttcattacgggtctcgggtactacgcctgtgactatcaggagaaatagtactggaggagtaacagagaatttagctggtacctctaaggttctgcctaagcaagtgagtactactgcctcacgtactgatccggtaagacgatcacttccagaattgaggaagagctctgtgtcttctctttctgctaagactgtatccaaaccaagcctttccgagagtaaaaagtctgtccccgtatcaccaggtagtcggagtttgacaaagtcaactgggtttagtttaagtaagcctgagtcttctgctagaccagccatgagtgtttctgtgtcttcgaaaagagctccatcttcatcagttgacagtagtggcagcaggactagtagtggaagactacactctactctcacaagtgggaggacagtttctaaagtttcttctccctctgcgggatcatcaccttctgtttctagcagtataagatcaaagtcattttcgtcacctctagaccggacttccaacttctctggacggaagaaaacatctacccctgaaagccgtgattcacgactcattattcttccaaaggtggaggttaaagctggcgatgacatgagattggatcttagaggccacaggattcgcagtctaacctctggtggcttacacttatcaccaaacttagagtttgtctatcttagagacaatctcctatctacgctggaaggtattgagatattgaatcgagtcaaggttctggatttgagttttaatgatttcaaagggcctggatttgaaccacttgagaattgcaaaatgctgcagcaactttatcttgctggaaatcagataacttcacttgctagtctgcctcaacttccaaacttagagtttctctcggttgctcaaaataaattaaagtcacttgcaatggcaagccagccccggcttcaggtactagcagcaagtaagaacaagataacaactctgaaggactttccgtatctaccagttcttgagcatctgcgggttgaggaaaatccattgctgaagatttctcacttggaagcggcatccatactactcgtaggtcctaccttgaagaaattcaatgacagagatctctctcgtgaggaagtggcaattgccaagcgttatcctccacaaacagctctctgcctcagagaaggttgggagttttgcaagtctgatcttgcagcagaatcgacattccgcttcttagttgagaggtggaaggacacattaccttctggttatcttattaaagaagcacatgttgaccgaccttctgaagaagctccctgtcaatgccactttggtctttttcaggaaagtcctactgctacagatcaagaattagccctgaaatttcaatggtctgtggcggacagatctctttctaatttcgttcctattcttaatgcaaccaaggagaatatcacagtgaagtgctgtgcaggaaagggaataccaaaagttgtgagccttgaattaaatggggaactagttgaggggaatattatcaagggtcaagcagtggttgcatggtgtggtgggacaccaggaaagtgtattaccagttggttgaggagaaagtggaatgggagccctgtggtgatcgatggagctgaagatgaggaatatatgttatctttagatgatgtgggatcaagtatggttttcatgtacacaccagtcacagaaggaggtgcaagaggagagcctcagtataagtacacagagttcgtaaaagcagcgcctccatctgtaagtaatgttcgaattactggagatgctgttgaaggctgcgttctcaagggggttggagattattttggaggcaaggaaggtcctagcaagttcgaatggttacggaagaacaaggaaacaggagaactctcgttgatatcggctggaacctccgagtatacattgacccaggaagatgttggcacacatgtaacttttgtgtacatacctgcaaattttgaggcacccccgaaagtaacagatgctaagatagttggtgacttgagggagaatagtaaggtcactgtaacaggtactgttactggaggaactgaaggttcaagcagagtgcaatggttcaaatcaagttgttctatcctggaaggagacaattctcttgaagaattgagcacatcaaaagtggcaaagtcattccgtatacccttgggggcagtgggctattacatagttgcaaagtatactccaatgacacctgatggggaatgcggtgaaccagtatatgtactctcggaaagagcagttgagacgcaggctgaaaatgatctccctggtgcattgatacctgaagcctctgggcttcttcagtatacgattactaaagaagctataggtaaattcatttcatttcaatgtattcctgtgagggatgatgggattgtgggtgagccaagaagttgcatgtcccaggaacgtgttcgtccaggaaacccaagcacggtatctcttcatgttgttggagctcttgttgaaggaaccatgctatctgcagagaaagaatattggggtggtgaagaaggagcatcagttttccggtggttccggactaattcagatggtactccatgcgaaataaagggtgcaactacttcgtcatatctactgtcagtcggtgatatcggttacttcatttcggtttcttatgaacctgtgagaaatgacagagcccgtggacccacagccatttctgaaatagctggaccaattgtagctggtataatactctcttcccatttgttatcaagctttgcggtatctgaaggggtactaatttccatgaacgagcggggccatccaaattgtcagtcactggagtttcttggatcaatgattgaagggcaacgcttgagctttgttgcttcatatactggagggatgaagggaaattgctatcttgaatgggttagggtgaaaaataatggtgttaaggaaatattgagtagtgatgagtttttggatttatcactggacgatgtcggggaaagcattgaacttatttacactcctgttcgtgaagatggaatagaagggagtccaaggagtatcaggactgatggtattgctccagcaaatcctatggggttggagcttttaattcctgactgctgtgagaaacaagaggttgtgcctcataaaacttattttgggggccatgaaggtgttggagagtacatctggtatcgaactaaggtcaagttgcatggatctgcacttacggaaatatcctatgccggtgaagaggttgttgtttgttgtagaacattaaaatatactccatcgcttgaagatgtgggggcttatctagtcttgtattggattcctactcgcgtagatgggagaagtgggaagccagttgttgtgataacaaactctcctgttgccccagctgatccagaagtatctaatgttcgtgtgaagaaacttttttcggatgcttattctggagaaggagagtactttggtggacatgaaggtccaagtctcttcagttggtacagagagaatgatggaaccattgatcttattgatggggctaactccaaaacgtatgaggtgactgagtcagattacaattgccggatattgttcgggtacacaccagttcgttcagattctgttgtgggagagctaaagatgtctgagccaactgaaattatcctcccagggttctctttgcaacacaatcctaacacttttgatcacaatacagaggttccaaaagtagacatgcttgctttcaccggaaaggctgtacaaggtgatgttctcacagccgtccaagtgatcccaaagactgaaattcaacaacttgtttggagcaagtacaaaggagatattcaataccaatggttccgctcaccggaatcaggggataagatatcgtatgaggctctctcttcagaaatttcgtgttcatacaaggtgcggtttgaggatattggcagatgtctcaaatgtgaatgtgtagtgcatgatgtgtttggaaggtctagtgaactagcatacgccgagactgatccaatatcaccaggttttcctaggatagagaagctagagattgaaggacaaggtttccatactaacttatatgctgtgcggggaaattattttggtggtaaagagggaaagagtaaaatccaatggcttagatcaatggttggaagccctgatctcatctcaattccaggtgagacaggaaggatgtatgaagctaatgtggatgatgtcggatacagactggtcgttgtatatacacccatacgtgaggatggtgtccaaggccacccagtttctgcatcaactgagcctgttgctgttgaacctgatattcttaaggaagtgagacagaaattagaaactgggttagtgaagtttgaggtgttgtgtgacaaggacccttatcccaaaaagattgtgggagagggaaatctcgagagacgaatgctagaaatgaacaggaagagaataaaggttgtgaaaccaggttcaaagacgtctttcgcaactactgaagtccgtggaagctatggtcctcctttccacgtggagacatttcgtaacgaccaaagaaggctaaggatagttgtggatagtgagaatgaagtagacatagtggtgcagtcgcgccatctccgcgatgttatagtacttgtcattcgcggctttgctcagcggttcaacagcacttcactcaattctctacttaagatcgatacatga

SEQ ID NO: 600 - protein, 1661 aa, Arabidopsis thaliana
MEEVAAKVEEETVETNVDAVKEDNATIANESRSPESVSAVSVVSNRAASTKKKPVISSNLIKPTASSSLRVSGTTPVTIRRNSTGGVTENLAGTSKVLPKQVSTTASRTDPVRRSLPELRKSSVSSLSAKTVSKPSLSESKKSVPVSPGSRSLTKSTGFSLSKPESSARPAMSVSVSSKRAPSSSVDSSGSRTSSGRLHSTLTSGRTVSKVSSPSAGSSPSVSSSIRSKSFSSPLDRTSNFSGRKKTSTPESRDSRLIILPKVEVKAGDDMRLDLRGHRIRSLTSGGLHLSPNLEFVYLRDNLLSTLEGIEILNRVKVLDLSFNDFKGPGFEPLENCKMLQQLYLAGNQITSLASLPQLPNLEFLSVAQNKLKSLAMASQPRLQVLAASKNKITTLKDFPYLPVLEHLRVEENPLLKISHLEAASILLVGPTLKKFNDRDLSREEVAIAKRYPPQTALCLREGWEFCKSDLAAESTFRFLVERWKDTLPSGYLIKEAHVDRPSEEAPCQCHFGLFQESPTATDQELALKFQWSVADRSLSNFVPILNATKENITVKCCAGKGIPKVVSLELNGELVEGNIIKGQAVVAWCGGTPGKCITSWLRRKWNGSPVVIDGAEDEEYMLSLDDVGSSMVFMYTPVTEGGARGEPQYKYTEFVKAAPPSVSNVRITGDAVEGCVLKGVGDYFGGKEGPSKFEWLRKNKETGELSLISAGTSEYTLTQEDVGTHVTFVYIPANFEAPPKVTDAKIVGDLRENSKVTVTGTVTGGTEGSSRVQWFKSSCSILEGDNSLEELSTSKVAKSFRIPLGAVGYYIVAKYTPMTPDGECGEPVYVLSERAVETQAENDLPGALIPEASGLLQYTITKEAIGKFISFQCIPVRDDGIVGEPRSCMSQERVRPGNPSTVSLHVVGALVEGTMLSAEKEYWGGEEGASVFRWFRTNSDGTPCEIKGATTSSYLLSVGDIGYFISVSYEPVRNDRARGPTAISEIAGPIVAGIILSSHLLSSFAVSEGVLISMNERGHPNCQSLEFLGSMIEGQRLSFVASYTGGMKGNCYLEWVRVKNNGVKEILSSDEFLDLSLDDVGESIELIYTPVREDGIEGSPRSIRTDGIAPANPMGLELLIPDCCEKQEVVPHKTYFGGHEGVGEYIWYRTKVKLHGSALTEISYAGEEVVVCCRTLKYTPSLEDVGAYLVLYWIPTRVDGRSGKPVVVITNSPVAPADPEVSNVRVKKLFSDAYSGEGEYFGGHEGPSLFSWYRENDGTIDLIDGANSKTYEVTESDYNCRILFGYTPVRSDSVVGELKMSEPTEIILPGFSLQHNPNTFDHNTEVPKVDMLAFTGKAVQGDVLTAVQVIPKTEIQQLVWSKYKGDIQYQWFRSPESGDKISYEALSSEISCSYKVRFEDIGRCLKCECVVHDVFGRSSELAYAETDPISPGFPRIEKLEIEGQGFHTNLYAVRGNYFGGKEGKSKIQWLRSMVGSPDLISIPGETGRMYEANVDDVGYRLVVVYTPIREDGVQGHPVSASTEPVAVEPDILKEVRQKLETGLVKFEVLCDKDPYPKKIVGEGNLERRMLEMNRKRIKVVKPGSKTSFATTEVRGSYGPPFHVETFRNDQRRLRIVVDSENEVDIVVQSRHLRDVIVLVIRGFAQRFNSTSLNSLLKIDT

SEQ ID NO: 601 - DNA, 1170 bp, Arabidopsis thaliana
atgtctcacaggaagtttgagcacccaagacatggttctcttggtttccttccaaggaagagagctaaccgtcacagaggaaaggtgaaggcgttccctaaggatgaccaaaccaagccttgcaagttcacagctttcatgggttacaaagctggtatgactcacattgtcagagaagtggagaaacctggatccaagcttcacaagaaggagacatgtgaggctgttaccatcattgagacacctgctatggtggttgttggagttgttgcctatgtgaagactcctagaggtttgaggtctttgaacactgtctgggcacagcatttgagtgaggaggtcaggagaaggttctacaagaactgggctaagtctaagaagaaggctttcactgggtacgctaagcagtatgacagtgaggatggcaagaagggtattcaggctcagcttgagaagatgaagaagtacgctactgtcatccgtgttttggctcacactcagatcaggaagatgaagggattgaagcagaagaaggctcacatgatggagatccagatcaatggtggtaccattgcccagaaggttgactttgcctacagtttctttgagaagcagatcccaattgaagctgtcttccagaaggatgaaatgattgatatcattggtgtgaccaagggtaagggttatgaaggtgttgttactcgttggggtgttacccgtcttcctcgtaagactcacagaggtctgcgtaaggttgcttgtattggtgcgtggcatcctgctagagtgtcctacactgttgctagggctggtcagaacggttaccatcaccgtactgagcttaacaagaagatttacaggttgggtaaggttggtactgaggcacacacagccatgactgaatatgacaggactgagaaggatgtgactccaatgggaggcttcccacactacggtattgtgaaggatgactacttgatgattaaggggtgctgtgttggtcccaagaagagagttgtaactctcagacagtcacttctcactcagacttcccgtcttgccttggaggagatcaaactcaagtttattgacaccgcctccatttttggacatggtcgcttccagacctcccttgagaagatgaggttttacaaccgtgtcacgaagtaa

SEQ ID NO: 602 - protein, 389 aa, Arabidopsis thaliana
MSHRKFEHPRHGSLGFLPRKRANRHRGKVKAFPKDDQTKPCKFTAFMGYKAGMTHIVREVEKPGSKLHKKETCEAVTIIETPAMVVVGVVAYVKTPRGLRSLNTVWAQHLSEEVRRRFYKNWAKSKKKAFTGYAKQYDSEDGKKGIQAQLEKMKKYATVIRVLAHTQIRKMKGLKQKKAHMMEIQINGGTIAQKVDFAYSFFEKQIPIEAVFQKDEMIDIIGVTKGKGYEGVVTRWGVTRLPRKTHRGLRKVACIGAWHPARVSYTVARAGQNGYHHRTELNKKIYRLGKVGTEAHTAMTEYDRTEKDVTPMGGFPHYGIVKDDYLMIKGCCVGPKKRVVTLRQSLLTQTSRLALEEIKLKFIDTASIFGHGRFQTSLEKMRFYNRVTK

SEQ ID NO: 603 - DNA, 3291 bp, Arabidopsis thaliana
atggcatctgagcagttgatgtctcccgccagtggtggtggacgctactttcagatgcagcctgagcaatttccttcgatggtctcttcgctcttctctttcgcgccggctcctacgcaggagactaatcgtatttttgaagaattaccaaaagcagtgatcgtctctgtctctcgccctgatgccggcgatattagccctgtactcttgtcttacaccattgagtgccaatacaagcagttcaagtggcagcttgtgaagaaagcatctcaagtcttttatttgcattttgcattgaagaaacgtgcttttattgaagaaattcacgagaagcaggaacaggttaaagaatggcttcaaaatctaggaataggggatcatccacccgttgtgcaagatgaagatgctgatgaagttccgctacatcaagatgaaagtgccaaaaatagagatgttccttcgagcgctgctttgccagtcattcgtcctttgggaagacagcagtccatatcagttagaggaaagcatgcaatgcaagaatatctgaatcattttctggggaatcttgatatcgtcaattcacgggaggtttgcaggtttttggaggtttcgatgttgtcattctcaccagagtatgggcccaaattgaaagaagactatatcatggtaaaacatctaccgaagttttcaaagagtgatgatgattctaatagatgttgtgggtgctgttggttctgttgctgcaacgataattggcaaaaggtgtggggggtactaaagccaggttttctcgccttattggaagatccatttgatgcgaagctattagatataattgtttttgatgtcctaccagtttctaatggaaatgatggtgtggatatatcactagcagtagaactgaaggatcataatcctttgcggcatgcattcaaggtaacatctggaaaccggagtataagaataagggcaaagaatagtgcaaaagttaaagattgggtggcttctattaacgatgctgctcttagacctcctgagggttggtgccatccccatcgctttggctcatatgctccgccgaggggtttgacggatgacggaagtcaagcccagtggtttgtagatggtggagcagcttttgcagccattgctgcagcgattgaaaatgctaaatctgagattttcatctgtggctggtgggtgtgcccagaactctatcttaggcgtccttttgacccgcatacttcatccagacttgataacttgttggagaataaagctaagcaaggagttcagatatacatccttatctacaaggaggttgctcttgctttaaagatcaacagtgtatatagcaaacgcaggcttcttggcattcatgagaatgtgcgggtacttcgttatcctgatcatttctcaagtggtgtctacctctggtctcaccatgaaaaactcgtcatcgtcgataatcaggtttgctttatcggagggctagacttgtgttttggccgatatgacacgtttgaacataaagttggagataacccttctgtgacatggcctggaaaggactattacaaccccagagagtctgaacccaatacttgggaggatgctctgaaagatgaattagagcgtaaaaagcatccacggatgccttggcatgatgtgcattgtgctttatggggaccaccttgccgtgatgtggctaggcactttgttcaacgctggaactatgctaagagaaacaaagcaccatatgaggattcaattccgcttcttatgcctcaacatcacatggttataccccactacatgggaaggcaagaggagtcagacattgaaagcaagaaagaggaagacagtattagagggattagaagagatgattcattttcttctagatcatctttgcaggacattccattacttttgcctcacgaaccagttgatcaggatggttcgagtggggggcataaagaaaatggaacaaacaacagaaatggtcctttctctttccggaaatcaaaaattgaaccagttgatggagatactcctatgaggggctttgtagatgatcgtaatgggctagatcttccagtagcaaagcgtggttctaatgcaatagattcagagtggtgggaaacacaagatcatgattatcaggttgggtcgccagatgagactgggcaagtcggtccgagaacttcatgccgctgtcagattatacgaagtgtcagtcagtggtctgccggtacaagccaagttgaagagagtatccattctgcttaccgttctctcattgacaaagctgaacattttatctacattgagaatcagtttttcatatcaggcctttctggagatgacacagtaaagaaccgtgtcttagaagcattgtacaagaggattttgcgtgcccataacgagaagaaaattttcagggttgttgttgttatacctctcctccccggtttccagggaggtattgacgacagtggtgcagcatctgttagagccataatgcattggcagtatcgaaccatatacagaggacataactcaatattgactaatctttacaatactattggcgtaaaggctcatgattatatttccttctatggccttagggcatatggtaaactttctgaggatggacctgtcgccactagtcaggtgtatgttcacagtaaaatcatgatagttgatgaccgtgctgcattgattggatctgccaatattaacgaccggagtttgcttggctcaagagattctgagattggagtactaatcgaagacacagagttagtagattctcgcatggcaggaaaaccatggaaggctggaaaattttcttcaagtcttaggctctctttgtggtccgaacaccttggacttcgtactggagagatcgaccagattattgatcccgtctctgattcaacctacaaggagatatggatggcaaccgcaaagacaaacacaatgatataccaggatgtcttctcttgtgtgcccaatgatctcatccattcaagaatggccttcagacaaagcctatcgtattggaaagagaagctgggacacacaacgatcgatttgggaatagcaccagagaagctggagtcttaccacaatggagacatcaagagaagcgatccaatggacagactaaaggcgataaaaggacatctcgtctctttccctttagatttcatgtgcaaagaagatctaagaccggtcttcaatgagagtgaatactacgcctcccctcaagtcttccattga

SEQ ID NO: 604 - protein, 1096 aa, Arabidopsis thaliana
MASEQLMSPASGGGRYFQMQPEQFPSMVSSLFSFAPAPTQETNRIFEELPKAVIVSVSRPDAGDISPVLLSYTIECQYKQFKWQLVKKASQVFYLHFALKKRAFIEEIHEKQEQVKEWLQNLGIGDHPPVVQDEDADEVPLHQDESAKNRDVPSSAALPVIRPLGRQQSISVRGKHAMQEYLNHFLGNLDIVNSREVCRFLEVSMLSFSPEYGPKLKEDYIMVKHLPKFSKSDDDSNRCCGCCWFCCCNDNWQKVWGVLKPGFLALLEDPFDAKLLDIIVFDVLPVSNGNDGVDISLAVELKDHNPLRHAFKVTSGNRSIRIRAKNSAKVKDWVASINDAALRPPEGWCHPHRFGSYAPPRGLTDDGSQAQWFVDGGAAFAAIAAAIENAKSEIFICGWWVCPELYLRRPFDPHTSSRLDNLLENKAKQGVQIYILIYKEVALALKINSVYSKRRLLGIHENVRVLRYPDHFSSGVYLWSHHEKLVIVDNQVCFIGGLDLCFGRYDTFEHKVGDNPSVTWPGKDYYNPRESEPNTWEDALKDELERKKHPRMPWHDVHCALWGPPCRDVARHFVQRWNYAKRNKAPYEDSIPLLMPQHHMVIPHYMGRQEESDIESKKEEDSIRGIRRDDSFSSRSSLQDIPLLLPHEPVDQDGSSGGHKENGTNNRNGPFSFRKSKIEPVDGDTPMRGFVDDRNGLDLPVAKRGSNAIDSEWWETQDHDYQVGSPDETGQVGPRTSCRCQIIRSVSQWSAGTSQVEESIHSAYRSLIDKAEHFIYIENQFFISGLSGDDTVKNRVLEALYKRILRAHNEKKIFRVVVVIPLLPGFQGGIDDSGAASVRAIMHWQYRTIYRGHNSILTNLYNTIGVKAHDYISFYGLRAYGKLSEDGPVATSQVYVHSKIMIVDDRAALIGSANINDRSLLGSRDSEIGVLIEDTELVDSRMAGKPWKAGKFSSSLRLSLWSEHLGLRTGEIDQIIDPVSDSTYKEIWMATAKTNTMIYQDVFSCVPNDLIHSRMAFRQSLSYWKEKLGHTTIDLGIAPEKLESYHNGDIKRSDPMDRLKAIKGHLVSFPLDFMCKEDLRPVFNESEYYASPQVFH

SEQ ID NO: 605 - DNA, 1803 bp, Arabidopsis thaliana
atgaagtacgtgcttgtaacaggaggtgttgtgagtggattagggaaaggagtaacagcaagtagtattggtgttctccttaaagcttgtggtcttcgagttacttctatcaaaatcgatccttatctgaacactgatgctggaactatgtctccatttgaacacggtgaagtttttgtcttggacgatggtggtgaggtggatcttgatcttggaaactacgaaaggtttctagatatcaaattaacaagagacaataacatcactactgggaaaatttatcagcatgttattgctaaagagaggaaaggagattatttgggaaagactgttcaggttgttcctcatgtcactgatgcaattcaagattggatcgagagagttgcggttattcctgttgatggagaagaggatcctgctgatgtttgcgttattgaattaggtggaacaataggtgatattgaatccgcgccttttatcgaggcgcttggtcaattctcttaccgtgtaggcccagggaatttctgtctggtccatgtcagcctcgtgcctgtgcttaatgttgttggtgaacagaaaactaagccgacacagcatagtgtcaaggggctacgaggattgggcttgacgccggatatcttagcttgtaggagcacaaagccacttgaagataatgtgaaagaaaaactagctcagttttgccatgtcccgcttgagtatatcttcactctctatgatgttcccaacatttggcgtattcctttgttgctaaaggatcagaaagctcatctggcaatctcaaaagtgctcaatcttgctagtattcttaatgagccttctctaggggaatggacttccagagctgaattatgtgacaatttacatgtgccggtgagaatcgctgttgtggggaaatatacaggcctctctgatgcttatctctctgtcttaaaggctctcttacatgcttctgtggcttgtcgcaaaaagctcgtagttgattgggttccagcttgtgatctcgaaaaagaaactgagaaagagaatccagatgcgtataaagctgcttggaagttgctaaagggtgtagatggaattcttgtacctggaggttttggtgatagaggagtggaagggaagattcttgctgcaaagtatgcacgtgaaaacaaaatcccgttcctcggtatttgtcttggaatgcagattgctgtcatcgagtttgcacgatcagttctaagcttgcaagacgcaaacagcacagaatttaaccctgaaaccaaacatccttgcatcattttcatgcccgagggttctaaaactcatatgggaggcactatgcgcttaggatcaagaaaatccatcttcaatgtcaaagacagcaaatctgcaaaactatacgagaacaaaagctttgtagatgagaggcatcgtcacagatacgaggtgaatccggacatggttgaacgccttgagaaggccggtctttctttcgctgcgaaagatgaaactggcaaacgcatggagatcattgaacttccaaaccatcctttctttatcggtgctcaattccaccccgagttcaaatccagacccgggaaagcttctcctctgtttttagggctcattgcagcatcgtgtggcgagttagacacagtcctgaatccagcttctgctcatcaacattcgattagtaacggtccaacaaacattttcatcaatggaacttccaagaaatctcccaatggcttggctgatgtaagatataataacggctactgcaatggcctctacactagatag

SEQ ID NO: 606 - protein, 600 aa, Arabidopsis thaliana
MKYVLVTGGVVSGLGKGVTASSIGVLLKACGLRVTSIKIDPYLNTDAGTMSPFEHGEVFVLDDGGEVDLDLGNYERFLDIKLTRDNNITTGKIYQHVIAKERKGDYLGKTVQVVPHVTDAIQDWIERVAVIPVDGEEDPADVCVIELGGTIGDIESAPFIEALGQFSYRVGPGNFCLVHVSLVPVLNVVGEQKTKPTQHSVKGLRGLGLTPDILACRSTKPLEDNVKEKLAQFCHVPLEYIFTLYDVPNIWRIPLLLKDQKAHLAISKVLNLASILNEPSLGEWTSRAELCDNLHVPVRIAVVGKYTGLSDAYLSVLKALLHASVACRKKLVVDWVPACDLEKETEKENPDAYKAAWKLLKGVDGILVPGGFGDRGVEGKILAAKYARENKIPFLGICLGMQIAVIEFARSVLSLQDANSTEFNPETKHPCIIFMPEGSKTHMGGTMRLGSRKSIFNVKDSKSAKLYENKSFVDERHRHRYEVNPDMVERLEKAGLSFAAKDETGKRMEIIELPNHPFFIGAQFHPEFKSRPGKASPLFLGLIAASCGELDTVLNPASAHQHSISNGPTNIFINGTSKKSPNGLADVRYNNGYCNGLYTR

SEQ ID NO: 607 - DNA, 1020 bp, Arabidopsis thaliana
atgtcaacttcagaaaacactccgtttaatggcgttgcctcatccaccattgttcgagctaccattgtccaagcctccaccgtctacaacgatactcccgccactctagaaaaggcgaacaagtttattgtggaggctgcaagcaagggatcggagctggttgtgttcccggaggcgtttatcggtggttatcctcgaggttttaggtttggtttaggggtgggagttcataacgaagaagggcgtgatgagttccgcaagtaccatgcttctgctattaaagttcctggccctgaagtagaaaagttggcggagttggccgggaagaacaatgtgtacttggtaatgggagcgatagagaaggatgggtatacactctattgcacagcacttttcttcagtccacaaggtcagttcttgggtaagcaccgtaaactcatgcccacaagtttggaacgttgcatttggggtcaaggagacggatcaaccatccccgtttacgacactccgattggaaaactcggtgctgctatttgctgggagaataggatgcccctctacagaactgctttgtacgccaaaggcattgagctttattgtgcacctactgctgatggttcgaaagaatggcaatcgtcgatgcttcacattgcgatcgaaggtggatgtttcgtattgtcggcttgccagttctgccttcgtaaagatttccctgatcatcctgactacttgtttaccgattggtacgacgacaaagagcctgactctattgtttcccaaggtggaagtgttattatttcacctttgggacaggttcttgcgggaccaaactttgaatcagagggtctcatcacagctgatcttgatcttggtgatgtagcaagagctaagttgtacttcgattcggttggacattactcgagaccagatgttttacacttgaccgtaaatgagcacccgaagaaaccggtcacattcatttcgaaggtggagaaagcggaagatgactcaaacaagtaa

SEQ ID NO: 608 - protein, 339 aa, Arabidopsis thaliana
MSTSENTPFNGVASSTIVRATIVQASTVYNDTPATLEKANKFIVEAASKGSELVVFPEAFIGGYPRGFRFGLGVGVHNEEGRDEFRKYHASAIKVPGPEVEKLAELAGKNNVYLVMGAIEKDGYTLYCTALFFSPQGQFLGKHRKLMPTSLERCIWGQGDGSTIPVYDTPIGKLGAAICWENRMPLYRTALYAKGIELYCAPTADGSKEWQSSMLHIAIEGGCFVLSACQFCLRKDFPDHPDYLFTDWYDDKEPDSIVSQGGSVIISPLGQVLAGPNFESEGLITADLDLGDVARAKLYFDSVGHYSRPDVLHLTVNEHPKKPVTFISKVEKAEDDSNK

SEQ ID NO: 609 - DNA, 2103 bp, Arabidopsis thaliana
atgaacaatctgagttatcttgaaccagattactctgagtttgttgaagttgatcctactggaagatatggaagatacaatgaagttcttggtaaaggagcttcaaagactgtttatagagcatttgatgaatatgaaggcatagaagtagcatggaaccaagttaagctatatgatttcctacaaagccctgaggatcttgagaggctttactgtgagattcatcttctcaagactctaaaacataagaacatcatgaaattctacacttcttgggtcgataccgccaatcgaaatatcaatttcgtcactgaattgttcacttctggcaccttaagacaatatagactcagacataagagagtgaacataagagctatgaagcattggtgcagacaaatcttgagaggcttacattatcttcacagccatgatcctcctgtgatccacagggatctcaaatgtgacaacattttcgttaacgggaatcaaggagaggtcaagattggagatcttggccttgctgctattttaagaaagtcccatgctgctcactgcgtcgggactcctgagttcatggcacctgaagtttacgaagaagcatataacgaattggttgatatatactcgttcggtatgtgtattttggagatggttacgtttgattacccgtacagtgagtgtactcatcctgctcagatctacaagaaagttatgtcgggcaagaaaccggatgcattgtacaaggtgaaagaccccgaggttaaatgtttcattgagaaatgcttggccaccgtatcgcttagagtctctgctcgtgagttactagatgacccttttctccgtatagacgatggtgagtttgatttaagatcagttgatatggaagattcggtcgggccactctataggcagccgcaccatcttcctgactactacaattacccgtcgaatagtagctctttgaatcgtcagtactcaaatggcaactacccgtcgaatagtagctcattgaatcgtcagtactcaaatggttataatagtcatcacgagtatcagaatggatgggcgtataatccagctgagacagaggagactcacggcatcgagctctttgaatctcgaaacaatgatgatcaagaagaagaaaagaaatctggtaatgttgacataaccatcaaagggaagaggagagatgatggtggcttgttcttgcgtcttaggatcgctgacaaagaaggacgtgtccgaaacatttacttcccatttgacattgagacggacaccgcattgagcgttgcaacagagatggtagcggaactggatatggacgatcatggagtcacaaaaatagccaacatgattgacggtgagatatcttctcttgtacctagttggagaccgggacctgaattcgaagaatgtcttgcggctgcggcggcggcaaatgctgcgagcatttgcaacaactgcgtatcaaaccgcacctcaatgggctcggtgatggatttcctgagaaccaatcctggggcaaatgtgatacaatgttgcagaaacgggtgcggtgagactcatggtcggtttgaagagatcacgatcagagaaaccgaggttcgtcttagagagctatggaagctgcagcaacagcaagaaagccgcgagctaagctcgatagattcaggccataaccattccgaagaagaggaggaagaagaggtgctatacgaagaccccgaaaacatgttttcttgcgaggcaggtaacgagataaaccatatatcgggttctggatcgttctcgtttatgccatctaaatactgcgatgagccatccgaaaaaaccgaaaatcaggtccaacaagagttgagatggcttaaagccaaatgccaaattgagcttagagatattcaggatgaacaactaaaaacccggtggccggaatccggagaagaggtggaaatttctccgaaagacgggttcttgggttcggtttccgggttaggaagagaagaagatacggtgaaagagatgtttggagaaagattggtaccaaagtgtctgaaaagaacaacttcacttcctgttgatgccattgattcttga

SEQ ID NO: 610 - protein, 700 aa, Arabidopsis thaliana
MNNLSYLEPDYSEFVEVDPTGRYGRYNEVLGKGASKTVYRAFDEYEGIEVAWNQVKLYDFLQSPEDLERLYCEIHLLKTLKHKNIMKFYTSWVDTANRNINFVTELFTSGTLRQYRLRHKRVNIRAMKHWCRQILRGLHYLHSHDPPVIHRDLKCDNIFVNGNQGEVKIGDLGLAAILRKSHAAHCVGTPEFMAPEVYEEAYNELVDIYSFGMCILEMVTFDYPYSECTHPAQIYKKVMSGKKPDALYKVKDPEVKCFIEKCLATVSLRVSARELLDDPFLRIDDGEFDLRSVDMEDSVGPLYRQPHHLPDYYNYPSNSSSLNRQYSNGNYPSNSSSLNRQYSNGYNSHHEYQNGWAYNPAETEETHGIELFESRNNDDQEEEKKSGNVDITIKGKRRDDGGLFLRLRIADKEGRVRNIYFPFDIETDTALSVATEMVAELDMDDHGVTKIANMIDGEISSLVPSWRPGPEFEECLAAAAAANAASICNNCVSNRTSMGSVMDFLRTNPGANVIQCCRNGCGETHGRFEEITIRETEVRLRELWKLQQQQESRELSSIDSGHNHSEEEEEEEVLYEDPENMFSCEAGNEINHISGSGSFSFMPSKYCDEPSEKTENQVQQELRWLKAKCQIELRDIQDEQLKTRWPESGEEVEISPKDGFLGSVSGLGREEDTVKEMFGERLVPKCLKRTTSLPVDAIDS

SEQ ID NO: 611 - DNA, 753 bp, Arabidopsis thaliana
atgttggctatcttccacgaggcgtttgctcatccgccggaggaactcaacagtccggcatctgagaaatgctctaaacaaccaaaacttccagaagaaaccctaaatgatttcttattacgttaccctctcaacactttctccatgtctttcggacaagctgctgttcttgcttacgttcgtccctctgcttccttctccatccaccagaggttgttttgtggatttgatgacatctactgtctcttctttgggagcttgaacaatctgtgtcagctaaacaaacagtatggtctcaccaagacaacaaacgaggccatgtttgtgatcgaagcttataggactcttagagacagaggtccttatccagctgatcaggtcgtcaaagacttagacggtagcttttcctttgtggtttatgatagcaaagccggctctgtcttcactgctctgggatctgatggaggggtgaagctatactggggcatagctgctgatggatctgttgttatatcagatgatttggatgttatcaaagagggttgtgctaaatcttttgctccatttcctacagggtgtatgttccatagtgaaggagggttaatgagctttgagcatccaatgaacaagatcaaggcgatgccgagggtagacagtgaaggagttctatgcggtgccaacttcaaggtggatgtgtacaatcgtgttaacagtatccctcgtcgaggaagtgaagccaattggtctctctga

SEQ ID NO: 612 - protein, 250 aa, Arabidopsis thaliana
MLAIFHEAFAHPPEELNSPASEKCSKQPKLPEETLNDFLLRYPLNTFSMSFGQAAVLAYVRPSASFSIHQRLFCGFDDIYCLFFGSLNNLCQLNKQYGLTKTTNEAMFVIEAYRTLRDRGPYPADQVVKDLDGSFSFVVYDSKAGSVFTALGSDGGVKLYWGIAADGSVVISDDLDVIKEGCAKSFAPFPTGCMFHSEGGLMSFEHPMNKIKAMPRVDSEGVLCGANFKVDVYNRVNSIPRRGSEANWSL

SEQ ID NO: 613 - DNA, 1839 bp, Arabidopsis thaliana
atggacttcttcacttcaagcaaagctaagaaagatagcaaaaaatcatcaggactctttggcaagaaaactgtcagcaagagcactccgggcagccctgctcatccccccggcgctagatccccgcccccatcgtatctttcaaacaaaagagccgaaacagagtacgatttccccatgtccaatgaacaaagaccatactggaaacagcctgcctctgaacgcgtccccaactcccaccctaggcctcccgtgtatggatacggcacgcccgaccatcgtcgagaccacggtagagaaagaatggaggccatgagttatgagccagagaccaacgctccttccagcccatatcatccagctggaaaccgcacgcctgaacgtcctaggaaatcaaccgagtatcgtcgagaacaccaggatcgaatgtatgaagcagatacccgaagcaatgcgagcccatttcacccattcagaagcccttctccatctccattccacacgcctgatcgccgcagagaccactacgacatgtatgagcctgaggccaacaccatgctgcagaatagcgctccagggagcccattccatccagctggaagccgctctccaccaccatacagaacgcctgatcgtcgtagtaactatgataaagagcaatttgaggacctgtacgagcaagatggtgatgtcacaccgcgaaacagctctccaccgagcccgtttcatccagcagcatacaaaacgtctgatcaacgtagtaaccatggtaaagagcaaattgaggacttttatgagcaagatgacgatgtaacaccacgaaacagctctccacctagcccattgcatccagcagcaagccattcaccaccaccaccacaaccatacagaacgcctgaccatcgtagaagccaccaggataacgaggatttcgaggcaatgtatgagctagatggcgacttaatacaccagaagagcgctcctccgagtcccgttcatggaccatactattcatccagcgacgacgataatcactccacctacctctatccagaaatccgcagcccacttcgttccaggatcgtatccgagaacagcacgcctgttcaccacaactaccagatagttgcggccgagacctatgagcaagacaagcagttcgagccgccggagctgcctgacgagtcacaaagcttcacaatgcaggagattaccaaaatgcgaggactcaagaactacgaaagcggcaaggaagagagtcaatcaatgatatccgaggcttacgtatccgtcgcgaattacagagtgaggcagagcgtgtcggaaaccctgcaggcgatcatcgacaagcacggcgacatcgcagcctcctcgaagctgcaagcaatggcaactcggtcttattacctggaatccctagccgctgtggtgatggagctgaaaaagacggttctgagggatttgacgaaaacgcgcgtggcggagatcgcggcggtggtgaaagacatggagtcggtgaaaatcaacgtgtcgtggctaaagacagcggtaacggaactggcggaggcggtggagtatttcgggcagtacgacacggcgaaggtggagaaagaggtgtgcgagagagatctgacggcgaaaaagggggagatggaggagatgacggcggagctggtgaagagggagaaggaaatcaaagaatgcagagagaaggtgacggtggtcgcagggaggctagggcagctggagatgaaaggttcgaaattgaacaagaatctcgacctcttccagtccaaagtccacaaattccaaggagaagccgtccttctccacctttag

SEQ ID NO: 614 - protein, 612 aa, Arabidopsis thaliana
MDFFTSSKAKKDSKKSSGLFGKKTVSKSTPGSPAHPPGARSPPPSYLSNKRAETEYDFPMSNEQRPYWKQPASERVPNSHPRPPVYGYGTPDHRRDHGRERMEAMSYEPETNAPSSPYHPAGNRTPERPRKSTEYRREHQDRMYEADTRSNASPFHPFRSPSPSPFHTPDRRRDHYDMYEPEANTMLQNSAPGSPFHPAGSRSPPPYRTPDRRSNYDKEQFEDLYEQDGDVTPRNSSPPSPFHPAAYKTSDQRSNHGKEQIEDFYEQDDDVTPRNSSPPSPLHPAASHSPPPPQPYRTPDHRRSHQDNEDFEAMYELDGDLIHQKSAPPSPVHGPYYSSSDDDNHSTYLYPEIRSPLRSRIVSENSTPVHHNYQIVAAETYEQDKQFEPPELPDESQSFTMQEITKMRGLKNYESGKEESQSMISEAYVSVANYRVRQSVSETLQAIIDKHGDIAASSKLQAMATRSYYLESLAAVVMELKKTVLRDLTKTRVAEIAAVVKDMESVKINVSWLKTAVTELAEAVEYFGQYDTAKVEKEVCERDLTAKKGEMEEMTAELVKREKEIKECREKVTVVAGRLGQLEMKGSKLNKNLDLFQSKVHKFQGEAVLLHL

SEQ ID NO: 615 - DNA, 678 bp, Arabidopsis thaliana
atgggttactggaattccaaggttgttccaaaattcaagaagttattcgagaaaaatagtgctaagaaggctgctgctgctgaagctaccaagacctttgatgaatctaaggaaacaatcaacaaggaaattgaggagaaaaagacagaactccaaccaaaggtcgtggaaacctatgaagccacgtctgcagaagtcaaggctttggtgagagaccctaaggtggctggtttgaagaaaaactcagcggctgtgcagaagtacctcgaggagctagtcaaaattgaattccccggatcaaaagcggtgagtgaggcttcgtctagcttcggagctggctatgtcgcaggaccggtcacgttcatattcgagaaggtatctgttttcctcccggaggaggtgaagactaaagaaataccggtggaggaagtgaaagctgaagaacctgccaaaactgaagaaccagccaaaaccgaaggaacaagtggtgagaaagaggagattgttgaagagacaaagaaaggcgagacccctgaaaccgcggtcgtggaggagaagaaaccagaggtagaggagaagaaggaagaggctactccggctccggcagtggttgaaactccagttaaggaaccggagacaacgacgacagcgccagtggctgaaccaccaaagccttga

SEQ ID NO: 616 - protein, 225 aa, Arabidopsis thaliana
MGYWNSKVVPKFKKLFEKNSAKKAAAAEATKTFDESKETINKEIEEKKTELQPKVVETYEATSAEVKALVRDPKVAGLKKNSAAVQKYLEELVKIEFPGSKAVSEASSSFGAGYVAGPVTFIFEKVSVFLPEEVKTKEIPVEEVKAEEPAKTEEPAKTEGTSGEKEEIVEETKKGETPETAVVEEKKPEVEEKKEEATPAPAVVETPVKEPETTTTAPVAEPPKP

SEQ ID NO: 617 - DNA, 2934 bp, Arabidopsis thaliana
atgtcgagaagaccagacctcctacgtggcagcgtggtcgccaccgtggctgccacgtttctcctcttcattttcccgccgaatgttgaatcgaccgttgagaaacaagctctgtttcgcttcaaaaaccgcctcgacgactctcacaacattctacaatcttggaagccttccgattcaccatgcgtgtttcgcggcatcacatgcgacccgttatccggcgaagtcatcggtatttctctaggaaacgtaaatctctccggcaccatttctccatcaatctcagctctcacaaagctctctacgctatcgcttccatctaacttcatctccggaagaatcccgccagagatagtcaactgcaaaaaccttaaagttctcaatctcacctccaacagactctccggaacaatcccaaacctttctcctctaaagtccctagaaattctcgacatctccgggaattttcttaacggagagtttcaaagctggattgggaatatgaatcagttggtttctctcggtcttggcaacaatcactacgaagaaggtataattcctgagagtattggaggtttaaagaaacttacttggctgttcttagctcgctccaacttgaccgggaagattccaaactcgatctttgatctgaatgctctcgacactttcgacatcgcgaacaacgcaatctccgatgatttcccaatcttaatctcaagattggtaaatctcaccaagattgagttgttcaacaacagcttaacaggtaaaatccctccggagataaagaacttgactcgtttacgcgaattcgacatctcttcgaatcagttgagcggggttttacctgaagaactcggagttttgaaggagctcagagttttccactgtcatgaaaacaacttcaccggcgaatttccttctggtttcggcgatctaagtcacctcacttctctttcgatttatagaaacaacttctccggtgaatttccggttaacatcggccggttctcgccgctcgacacggttgatatatctgaaaacgagtttactggtccatttccaagattcttatgccaaaacaagaaactacaattcttgctcgccttgcagaacgagttttccggcgagattccgagatcttacggcgagtgcaaatctctattgagactaaggattaacaacaaccgtctaagtggtcaagttgttgaaggattctggtctctaccgcttgctaagatgattgatctcagcgataacgaactcaccggagaggtttctcctcagattggactttcaacagaactgagtcagctcattttacagaacaacagattttccggcaagattcctcgtgagctcggaagattgactaatatagagaggatttatctgagcaacaacaatctttccggcgaaattccgatggaagttggagatttgaaagagttatcatctctgcatcttgaaaacaattcattaacaggatttatccctaaggaattgaagaattgtgtcaaacttgttgatctgaatctcgctaagaacttcttgaccggagaaatccctaacagtttatctcagattgcttctttaaactcgttggatttctcagggaataggctaacaggtgaaatcccggcgagtcttgtgaagttgaagctgagtttcattgacttgtctggaaatcaactttcaggaagaataccaccggatcttttagcggtgggaggatccaccgcgttctcacgtaacgagaagctctgtgttgataaagagaacgctaaaacaaatcagaacttggggttgagtatttgcagtggctaccaaaacgtgaagaggaatagttcactcgatggaacactcttgttcttggctcttgcaattgttgtggtagtactagtgagtggtttgttcgcgttgcgttacagagttgtgaagatacgtgagcttgattcggaaaacagagatatcaacaaggcggatgcgaagtggaaaatcgcgtcttttcatcaaatggagttggacgttgatgagatttgtagattggatgaagatcatgtgattggatctggaagtgcaggaaaagtgtaccgtgttgatttgaaaaaaggtggcgggacagtggcggttaagtggttgaagagaggaggaggagaagaaggtgatggaacagaggtctctgttgcggagatggagattcttggaaagattagacacagaaacgtgttgaaactctacgcttgtttggttggaagaggttctagatatttggtgtttgagttcatggagaatgggaacttgtatcaagctcttggcaacaatattaaaggcggtctaccagaactggattggctcaaaagatataaaattgcggtgggagcggcaaaaggaatcgcatatttgcatcatgattgttgtccacccatcattcacagagatataaagtcaagcaacattttacttgacggagattatgagtcgaaaatcgcagattttggagttgcaaaagttgcagacaaaggatatgaatggagctgcgttgctggaactcatggctatatggctcctgagctggcttactccttcaaggcaacggaaaagagtgatgtgtacagcttcggtgtggttcttctagagctagttaccggtcttcggcctatggaagacgagtttggagaggggaaagacattgttgactatgtctactctcagattcaacaagatccgaggaaccttcaaaatgttttggacaagcaagttttgtccacttatatagaagaaagcatgattagagttctgaagatgggtcttctctgcactacgaagctcccgaatctcagaccgagtatgagagaggtcgtgagaaagcttgacgacgctgatccctgtgtctccaattctcaagacacaactggaaagattacagtatag

SEQ ID NO: 618 - protein, 977 aa, Arabidopsis thaliana
MSRRPDLLRGSVVATVAATFLLFIFPPNVESTVEKQALFRFKNRLDDSHNILQSWKPSDSPCVFRGITCDPLSGEVIGISLGNVNLSGTISPSISALTKLSTLSLPSNFISGRIPPEIVNCKNLKVLNLTSNRLSGTIPNLSPLKSLEILDISGNFLNGEFQSWIGNMNQLVSLGLGNNHYEEGIIPESIGGLKKLTWLFLARSNLTGKIPNSIFDLNALDTFDIANNAISDDFPILISRLVNLTKIELFNNSLTGKIPPEIKNLTRLREFDISSNQLSGVLPEELGVLKELRVFHCHENNFTGEFPSGFGDLSHLTSLSIYRNNFSGEFPVNIGRFSPLDTVDISENEFTGPFPRFLCQNKKLQFLLALQNEFSGEIPRSYGECKSLLRLRINNNRLSGQVVEGFWSLPLAKMIDLSDNELTGEVSPQIGLSTELSQLILQNNRFSGKIPRELGRLTNIERIYLSNNNLSGEIPMEVGDLKELSSLHLENNSLTGFIPKELKNCVKLVDLNLAKNFLTGEIPNSLSQIASLNSLDFSGNRLTGEIPASLVKLKLSFIDLSGNQLSGRIPPDLLAVGGSTAFSRNEKLCVDKENAKTNQNLGLSICSGYQNVKRNSSLDGTLLFLALAIVVVVLVSGLFALRYRVVKIRELDSENRDINKADAKWKIASFHQMELDVDEICRLDEDHVIGSGSAGKVYRVDLKKGGGTVAVKWLKRGGGEEGDGTEVSVAEMEILGKIRHRNVLKLYACLVGRGSRYLVFEFMENGNLYQALGNNIKGGLPELDWLKRYKIAVGAAKGIAYLHHDCCPPIIHRDIKSSNILLDGDYESKIADFGVAKVADKGYEWSCVAGTHGYMAPELAYSFKATEKSDVYSFGVVLLELVTGLRPMEDEFGEGKDIVDYVYSQIQQDPRNLQNVLDKQVLSTYIEESMIRVLKMGLLCTTKLPNLRPSMREVVRKLDDADPCVSNSQDTTGKITV

SEQ ID NO: 619 - DNA, 1305 bp, Arabidopsis thaliana
atggctcctcaccaaacacaagaagagaggtacggccacaacttaatgcgcaatcacaacaaagtggaaacactcgtgcacatggcatcacagtttatggtgtttagagcggaggaatcatgggaggaaaagtatgtgtattacacagaagatattggagatctttgcatctttcttggacatagtgaggctttctgtatccaggccagttcgggctcaagcctaactgcatctattttgtgggctataactttgagatctcacagcaagcaggttcggatgttctcctctaagccgacatacccgtacttgttgattgaccacctccttaagacgacggaacactgttccaatgatcaagtatactacgatgataaatattacgaaaagaatctcgtgattaaggaccagggactcgcagaggaggtccgagaggtgatgaccgttggattttcacataaagatgattggagagttcacttggagaaatctgaggatagttccacaagtctcatgatggtgagtaacacatcgtttgtcccagtgaaacatcagctccctcctctgtctagtaattgtcgaatccagaatgtggcaatatcaaactctgttgacataaagaaggaagacttggttgtggctgtcaagttctttggatctgatgtgagtctgtgcaagcccttcagcgactctagctctgaatggatcaacatcaatacctctggctctgtacaccctttctcgagtctaacgtattcgaagaagaataaaaaatttctcagtgttagtccttctgggacgtatctttggtacttggatcttcacttcgatgaggatgatgtcgagccctactcatcatatttatattttagggaggaccctctcctgaggttgtataagatggatttggaagattacatctggcgtttcagaacagaccacctggcggagttaccctccggtgaacatttcctcgtcaagtggttctttaaggacgtgatgatgaacgtggggaaaatcacccagaaaacggatgggtttaaggtgtttagagtggatacaatttgcggtcacttgactaacacgcaagacattggagatctttgtatctttcttggacatggtgaagcatactgtgtcccggcaagctcgtctcctggactcagacctaactccatctattatgtgggctgtaactttggtgttcacgatattgcaaccgacactaccactaacttctacacacacagtaatgttcctttaaggtccactgagttcccttactggcctcttcctctctcttag

SEQ ID NO: 620 - protein, 434 aa, Arabidopsis thaliana
MAPHQTQEERYGHNLMRNHNKVETLVHMASQFMVFRAEESWEEKYVYYTEDIGDLCIFLGHSEAFCIQASSGSSLTASILWAITLRSHSKQVRMFSSKPTYPYLLIDHLLKTTEHCSNDQVYYDDKYYEKNLVIKDQGLAEEVREVMTVGFSHKDDWRVHLEKSEDSSTSLMMVSNTSFVPVKHQLPPLSSNCRIQNVAISNSVDIKKEDLVVAVKFFGSDVSLCKPFSDSSSEWININTSGSVHPFSSLTYSKKNKKFLSVSPSGTYLWYLDLHFDEDDVEPYSSYLYFREDPLLRLYKMDLEDYIWRFRTDHLAELPSGEHFLVKWFFKDVMMNVGKITQKTDGFKVFRVDTICGHLTNTQDIGDLCIFLGHGEAYCVPASSSPGLRPNSIYYVGCNFGVHDIATDTTTNFYTHSNVPLRSTEFPYWPLPLS

SEQ ID NO: 621 - DNA, 1275 bp, Arabidopsis thaliana
atggggaaagacgaagaggaaatgcgaggtgagatcgaggagcgactaatcaatgaagagtacaagatctggaagaagaacactcctttcctctacgatctcgttattactcacgctctcgagtggccttcacttactgttgaatggcttcctgaccgtgaagaaccttccggtaaagactactccgttcagaagatgattctcggtacccatacctccgagagcgagcccaattacttgatgctagcccaagttcagcttcctcttgacgataccgagagtgaagctcgtcagtacgatgatgaccgctctgaatttggtggctttggctgtgcaactggaaaggtacaaattatccagcagataaatcatgatggtgaggttaatcgagctcgctatatgcctcaaaaccctttcataattgctaccaagacagttaatgcggaggtctatgttttcgattacagtaagcatccatctaagcctcctcttgatggggcttgtaatcctgatttaaagcttagaggtcacagctctgagggatatggtctctcttggagtaagttcaagcagggtcatttgcttagtggctctgatgatgctcagatctgcttgtgggatattaacgctactcctaaaaacaaatctctggacgctcagcagatttttaaggctcatgaaggggttgtggaagatgttgcatggcatctgagacatgagtacctgtttggatcagttggagatgaccaataccttctcatatgggatctgcgttctccatctgccagtaaaccagtacagtctgtggttgctcattcgatggaggttaactgcttagccttcaatccatttaatgagtgggttgtggcaacaggatcaactgacaagactgttaaattattcgatctacggaagctaagcaccgctcttcacacatttgatagccacaaagaggaggtttttcaagttggttggaacccaaagaacgagactattttagcttcatgttgccttggtagaagacttatggtttgggaccttagcaggatcgatgaggaacagacagtggaggacgcagaagacggcccacctgagctgctgtttattcacggtggtcacactagcaaaatttcagatttctcgtggaacccttgtgaagattgggttatttccagtgttgctgaggacaacatactccaaatatggcaaatggctgaaaacatctatcatgatgaggatgacgctccaggggaagaaccatcaaaagcttcttag

SEQ ID NO: 622 - protein, 424 aa, Arabidopsis thaliana
MGKDEEEMRGEIEERLINEEYKIWKKNTPFLYDLVITHALEWPSLTVEWLPDREEPSGKDYSVQKMILGTHTSESEPNYLMLAQVQLPLDDTESEARQYDDDRSEFGGFGCATGKVQIIQQINHDGEVNRARYMPQNPFIIATKTVNAEVYVFDYSKHPSKPPLDGACNPDLKLRGHSSEGYGLSWSKFKQGHLLSGSDDAQICLWDINATPKNKSLDAQQIFKAHEGVVEDVAWHLRHEYLFGSVGDDQYLLIWDLRSPSASKPVQSVVAHSMEVNCLAFNPFNEWVVATGSTDKTVKLFDLRKLSTALHTFDSHKEEVFQVGWNPKNETILASCCLGRRLMVWDLSRIDEEQTVEDAEDGPPELLFIHGGHTSKISDFSWNPCEDWVISSVAEDNILQIWQMAENIYHDEDDAPGEEPSKAS

SEQ ID NO: 623 - DNA, 1374 bp, Arabidopsis thaliana
atgggaagtccaaagaagaacgagaacaaaggcttcttcgccgccatgacttctggcttctccatgttcggtaccgccgtgtcgagatccgttaacggcgtgcaaggtaatgaaggagttgaggtcataaatccagaaggtggcaaggaagatgctgaagaggaagctcagaaaggaaggtggaaggacgaggaacgagatagttactggaagatgatgcagaaatatataggttcggatattacgtcaatggtgactcttcctgttgttatatttgagcctatgactatgctccagaagatggctgagataatggagtattctcatttgttggatcaagcagatgaatgcgaagatccatacttgcgtttagtatatgcttcatcatgggctatatctgtttactatgccttccaacgaacttggaagcctttcaatcctattcttggggagacatatgagatggtcaaccatggtgggatttcttttatttctgagcaggttagccatcatccaccaatgagtgctggtcatgccgagaacgagcacttcatttacgacatcacatcaaagttgaaaactaaacttttgggtaactctgttgatgtttaccctgtgggaagaacgcgtgtaaccctcaagaaagatggtgtggttctggatttggtgccgcctctcactaagattcacaatctaatatttggacgaacctgggttgactcacctggggaaatggtcatgacaaatttaaccactggagacaaagttgtgctttatttccagccatgtggctggttcggttctggccgctatgaagttgatggctacgtttacagcgcagctgaagaaccgaaaatcatgatgacaggaaaatggaatgagaaaatgagctaccaaccttgtgatgccgaaggggaaccccttccaggaacagagctgaaagaggtgtggcatttggctgatgtccccaaaaacgacaactttcagtacactcactttgctcacaagataaacagcttcgacacagcgcctgctaagctcttggcttcagactcacgtatccgtcctgatagatattcccttgagcagggtgacctttctaaagctggttccgagaaacacagccttgaggagagacaaagggccgaaaagaggaccagagagacaaagggacaaaagttcactccaagatggttcgatctaacggatgagatcacacctactccatggggagatattgaagtataccaatacaacgggaagtacaatgaacaccgagacacggcagagagctcaagtagtgcctccaacgaaacggacctcaaatcgatcgagtttaatccttggcaatatggtaatatctcaaccgaatga

SEQ ID NO: 624 - protein, 457 aa, Arabidopsis thaliana
MGSPKKNENKGFFAAMTSGFSMFGTAVSRSVNGVQGNEGVEVINPEGGKEDAEEEAQKGRWKDEERDSYWKMMQKYIGSDITSMVTLPVVIFEPMTMLQKMAEIMEYSHLLDQADECEDPYLRLVYASSWAISVYYAFQRTWKPFNPILGETYEMVNHGGISFISEQVSHHPPMSAGHAENEHFIYDITSKLKTKLLGNSVDVYPVGRTRVTLKKDGVVLDLVPPLTKIHNLIFGRTWVDSPGEMVMTNLTTGDKVVLYFQPCGWFGSGRYEVDGYVYSAAEEPKIMMTGKWNEKMSYQPCDAEGEPLPGTELKEVWHLADVPKNDNFQYTHFAHKINSFDTAPAKLLASDSRIRPDRYSLEQGDLSKAGSEKHSLEERQRAEKRTRETKGQKFTPRWFDLTDEITPTPWGDIEVYQYNGKYNEHRDTAESSSSASNETDLKSIEFNPWQYGNISTE

SEQ ID NO: 625 - DNA, 432 bp, Arabidopsis thaliana
atggcaatgaccgcggctgcagttccatcaagtggatctttccagaaacaagacgaagagtggcgtgctgttctgtctcctgagcagtttagggttctcagactaaaaggaacagataaacgaggcaaaggagagtttacaaagaagttcgaggaagggacttatagttgtgctggttgtggaactgctctttataaatcgaccactaagttcgactccggttgcggttggcctgcgttcttcgacgccatccccggtgctattaaacaaactccagaagcaggtggaagaagaatggagataacatgtgcagtgtgtgatggacatctaggccatgttttcaaaggcgaaggttactctactccaaccgatcaacgtcactgcgttaacagtgtctctctcaaattcgcttctgctgattcttccaaataa

SEQ ID NO: 626 - protein, 143 aa, Arabidopsis thaliana
MAMTAAAVPSSGSFQKQDEEWRAVLSPEQFRVLRLKGTDKRGKGEFTKKFEEGTYSCAGCGTALYKSTTKFDSGCGWPAFFDAIPGAIKQTPEAGGRRMEITCAVCDGHLGHVFKGEGYSTPTDQRHCVNSVSLKFASADSSK

SEQ ID NO: 627 - DNA, 591 bp, Arabidopsis thaliana
atggccggagttttcaaaacggttacgtttcttgttttggttttcgctgccgttgttgtcttcgcggaggactacgatgttggtgatgatacggaatggacgagacctatggaccccgagttctatactacttgggctaccggtaaaactttccgtgtaggcgacgagctcgaatttgatttcgctgctgggaggcatgatgtggcagttgtatcagaagctgcatttgaaaactgtgagaaagagaaacccattagccacatgaccgttcctccggtcaaaattatgctaaacaccactggaccacaatactttatctgcaccgtcggtgaccattgtcgttttggtcaaaaactttccatcactgtagttgctgctggtgcaactggaggtgctactcctggtgccggtgctaccccagcacctggatcaaccccaagtactggaggaaccactcctcccactgcgggtgggaccacaacaccttcaggctctagcggaaccactactccagctggaaatgccgcttcctcattaggtggtgctacttttctggtcgcttttgtttctgctgttgttgctctcttttga

SEQ ID NO: 628 - protein, 196 aa, Arabidopsis thaliana
MAGVFKTVTFLVLVFAAVVVFAEDYDVGDDTEWTRPMDPEFYTTWATGKTFRVGDELEFDFAAGRHDVAVVSEAAFENCEKEKPISHMTVPPVKIMLNTTGPQYFICTVGDHCRFGQKLSITVVAAGATGGATPGAGATPAPGSTPSTGGTTPPTAGGTTTPSGSSGTTTPAGNAASSLGGATFLVAFVSAVVALF

SEQ ID NO: 629 - DNA, 3267 bp, Arabidopsis thaliana
atgagcgtatggaactacgccgttacggctcagaaaccgacctgtgtcactcactcttgcgtcgggaacttcacaagtcctcaagaactcaatctcattgttgcgaaatccactcgaatcgagatccatctgctttctccacagggacttcagactatactggatgttcctctatatgggagaatcgcaactatggaattgttccgtccccatggtgaagcacaagactttttgtttgttgcaactgaaagatataaattctgtgttcttcaatgggattatgagtcctctgagcttattacaagggcaatgggggatgtttctgatcgtataggccgaccgacagacaatggtcagattggtataattgatcctgattgcagagtaattggtctgcatctgtatgacggcttgtttaaggtcattccatttgacaataaaggacagctcaaggaagcctttaacataaggctggaggagttgcaggtcctagatatcaagtttctgtatggatgcacgaaaccaacaattgcagtactttatcaggacaacaaagatgctcgtcatgtcaaaacatatgaagtttctctaaaggataagaactttgtcgaaggtccatggtcacagaacaatctcgacaatggtgctgacttattgatccctgtaccttcacctctatgtggcgtcctcatcattggggaagaaacaattgtctattgtagtgccaatgcattcaaagcaataccaataagaccttccatcacaaaagcatatggaagagttgatcttgatggttctaggtatcttcttggtgaccatgccggactgattcacctgcttgttataacccatgagaaagaaaaggtcactggcctcaaaattgagcttttgggtgaaacctctattgcatcttccatctcgtatctggacaatgctgtcgtctttgtcggttcaagctatggagattcacagcttattaagctaaacctgcaaccggatgcaaaagggtcatatgtagaaattttagaaaagtatgtcaacttggggcctattgtcgatttttgtgtagttgaccttgagagacaggggcaaggtcaggttgtaacttgctctggagcatacaaggatggttctcttcgcatagttcgcaatgggataggaataaatgaacaggcgtccgtggaacttcaaggcatcaaaggaatgtggtcgttgaaatcgtcaattgatgaagcctttgatacattccttgtagttagttttatcagtgaaactcgtatactagccatgaatatagaggatgaactggaagaaacagagattgagggttttttgtctgaagttcagactttattttgccatgatgctgtctacaaccaacttgtacaggttacctcaaattctgttagattagttagttctacaactagagagttgcggaataaatgggatgccccagctggattctctgttaatgttgcaactgcaaatgcgagccaggttcttttggccactggaggtgggcatttggtctatctagaaattggggatgggacattgacggaagtgaaacatgtcctgttggagtacgaggtttcttgtcttgacataaaccccattggtgataatcctaattacagtcagctagctgccgtcgggatgtggactgatataagtgtgaggatttttgtgctaccagacttgactcttattactaaggaggaactaggaggagagatcattccccgatctgttcttctttgtgcatttgaagggatatcttacttgctctgtgctcttggagacggtcatctcttaaacttccagttggatacaagttgcgggaaattaagagatcggaaaaaagtatcactggggactcgacctataactctgcgtactttttcatctaaaagtgcaacgcatgtcttcgctgcatcagatagaccagctgttatatatagcaacaacaagaagctattatacagcaacgtgaatctgaaagaagttagtcatatgtgtcccttcaactctgctgcttttccagacagtctagcaattgcaagggagggcgaacttacaattggtaccatcgatgacattcagaagcttcacatacgcaccattcccattggagagcatgctcgtcggatatgtcatcaggaacaaacacgaacatttgctatctcctgtttgagaaacgaaccaagtgcagaagaatctgaatcgcattttgtccgtctgctggatgcccaaagtttcgagttcttgtcaagttaccctttggatgcctttgaatgtggttgctccatattgagctgctcgtttacagacgacaaaaatgtctattattgtgttggtacagcatatgttttgcccgaggaaaatgaaccaactaagggaaggatacttgtgtttatagttgaagaaggaagattgcagcttatcacagagaaggaaaccaagggagctgtttattctctcaatgccttcaatggcaaacttcttgcttctattaatcaaaagattcagttgtataagtggatgctgcgggatgatggcactcgcgagctgcaatctgaatgtggacatcacggtcacatactagctctctacgtgcagacccgtggagacttcatcgctgttggtgatctcatgaaatcaatctctttattgatctacaagcacgaggaaggtgcgatcgaggagagagctcgggactataatgcaaactggatgacggcagttgagatactcaatgatgacatctacctcggtactgataattgcttcaacatattcaccgtaaagaagaacaacgaaggtgctacagatgaagaacgtgctcgtatggaggtggttggtgagtatcacataggggaatttgtgaaccgattccgccatggctctcttgtcatgaagctgcctgattcagatattggtcagataccgacagtcatatttggcactgtcagtgggatgattggagtgatagcgtctctgcctcaagaacagtatgcgtttctagagaaactgcagacgagtctgaggaaagtgattaaaggagttggtggtctaagccacgagcagtggagatcgttcaacaacgagaaaagaactgcggaagcaaagggttacttggatggagaccttattgaatcgttcttggatttgagcagaggtaagatggaggagatctccaaaggtatggatgttcaagtggaagagttgtgcaagagagttgaagaactcactaggcttcactga

SEQ ID NO: 630 - protein, 1088 aa, Arabidopsis thaliana
MSVWNYAVTAQKPTCVTHSCVGNFTSPQELNLIVAKSTRIEIHLLSPQGLQTILDVPLYGRIATMELFRPHGEAQDFLFVATERYKFCVLQWDYESSELITRAMGDVSDRIGRPTDNGQIGIIDPDCRVIGLHLYDGLFKVIPFDNKGQLKEAFNIRLEELQVLDIKFLYGCTKPTIAVLYQDNKDARHVKTYEVSLKDKNFVEGPWSQNNLDNGADLLIPVPSPLCGVLIIGEETIVYCSANAFKAIPIRPSITKAYGRVDLDGSRYLLGDHAGLIHLLVITHEKEKVTGLKIELLGETSIASSISYLDNAVVFVGSSYGDSQLIKLNLQPDAKGSYVEILEKYVNLGPIVDFCVVDLERQGQGQVVTCSGAYKDGSLRIVRNGIGINEQASVELQGIKGMWSLKSSIDEAFDTFLVVSFISETRILAMNIEDELEETEIEGFLSEVQTLFCHDAVYNQLVQVTSNSVRLVSSTTRELRNKWDAPAGFSVNVATANASQVLLATGGGHLVYLEIGDGTLTEVKHVLLEYEVSCLDINPIGDNPNYSQLAAVGMWTDISVRIFVLPDLTLITKEELGGEIIPRSVLLCAFEGISYLLCALGDGHLLNFQLDTSCGKLRDRKKVSLGTRPITLRTFSSKSATHVFAASDRPAVIYSNNKKLLYSNVNLKEVSHMCPFNSAAFPDSLAIAREGELTIGTIDDIQKLHIRTIPIGEHARRICHQEQTRTFAISCLRNEPSAEESESHFVRLLDAQSFEFLSSYPLDAFECGCSILSCSFTDDKNVYYCVGTAYVLPEENEPTKGRILVFIVEEGRLQLITEKETKGAVYSLNAFNGKLLASINQKIQLYKWMLRDDGTRELQSECGHHGHILALYVQTRGDFIAVGDLMKSISLLIYKHEEGAIEERARDYNANWMTAVEILNDDIYLGTDNCFNIFTVKKNNEGATDEERARMEVVGEYHIGEFVNRFRHGSLVMKLPDSDIGQIPTVIFGTVSGMIGVIASLPQEQYAFLEKLQTSLRKVIKGVGGLSHEQWRSFNNEKRTAEAKGYLDGDLIESFLDLSRGKMEEISKGMDVQVEELCKRVEELTRLH

SEQ ID NO: 631 - DNA, 714 bp, Arabidopsis thaliana
atggttgctcagggattcactgtggatcttaaaaagccccttgtatttcaggttggtcatcttggagaagattatgaggaatgggttcaccaacctatcgcgaccaaggaaggccctcggttttttcagagtgacttttgggagttcttgacacttacagtttggtgggcagttcctgtcatttggttgccagttgtagtctggtgcatatcaaggtcagtaagtatgggatgttcacttccagaaatcgtcccaattgttgtcatgggaatattcatctggacattttttgaatacgttcttcaccggttcgttttccacataaaaacgaagagttactggggaaacactgcacactatcttattcacggatgccatcataagcacccgatggaccaccttcggctcgtctttcctcctactgcaacagcgattttatgctttccgttctggaacattgcgaaggctatctcaactccttcaaccgcacctgcattgtttggtggaggcatgctcggatatgtgatgtacgatgtcactcattattaccttcaccatgcccaacctactagaccagtgaccaaaaatctcaagaagtaccatttgaatcatcacttcaggattcaggacaaaggatttggtataacttcgtcgttatgggacatagtctttgggacacttcccaccacaaaagcccccagaaaagagcaatag

SEQ ID NO: 632 - protein, 237 aa, Arabidopsis thaliana
MVAQGFTVDLKKPLVFQVGHLGEDYEEWVHQPIATKEGPRFFQSDFWEFLTLTVWWAVPVIWLPVVVWCISRSVSMGCSLPEIVPIVVMGIFIWTFFEYVLHRFVFHIKTKSYWGNTAHYLIHGCHHKHPMDHLRLVFPPTATAILCFPFWNIAKAISTPSTAPALFGGGMLGYVMYDVTHYYLHHAQPTRPVTKNLKKYHLNHHFRIQDKGFGITSSLWDIVFGTLPTTKAPRKEQ

SEQ ID NO: 633 - DNA, 717 bp, Arabidopsis thaliana
atggcgactctcaaagcttcctttttgatcaaaaccctcgacagtgacgtcaccggagattttctctccgatctggaacgtcgtgggtcaggtgctgttcatgttatcatgggtcctatgttttctgggaaatcgacctctctccttcgccgaatcaagtcagagatcagcgacggaagaagtgttgcgatgctgaaatcgagtaaggatacgagatacgcaaaagattcggtggtgacacatgatggaattggattcccttgctgggctcttccagatctcatgtcatttcctgagaaattcggactagatgcttataacaagcttgatgtgattggtattgatgaggctcagttctttggagatctttatgagttttgctgcaaagtcgctgatgatgatggtaaaattgtgatcgttgctggcctagatggtgactatttaaggaggagttttggggctgtacttgacattataccaatagctgattctgtgactaagctaactgcaaggtgtgaggtctgtggacataaagctttcttcactttaagaaagaattgtgacaccagaactgagcttattggtggagctgatgtctatatgcctgtttgtcgcaagcattacatcactaatcatattgttattaaagcctctaagaaagtcttggaagattctgacaaggctagagctgaatcctgtgttgctgctacaatctaa

SEQ ID NO: 634 - protein, 238 aa, Arabidopsis thaliana
MATLKASFLIKTLDSDVTGDFLSDLERRGSGAVHVIMGPMFSGKSTSLLRRIKSEISDGRSVAMLKSSKDTRYAKDSVVTHDGIGFPCWALPDLMSFPEKFGLDAYNKLDVIGIDEAQFFGDLYEFCCKVADDDGKIVIVAGLDGDYLRRSFGAVLDIIPIADSVTKLTARCEVCGHKAFFTLRKNCDTRTELIGGADVYMPVCRKHYITNHIVIKASKKVLEDSDKARAESCVAATI

SEQ ID NO: 635 - DNA, 1206 bp, Arabidopsis thaliana
atgactatggggaatttcttaaagagatttggaagtggaaaaagcagaagcagtagaaatatgactctgggaacgacgtcgtctcaatctcatgaaccatcaccgtcggatccttcactctcccttgccgataataccaacgccaccaagaagaagtacgctctcatccctgaccgcttctcttccctcgaccaggtatcaaaagctctaagagaagctggtcttgaatcatccaatctcattctcggagttgatttcacaaagagcaacgagtggactgggaaaacttctttcgatggaaaatgtctgcacgcgctcggcgaaacttcgaatccatatgaaaaggcgatttttgtaatcggccaaacgttggctccttttgatgaagacaatctcatcccttgtttcggctttggcgattcaacaactcatgacgaggaagtgttcggtttccatagcgacaattctccatgtcatggcttcgaagaggtcttagcatgttacaagagaattgcacccaacttgcgtctatcagggccaacgtcgtatggaccgctcatcgatgctgctgtcgacattgtggagaagaacaacggacaattccatgttctggtgattgttgcagatggacaggtaacgagaggtacggatatggccgagggagaactcagtcaacaagagaaaacaaccatcgacgcgattgtaaatgcaagctcgtatgctttgtcgattgttttagtcggtgttggagacggaccatgggaagacatgaggaagttcgatgataagatccctaagcgtgaattcgacaactttcagtttgtgaatttcacagagattatgacgagaaactcaccagagtctgccaaagaaactgcttttgctctagctgctctaatggagattccctttcagtatcaagcagccatcgaactccgcttactcgggaagcagacgggcttagcgaagacaatagttccgaggccaccaccaattccgtacacacctccaactaatgctgaactaccatcaactgcatcacctgcatcacctgaacaaacccagagttgcccgatttgtctgactaaccgaaaagacgtggctttcagctgtggccacatgacttgtggagattgcggatccaaaatatcaaattgcccgatctgtcgagtaaggatcacgaaccggctaaagctttacacatga

SEQ ID NO: 636 - protein, 401 aa, Arabidopsis thaliana
MTMGNFLKRFGSGKSRSSRNMTLGTTSSQSHEPSPSDPSLSLADNTNATKKKYALIPDRFSSLDQVSKALREAGLESSNLILGVDFTKSNEWTGKTSFDGKCLHALGETSNPYEKAIFVIGQTLAPFDEDNLIPCFGFGDSTTHDEEVFGFHSDNSPCHGFEEVLACYKRIAPNLRLSGPTSYGPLIDAAVDIVEKNNGQFHVLVIVADGQVTRGTDMAEGELSQQEKTTIDAIVNASSYALSIVLVGVGDGPWEDMRKFDDKIPKREFDNFQFVNFTEIMTRNSPESAKETAFALAALMEIPFQYQAAIELRLLGKQTGLAKTIVPRPPPIPYTPPTNAELPSTASPASPEQTQSCPICLTNRKDVAFSCGHMTCGDCGSKISNCPICRVRITNRLKLYT

SEQ ID NO: 637 - DNA, 1539 bp, Arabidopsis thaliana
atggaagaagacaagcaaatgcacgaggagaaatcatctctggttaaagaagaaccggttcgtggagaagagcccgagattgagaaattgacagtggcagatgtggacgcgccaccgaagagtaccggtggttggggttggggtttctctggcttctctgtgctttccgatctccaaaaagctgcggaagatatttctcgtaatgctgcagcggtggcagagaaagcagcgaaaagcattgcagagatgggagaagtggatgaagactctgaatcttctgctaaggaagaagagaaaactgaagaagctgatacagagcaggatagtgatgatgagaatgcgaagttaaagaagtcagctcttgagagattggagggtgcaagtgaagagtcacttcttagccagggtttgaaggttttcgatgattcagttgagagtttcacttctggagcttggcaagcatttggaaatgcgttaaaagggggcacaagtttggtgcaaaagcttgaaaacagtgtccagcaaggttcttcgcctagggaagctggatctggtgcaccgtctctactagagacaggaaaagcattaactgcgaaaggaatgcaagtacttgaatttgtgggcaaggaaactatggatttactgattacagagactggtattggagctgagaaggatagggtagactttaaggatcaagtacttgaggaggttacatttgatcgatgcttttacatttatggtggtcctgagcagcttgaggaattggaagcattggctagccactatactctgttgttcaacaggagaaaggggaaattgtcaccagatcaaaaatcgctgtatgacgggaagctcaaacaaatccagcaacttttcagctttgctgatgaaatgagtggaagtaaagcagagtctgacaaagggaagaaaatagatatcaaaactgaaggcaatgatgatgacatgaagaatctgcataactcaagtgtcagcaaagctgctgatatggctactgggttcacaaatgctttagcgggactacacgtaaatgatatgatccagcgaaccggtggcaggcttgaatctcttcactcagaaggagttcatagactttcagagatgtgctgttttgcagtcacacatctgcttatcctcggtaagtccatgatatctcatgccaacaaagttcaggatgaagacactgaggcattgaaaatcgagtgggcagaggatcctacagagaaagctaagctgattagaggcaaggcagaaacaatggctggatatgttgaagcagtttccaatagctttataacaggaatatcagatgtatctgaaacatactcagctgcgattaaaggagttgcagctgctgattccaaagatgatcttctgaaaacatcgaccatgcaggaaaaagcaagcaccttcaacgatagtcttcgctctgaccaaaccacagctatcacaaagatccaggaagggcttcagtacctgtcctatgtcgtgatttctacctcgatgccctctgcctaa

SEQ ID NO: 638 - protein, 512 aa, Arabidopsis thaliana
MEEDKQMHEEKSSLVKEEPVRGEEPEIEKLTVADVDAPPKSTGGWGWGFSGFSVLSDLQKAAEDISRNAAAVAEKAAKSIAEMGEVDEDSESSAKEEEKTEEADTEQDSDDENAKLKKSALERLEGASEESLLSQGLKVFDDSVESFTSGAWQAFGNALKGGTSLVQKLENSVQQGSSPREAGSGAPSLLETGKALTAKGMQVLEFVGKETMDLLITETGIGAEKDRVDFKDQVLEEVTFDRCFYIYGGPEQLEELEALASHYTLLFNRRKGKLSPDQKSLYDGKLKQIQQLFSFADEMSGSKAESDKGKKIDIKTEGNDDDMKNLHNSSVSKAADMATGFTNALAGLHVNDMIQRTGGRLESLHSEGVHRLSEMCCFAVTHLLILGKSMISHANKVQDEDTEALKIEWAEDPTEKAKLIRGKAETMAGYVEAVSNSFITGISDVSETYSAAIKGVAAADSKDDLLKTSTMQEKASTFNDSLRSDQTTAITKIQEGLQYLSYVVISTSMPSA

SEQ ID NO: 639 - DNA, 1041 bp, Arabidopsis thaliana
atgggaacgagcagcgatccgattcaagatggttccgatgagcagcagaagcgatcagagatctatacatacgaagcgccatggcacatctacgcaatgaattggagcgttcgtcgcgataagaagtatcgtctcgccatcactagcctcctcgagcaatacccgaaccgtgtcgagattgtgcagctcgatgaatccaatggtgagatccgttccgatcctaacctctcctttgagcatccttatccaccaacgaagaccattttcatacctgacaaggaatgccaaagacctgatcttctcgctacttcaagtgatttccttcgtttatggagaatcgctgatgatcattcccgtgttgagctcaaatcttgtctcaatagcaataagaacagtgagttttgtggtcctcttacttcttttgattggaatgaagctgagccacgtcgaattggaacatctagtactgatacgacttgtactatctgggacattgagcgtgaagctgttgatactcagcttattgctcatgataaggaagtttttgatattgcttggggtggtgttggtgtttttgcatctgtttcagctgatggctccgttagggtgtttgatcttcgtgataaggaacattcgacgattatctatgagagctccgagcctgatactcctttagtgcgtcttggttggaacaaacaggatcctaggtacatggctactattatcatggacagtgctaaagttgtggtgcttgacattcgttttccggctcttcctgtggttgagcttcaacgacatcaagctagtgtcaatgccattgcttgggctcctcatagctcttgtcacatttgtactgctggagatgattctcaagctttgatttgggatatttcatccatgggacagcatgttgaaggtggtcttgaccctattctagcttacactgctggtgctgagattgagcagcttcagtggtcctcttctcagcctgattgggtcgcaattgctttctctactaagctgcaaattctcagggtttga

SEQ ID NO: 640 - protein, 346 aa, Arabidopsis thaliana
MGTSSDPIQDGSDEQQKRSEIYTYEAPWHIYAMNWSVRRDKKYRLAITSLLEQYPNRVEIVQLDESNGEIRSDPNLSFEHPYPPTKTIFIPDKECQRPDLLATSSDFLRLWRIADDHSRVELKSCLNSNKNSEFCGPLTSFDWNEAEPRRIGTSSTDTTCTIWDIEREAVDTQLIAHDKEVFDIAWGGVGVFASVSADGSVRVFDLRDKEHSTIIYESSEPDTPLVRLGWNKQDPRYMATIIMDSAKVVVLDIRFPALPVVELQRHQASVNAIAWAPHSSCHICTAGDDSQALIWDISSMGQHVEGGLDPILAYTAGAEIEQLQWSSSQPDWVAIAFSTKLQILRV

SEQ ID NO: 641 - DNA, 2079 bp, Arabidopsis thaliana
atgttttctgggataaagatcatacctcgtgatgaggtgcatgatgatagttgggagggggaaagagagaaatctaaaggtgggaaggatagaagaagaaagaacaaggacgtaaatagaaaggagcgtaggggagaaggaagtaagagagatgggaagaagattgccaagagtggagatggcgagaccgttgatgatgacttgcttgaaggggatattgttagaaagaaaatgggtctcgattggatgctgccgccaacccgaaaggctgatccaaaccctgcttcagatgtagaggataaatttgaagaaagtgcacctgaggtaactaaagttaacccaagggaactaaatccttatttgaaagaaaatggaaccggttatccagaggaagaatctgagaaaaaacatggtaaagaccagcttttaccttcttcggttgttggagatgggggtgcaagttggagaatgaaagcactcaagcgtgcgaaagaacaggctgcgagagaagggctaaggcttgaggaggttgctggcgagcgatatggttctcttggtaaccttgttgagtctgtcgcatctcaaagagcagctccatctcgtgcccatttgaatgccataaataatagaagaagaggggaaaatgaaaagaatgattcagaaaaaaaaccaaaagaaagaatttctgagaagggtaataatcgggagtatttgaaaggtgagtcgttgaaccatcgtgtattgagagcccccaaaaccgacccttctttatcctggggaaagagaaagagccaaactcatagaaacgaagactcgaagctgatatctgaagctgcagctcacatgaataagttttccaatgacggaaatttcatgaaggaaatgctttctaagcagaagaatgtatcagtgtctcccgtagagactcgtggagatcacagaagtgatgtggagcaggaagcattaccgtcagagaccaataaggatgacgaagggactcttccgagtatggaaaatttaagtgtgaataaactggctgctaaagccttacagctccgtatgaaggggaaacatgaagaagcccagaaaattatggaagaagcggaaaggctgaaagcaaaacaagctgttggagacgattcatccaaagaccaccactccatcagaaccgcagtgagatatcctgtcaaagatatgtcgggtagaaggaagaatgaagatgatacggatatgcatctagccaagagcataatgcagaacaaacagtacaaaacatcgaatcaagctgctgatgatgagtatgaatatggagacgctccaagcaaaaagtcccggaagcgggaatcgtcaagtaacattcctgaaaaggacaaccgtgtgaaacgtattatgacccagcaagaacgctgtctcttctgttttgagaacccaaagcggccgaaacatttagttgtgtccattgccaacttcacctatctgatgttaccacaacatcagccccttgtccaaggccattgctgtatcttgccaatgcagcacgaggcagccagcagaagtgttgacgacaatgtttgggacgagattcgtaatttcaaaaagtgtcttataatgatgtatgcaaaagaaggaaaagacgcagtgtttctggagacagtgattggtttgtctcagcaacgtcgccactgtttgatcgagtgtatcccaatcccccaagagatagcaaaagaaggtcctttatacttcaagaaggcgatcgatgaagcggaaagtgaatggagtcagcacaatgcgaagaagctcatagacactagcgtgaaaggtctgaggaactctataccgaagaatttcccttacttccacgttgagtttggtttagacaaagggtttgttcacgtgattgatgatgaacaacagttcaatagcaatcttggactaaatgtaatcagaggaatgctcgagttaccagaagaagatatgtatagacgtagaaggcaggagtcggtggagagccagaagaaggcggttgcgacctttgcccgcgaatgggaacactttgattggacgaaacagcttgattaa

SEQ ID NO: 642 - protein, 692 aa, Arabidopsis thaliana
MFSGIKIIPRDEVHDDSWEGEREKSKGGKDRRRKNKDVNRKERRGEGSKRDGKKIAKSGDGETVDDDLLEGDIVRKKMGLDWMLPPTRKADPNPASDVEDKFEESAPEVTKVNPRELNPYLKENGTGYPEEESEKKHGKDQLLPSSVVGDGGASWRMKALKRAKEQAAREGLRLEEVAGERYGSLGNLVESVASQRAAPSRAHLNAINNRRRGENEKNDSEKKPKERISEKGNNREYLKGESLNHRVLRAPKTDPSLSWGKRKSQTHRNEDSKLISEAAAHMNKFSNDGNFMKEMLSKQKNVSVSPVETRGDHRSDVEQEALPSETNKDDEGTLPSMENLSVNKLAAKALQLRMKGKHEEAQKIMEEAERLKAKQAVGDDSSKDHHSIRTAVRYPVKDMSGRRKNEDDTDMHLAKSIMQNKQYKTSNQAADDEYEYGDAPSKKSRKRESSSNIPEKDNRVKRIMTQQERCLFCFENPKRPKHLVVSIANFTYLMLPQHQPLVQGHCCILPMQHEAASRSVDDNVWDEIRNFKKCLIMMYAKEGKDAVFLETVIGLSQQRRHCLIECIPIPQEIAKEGPLYFKKAIDEAESEWSQHNAKKLIDTSVKGLRNSIPKNFPYFHVEFGLDKGFVHVIDDEQQFNSNLGLNVIRGMLELPEEDMYRRRRQESVESQKKAVATFAREWEHFDWTKQLD

SEQ ID NO: 643 - DNA, 1143 bp, Arabidopsis thaliana
atggatcttgttgagagtttttcccatggcgatcctgatactccgcgtttcagtgacgacttcggttctggctctgcttgctctactccgttcgttagcgctccgtctagtcccggccgtggtcctccgcctggttatttcttcagtgcaccgtcgagtccgatgcatttcttcctttgctctgcttcttcttcatcggagaatcctaaaaagcttgacacgtcttcatgcggcgactttgagtttgacttctcgtcgaggttgtcttcaagcagtggtcctttaggcggtgtttccatgacttcagctgaagagcttttctctaatggccagatcaagccaatgaagctctcttcgcatcttcagagacctcagatcttatctccgcttctagatctggagaacgaggaagaagacgacgatgatgagaccaaaccaaacggtgagatgaagcgtgggagagatctgaaactaagaagcagatctgttcaccggaaggccagatccctctctccgctccgaaacgcagcgtatcaatggaaccaagaagaaggagaagaagaagaagtcgccggagagagagaagttaaagagtgtataagaaagcttcaagaagacgaaaacgtgccttcagctgaaacgacaccgtcttgttctgcttcttcttcacgatcatcgtcttacggtagaaactctaagaaatggatctttcttaaagatctgcttcacagaagcaaaagcgaaggaagaggcaacgggaaagagaagttctggtccaacatttccttctctccttccaatttcaaagacaagaaactcaaatcatctcaacttgaagagaaaccgattcaagaaacagttgacgctgccgtggaatcaaagaagcagaagcagaaacaaccgccggcgaagaaagctccggttaacggaaaaccaaccaacgggatagcaaaacggagaggattgcagccgtctgctcacgagctacattacacaacgaacagagctcaagcagaggaaatgaagaagagaacatatttgccttacaggcatggactctttggttgtttagggtttagttccaaaggttacagtgccttgaacggtttagcccgtagcttaaacccagtttcatctggttaa

SEQ ID NO: 644 - protein, 380 aa, Arabidopsis thaliana
MDLVESFSHGDPDTPRFSDDFGSGSACSTPFVSAPSSPGRGPPPGYFFSAPSSPMHFFLCSASSSSENPKKLDTSSCGDFEFDFSSRLSSSSGPLGGVSMTSAEELFSNGQIKPMKLSSHLQRPQILSPLLDLENEEEDDDDETKPNGEMKRGRDLKLRSRSVHRKARSLSPLRNAAYQWNQEEGEEEEVAGEREVKECIRKLQEDENVPSAETTPSCSASSSRSSSYGRNSKKWIFLKDLLHRSKSEGRGNGKEKFWSNISFSPSNFKDKKLKSSQLEEKPIQETVDAAVESKKQKQKQPPAKKAPVNGKPTNGIAKRRGLQPSAHELHYTTNRAQAEEMKKRTYLPYRHGLFGCLGFSSKGYSALNGLARSLNPVSSG

SEQ ID NO: 645 - DNA, 3864 bp, Arabidopsis thaliana
atgggtgaggaaggttcaatgtttggtctgggaggtgaatttccggttgatgattgtgatggtggttttgagtttgaagatgatgacgagactattgacatcgaaacgctttatcggattctagatgagaagcctgattctgctgaggtagttttctcggcttttgtgggtagccaagaaaacttatcaccagttggttcatctgctgacgagctcaaggattcacagttgctaaatggttcatttgatgaacatgtgaaaatggaagccgggctgagtccttcacctgctcatacttgctctgcaagtcttaaagattggttttcgttaagtcagggtgagcagcctgtggaaacatgtggagtatctcaatctgagatgactagttgtagtatatcgtctagtttctctgatcctgatggcaatatgatggccttcaatcctgtgaattgtgacgttgacactgtttccaagcaggatgataagataatcgattccaaatctatgttgactccatattttgacaacgtgactggatacggagtggggttgggagccaatcataattcgtctgccatgtctgttttttttaataattccaattccctcagtgacagtgcggataactatgtctcttctgcacaagattgctacaatacaagtggtacatccttgtcagaccatacccccaattctgttcagaatttcgcgtttgagttctttcctaataaagaagaagctgtaaatgatgttgagagtggagtaagtgagtctcagtcggatggtgccagccggatgatttttgatagacatggaagagtggataatggatctttagaaaggaaacctcctattgatttttctagtgcaagagggatcagtttcaagtttgaaagtaatccttcagtttctcctgcctgtgtcaaaccctacaacagttttgacagtcatttagctgatagtgaccttgaccggcctaataattattcatgcagttttcaggataataaaactgttcatgtgaaggttaaaccagaggctgaatcagagaaagttgtctacagttcagttccaggggaatttagtgtcagggatgatgcttatctttctggagaaaccaatcgttggtggtctggtgcatcaagctctgcagtctcctatcaaacagatattgaaaaaggatactcatatatggcaccgcaaacagctctacctagccaagacagtggcaagataagctccaatcatttttacgattcagatacatgtttgcaatatgttgtagaagatcccagcccagtgacacaaaacaatgagtataaagactttcaaattcaacaaggagaccgggaatatattcaaccgaggggcattgattctcaattctcaaatgccagctttgaatcagttcaaagccattcttcagaatgtatatccgatagtgatgatgattctgacgtctgcataatagaaccttatggtcaatctgcaatcccacatcgacctctagctatgaaaatgccggtagtttcttcagaatattctacagttagtcataattttaatcaatctggaggcctgaagcttcagtcaaataaagaaaatatgatctttcaagctgcattgcaggatctcactcagcctaattctgaagcaattctgcctgatggtgtcttgacagtcccgcttctgagacatcagcgaatcgcattgtcatggatggcccagaaggagacaagtggcttcccctgttcgggtggaattcttgctgatgatcagggtcttgggaagacagtttccactatagctcttatactgaaggaaaggtctaaacctgcccaagcatgtgaagaaagtacgaagaaagaaatttttgacctagaaagcgagactggagaatgtgcgcctttaaaacccagtggaagaagcaagcattttgaacactctcaattgctttccaatgaaaacaaagttggtggagacagtgtgggtaaagtgacgggaaggccagctgctggaacgcttgttgtatgtcccactagtgttatgcggcagtgggctgatgaattacataagaaggtgactagtgaagcaaatctctctgttctggtataccatgggtctagcagaacaaaggatcctcatgagttggctaaatatgatgttgttgttaccacattttctattgtaagtatggaagtgccaaagcagcctcttgttgatgatgaggatgaagagaaggatggtgtacatgatggtggaactgcagctactggcttttgctcaaacaagaaaaggaaatatcctcccgattctaaaaagaagggttcaaagaagaagaaagttgagtttctgtctggccctcttgcgaaagtttcatggtttagagttgttctagatgaggcacagagcattaaaaattacaaaacccaagttgcaagagcatgctggggccttcgtgctaaacggaggtggtgtttgtctggcactccaatccagaattcaatcgatgacctttacagctactttcgattcctcaaatatgatccttactcttcctacgtattgttctgtagcacgattaagaaccctataactaggaacccagtgaaaggatatcagaagctgcaggctatccttaaaacagtgatgcttcgccgaactaaaggttcacttcttgatgggaaacccataatctctttacctccgaagtccattgagttgagaaaagtggatttcactgtggaggaacgtgatttctactccaaactagaggctgaatctcgtactcaattcagggaatatgcagaagctggaacagtgaagcaaaattatgtaaatatcttgttgatgctcttgcgccttcgccaagcttgtgatcaccctcttctcgtgaatggtgaatacagttttacctgggaatcttctgttggattagctaagaagcagattcagtcagacgcttcattggcaatttgtggtatctgcaatgatgcacctgaagatgctgttgcttcagtttgcggtcatgttttctgtaaacagtgcatttatgaacgccttactggtgatagtaatcactgtccctttgcaaactgcaatgtcagactcaccatctcatcgttatcttccaaaacgagattggacgatgctatgcctgacatgcaggagcgtgctacttcgaatagccttagcccttgttctgatgaagatcttccatatggttcatctaaaatcaaggctgctctagagatcttacaatcactgcccaaagcacatgatttgacagattcaaatcagatctctgaaaacagagaatactccggtctttctataactcctgtgaagaatgagggtatgagcgttgatgttccgattaaggtagctggagaaaaagccattgttttttcccaatggacaaagatgctaaacctacttgaagcttctcttgtaagttcacatattcagtatagaaggctcgatggaacaatgtcagttgctgctagggataaagcagtgcaggatttcaacactctccctgaggttactgtaatgataatgtctctcaaggctgctagtctcggactgaacatggtggcagcttgtcatgttctgatgctggacttatggtggaacccaacaaccgaggatcaagcaatcgatagagcacatcgtataggacagacacgaccagtaacagtagttcgcttcacagtaaaagatacagtcgaagatcggatattagcccttcagcaaaagaagagaatgatggtagcctctgcatttggagaagatgaaaagggaagccgacagtctcacctcacagtagaggacttgagctatctgtttatggctgattcatga

SEQ ID NO: 646 - protein, 1287 aa, Arabidopsis thaliana
MGEEGSMFGLGGEFPVDDCDGGFEFEDDDETIDIETLYRILDEKPDSAEVVFSAFVGSQENLSPVGSSADELKDSQLLNGSFDEHVKMEAGLSPSPAHTCSASLKDWFSLSQGEQPVETCGVSQSEMTSCSISSSFSDPDGNMMAFNPVNCDVDTVSKQDDKIIDSKSMLTPYFDNVTGYGVGLGANHNSSAMSVFFNNSNSLSDSADNYVSSAQDCYNTSGTSLSDHTPNSVQNFAFEFFPNKEEAVNDVESGVSESQSDGASRMIFDRHGRVDNGSLERKPPIDFSSARGISFKFESNPSVSPACVKPYNSFDSHLADSDLDRPNNYSCSFQDNKTVHVKVKPEAESEKVVYSSVPGEFSVRDDAYLSGETNRWWSGASSSAVSYQTDIEKGYSYMAPQTALPSQDSGKISSNHFYDSDTCLQYVVEDPSPVTQNNEYKDFQIQQGDREYIQPRGIDSQFSNASFESVQSHSSECISDSDDDSDVCIIEPYGQSAIPHRPLAMKMPVVSSEYSTVSHNFNQSGGLKLQSNKENMIFQAALQDLTQPNSEAILPDGVLTVPLLRHQRIALSWMAQKETSGFPCSGGILADDQGLGKTVSTIALILKERSKPAQACEESTKKEIFDLESETGECAPLKPSGRSKHFEHSQLLSNENKVGGDSVGKVTGRPAAGTLVVCPTSVMRQWADELHKKVTSEANLSVLVYHGSSRTKDPHELAKYDVVVTTFSIVSMEVPKQPLVDDEDEEKDGVHDGGTAATGFCSNKKRKYPPDSKKKGSKKKKVEFLSGPLAKVSWFRVVLDEAQSIKNYKTQVARACWGLRAKRRWCLSGTPIQNSIDDLYSYFRFLKYDPYSSYVLFCSTIKNPITRNPVKGYQKLQAILKTVMLRRTKGSLLDGKPIISLPPKSIELRKVDFTVEERDFYSKLEAESRTQFREYAEAGTVKQNYVNILLMLLRLRQACDHPLLVNGEYSFTWESSVGLAKKQIQSDASLAICGICNDAPEDAVASVCGHVFCKQCIYERLTGDSNHCPFANCNVRLTISSLSSKTRLDDAMPDMQERATSNSLSPCSDEDLPYGSSKIKAALEILQSLPKAHDLTDSNQISENREYSGLSITPVKNEGMSVDVPIKVAGEKAIVFSQWTKMLNLLEASLVSSHIQYRRLDGTMSVAARDKAVQDFNTLPEVTVMIMSLKAASLGLNMVAACHVLMLDLWWNPTTEDQAIDRAHRIGQTRPVTVVRFTVKDTVEDRILALQQKKRMMVASAFGEDEKGSRQSHLTVEDLSYLFMADS

SEQ ID NO: 647 - DNA, 990 bp, Arabidopsis thaliana
atgagtgctgcagcacacaggactcctaaatcagggaggcaatctctgctatttcaagatttagcttctcctgtttcagcacgtagagggaaattctcgagtccgggacaggcagctgcggtatctgcactatggcgtgagaatttcggaggatctgatcttccaccacctccaatgtatactttggatgaccggtccgatttctctcctgagtctggtattgcagactactctgcgtctccagatgctaagtctgacagaagaacaccattccagagttctggaaagaatattgtaactcctggtaaaggaaagttggaagcaagcccttctttttctctactgaatgcacaacagagtcagcaagtttcagggagtccgagttggtggtcgcagtcaaaggcaggtagtagtaccgagcaggatgataaagggaagggatctcctgtagaaggggtggttcagccaggtgcattggtcactcttccgccgccaagagaagttgctaggccagaggttcagaggcagattatacctacaggaaaccttgatgaggaagagtgggtcactgtctatggattttctccaggtgatacaaatttagtactacgggagtttgaaaaatgtggtatggtcttgaaacatgttcctggtccaagaaatgccaactggatgcacatcctctaccagaaccggtctgatgcacataaggcgctgaacaaagcagggatgatgataaacggagttgtaatagtaggagtgaagccagtagacccaatacagaagcaagcgttaaacgagagactcaacaaccaaggattcatgcctttacctccaccatcatccactagaaacactgctcgacccctgtctcgtcctcagtacttgcaaaacggcagcgctttctctcctcaaccaagtggtggcgctatggcctctccgtcaaagtcaatggtctcaaagttctttgacttgatgttcggtgtttaa

SEQ ID NO: 648 - protein, 329 aa, Arabidopsis thaliana
MSAAAHRTPKSGRQSLLFQDLASPVSARRGKFSSPGQAAAVSALWRENFGGSDLPPPPMYTLDDRSDFSPESGIADYSASPDAKSDRRTPFQSSGKNIVTPGKGKLEASPSFSLLNAQQSQQVSGSPSWWSQSKAGSSTEQDDKGKGSPVEGVVQPGALVTLPPPREVARPEVQRQIIPTGNLDEEEWVTVYGFSPGDTNLVLREFEKCGMVLKHVPGPRNANWMHILYQNRSDAHKALNKAGMMINGVVIVGVKPVDPIQKQALNERLNNQGFMPLPPPSSTRNTARPLSRPQYLQNGSAFSPQPSGGAMASPSKSMVSKFFDLMFGV

SEQ ID NO: 649 - DNA, 1488 bp, Arabidopsis thaliana
atggtttccgaaacaaccaaatcttctccacttcactttgttctcttccctttcatggctcaaggccacatgattcccatggttgatattgcaaggctcttggctcagcgtggtgtgatcataacaattgtcacgacgcctcacaatgcagcgaggttcaagaatgtcctaaaccgtgccattgagtctggcttgcccatcaacttagtgcaagtcaagtttccatatctagaagctggtttgcaagaaggacaagagaatatcgattctcttgacacaatggagcggatgatacctttctttaaagcggttaactttctcgaagaaccagtccagaagctcattgaagagatgaaccctcgaccaagctgtctaatttctgatttttgtttgccttatacaagcaaaatcgccaagaagttcaatatcccaaagatcctcttccatggcatgggttgcttttgtcttctgtgtatgcatgttttacgcaagaaccgtgagatcttggacaatttaaagtcagataaggagcttttcactgttcctgattttcctgatagagttgaattcacaagaacgcaagttccggtagaaacatatgttccagctggagactggaaagatatctttgatggtatggtagaagcgaatgagacatcttatggtgtgatcgtcaactcatttcaagagctcgagcctgcttatgccaaagactacaaggaggtaaggtccggtaaagcatggaccattggacccgtttccttgtgcaacaaggtaggagccgacaaagcagagaggggaaacaaatcagacattgatcaagatgagtgccttaaatggctcgattctaagaaacatggctcggtgctttacgtttgtcttggaagtatctgtaatcttcctttgtctcaactcaaggagctgggactaggcctagaggaatcccaaagacctttcatttgggtcataagaggttgggagaagtacaaagagttagttgagtggttctcggaaagcggctttgaagatagaatccaagatagaggacttctcatcaaaggatggtcccctcaaatgcttatcctttcacatccatcagttggagggttcctaacacactgtggttggaactcgactcttgaggggataactgctggtctaccgctacttacatggccgctattcgcagaccaattctgcaatgagaaattggtcgttgaggtactaaaagccggtgtaagatccggggttgaacagcctatgaaatggggagaagaggagaaaataggagtgttggtggataaagaaggagtgaagaaggcagtggaagaattaatgggtgagagtgatgatgcaaaagagagaagaagaagagccaaagagcttggagattcagctcacaaggctgtggaagaaggaggctcttctcattctaacatctctttcttgctacaagacataatggaactggcagaacccaataattga

SEQ ID NO: 650 - protein, 495 aa, Arabidopsis thaliana
MVSETTKSSPLHFVLFPFMAQGHMIPMVDIARLLAQRGVIITIVTTPHNAARFKNVLNRAIESGLPINLVQVKFPYLEAGLQEGQENIDSLDTMERMIPFFKAVNFLEEPVQKLIEEMNPRPSCLISDFCLPYTSKIAKKFNIPKILFHGMGCFCLLCMHVLRKNREILDNLKSDKELFTVPDFPDRVEFTRTQVPVETYVPAGDWKDIFDGMVEANETSYGVIVNSFQELEPAYAKDYKEVRSGKAWTIGPVSLCNKVGADKAERGNKSDIDQDECLKWLDSKKHGSVLYVCLGSICNLPLSQLKELGLGLEESQRPFIWVIRGWEKYKELVEWFSESGFEDRIQDRGLLIKGWSPQMLILSHPSVGGFLTHCGWNSTLEGITAGLPLLTWPLFADQFCNEKLVVEVLKAGVRSGVEQPMKWGEEEKIGVLVDKEGVKKAVEELMGESDDAKERRRRAKELGDSAHKAVEEGGSSHSNISFLLQDIMELAEPNN

SEQ ID NO: 651 - DNA, 1035 bp, Arabidopsis thaliana
atgtttggtggaggaagagggcctatgggtggcggcggaggtatgttacgcgccgccggtcgtgcgatgacgaggaccggtgtagccaacggtggtattcaagatccctttgcttcttcatcatcatcgtccacgtcgtctccggctggaaacgcctctgtttcgcatgtccagaaacagagatcttcttcttctgggtcgaataatctgacgtattccgcggcttctgggttgttgttgaatcttccggtggctgcaacctccggatggagcggcggcggtcctttttcctttgttaattctggaggttatgatgattttgagtgggtttctgaggaagaagatgattctctgtttggctctgttccttctgttgatgaagtccaagatgctgtttctgctctccagcaggttttcgatgctagttcatattcccagctggttagagacaaatacgagtgctatccggaaaatggtggtggaaaccagagccctatagccacagggatggttcatcaagttccttcattcgggtcggattcggactggatggagccatcaatgcatttatgccattcaagaacgttaaagcctcatgcttatgatcaggtttacaatgcttttgacctactacgaaccgaaccatctgtccagaaaatggtagtatcattgtcgtctgacaaagcagtttgggaggcggtgatgaacaacgatgtggtgcgagagattagggacttgtacaacaatggcataagtcaagatgaggaaaattcagaagacacccctagggagaataacgcagcaacggatttcataaagtgggtatttgacaacacaatggttaaggccacggaagtgtttgtgaaaataacaaaggtcgtgaccgagctcttcaattgttacaatggtgatggtgttaacaacaaggggaaagatgccaaattcaacaattggctcgaggaaaagctgaccacttcggtcctgctatccatcatcgttatgctggtcgtgatggtatcccgagcctgcaactag

SEQ ID NO: 652 - protein, 344 aa, Arabidopsis thaliana
MFGGGRGPMGGGGGMLRAAGRAMTRTGVANGGIQDPFASSSSSSTSSPAGNASVSHVQKQRSSSSGSNNLTYSAASGLLLNLPVAATSGWSGGGPFSFVNSGGYDDFEWVSEEEDDSLFGSVPSVDEVQDAVSALQQVFDASSYSQLVRDKYECYPENGGGNQSPIATGMVHQVPSFGSDSDWMEPSMHLCHSRTLKPHAYDQVYNAFDLLRTEPSVQKMVVSLSSDKAVWEAVMNNDVVREIRDLYNNGISQDEENSEDTPRENNAATDFIKWVFDNTMVKATEVFVKITKVVTELFNCYNGDGVNNKGKDAKFNNWLEEKLTTSVLLSIIVMLVVMVSRACN

SEQ ID NO: 653 - DNA, 6375 bp, Arabidopsis thaliana
atgttgtctcccttatttgtgatctctattggagcagtcagaaagtgtcttagagctatcaatgaatctcgtgcactgaagcgcaaggtaatcaagagactctcagactccaatccttttcaatttatcttttgtgcagagttcagggctggtcaggtttatggggtgcctctctctggttcgcttctatgtaagcctggatttccagaacaaaggtcatgtggggaggagacaaagaaaagatggatcgagagtttatcacaacagcacaaacgattgcgctctttggctgataacattcctggatataggagaaaaaccttatttgaagtccttataaggaacaatgtcccactattgagagctacttggtttataaaagtgacttatctcaatcaggtacattgttgggcaataaattggtgcgacctagtcctgctgctatttcttcaggaacacctgacaagacacaagcttctcggtgtgagcaatggacaaaagatgttattgaatatttgcaatacctcttggatgaacttttgtcacggaatagctcatttcctgctcagcaaactagagataggtcaccacagatgctttatacaggatcaatgcaaaagaatagtccagcatcaacaagcctttacggcgaggaaacatctctacattttaaatggtggtatatggtgcgtcttctacagtggcaccatgctgaagggcttctttttcctaatctcattgttgattgggttctcaagctcttacagctttgtgaatttccattttgctttactgcaggaaaaggagatctttgaaattttgcagctgctactccccattgtgtatggtgttttagagagtattgttctctctcagacatatgtacagagtcttgtagctattgctgtccgtttcattcaggaacctgctcctggtggatctgatcttgttgataactctcgaagagcttatactctatctgctctaattgagatggttcgctacttggtacttgctgcacccgacacatttgttgcttcagatttctttcctcttcctccttccgtagcagcatgtggacctaatgatgtgagctatacgtcaaaggcttatgagaatctggaaaagctgagaagtaactctgcggagatttctgcccagtttcaaggaagaggagttctttcccggtttgagttcctttcttttgattataccatttcaaccattcaaagaagtgcagatgatttggcaaagatagctagcgctggttaccctcaacataacgtggctaaagctgttcaggccttggataaagctttgtcggatggagatatcagagctgcttacagttatctctttgaagacctttgcaatggagccgttgatgaggcctggattactgacgtcagtccatgtttaagatcatcccttagatggattggcgctattagcacatcctttgtttgctccgtttttttccttatagaatgggctacatgtgattttagagatttccgtgctggtgtgcctaaagatatcaagttctctggcagaaaagattgttctcaggtgtatttagtcattcagcttctgaagcaaaagattctgggtggagaattcacagctcgcaaaggaaagaattgtcgcaacaattttcttggtgtttctaaacctagcggttcgatggatgcatttgaaagcccgggcccattacatgatatcatagtctgttggattgatcagcatgaggtacacaagggaggagcaaagcgcttgcaattactcgtttttgaacttatacgttctggaatctttaatcccatagcatatgtgaggcaactcatagttagcgggatgatcgatgtgattcaacctgctgttgatcctgaaaggagaatgaggcaccatcgcatattgaaacagctacctgggtgttttgtacatgaaaccttagaggaagctcaactctttggaggggataagctttccgaggctgtgagaacttattctaatgaacggcgccttcttcttcgagaactgcttgttgagaaaggtaaatactggaataatttagttctctcagatcagaagtcaaagaaaatttccacttccctttcgtctgttatttttccaagggcgtgtaatgccaagagcaatagtaagggacctcgcaaacataccaagagtagtgtggatattagagaactaaaggagcgcatatcagctctactgcagtttccaggtatgtcatgtggtgtggaaaccccagtgcgagatgaattccaaaatagtgttaagagatcaagtggatctgtgtatagcaagatggatcaaccagaagctacaccagggtgtgaagactgtagaagagcaaaaagaccaaaaatgaatgatgaaaagagctcttgctatcaagggaattcaccaattgcatcagatgaagaagataactggtggatcaagaaaggatcgaaaactgtggagtcttctctgaaggttgatcctcagatagagataactaaacaagtaccacgaggtaggcagaagatggcgcgtaagacacagtcgctggctcaactacaagctgctagaattgaaggtagccagggcgcttcaacgagtcatgtttgtgataataaagtaagctgtcctcatcatggccctggagtggaaggagaaaatcagaaggtggttgatgtgtttagaacttccacccctgtggatatggtatctgttggaaactctttgaagcagctacagtttgttgataagcgatctattgcagtttggcttactactgcagttcggcaacttgttgaagagccccaaaagagcagtgtgagagttgggcagttcaatagaggtgctccagttgaggagaagaacacaattaggtggaagcttggggcagacgagctatactccatattatttctcttggatatctctcttgacttggtttcagcgggtggaagaaaccttgtaactgtaccaaggaatgttgaaaacaacatgtgtgaaataggcgaggcgattctagtatcatcactgagaaggtatgaaaacattctactttcagctgatcttgttcctgaggccatgacagctttgatgaaccgtgctgcatcacttatgtctagtaatggaaaaatttctggatcagcagccttagtttatactcgctatattttgaaaagatatggaagcctccccagtgttgtggaatggcataacaatttcaaagcaacatccgaaaagaagctactttctgaactagatcatacgcgatcaggaaatggtgagtatgggaaccccctcggggttccagcaggagtagataatccagatgactatttacgtaaaaaaatcagcattggcggtgcacgtccttcaagagtgggtttgagtatgcgagatgttttgcaacgacatgttgaagaggcgactcattatctcaaaaaactcattgggactggtactatgaaagcctctctcgctgagaaaaatgatgacgggtatcaggtggctcaacaaattgtagttggactaatggactgcattagacagactggcggtgcagctcaagagggtgatccctctttggtttcttctgcggtttctgcgattataaacagtgtaggcctttcagtggcaaggattacagatttctctttgggaaacatttatcagaatcatccttctggcgttgattcatctaatattgcacgatacattttacgaatccatataacctgtctgtgccttcttaaggaagctcttggagagcgtcaaagccgagtgtttgaaatagcacttgcaacagaaagttccactgcgcttactggagtttttgctcctgtgaagggatcacgaggtcagcatcagctatctcctgaatcctatgattcaaatgcaaacaattcaacaatcgatatgtcgaatggtactggaaaaatggcgctgagcagagcgacaaaaattactgcagctgtatctgcacttgttataggttctatcacacatggtgttataacccttgagaggattgttggtctactgagactaaaggattacttagatttcgttcagtttgtaaggcgtacaaaatcgagttctaatggcagtgctagatccatgggagcctctaaagtggaaagccctattgaagtgtatgtacattggttcagactccttgttggtaactgtaaaactgtttcggaagggctggttttggagcttgtgggagaatcttccgtggtggctatatcacgcatgcagcgtatgcttccgctgaaattggtcttcccaccagcctattcaattattgcgtttgttctgtggaggccttttgtttcaaatagtaactctaactccagcgtccatgaagacactcaccgcctttatcagtctttgacaatggccttccatgatgttattaagcatcttcctttccgagacgtgtgcttcagagacacccagggactttatgaactgatagttgctgattccacagatgctgaatttgcgtcggtgtttgaatcgcatggattggatatgcacttgaaatctgtggcctttgctcctcttcgagcgcgtcttttcttaaattccctaattgattgtaaggtgccatcctctggttattcccatgaaggagttagtgaagcaaaaaaccgacatcagggaaatggaacaaagcttgtggacaagcttgtatctgtattagattgcctgcagcctgcaaaatttcactggcagtgggttgaactcaggctgcttctaaacgagcaagcacttgctgagaaactcgaaaatcatgatatgcctttgacagatgcaatacgatcttcctgtcctacctctgagaagcctgatgcctctgagaatgagaaaaatttcattcaaatcctcctcacaaggttattggttagacctgatgcggtccctcttttctcagaagtggttcatctcttcggtagatcggttgaggattcaatgttgaagcaagctgaatggtttctagcaggccaagatgttctttttggacgaaaaacaatcagacaaaaactgattattgtaggtgaaagcaaaggactccccacgaaacctcagttttggaaaccttggggttggtgcaacagctctagttccgatcatattacagcaaacaaggcagggaagaaaaggaagtttgaaattacttctatcgaagaaggggaagtgattgaggaaggttcaggttcaagaaaggtattattaccccgggtattggatgagaatagtcccagtgttggctatgggattacaactgagagggcttttgttcagctagtgcttccatgcatagaccaaagctctgatgagtctcgaagtacctttgtgaatgagttggtaagacagtttagcaatattgagcagcaattaagttcagttaccaaccgcagtacaacaagcaacaagcaaatgggaactgcttcttctgggtctgagatttcatcaaataaaggaagtacccggaagggccttcgcggtggtagccctagtttggcaagaagatcctcagccaatactactgacacttcgccgccgccttcccctgctgctttgagagcttctatgtctttgcggttgcaatttcttctaagattactgcctgtcatctgcggggaaccttcatttaagaacaccagacatgcacttgcgtctacaatagttcgtctacttggaagcagagtagtttatgaagattatgctgtatgttctcctcgtagtgagctatcaaaggcagaaacagaatcaacaatagatccttcttccatggcagatctctctagtgaagtcttatttgaccgcagagagcttacaggtttgtcaacaaattttaaaaaatccttaaaagtctgtcttcttggctgcaaaaatgagctttcgcggatgcagttaccagacaccattagatggcggatccaagcagcgatgccaatcctccttccttctctacgctgttctctctcatgccagcctcattctgttccgccaaccgcactcacacttgttcagccctctggatctactgctgctgctggaaccaatcaaagaaactcccctgccatatcgaaaagtggaactgcagcagcacaagggaagctgaagccgacaatgttggcaccacatcaacaacaagaagcagacaacacggatgtggttgacccgtggacgctcctcgaagatgggacaagttcaggtctatcaagcagcaacgcttcaaatagcagcgacatggccaaccttcgagccacctgttggctgaaaggtgcagtcagggtcagacggactgatctaacttacgttggttcagtagacgacgacagctga

SEQ ID NO: 654 - protein, 2124 aa, Arabidopsis thaliana
MLSPLFVISIGAVRKCLRAINESRALKRKVIKRLSDSNPFQFIFCAEFRAGQVYGVPLSGSLLCKPGFPEQRSCGEETKKRWIESLSQQHKRLRSLADNIPGYRRKTLFEVLIRNNVPLLRATWFIKVTYLNQVHCWAINWCDLVLLLFLQEHLTRHKLLGVSNGQKMLLNICNTSWMNFCHGIAHFLLSKLEIGHHRCFIQDQCKRIVQHQQAFTARKHLYILNGGIWCVFYSGTMLKGFFFLISLLIGFSSSYSFVNFHFALLQEKEIFEILQLLLPIVYGVLESIVLSQTYVQSLVAIAVRFIQEPAPGGSDLVDNSRRAYTLSALIEMVRYLVLAAPDTFVASDFFPLPPSVAACGPNDVSYTSKAYENLEKLRSNSAEISAQFQGRGVLSRFEFLSFDYTISTIQRSADDLAKIASAGYPQHNVAKAVQALDKALSDGDIRAAYSYLFEDLCNGAVDEAWITDVSPCLRSSLRWIGAISTSFVCSVFFLIEWATCDFRDFRAGVPKDIKFSGRKDCSQVYLVIQLLKQKILGGEFTARKGKNCRNNFLGVSKPSGSMDAFESPGPLHDIIVCWIDQHEVHKGGAKRLQLLVFELIRSGIFNPIAYVRQLIVSGMIDVIQPAVDPERRMRHHRILKQLPGCFVHETLEEAQLFGGDKLSEAVRTYSNERRLLLRELLVEKGKYWNNLVLSDQKSKKISTSLSSVIFPRACNAKSNSKGPRKHTKSSVDIRELKERISALLQFPGMSCGVETPVRDEFQNSVKRSSGSVYSKMDQPEATPGCEDCRRAKRPKMNDEKSSCYQGNSPIASDEEDNWWIKKGSKTVESSLKVDPQIEITKQVPRGRQKMARKTQSLAQLQAARIEGSQGASTSHVCDNKVSCPHHGPGVEGENQKVVDVFRTSTPVDMVSVGNSLKQLQFVDKRSIAVWLTTAVRQLVEEPQKSSVRVGQFNRGAPVEEKNTIRWKLGADELYSILFLLDISLDLVSAGGRNLVTVPRNVENNMCEIGEAILVSSLRRYENILLSADLVPEAMTALMNRAASLMSSNGKISGSAALVYTRYILKRYGSLPSVVEWHNNFKATSEKKLLSELDHTRSGNGEYGNPLGVPAGVDNPDDYLRKKISIGGARPSRVGLSMRDVLQRHVEEATHYLKKLIGTGTMKASLAEKNDDGYQVAQQIVVGLMDCIRQTGGAAQEGDPSLVSSAVSAIINSVGLSVARITDFSLGNIYQNHPSGVDSSNIARYILRIHITCLCLLKEALGERQSRVFEIALATESSTALTGVFAPVKGSRGQHQLSPESYDSNANNSTIDMSNGTGKMALSRATKITAAVSALVIGSITHGVITLERIVGLLRLKDYLDFVQFVRRTKSSSNGSARSMGASKVESPIEVYVHWFRLLVGNCKTVSEGLVLELVGESSVVAISRMQRMLPLKLVFPPAYSIIAFVLWRPFVSNSNSNSSVHEDTHRLYQSLTMAFHDVIKHLPFRDVCFRDTQGLYELIVADSTDAEFASVFESHGLDMHLKSVAFAPLRARLFLNSLIDCKVPSSGYSHEGVSEAKNRHQGNGTKLVDKLVSVLDCLQPAKFHWQWVELRLLLNEQALAEKLENHDMPLTDAIRSSCPTSEKPDASENEKNFIQILLTRLLVRPDAVPLFSEVVHLFGRSVEDSMLKQAEWFLAGQDVLFGRKTIRQKLIIVGESKGLPTKPQFWKPWGWCNSSSSDHITANKAGKKRKFEITSIEEGEVIEEGSGSRKVLLPRVLDENSPSVGYGITTERAFVQLVLPCIDQSSDESRSTFVNELVRQFSNIEQQLSSVTNRSTTSNKQMGTASSGSEISSNKGSTRKGLRGGSPSLARRSSANTTDTSPPPSPAALRASMSLRLQFLLRLLPVICGEPSFKNTRHALASTIVRLLGSRVVYEDYAVCSPRSELSKAETESTIDPSSMADLSSEVLFDRRELTGLSTNFKKSLKVCLLGCKNELSRMQLPDTIRWRIQAAMPILLPSLRCSLSCQPHSVPPTALTLVQPSGSTAAAGTNQRNSPAISKSGTAAAQGKLKPTMLAPHQQQEADNTDVVDPWTLLEDGTSSGLSSSNASNSSDMANLRATCWLKGAVRVRRTDLTYVGSVDDDS

SEQ ID NO: 655 - DNA, 648 bp, Arabidopsis thaliana
atggtgctaaaggtgtacggacctcactttgcttcaccaaagagagctttggtcacactgatcgagaagggcgttgccttcgagaccatccccgtcgatctcatgaaaggagaacacaagcagcctgcttatctcgctctacagccttttggtactgttcctgctgttgttgacggtgactacaaaatcttcgagtcccgtgcggtgatgaggtacgtagctgagaagtacaggtcacaaggacctgatcttttggggaaaaccgttgaagacagaggtcaagttgaacaatggcttgatgtggaagcgaccacttaccacccaccgctattgaacttaacgcttcacataatgttcgcatcagtcatgggattcccatctgatgagaagctgatcaaggagagtgaagagaagcttgcgggtgttcttgatgtctacgaggcacatctctcaaagagcaagtacttggccggtgacttcgtgagcttggctgatttggctcacctcccgttcactgattacttggttggtccgattgggaaagcttacatgatcaaagataggaaacacgtgagcgcgtggtgggatgatattagcagccgtcctgcgtggaaggagactgttgccaagtattcattcccagcttaa

SEQ ID NO: 656 - protein, 215 aa, Arabidopsis thaliana
MVLKVYGPHFASPKRALVTLIEKGVAFETIPVDLMKGEHKQPAYLALQPFGTVPAVVDGDYKIFESRAVMRYVAEKYRSQGPDLLGKTVEDRGQVEQWLDVEATTYHPPLLNLTLHIMFASVMGFPSDEKLIKESEEKLAGVLDVYEAHLSKSKYLAGDFVSLADLAHLPFTDYLVGPIGKAYMIKDRKHVSAWWDDISSRPAWKETVAKYSFPA

SEQ ID NO: 657 - DNA, 2055 bp, Arabidopsis thaliana
atggcggaaactgagagaccccaccggtcttcaagtattaacagtagtagcaacaacaacagtggttcatcaaccgatctattcatttgtttcacatctcgtttctcttcttcttcctctatgcgtctctcttctaaatccatccatagcccagctcgttccgcttgtctcaccacttctcttagccgtcgtctccgtactagcggtagcttgaagaacgcttcagctggagttttgaactctcccatgtttggtgctaatggaggacggaagagatctggatctggctacgagaatagtaacaacaacaacaataataacatagagccgtcgtctccgaaggtgacgtgtattggtcaagttagagtgaagactaggaagcatgtgaagaagaagatgagagctagatctagaaggaaaggaggtgagaatagtttcaggagatccgttgatcaaaacgacggtggtggtggatgtcgttttaaagcgagtgagaatcgtttggtgcatcttccggtgactatctgcgagtcgttgagatcgtttgggtctgagctcaactgcttcttcccgtgtcgatcttcctgtacggagaatagtcatggagatgggaggagagctgagagtaacaacgacggttgcggcggcggcggaggaggaagtaattcgtgtggtgcggtgtttacgaggtggtttgtggcggtggaggagacttcgggagggaagagaagagagattgagcttgttgttggtggagaagacgaagttgaggaggataggcggaggagtcgtcggagacatgttttcgaggggcttgatttaagtgagatagagatgaagacggagaagaaagagagaggagaagaagttggacggatgagtatttgttctccgccgaagaatgctttgttgttgatgcggtgtagatctgatccggttaaggttgcggcgttagctaaccgggttcgtgaaagacagttgtcgttaaacgacggcgtatacacagaggaggaagaagatgagagaagaagaaggtttgagctggaaattgaagataagaaacggatcgacttgtgtgagaaatggatctctggtgagactactgtggaaacagaagaagtttcagtagcagttgcagaagcagaagcagaagcagaagcagaagctcctttgccttcaaatccagctacagaggaagaagaaagagtcaaagttgtggaagattcgattgttgaagaagaacaagaagcttcgaaaattctggattcgtttgaggaagaaatagaagctacgatcatgaaaaaaattgaagacgaaatcagaaacgctatagaagaagaggagaaacttgctgagatggaagaattagcggttgtggcggtggctgagacggaggaggtagaagaaagcaaagaggttgttcctgattgtatacctcaaaatgaggaaagatccgaacaaggaaaccgggaacccgacccgagtccggaagtggtgatgagaagaagtctacaagaggaaacaacggagaaagagaagacgacggcgacgccgtataaggtgttaccggattgtttgctgcttatgatgtgtgaaccaaagctctcaatggaagtctctaaggagacttgggtttgcagtacagatttcgtcagatgtttaccaggaagacctccggcgaagaagataccaccagaagccgtcggagacaatcatcatcatcatcaacccaagaagcgaatcgtcacagccgttgattccaacgcatcctctcgccggcggtcaatcgatagaccaccacttcacctacagccgccacggtcatcgtgttcatacccagcagctccaccgataataacggcagctgcggcggttggggaacagagggtagccggagctaataaggtacagccaccagtgctgccacgttgcaaatcggaaccgaggaagtcagcgtcgaagctagcgccggaagcttgtttctggaaaaataggaagcttgagccacaccctccggcaaccgtcggtgtcggcggcgccggagtagggttctag

SEQ ID NO: 658 - protein, 684 aa, Arabidopsis thaliana
MAETERPHRSSSINSSSNNNSGSSTDLFICFTSRFSSSSSMRLSSKSIHSPARSACLTTSLSRRLRTSGSLKNASAGVLNSPMFGANGGRKRSGSGYENSNNNNNNNIEPSSPKVTCIGQVRVKTRKHVKKKMRARSRRKGGENSFRRSVDQNDGGGGCRFKASENRLVHLPVTICESLRSFGSELNCFFPCRSSCTENSHGDGRRAESNNDGCGGGGGGSNSCGAVFTRWFVAVEETSGGKRREIELVVGGEDEVEEDRRRSRRRHVFEGLDLSEIEMKTEKKERGEEVGRMSICSPPKNALLLMRCRSDPVKVAALANRVRERQLSLNDGVYTEEEEDERRRRFELEIEDKKRIDLCEKWISGETTVETEEVSVAVAEAEAEAEAEAPLPSNPATEEEERVKVVEDSIVEEEQEASKILDSFEEEIEATIMKKIEDEIRNAIEEEEKLAEMEELAVVAVAETEEVEESKEVVPDCIPQNEERSEQGNREPDPSPEVVMRRSLQEETTEKEKTTATPYKVLPDCLLLMMCEPKLSMEVSKETWVCSTDFVRCLPGRPPAKKIPPEAVGDNHHHHQPKKRIVTAVDSNASSRRRSIDRPPLHLQPPRSSCSYPAAPPIITAAAAVGEQRVAGANKVQPPVLPRCKSEPRKSASKLAPEACFWKNRKLEPHPPATVGVGGAGVGF

SEQ ID NO: 659 - DNA, 768 bp, Arabidopsis thaliana
atggcgacacacgacttcgatttcactgatccctatggaaataaagatagaaaaagtttgtactcaaaccaagataactatttcaataattggtcttcacttactcaatcagaggaagttgttgaggagctttctattcaacagactaaatacgaccatcggagtctgccttctttgagaactgccgaagccgaggctgctgagtggaatgagttggagagatgggggaaccaagagttgcagcataatggcactcgcattagaggaattataacttacaaatcagggaacttgcccggtgttttgtcattctctgtaatagagattctcatgatggttgtggcttcgtttgttccaaacttcttgactggtcttttcactggagctggccttattggaatcatcatgacgtcttctggattctcccgtcttcttcctgatcttcccaaaatcttttgccgtttctcgatttcctacacgatttcttacatgatttttggatcttgggccatcaagctagggcacaacaacaattttctcgggcctctatcaccggacgagccgaaaatgacaggagaagaaatgaatatgaatgaatttggagtaaaggtgacgcattcaggatggtggggcttccctgagattgtgatagcaatccttgtgtgtacctggcttcttttcttcgtggcccaaaagctgaaggagagagcacgaccagcttcaagggtgattcaggcgaaagtttattttaatgtgcagctttcataa

SEQ ID NO: 660 - protein, 255 aa, Arabidopsis thaliana
MATHDFDFTDPYGNKDRKSLYSNQDNYFNNWSSLTQSEEVVEELSIQQTKYDHRSLPSLRTAEAEAAEWNELERWGNQELQHNGTRIRGIITYKSGNLPGVLSFSVIEILMMVVASFVPNFLTGLFTGAGLIGIIMTSSGFSRLLPDLPKIFCRFSISYTISYMIFGSWAIKLGHNNNFLGPLSPDEPKMTGEEMNMNEFGVKVTHSGWWGFPEIVIAILVCTWLLFFVAQKLKERARPASRVIQAKVYFNVQLS

SEQ ID NO: 661 - DNA, 855 bp, Arabidopsis thaliana
atggcgatcacttacttgcttcctctgtttctttctcttatcatcacctcctctgtttcagctaatttccaaagagacgttgagatcacttggggtgatggtcgtggacagatcaagaacaatggagagcttctcactttatctctagataaatcctctggttctggattccaatccaaaaacgagtacttgtttggtaaagtctccatgcaaatgaagcttgtccctggaaactccgcaggaacagtcacaacactttacttgaaatcacctggaacaacatgggacgagatagatttcgagtttttagggaattcaagtggagaaccttacacacttcacacaaatgtctacacacaaggcaaaggagacaaagaacaacaattcaaactctggtttgatccaacagctaatttccacacttacactattctctggaacccacaaagaatcattttcaccgtcgatggaactccgatcagagaattcaagaacatggagtctctaggcactctgtttcccaagaacaaaccaatgagaatgtactcgagtctttggaacgctgatgattgggcaacgagaggtggtttggtcaaaaccgattggtctaaagctcctttcactgcttcttaccgtggctttcaacaagaagcttgtgtttggtcaaacggcaagtcttcttgtcctaatgcctcgaaacaggggactactactggctcgtggttgtcacaagagcttgactcaacagctcaacaaaggatgagatgggtgcagaggaactacatgatctataattattgtacggatgcgaagaggttccctcaaggtcttcctaaagagtgcttagctgcatag

SEQ ID NO: 662 - protein, 284 aa, Arabidopsis thaliana
MAITYLLPLFLSLIITSSVSANFQRDVEITWGDGRGQIKNNGELLTLSLDKSSGSGFQSKNEYLFGKVSMQMKLVPGNSAGTVTTLYLKSPGTTWDEIDFEFLGNSSGEPYTLHTNVYTQGKGDKEQQFKLWFDPTANFHTYTILWNPQRIIFTVDGTPIREFKNMESLGTLFPKNKPMRMYSSLWNADDWATRGGLVKTDWSKAPFTASYRGFQQEACVWSNGKSSCPNASKQGTTTGSWLSQELDSTAQQRMRWVQRNYMIYNYCTDAKRFPQGLPKECLAA

SEQ ID NO: 663 - DNA, 1686 bp, Arabidopsis thaliana
atgagaggtactactgagaatacggatctgttcgatcccaaaacccaaatggatcctgacttcactcgtcatggttcttcctccgacggcgattttggattcgcttttaacgacagtaacttctctgatcgtttgcttcggatcgagatcatgggtggaccttcggattctcggtctgaagttgaagggtgtacgagtatcgctgattgggctcgtcatcgcaagagaagaagagaagatatcaagaaggaatctggtgtcacgatttcagacattgtggcatgtcctgaggagcagattttaactgatgaacaacctgacatggatggatgtcctggtggtgagaatcctgatgatgaaggaggagaggcaatggttgaagaagctttatcaggtgatgaagaggaaacgtctagtgagccaaactggggaatggattgttctacagttgttagggttaaagaacttcatattagttctcctattttagctgccaaaagccctttcttttacaagttgttctccaatggaatgagggaatctgagcaaaggcatgtcacccttaggattaatgcatcagaggaagctgctttgatggagcttttaaactttatgtatagcaatgcggtatctgtcaccacagcacctgccttattagatgtgttgatggctgctgataagtttgaagttgcctcttgtatgaggtactgcagtagacttctccgtaatatgcctatgactccagagtctgccctgctctatctcgagcttccctctagtgttctaatggccaaagctgttcagcctttaactgatgctgcaaaacagttccttgcagcccgctacaaggatattaccaagtttcatgaggaggtaatgtctctacctttggctggaattgaggcaattctatcaagcgatgaactccaaattgcatcagaggatgcagtttatgattttatcttgaagtgggcaagggcgcaatacccttgtttggaagagcgaagagagattctcgggtcacgccttgcactctccatccgcttcccattcatgacatgccgaaagctgaagaaagtgctgacttgcagtgactttgagcatgaaatagcatcaaagcttgttctagaagctcttttcttcaaagcagaagccccacacagacaacgtagcctagcctccgaagaatctgcatccctgaaccgccgcctgatagagagggcttacaaatacagacccgtcaaagtggtcgagtttgagcttcctagaccgcagtgtgtagtctacctagacttgaaaagagaagaatgtgggggactgttcccgtcgggtagagtgtattcgcaggcctttcacttgggaggtcaagggtttttcctgtcagctcactgcaacatggaccaacagagctcgttccactgtttcgggctgttcctagggatgcaggagaaagggtcggtgagtttcggagtggactatgaattctcggcaaggtcaaagcccgcagaggatttcataagcaaatacaaagggaactacacattcacaggagggaaagcagtaggttacagaaacctgtttggggtcccatggacgtcttttatagcggaagatagtcaatacttcatcaatggcattctccatctcagagcagagcttaccatcaaaaggtctacagatccttag

SEQ ID NO: 664 - protein, 561 aa, Arabidopsis thaliana
MRGTTENTDLFDPKTQMDPDFTRHGSSSDGDFGFAFNDSNFSDRLLRIEIMGGPSDSRSEVEGCTSIADWARHRKRRREDIKKESGVTISDIVACPEEQILTDEQPDMDGCPGGENPDDEGGEAMVEEALSGDEEETSSEPNWGMDCSTVVRVKELHISSPILAAKSPFFYKLFSNGMRESEQRHVTLRINASEEAALMELLNFMYSNAVSVTTAPALLDVLMAADKFEVASCMRYCSRLLRNMPMTPESALLYLELPSSVLMAKAVQPLTDAAKQFLAARYKDITKFHEEVMSLPLAGIEAILSSDELQIASEDAVYDFILKWARAQYPCLEERREILGSRLALSIRFPFMTCRKLKKVLTCSDFEHEIASKLVLEALFFKAEAPHRQRSLASEESASLNRRLIERAYKYRPVKVVEFELPRPQCVVYLDLKREECGGLFPSGRVYSQAFHLGGQGFFLSAHCNMDQQSSFHCFGLFLGMQEKGSVSFGVDYEFSARSKPAEDFISKYKGNYTFTGGKAVGYRNLFGVPWTSFIAEDSQYFINGILHLRAELTIKRSTDP

SEQ ID NO: 665 - DNA, 2787 bp, Arabidopsis thaliana
atggaggctcctacgcctctcctccttctcgtcctcctcacaaccataaccttcttcaccacctccgtcgctgatgaccaaacagcaatgctcgctttagctaaatcattcaatcctccgccgtcagattggtcttccaccaccgatttctgcaaatggtccggcgtacgatgtaccggcggtcgtgtcacaaccatcagcctcgctgataaatctctcaccggattcatcgcacctgagatctcgactctttcagagctcaaatctgtttctattcaacgtaacaaactctccggtacaatcccttcgtttgctaaactctcgtctcttcaagagatctatatggatgagaataatttcgtcggagttgaaaccggagctttcgccggacttactagtctccagatcttgagtttaagcgataacaacaacattactacttggagtttcccatcggagctcgtcgattcgacttctctcactacgatttatctcgataacacaaacatcgccggagttttgcctgacattttcgattccttagcttctcttcaaaatctccggttatcttacaacaacatcaccggcgttttaccaccgtcgcttggaaaatcttcgattcagaatctttggatcaacaatcaagacctaggaatgtcaggaacgatcgaagttctttcgagtatgacgtccttgtcacaagcttggcttcacaagaatcacttctttggaccgattccagatctctccaagagcgagaatctcttcgatctacagctccgggataatgatttaaccggaatagtacctccgacgcttcttacactcgctagcttgaagaatatttctctagataacaataaatttcaaggacctcttcctttgttttcaccggaggttaaagtaacaatagaccacaacgttttttgtactactaaagctggacaaagctgtagtcctcaggtgatgacgcttttagcggtggctggaggtttgggatatccttcaatgttggctgagtcttggcaaggtgatgatgcttgtagtggttgggcttatgttagttgtgattcagctgggaagaatgttgtcacgttgaatcttgggaaacatggattcaccgggtttatatctccggcgattgcgaatcttacttcattgaagagtctttatcttaatggtaacgatttgactggtgttattcctaaggagttgacatttatgactagtttgcagttaattgatgtctcgaataacaatcttagaggggagatacctaagtttccggctacggtgaagtttagttacaaaccggggaatgctttgttgggaactaatggtggagatggttcgagtcctggaactggtggtgctagtggtggtcctggtgggtcttctggtggtggtggtagtaaggttggtgtgattgttggtgtgattgtggcggttttagtgtttcttgccattttaggatttgtggtttataaatttgttatgaagaggaagtatgggaggtttaataggacggatcctgagaaggttgggaagattttggttagtgatgctgtatctaatggtggtagtggtaatggtggatatgctaatgggcatggagctaataacttcaatgctttgaatagtcctagtagtggtgacaatagtgatcgtttccttcttgaaggtggaagtgttaccattccaatggaggttcttcgccaggttacaaataatttcagtgaggataacatattgggcagagggggtttcggtgtcgtgtatgctggagaattacacgatggaacaaagactgctgttaagaggatggaatgtgcagcaatgggtaataaaggaatgagcgagtttcaggctgagatagcggtacttactaaggtcaggcatagacatttggttgctctattgggttactgtgtgaacgggaacgagaggttgcttgtctatgagtacatgccacagggaaatcttggacagcatttgtttgagtggagtgaactcggttactctcctttgacatggaaacagagagtgagcattgctttagacgtggcaagaggtgtggaatatctccatagcttggctcaacaaagcttcatccacagagatttaaagccctctaacatccttctaggagatgacatgagagccaaggttgctgattttggattggtcaagaacgcacctgatggtaaatactctgttgaaacaagattagcaggcacattcggttatctagcaccagaatacgccgctactggaagagtaacgacgaaagtggatgtgtatgcatttggtgtggttctcatggaaatactaactggaagaaaagctttagatgattcattaccagacgagagatctcatctagtcacatggttcagaagaatcctaatcaacaaagaaaacatcccaaaggcactcgaccaaaccttagaagcagacgaggaaacaatggagagcatttacagagttgctgagctagctggacactgcacagcccgcgaacctcaacaaagacccgacatgggccacgcagtaaacgtgctaggtccacttgtagagaagtggaaaccgtcgtgccaagaagaagaagagagtttcggaatcgatgtgaacatgagtttacctcaagctctacaaagatggcaaaacgaaggaacatcgtcatcaacaatgttccatggagacttctcttattctcagacacagtctagtattcctcctaaagcctctggctttcctaatactttcgattcagctgatggtcggtga

SEQ ID NO: 666 - protein, 928 aa, Arabidopsis thaliana
MEAPTPLLLLVLLTTITFFTTSVADDQTAMLALAKSFNPPPSDWSSTTDFCKWSGVRCTGGRVTTISLADKSLTGFIAPEISTLSELKSVSIQRNKLSGTIPSFAKLSSLQEIYMDENNFVGVETGAFAGLTSLQILSLSDNNNITTWSFPSELVDSTSLTTIYLDNTNIAGVLPDIFDSLASLQNLRLSYNNITGVLPPSLGKSSIQNLWINNQDLGMSGTIEVLSSMTSLSQAWLHKNHFFGPIPDLSKSENLFDLQLRDNDLTGIVPPTLLTLASLKNISLDNNKFQGPLPLFSPEVKVTIDHNVFCTTKAGQSCSPQVMTLLAVAGGLGYPSMLAESWQGDDACSGWAYVSCDSAGKNVVTLNLGKHGFTGFISPAIANLTSLKSLYLNGNDLTGVIPKELTFMTSLQLIDVSNNNLRGEIPKFPATVKFSYKPGNALLGTNGGDGSSPGTGGASGGPGGSSGGGGSKVGVIVGVIVAVLVFLAILGFVVYKFVMKRKYGRFNRTDPEKVGKILVSDAVSNGGSGNGGYANGHGANNFNALNSPSSGDNSDRFLLEGGSVTIPMEVLRQVTNNFSEDNILGRGGFGVVYAGELHDGTKTAVKRMECAAMGNKGMSEFQAEIAVLTKVRHRHLVALLGYCVNGNERLLVYEYMPQGNLGQHLFEWSELGYSPLTWKQRVSIALDVARGVEYLHSLAQQSFIHRDLKPSNILLGDDMRAKVADFGLVKNAPDGKYSVETRLAGTFGYLAPEYAATGRVTTKVDVYAFGVVLMEILTGRKALDDSLPDERSHLVTWFRRILINKENIPKALDQTLEADEETMESIYRVAELAGHCTAREPQQRPDMGHAVNVLGPLVEKWKPSCQEEEESFGIDVNMSLPQALQRWQNEGTSSSTMFHGDFSYSQTQSSIPPKASGFPNTFDSADGR

SEQ ID NO: 667 - DNA, 1674 bp, Arabidopsis thaliana
atggctacctcctccgcttggaagctcgatgaccaccccaagctccccaagggtaagaccatcgccgtaatcgtcttagatggttggggtgaatctgcccctgatcagtacaactgtatccacaacgctccaactccagccatggattctcttaaacatggagctcctgatacttggactttgatcaaagctcacggtactgctgtaggacttcctagtgaagatgatatgggaaacagtgaggttggtcataatgctcttggtgctggtcgtatctttgctcaaggtgctaagctttgtgaccaagctcttgcttctggcaaaatctttgaaggtgaaggttttaaatacgtttctgaatctttcgagacgaatactttgcatcttgttggacttctcagtgacggtggagttcactctcgtctcgatcaactacagttgttgattaaaggatctgctgaacgtggtgctaagagaatcagagtccatattcttactgatggtcgtgatgttttggatggttctagtgttggatttgtggaaacccttgaagccgacctcgttgcattacgtgagaatggtgtggatgctcagattgcatctggtggaggacgtatgtatgtgactttggaccgatatgagaatgattgggaagttgttaaaagaggttgggatgctcaagttcttggagaagctcctcacaaattcaaaaacgctgttgaagctgtgaagactttgaggaaagagcctggtgctaatgaccagtatttgcccccgtttgtgattgttgatgaatcagggaaagcagttggtccgattgtggacggtgatgctgttgttaccttcaacttcagggctgatcgtatggttatgcatgctaaggcacttgagtacgaagattttgacaaatttgaccgtgtgaggtacccaaagattcgttatgctggtatgcttcagtatgatggagagcttaagctaccaagccgttaccttgtttctcccccggagattgatagaacatctggtgaatatttgactcacaatggcgtcagtacttttgcttgcagtgagaccgtcaagtttgggcatgtcaccttcttctggaatggaaatcgatctggatatttcaacgagaaattggaggagtatgttgaaatcccaagtgacagtggaatatcattcaatgtccagccaaagatgaaagctctggaaattggtgagaaggcaagggatgcaatccttagtggcaagtttgatcaggtgcgagttaacattccaaatggagatatggtgggtcatacaggtgatattgaagccacggttgttgcatgcgaggctgctgatcttgctgtgaagatgatttttgatgcaatcgaacaagtgaaaggaatttatgttgtgactgctgatcacggaaacgcagaggacatggtgaagagggataaatctggcaagcctgctttggataaggaagggaagcttcagattctaacctctcacacactcaagccagtgccaattgctattggaggtcctggtttggctcaaggagtgagattccgtaaagatctggaaacaccggggcttgcaaatgtagctgcaacagtgatgaacctccatggatttgtggctccctctgactatgagcccaccctgattgaagtagtggagtag

SEQ ID NO: 668 - protein, 557 aa, Arabidopsis thaliana
MATSSAWKLDDHPKLPKGKTIAVIVLDGWGESAPDQYNCIHNAPTPAMDSLKHGAPDTWTLIKAHGTAVGLPSEDDMGNSEVGHNALGAGRIFAQGAKLCDQALASGKIFEGEGFKYVSESFETNTLHLVGLLSDGGVHSRLDQLQLLIKGSAERGAKRIRVHILTDGRDVLDGSSVGFVETLEADLVALRENGVDAQIASGGGRMYVTLDRYENDWEVVKRGWDAQVLGEAPHKFKNAVEAVKTLRKEPGANDQYLPPFVIVDESGKAVGPIVDGDAVVTFNFRADRMVMHAKALEYEDFDKFDRVRYPKIRYAGMLQYDGELKLPSRYLVSPPEIDRTSGEYLTHNGVSTFACSETVKFGHVTFFWNGNRSGYFNEKLEEYVEIPSDSGISFNVQPKMKALEIGEKARDAILSGKFDQVRVNIPNGDMVGHTGDIEATVVACEAADLAVKMIFDAIEQVKGIYVVTADHGNAEDMVKRDKSGKPALDKEGKLQILTSHTLKPVPIAIGGPGLAQGVRFRKDLETPGLANVAATVMNLHGFVAPSDYEPTLIEVVE

SEQ ID NO: 669 - DNA, 1290 bp, Arabidopsis thaliana
atgatcggagctgtgaactcggtggaggctgtgataacgtcaatccaaggtttatcggggagtccagaggatttatctgcacttcacgatcttttgagaggagctcaagactcgctccgagccgaaccaggtgttaatttctctactcttgaccagctcgacgcctcgaagcactctctcggttacctgtatttccttgaggttcttacctgtggtccagtgtcgaaggagaaagctgcttatgagataccgataattgcacggttcatcaattcttgtgatgctgggcagattcgtttggcgagctataaatttgtatctctttgtaagatattgaaagaccatgttatagcactgggagatccgttgcgaggagtagggccactgttaaacgctgttcagaagcttcaggtctcctccaagcgtttgactgcattgcatccagatgttcttcaactctgtttgcaggcgaaatcgtacaaatctggtttctccattcttagtgatgatatcgtggagattgaccagccaagagacttttttctctatagctattatgggggaatgatttgtattggactgaagagatttcagaaagcattagagcttctttacaatgttgtgactgctcctatgcatcaagtcaatgccatagctcttgaggcgtacaaaaagtacatattggtgtctctcattcacaatgggcagtttactaacactctccccaagtgtgcttctacagcagcacagaggagcttcaagaactataccggaccttacattgaactgggtaattgttacaacgacgggaagattggtgaactagaggcattggttgtggccaggaatgcagaatttgaagaggataagaaccttggattagttaagcaagcagtgtcatccctttacaagcgtaacattctgagattgacacagaagtacttgaccctgtcgcttcaagatatagccaacatggtccaacttggtaatgctaaggaggcggaaatgcatgtgcttcagatgatccaggatggtcagatacatgcccttatcaaccagaaagacgggatggtcagattcttggaggaccctgagcagtacaaatctagtgagatgattgagatcatggattctgttatacaaaggactattggtctgtcgaagaatctcttagccatggatgagagcttatcatgtgaccctttatacttgggaaaggtaggaagggaaagacaaaggtacgactttggagacgatttcgatactgttcctcagaagttctccatgtaa

SEQ ID NO: 670 - protein, 429 aa, Arabidopsis thaliana
MIGAVNSVEAVITSIQGLSGSPEDLSALHDLLRGAQDSLRAEPGVNFSTLDQLDASKHSLGYLYFLEVLTCGPVSKEKAAYEIPIIARFINSCDAGQIRLASYKFVSLCKILKDHVIALGDPLRGVGPLLNAVQKLQVSSKRLTALHPDVLQLCLQAKSYKSGFSILSDDIVEIDQPRDFFLYSYYGGMICIGLKRFQKALELLYNVVTAPMHQVNAIALEAYKKYILVSLIHNGQFTNTLPKCASTAAQRSFKNYTGPYIELGNCYNDGKIGELEALVVARNAEFEEDKNLGLVKQAVSSLYKRNILRLTQKYLTLSLQDIANMVQLGNAKEAEMHVLQMIQDGQIHALINQKDGMVRFLEDPEQYKSSEMIEIMDSVIQRTIGLSKNLLAMDESLSCDPLYLGKVGRERQRYDFGDDFDTVPQKFSM

SEQ ID NO: 671 - DNA, 855 bp, Arabidopsis thaliana
atgggtaggaaaaagaaatctagggcttcgacaaccgaagaagatgagattgagatggataatgctggcccatcctctgagacaagtctttacgaggttcttggagttgaaagaagagccacttcacaggaaataagaaaagcataccataagttggcattgaagcttcaccctgataaaaatcaggatgataaggaagctaaagacaagttccagcagctgcaaaaagtgatatcaattcttggtgatgaagagaaaagggcagtctatgatcaaactggctcaattgatgatgctgatattcctggagatgcgtttgagaatttgcgggatttcttccgggacatgtataagaaggtcaacgaagctgatattgaagagtttgaggcaaactacaggggatctgagtcagagaagaaagacttgcttgagcttttcaacaagtttaagggtaaaatgaacaggctattctgctcaatgctttgctcggaccccaagcttgattcacaccgtttcaaagacatgcttgatgaggccattgcagcaggagaagtgaagtcaagcaaggcatatgagaaatgggcaaataaaatttcagaaacgaaaccgcccaccagtccattgaggaagaggaagaagaagaagtcagcagcaaaggattcagagacagatctttgcttgatgattgcgaaacgacaagaggagaggaaagggaaggtggactcgatgttttcatcacttatctctaggtatggtggtgatgcggaagcagagcccactgaagaagaatttgaagctgcccagagaaggattgaaagcaaaagaaaaccatccaagaagtctagaggaaagtag

SEQ ID NO: 672 - protein, 284 aa, Arabidopsis thaliana
MGRKKKSRASTTEEDEIEMDNAGPSSETSLYEVLGVERRATSQEIRKAYHKLALKLHPDKNQDDKEAKDKFQQLQKVISILGDEEKRAVYDQTGSIDDADIPGDAFENLRDFFRDMYKKVNEADIEEFEANYRGSESEKKDLLELFNKFKGKMNRLFCSMLCSDPKLDSHRFKDMLDEAIAAGEVKSSKAYEKWANKISETKPPTSPLRKRKKKKSAAKDSETDLCLMIAKRQEERKGKVDSMFSSLISRYGGDAEAEPTEEEFEAAQRRIESKRKPSKKSRGK

SEQ ID NO: 673 - DNA, 1647 bp, Arabidopsis thaliana
atgcgtttaattctcaccgtcatgtgctcattcattccttacctttattcatcttctcctcaccgtccttgctcttccccaatctctcgtcctcctcctcgaatccgtccttgtcgtctcagtcgtttcgccaccgcattagtcgctacctccgctcttcttctcgcttccgtcgcttggctttctctcgtcttctcaccaaccacttcccgttgttggcatcttcttaaagattgggaagacaatcatctctggaacaaacggtaccatcatccaattgtaactcctcctccgccgccgccgtcgccgccgtctcttccagctcttccgttattcgatcatgaatttagaaatcgtagtctctcagagattgataaacttgatctgtctatgaatcacttgatgtttggtattgctggatcttcacagctttgggaacgtcgtaaggaacttgtgagattatggtggaaaccttctcagatgcgtggacatgtctggcttgaagagcaagtttctcctgaggaaggtgatgattctcttcctcctataattgtctctgaagacagctctcgttttcgttacactaatcctactggtcatccttctggacttcgaatctctcgtattgctatggagtcttttcgtctctctctccctaatgttcggtggtttgttcttggtgatgatgatactatcttcaatgttcataatcttcttgctgtgttaagcaagtatgatccttcggagatggtttatattggaaacccctcggagagccactctgctaactcttactttagtcataacatggcttttggaggcggtggcattgccattagctaccctttagcggaagctctctcccggattcacgacgattgtctcgatagatacccgaagctatacggtagtgatgatcgtctccacgcctgcatcactgaactcggagttcctttgtccagagagcctggctttcaccagtgggatattaagggaaatgctcatggtctcttgtcctctcatcctattgcaccatttgtctcaattcatcacgttgaagctgttaatcctctctatccgggattatctacattagatagtttgaaactcttgacaagagctatgagtttggatcctaggagtgttttgcagcgatcgatctgctatgatcatactcacaaactgacatttgcgatatctcttggttatgttgtacaagttttcccaagtattctcctaccacgggatcttgagcgagctgaactttctttctctgcttggaacgggataagtcaacccagtgagtttgatcttgacataaagcttccaatttcgtctctctgtaagaagcctatcctcttcttcttgaaagaggttggccaagaaggtaatgctacacttggaacgtactcaagatccttggtaaaggatgatttgaagacgaagcttctatgttttccacgctctctacctctgcacaaagtggataaaatccaggtctcagggtttcctctgagtaaaaattggcacttggcgccgagacggttgtgttgcagagcaaccccaactactactaacgagcctctcagattaacagttgggcagtgtggtaagataattttgggttccacgattagttctcaatga

SEQ ID NO: 674 - protein, 548 aa, Arabidopsis thaliana
MRLILTVMCSFIPYLYSSSPHRPCSSPISRPPPRIRPCRLSRFATALVATSALLLASVAWLSLVFSPTTSRCWHLLKDWEDNHLWNKRYHHPIVTPPPPPPSPPSLPALPLFDHEFRNRSLSEIDKLDLSMNHLMFGIAGSSQLWERRKELVRLWWKPSQMRGHVWLEEQVSPEEGDDSLPPIIVSEDSSRFRYTNPTGHPSGLRISRIAMESFRLSLPNVRWFVLGDDDTIFNVHNLLAVLSKYDPSEMVYIGNPSESHSANSYFSHNMAFGGGGIAISYPLAEALSRIHDDCLDRYPKLYGSDDRLHACITELGVPLSREPGFHQWDIKGNAHGLLSSHPIAPFVSIHHVEAVNPLYPGLSTLDSLKLLTRAMSLDPRSVLQRSICYDHTHKLTFAISLGYVVQVFPSILLPRDLERAELSFSAWNGISQPSEFDLDIKLPISSLCKKPILFFLKEVGQEGNATLGTYSRSLVKDDLKTKLLCFPRSLPLHKVDKIQVSGFPLSKNWHLAPRRLCCRATPTTTNEPLRLTVGQCGKIILGSTISSQ

SEQ ID NO: 675 - DNA, 954 bp, Arabidopsis thaliana
atgactattcttgttgaacattttgttcctgattcaagagtggatgaaaagaaagtgatagaggagagggataatgaattggtgttggatggaggttttgtggttccaaaatcaaaggaaactgatgcattcgatgctcctgatatgaatttcttgggccattccttcagggattatgagaatggtgaaagcgagagacaacaaggtgttgaggaattttacaggatgcaacacattcaccagacctatgactttgtgaagaagatgaggaaagagtatggaaaacttaacaagatggaaatgagtatatgggaatgttgtgagttattgaacaatgttgttgatgaaagcgatccggatcttgatgagcctcaaattcaacaccttctccaaaccgctgaagccattcgaagggactatcccgacgaagattggctccatctcactgccctaatccatgatcttggcaaggttctccttctgccagaattcggtggtcttccccagtgggctgtcgttggcgatacatttccagttggatgtaccttcgactcagccaatattcaccacaagtatttcaaaggaaaccatgatatcaacaacccaaagtacaacacaaaaaatggagtttacactgaaggatgtggtttagacaatgttctcatgtcatggggtcatgacgactacatgtatttggtggctaagaagaatggcacgacccttcctcacgctggtctcttcattattcgatatcattccttttatccattgcacaaggcaggagcctacacacacttgatgaacgatgaggacagagatgatctcaagtggctccatgtcttcaataaatatgacctatacagtaagagcaaagttctggtagatgtcgaacaagtgaagccttactacatttcactcatcaacaagtattttccggcgaaactaaaatggtga

SEQ ID NO: 676 - protein, 317 aa, Arabidopsis thaliana
MTILVEHFVPDSRVDEKKVIEERDNELVLDGGFVVPKSKETDAFDAPDMNFLGHSFRDYENGESERQQGVEEFYRMQHIHQTYDFVKKMRKEYGKLNKMEMSIWECCELLNNVVDESDPDLDEPQIQHLLQTAEAIRRDYPDEDWLHLTALIHDLGKVLLLPEFGGLPQWAVVGDTFPVGCTFDSANIHHKYFKGNHDINNPKYNTKNGVYTEGCGLDNVLMSWGHDDYMYLVAKKNGTTLPHAGLFIIRYHSFYPLHKAGAYTHLMNDEDRDDLKWLHVFNKYDLYSKSKVLVDVEQVKPYYISLINKYFPAKLKW

SEQ ID NO: 677 - DNA, 1173 bp, Arabidopsis thaliana
atgtctattgcatcatcacttacttcagccacactttgcggcgcctcagtttttcctaaagcattagcctgcagctctgagttccctatcaatcttcccagcccttttgaaagttcaaagatttgtttgacttcgtttcctgcctctagggatctcaagaaaaatgctactttgaatctgactcgaaatgttggtccagtcaggtgtcatgctatgcaagctgggacgagggagttgaagaaatttgaacttagtgatgtgattgaagggaaacagtttgatagagagatgctaagcgctatattcgatgttgcacgcgaaatggaaaagatagaaaagagctcttcacaaagtgaaatcctcaagggttatttaatggctaccctcttttatgagccttctacccgtaccaggctttcatttgaatctgctatgaaacgccttggaggtgaagtcttaactactgagaacgctagagagttttcgtctgccgcgaaaggggaaacacttgaagacacaataagaacagtggagggttattcagatataattgtgatgcgacattttgaaagcggtgctgcaagaaaagctgcagctactgccaatatacctgtcattaatgcaggtgatggtcctggagagcatcctactcaggctctattggacgtctataccatccaaagtgaaattggaaaattagatggcatcagtgtagccttagttggagaccttgccaacggaaggactgtgcggtctcttgcatacttgcttgccaagttcaaagacgtgaagatctactttgtttcccctgaaattgtgaaaatgaaggatgatataaaagactatttgacatcaagcggggttgaatgggaagaaagttcagatttaatggaagtagcatccaagtgtgatgtagtttatcaaacacgaatccaaagagagaggtttggagaaaggctggacctttacgaagcagctcgtgggaagtatatcgtagacaaggatctgttaggagtgatgcagaaaaaagctattatcatgcatcctttaccgagattggatgaaatcaccgcagatgttgatgctgatccaagagctgcctacttcagacaagcaaagaacggtttgttcattagaatggctcttctaaagctactgcttgtcggttggtga

SEQ ID NO: 678 - protein, 390 aa, Arabidopsis thaliana
MSIASSLTSATLCGASVFPKALACSSEFPINLPSPFESSKICLTSFPASRDLKKNATLNLTRNVGPVRCHAMQAGTRELKKFELSDVIEGKQFDREMLSAIFDVAREMEKIEKSSSQSEILKGYLMATLFYEPSTRTRLSFESAMKRLGGEVLTTENAREFSSAAKGETLEDTIRTVEGYSDIIVMRHFESGAARKAAATANIPVINAGDGPGEHPTQALLDVYTIQSEIGKLDGISVALVGDLANGRTVRSLAYLLAKFKDVKIYFVSPEIVKMKDDIKDYLTSSGVEWEESSDLMEVASKCDVVYQTRIQRERFGERLDLYEAARGKYIVDKDLLGVMQKKAIIMHPLPRLDEITADVDADPRAAYFRQAKNGLFIRMALLKLLLVGW

SEQ ID NO: 679 - DNA, 978 bp, Arabidopsis thaliana
atgggagacgaccagctagatttcgagctcccagaagaggttttgtcggtgattccgatggacccttttgagcagctggatctcgcgaggaagattacatcaatggcgatagcttcaagggtgtcgaatctggactctgaggtggttgaattgagacagaagcttctgggtaaggaaagtgttgtccgtgagcttgaggagaaagcgtctcgcctggagagagactgccgcgaggctgattcgagattgaaggtcgttctcgaagataatatgaacctgacaaaggagaaggattcactggcaatgactgtaacgaaactcacccgtgatttggctaagctggagacattcaagcggcagttaatcaaatccctgagcgatgagagtggtccgcaaacagaacctgttgatattaggacatgcgaccagccaggatcatatccaggcaaagatggaaggatcaatgcacactcaattaaacaagcttacagtggatctacagacacgaacaatccagttgttgaagcttcaaaatacactggaaacaaattttcaatgacatcatacatatctccacgtcttaccccaaccgcaacaccaaagatcatctccacaagtgtgtctcctcgaggctattctgcagcaggttctcctaaaagaacatcaggtgcagtttctcccacaaaggcaacactctggtacccgtcaagtcagcaatcatcggctgcgaattctcctcctcgcaaccgcacactcccagctcgtacaccgcggatggatggtaaagaattcttccggcaagccaggagccgattatcctatgaacaattcagttccttcttagctaacatcaaagagctcaacgcccagaagcaaacccgagaggaaactctgaggaaagcagatgagatatttggggaagagaacaaagatctttatttatctttccaaggtctccttaacagaaacatgcgttaa

SEQ ID NO: 680 - protein, 325 aa, Arabidopsis thaliana
MGDDQLDFELPEEVLSVIPMDPFEQLDLARKITSMAIASRVSNLDSEVVELRQKLLGKESVVRELEEKASRLERDCREADSRLKVVLEDNMNLTKEKDSLAMTVTKLTRDLAKLETFKRQLIKSLSDESGPQTEPVDIRTCDQPGSYPGKDGRINAHSIKQAYSGSTDTNNPVVEASKYTGNKFSMTSYISPRLTPTATPKIISTSVSPRGYSAAGSPKRTSGAVSPTKATLWYPSSQQSSAANSPPRNRTLPARTPRMDGKEFFRQARSRLSYEQFSSFLANIKELNAQKQTREETLRKADEIFGEENKDLYLSFQGLLNRNMR

SEQ ID NO: 681 - DNA, 1440 bp, Arabidopsis thaliana
atggatccttctctctctgcaaccaatgatcctcatcatcctcctcctcctcagttcacatctttccctcctttcaccaacaccaaccccttcgcctctccaaaccaccccttcttcaccggacccaccgccgtcgcgccgccaaacaacatccatctctatcaagcagctcctccgcagcagccacaaacatctccagttcctcctcatccatctatttcccaccctccttactctgacatgatttgcacggcgattgcagcgttaaacgaaccagatgggtcaagcaagcaagctatttcgaggtacatagagagaatttacactgggattcctactgctcatggagctttgttgacacaccatctcaagactttgaagaccagtgggattcttgtcatggttaagaaatcttacaagcttgcttctactcctcctcctcctcctcctactagtgtagctcctagtcttgaacctcccagatctgatttcatagtcaacgagaaccaacctttacctgatccggttttggcttcttctactcctcagactattaaacgtggtcgtggtcgacctccaaaagctaaaccagatgttgttcaacctcaacctctgactaatggaaaactcacctgggaacagagtgaattacctgtctctcgaccagaggagatacagatacagccgccacagttaccgttacagccacagcagccggttaagagaccgccgggtcgtcctagaaaagatggaacttcgccgacggtgaagccagctgcttctgtttccggtggtgtggagactgtgaaacgaagaggtagacctccgagtggaagagctgctgggagggagagaaagcctatagtagtctcagctccagcttcagtgttcccgtatgttgctaatggtggtgttagacgccgagggagaccaaagagagttgacgctggtggtgcttcctctgttgctccaccaccaccaccaccaactaacgtagagagtggaggagaggaggttgcagtcaagaaacgaggaagaggacggcctcctaagattggaggtgttatcaggaagcctatgaagccgatgagaagctttgctcgtactggaaaacccgtaggaagacccagaaagaatgcggtgtcagtgggagcttctggacgacaagatggtgactatggagaactgaagaagaagtttgagttgtttcaagcgagagctaaggatattgtaattgtgttgaaatccgagataggaggaagtggaaatcaagcagtggttcaagccatacaggacctggaagggatagcagagacaacaaacgagccaaagcacatggaagaagtgcagctgccagacgaggaacaccttgaaaccgaaccagaagcagagggtcaaggacagacagaagcagaggcaatgcaagaagctctgttctaa

SEQ ID NO: 682 - protein, 479 aa, Arabidopsis thaliana
MDPSLSATNDPHHPPPPQFTSFPPFTNTNPFASPNHPFFTGPTAVAPPNNIHLYQAAPPQQPQTSPVPPHPSISHPPYSDMICTAIAALNEPDGSSKQAISRYIERIYTGIPTAHGALLTHHLKTLKTSGILVMVKKSYKLASTPPPPPPTSVAPSLEPPRSDFIVNENQPLPDPVLASSTPQTIKRGRGRPPKAKPDVVQPQPLTNGKLTWEQSELPVSRPEEIQIQPPQLPLQPQQPVKRPPGRPRKDGTSPTVKPAASVSGGVETVKRRGRPPSGRAAGRERKPIVVSAPASVFPYVANGGVRRRGRPKRVDAGGASSVAPPPPPPTNVESGGEEVAVKKRGRGRPPKIGGVIRKPMKPMRSFARTGKPVGRPRKNAVSVGASGRQDGDYGELKKKFELFQARAKDIVIVLKSEIGGSGNQAVVQAIQDLEGIAETTNEPKHMEEVQLPDEEHLETEPEAEGQGQTEAEAMQEALF

SEQ ID NO: 683 - DNA, 609 bp, Arabidopsis thaliana
atgagttctcagatttcggagattgaacaagagcagctgatcgagaagcttgagatcttcaagatccatggcagagacaaacgtggccgtaagatccttcgtattatcggaaaattcttcccagctcgatttctgtcactggatgtgttgaagaagtatctagaggagaagatatttcctcgattaggtagaaaaccattcgccgtactctacgtccacaccggcgtacagagaagcgagaacttcccaggtatctcagctctacgagcgatctacgacgcaattccggtaaacgtcagagacaatcttcaggaggtttacttcctccatccaggtcttcaatcacgtctcttcctcgccacctgcggccgatttctattttccggcgggttgtacgggaagctgaggtacataagcagagttgattatctgtgggaacatgtgaggaggaatgagatagagatgccggagtttgtatacgatcacgatgatgatctggagtatcgtccgatgatggattacggtcaagaaagcgatcacgcgagggttttcgccggagccgccgtggattcatcagtctcaagtttctccatgaggtgtatctcatag

SEQ ID NO: 684 - protein, 202 aa, Arabidopsis thaliana
MSSQISEIEQEQLIEKLEIFKIHGRDKRGRKILRIIGKFFPARFLSLDVLKKYLEEKIFPRLGRKPFAVLYVHTGVQRSENFPGISALRAIYDAIPVNVRDNLQEVYFLHPGLQSRLFLATCGRFLFSGGLYGKLRYISRVDYLWEHVRRNEIEMPEFVYDHDDDLEYRPMMDYGQESDHARVFAGAAVDSSVSSFSMRCIS

SEQ ID NO: 685 - DNA, 1437 bp, Arabidopsis thaliana
atggcaatctcagaggcatcgaaatcgagccacgagctcccagtaacaacagccgaatccagcgggaagaaagcaaccgcaaagaaactgactttaatccctttggttttccttatttactttgaggtcgctggtggtccatttggtgaagaaccggcggttcaagcggctggaccgcttttagcgattctcggtttccttatcttccctttcatttggagtatccctgaagccctaatcactgcagagctctccactgcgtttccaggcaacggagggtttgtgatatgggcgcatcgagcatttggctctttcgtgggctcaatgatgggttcgttgaagttccttagtggggtgattaacgttgcttcgtttcctgttctctgtgtcacttacttggataagctcttccctgttcttgaatccggatggcctcgaaatgtctgcatattcgcctcgacggtggtcttgtctttcttaaactatactggcttagccattgtaggttacgcagctgttgtgctcggtctggtgtctctctcgcctttccttgtcatgtcggctatggctatccctaagatcaaacctcaccgttggggtagtttaggaaccaagaaaaaggattggaatctctacttcaacacactcttctggaacttgaatttctgggacaatgtcagtactcttgcaggggaagtggacgagcctcaaaagacgttccctttggcgcttcttatcgctgtgatcttcacttgtgtagcttacttgattcctcttttcgctgtcacgggtgcggtctcggtagatcagagcagatgggaaaacgggtttcacgcagaagcagctgagatgattgcagggaaatggttgaaaatatggattgagattggtgctgtcttatcgagcattggacttttcgaagctcagttaagcagtagtgcttatcagctggaggggatggcggaattagggttcttgcctaaattctttggggtacggtcgaaatggttcaacactccttgggtcgggattctaatctcagctctcatgtcgctcgggttatcgtacatgaacttcacagacatcatatcctcggcgaatttcttgtacactctagggatgtttctagagtttgcatctttcatttggttaagaagaaaactacctcagctaaagagaccttaccgagttccgctgaaaataccggggctggtggttatgtgcttgataccttcggcgtttctagtgctgattttagtgtttgctactaagattgtgtaccttatttgcggtgtaatgaccataggagcaatcggttggtacttcttgatcaactacttcagaaagacgaagatcttcgaattcaacgaagttatcgatgatcttgacaacaatgtcaacggagaacatcccaaagtcgatgatcacaattcatga

SEQ ID NO: 686 - protein, 478 aa, Arabidopsis thaliana
MAISEASKSSHELPVTTAESSGKKATAKKLTLIPLVFLIYFEVAGGPFGEEPAVQAAGPLLAILGFLIFPFIWSIPEALITAELSTAFPGNGGFVIWAHRAFGSFVGSMMGSLKFLSGVINVASFPVLCVTYLDKLFPVLESGWPRNVCIFASTVVLSFLNYTGLAIVGYAAVVLGLVSLSPFLVMSAMAIPKIKPHRWGSLGTKKKDWNLYFNTLFWNLNFWDNVSTLAGEVDEPQKTFPLALLIAVIFTCVAYLIPLFAVTGAVSVDQSRWENGFHAEAAEMIAGKWLKIWIEIGAVLSSIGLFEAQLSSSAYQLEGMAELGFLPKFFGVRSKWFNTPWVGILISALMSLGLSYMNFTDIISSANFLYTLGMFLEFASFIWLRRKLPQLKRPYRVPLKIPGLVVMCLIPSAFLVLILVFATKIVYLICGVMTIGAIGWYFLINYFRKTKIFEFNEVIDDLDNNVNGEHPKVDDHNS

SEQ ID NO: 687 - DNA, 1857 bp, Arabidopsis thaliana
atggctgctaccgctgctgcttctgttgtccgttacgcacctgaggatcatactcttcccaagccctggaaaggccttatcgatgatagaactggttacttgtacttttggaatcctgagaccaatgttactcagtacgagaaaccaaccccctctctacctcctaagttttctcccgccgtttctgttagctcttccgttcaggttcaacaaactgatgcctatgctcctcccaaggatgacgataagtactccagaggctctgaacgtgtgtccaggttttctgagggtggcaggagtggaccgccttattcgaacggtgctgctaatggagttggggattctgcttatggtgcagcatctaccagagttcctcttccttcatcagctccagcaagtgaactatcccctgaggcctattcccgccgtcatgaaattactgtcagtgggggccaagtaccaccacctctaatgtcctttgaagctactggttttccacctgagcttctgcgggaggtactcagtgcaggtttctctgctccaactccaattcaagctcagtcatggcccattgctatgcaaggtagggacatagtagccattgctaaaactggctcgggaaaaactttgggttacttgattcctggatttttgcatcttcaacgtatccgaaatgattcgcgaatgggcccaacaatcttggtattgtctccaacgagagagctggccacacaaatccaagaagaagctgttaaatttgggaggtcatcaagaatttcgtgtacgtgtttgtatggtggtgcaccaaagggccctcagttgagggatttagaaagaggagcagatatcgtggttgcaactcctgggagattgaatgatatccttgaaatgaggaggattagtctgcgtcagatatcttatcttgtgctagatgaggcagatagaatgttggacatgggttttgaacctcagataaggaagattgtgaaagaaattcccactaagcgtcaaacccttatgtacacagctacatggccaaagggagttaggaaaattgcagctgacttgcttgttaaccctgctcaagtcaacattggcaatgttgacgagcttgtggctaacaagtcaatcacacagcatattgaagtggtagcaccaatggagaaacagaggaggttagagcagatcttgcggtctcaggaaccaggctcaaaggtgataatattctgctcaaccaaaaggatgtgtgatcaactaacacgcaatctaacccgccaatttggagctgctgctatacatggagacaagtcccagcctgagagagacaatgttcttaatcaattccgcagtggcagaactccggttcttgtagcaaccgatgttgctgctcgtggtctggacgttaaggacatcagggcggtcgtaaactatgatttccccaatggagtggaagactatgttcatagaatcggaagaacaggaagagctggagcgactggtcaggcattcacattctttggtgatcaagattcgaaacatgcttcggatctgatcaagattttggaaggagcaaaccagcgagttcctcctcagatccgcgaaatggctacacgtggtggtgggggaatgaacaaattcagtcgttggggacctccttccggcggccgtggtcgtggtggcgactctggttatggtggcagaggtagctttgcttcccgtgacagaagcagcaatggatggggaagagagcgagaaaggagccgtagccctgagagattcaacagagctccaccaccgtcttccaccggatctcctcctcgcagcttccacgagacgatgatgatgaaacacagatga

SEQ ID NO: 688 - protein, 618 aa, Arabidopsis thaliana
MAATAAASVVRYAPEDHTLPKPWKGLIDDRTGYLYFWNPETNVTQYEKPTPSLPPKFSPAVSVSSSVQVQQTDAYAPPKDDDKYSRGSERVSRFSEGGRSGPPYSNGAANGVGDSAYGAASTRVPLPSSAPASELSPEAYSRRHEITVSGGQVPPPLMSFEATGFPPELLREVLSAGFSAPTPIQAQSWPIAMQGRDIVAIAKTGSGKTLGYLIPGFLHLQRIRNDSRMGPTILVLSPTRELATQIQEEAVKFGRSSRISCTCLYGGAPKGPQLRDLERGADIVVATPGRLNDILEMRRISLRQISYLVLDEADRMLDMGFEPQIRKIVKEIPTKRQTLMYTATWPKGVRKIAADLLVNPAQVNIGNVDELVANKSITQHIEVVAPMEKQRRLEQILRSQEPGSKVIIFCSTKRMCDQLTRNLTRQFGAAAIHGDKSQPERDNVLNQFRSGRTPVLVATDVAARGLDVKDIRAVVNYDFPNGVEDYVHRIGRTGRAGATGQAFTFFGDQDSKHASDLIKILEGANQRVPPQIREMATRGGGGMNKFSRWGPPSGGRGRGGDSGYGGRGSFASRDRSSNGWGRERERSRSPERFNRAPPPSSTGSPPRSFHETMMMKHR

SEQ ID NO: 689 - DNA, 960 bp, Arabidopsis thaliana
atggccgccgccgtcgcagcaccgagactcatctccttgaaagccgtcgcgaagctaggtttccgtgagatctctcaaatccgacaattggctccgcttcactctgcgatacctcatttcggaatgctgcgatgtagatcgcggcagccgttttctacctctgttgtgaaagctcaagctactgctactgagcaatcaccaggggaagttgttcaaaaagtggaatctccagtggtcgttatcactggtgcctcgagagggattggtaaagcaattgctctagccttgggtaaagctggctgcaaggtcttggtgaattatgctaggtcagcaaaagaggctgaagaagttgctaaacagattgaagaatatggtggccaggctatcacttttgggggtgatgtctcgaaagcgactgatgtggatgcgatgatgaaaaccgctcttgacaaatggggaaccattgatgttgtggttaacaatgcaggaattactcgggataccttgttaatacgaatgaagcaatcacaatgggacgaagtgattgctttgaatctcactggtgtatttctctgtactcaggcagcagtaaagatcatgatgaagaaaaaaaggggaagaatcatcaatatctcgtcagttgttggtctcattggtaatattggtcaagcaaactacgcagcggctaaaggtggagttatttcgttttccaagactgctgccagagaaggtgcgagcaggaatataaatgtcaatgtggtttgccccggattcattgcatctgacatgactgcagagcttggagaagacatggaaaagaaaatcctgggaacaatcccattaggacggtatggaaaagctgaagaagtggctggcttggtagaattcttggctctcagtcctgcagccagttacataaccggacaggcattcaccattgatggaggtattgctatctag

SEQ ID NO: 690 - protein, 319 aa, Arabidopsis thaliana
MAAAVAAPRLISLKAVAKLGFREISQIRQLAPLHSAIPHFGMLRCRSRQPFSTSVVKAQATATEQSPGEVVQKVESPVVVITGASRGIGKAIALALGKAGCKVLVNYARSAKEAEEVAKQIEEYGGQAITFGGDVSKATDVDAMMKTALDKWGTIDVVVNNAGITRDTLLIRMKQSQWDEVIALNLTGVFLCTQAAVKIMMKKKRGRIINISSVVGLIGNIGQANYAAAKGGVISFSKTAAREGASRNINVNVVCPGFIASDMTAELGEDMEKKILGTIPLGRYGKAEEVAGLVEFLALSPAASYITGQAFTIDGGIAI

SEQ ID NO: 691 - DNA, 2919 bp, Arabidopsis thaliana
atggagtggaatcgggagactctagtgttcctttcgcaatgttttcttaacacgctctctccgataccggagcctcgtcgaacggctgagagagcactctcggatgctgctgatcaggctaactacggcctagccgttctccgtttggtggctgagccagcaatcgatgaacagacgcgtcacgccgctgctgtcaactttaagaaccatctccgttcgcgatggcatcctgctggtgattctggtatctcaccgatcgtagattctgagaaggagcagatcaagacactcatcgtctctcttatgctctctgcttctcctcgtatccagagccagttgagtgaagccctaaccgtcattggtaagcacgatttccccaaagcttggcctgctttgcttcctgagcttatcgccaaccttcaaaacgctgctctcgctggcgattatgtgtccgtcaatggtattcttgggaccgctagttcgattttcaaaaagtttagttatgagtatagaaccgatgctctgtttgttgatttgaagtattgcctggataattttgctgctcctttgactgaaatattcctgaaaacgtcttcgttgattgattctgctgcgagctctggtggttcacctccgatcctgaagcctctcttcgagtcccaaaggctgtgctgtacaatattttactctttgaactttcaggacttaccggagtttttcgaggatcatatgaaggagtggatgggagagtttaagaagtatctatcttcaaattatcccgccttggaaagcacagaggaggggttaacacttgttgatgatcttcgcgctgctatttgcgagaatatcaatcattatattgagaaaaacgaagaagagtttcaaggctttttgaatgagtttgcatcagttgtctggacattgctccgggatgtgtcaaagtctcctagcagagatcaactagctactacagcaatcaagttcttgacctctgtgagcacaagtgttcaccatgctttgtttgcgggggacaatgttatcaaggaaatttgccaaagtattgtgattcctaatgtttctttgagggtggaagatgaagaaattttcgagatgaactatattgagtttatccgtagagatatggaaggaagtgatgtggacactagaaggagaatagcttgtgagctactcaaaggccttgccacaaactacaaaacacaagtgacagaagtagtttctcttgagatacagaggctcttgagttcattttcagcaaacccgtcggcaaactggaaagataaggattgtgcaatttacttggttgtctctctatctactaagaaggcagggggtgcatctgtgtctacagatctcattgatgttcaaaacttctttgcaaacattattctcccggagctgcaaagccgcgatgtcaacagctttccaatgctaaaggcagggtccttgaagttcttaactatgtttcgtagtcatataccaaagccctttgcaatgcagttgttcccagagttggtccgtttccttaaagcagagtcgaacgtggtccactcttatgctgctagctgcatagagaagctcttgctagtgaaggaggaaggcgcaaggggtaataggtatgctgctggtgatttaagtccctttttgctgcagttgatgacaaacctgtttgatgcgctgaaattcccagaatcagaggagaatcaatatctgatgaagtgtataatgcgggtccttggtgttgctgatatcagtgctgaggttgctggaccttgcatcgggggattgacctctattctcagtgaagtttgcaaaaatcctaaaaatcctatatttaaccactatctctttgagtctgtggctgtacttgttcgacgggcatgtgaacgtgatatttctcttatatctgcatttgaaacgagtcttttcccaagcctccagatgattttggcgaatgatatcacagagttcttgccttatgggtttcagttgctggctcagcttgttgagttaaatagaccaactctctcaccaaactacatgcagatcttcttgctgctcctctcgcctgagtcatggaagagaagtggcaatgttccagctcttgtgcgcctgcttcaagcttttctgcagaaagcacctcatgaggttactcaagagaatcggttgagtcaagttctggggatatttgaaaagctggttgcatctcctagcacggatgagcaaggcttttatatccttaacacgattattgagaatctggactacagtgtgattgcaccttacatgaaaggtgtatggagtgctctattcacacgcgttcaaaacaaaaagacagtcaagttccagaagtcgctagtaatattcatgtcgcttttcttggtgaagcatggacaggcttatctagtggagactatgaatactgttcagccaaacatcatcactgctatcgtggagcatttctggattccgaacctgaaactgatcatggggagtatggaggtcaagttaacggcagttgctgcaactagactcatatgtgagactccggctctcctggatccatcagctgctaaactctgggggaagatgcttgatagcatagtgacgcttgtttccaggcctgagcaagaaagggtacttgatgaacctgaaatgccagaaatctcagagaatgttggatacacagctgcatttgtgaaactccacaatgctgggaaaaaagaagaggatcctctgaaagacatcaaggacccaaaacagttcttggtcgcttctgtttcgaggctttcttctgcttctcctggtaggtacccacagataattggtgagaatcttgaacaagcaaaccaaacagctttgatccagctctgcaatgcttacaactgtggaattgcttga

SEQ ID NO: 692 - protein, 972 aa, Arabidopsis thaliana
MEWNRETLVFLSQCFLNTLSPIPEPRRTAERALSDAADQANYGLAVLRLVAEPAIDEQTRHAAAVNFKNHLRSRWHPAGDSGISPIVDSEKEQIKTLIVSLMLSASPRIQSQLSEALTVIGKHDFPKAWPALLPELIANLQNAALAGDYVSVNGILGTASSIFKKFSYEYRTDALFVDLKYCLDNFAAPLTEIFLKTSSLIDSAASSGGSPPILKPLFESQRLCCTIFYSLNFQDLPEFFEDHMKEWMGEFKKYLSSNYPALESTEEGLTLVDDLRAAICENINHYIEKNEEEFQGFLNEFASVVWTLLRDVSKSPSRDQLATTAIKFLTSVSTSVHHALFAGDNVIKEICQSIVIPNVSLRVEDEEIFEMNYIEFIRRDMEGSDVDTRRRIACELLKGLATNYKTQVTEVVSLEIQRLLSSFSANPSANWKDKDCAIYLVVSLSTKKAGGASVSTDLIDVQNFFANIILPELQSRDVNSFPMLKAGSLKFLTMFRSHIPKPFAMQLFPELVRFLKAESNVVHSYAASCIEKLLLVKEEGARGNRYAAGDLSPFLLQLMTNLFDALKFPESEENQYLMKCIMRVLGVADISAEVAGPCIGGLTSILSEVCKNPKNPIFNHYLFESVAVLVRRACERDISLISAFETSLFPSLQMILANDITEFLPYGFQLLAQLVELNRPTLSPNYMQIFLLLLSPESWKRSGNVPALVRLLQAFLQKAPHEVTQENRLSQVLGIFEKLVASPSTDEQGFYILNTIIENLDYSVIAPYMKGVWSALFTRVQNKKTVKFQKSLVIFMSLFLVKHGQAYLVETMNTVQPNIITAIVEHFWIPNLKLIMGSMEVKLTAVAATRLICETPALLDPSAAKLWGKMLDSIVTLVSRPEQERVLDEPEMPEISENVGYTAAFVKLHNAGKKEEDPLKDIKDPKQFLVASVSRLSSASPGRYPQIIGENLEQANQTALIQLCNAYNCGIA

SEQ ID NO: 693 - DNA, 1161 bp, Arabidopsis thaliana
atgtcggtgtacgacgctgctttccttaatacagagctttcgaaaccgacatcgatttttggtctccggctatgggtcgtgatcggaatcttacttggatctctaattgtcatcgcactctttcttctctccctctgcttaacttctcgccggaaaaatcgaaagccgagagccgatttcgcctccgccgccatcgctacaccgccgatttcaaaggagattaaagagatcgttccggcgcagaatcagtctgttccggcggagatccaggtcgatatcgggaagatcgagcatcgagtggtgttttcagatcgagtgtcgagtggtgagagtagaggaacagcgagtgcaagtgaaacggcgtcgtattccggtagcgggaattgtgggccggaggtgtcgcatcttggatggggccgatggtatactctgagagagcttgaagcggccacgaatgggctttgtgaagagaatgtaatcggagaaggtggttacgggattgtgtatcgtggcattttaactgatggaaccaaagtcgccgtcaagaacttgcttaacaataggggtcaagcagagaaggaattcaaagtagaagtggaagtcattgggcgagtacgacacaagaatcttgttaggcttttagggtattgcgtggaaggtgcatacaggatgctcgtgtatgactttgtcgacaatggtaatttggagcaatggattcacggtgatgttggcgatgtcagcccgctaacttgggatatacgtatgaatattatactggggatggccaaaggattggcgtatctacacgagggtcttgagccaaaagttgttcatcgggatattaaatcaagcaatatcttacttgatcgccaatggaatgctaaggtttcggattttggacttgctaagctcttggggtctgagagcagttatgtgactactcgtgtgatgggaactttcggttatgtagcaccagaatacgcttgcaccggaatgttaaacgagaagagtgatatctatagcttcggaatactaatcatggagataatcactggaagaaacccggttgattatagtcggcctcaaggagaggtatttgataagcatattcaatcctctctatgtttttgtaaatggtcttactatgtgtcgtggctgtag

SEQ ID NO: 694 - protein, 386 aa, Arabidopsis thaliana
MSVYDAAFLNTELSKPTSIFGLRLWVVIGILLGSLIVIALFLLSLCLTSRRKNRKPRADFASAAIATPPISKEIKEIVPAQNQSVPAEIQVDIGKIEHRVVFSDRVSSGESRGTASASETASYSGSGNCGPEVSHLGWGRWYTLRELEAATNGLCEENVIGEGGYGIVYRGILTDGTKVAVKNLLNNRGQAEKEFKVEVEVIGRVRHKNLVRLLGYCVEGAYRMLVYDFVDNGNLEQWIHGDVGDVSPLTWDIRMNIILGMAKGLAYLHEGLEPKVVHRDIKSSNILLDRQWNAKVSDFGLAKLLGSESSYVTTRVMGTFGYVAPEYACTGMLNEKSDIYSFGILIMEIITGRNPVDYSRPQGEVFDKHIQSSLCFCKWSYYVSWL

SEQ ID NO: 695 - DNA, 2577 bp, Arabidopsis thaliana
atggtttacacgatttcaggcgtacgttttcctcatcttccatcgattaagaagaagaattcgtctcttcacagtttcaatgaagatctcaggagaagcaacgctgtctcattctctctgaggaaggactctcgttcttctgggaaggtttttgctcggaagccatcgtatgattctgattcgtcttccttagctaccactgcatctgagaagctccgtggccatcagagtgatagctcttcatctgcctctgatcaagtacaatctcgggatactgtctctgacgatactcaggtgctcggcaatgtagacgttcagaaaactgaagaagcccaggaaacagagacactagatcaaacttctgcactctcaacatctggaagcataagttataaagaagattttgcaaagatgtcacactctgtcgaccaagaagttgggcagaggaagattccacctcctggagatgggaagagaatatatgacattgatcctatgttgaacagtcatcgtaatcatcttgattaccgatatgggcagtacagaaaactgcgtgaagaaattgacaagaatgaaggtggtttggaggcattttctcgtggttatgaaatatttggcttcactcgaagcgccactggtatcacttaccgggaatgggcaccgggagctaaggcagcatcactgatcggagattttaataactggaatgcgaaatctgatgttatggctcggaacgactttggtgtgtgggaaatatttctgccaaataatgctgatggctcaccagcaattccccatggctcccgtgtgaagatccgcatggataccccatctggtattaaagactccattccagcttggatcaagtattctgtccagccacctggcgagatcccatataatggagtatattatgaccctcctgaggaggataaatatgcgttcaaacatcctcgtccaaagaaacccacatcgctgcgtatatatgaatcacatgttggaatgagtagtacggaaccaaagataaatacatatgccaactttagagatgatgtacttccccgtataaaaaagctaggctataatgctgtgcagataatggccattcaagagcatgcctactatgccagctttgggtatcatgtgacaaattttttcgcacctagcagccgctttggaacacctgatgaccttaaatctttgatagacaaagctcatgagctaggtctggttgttctgatggatattgtgcacagccatgcatcaaaaaacacactggatggcctggacatgtttgatggtactgatggtcaatatttccactctggatcgcgtggttatcattggatgtgggattctcgtcttttcaattacggaagctgggaagtgcttaggtatcttctttccaacgcgagatggtggctggaagaatacaagtttgatgggttcagatttgatggtgtgacttccatgatgtacactcatcatggactgcaggtcgaatttactgggaattacaatgagtactttggatattctactgatgttgacgctgtggtctatctaatgctggtgaacgatttgattcatgggctataccctgaggctattgttgtcggcgaagatgttagcgggatgccagctttttgcgttcctgtcgaagacggtggtgtgggttttgactaccgtctacacatggcagtggcagataaatggattgagcttcttaagaagagagacgaggactggcaggttggtgatataactttcacgcttaccaacaggaggtggggagaaaaatgtgtcgtctatgcagagagtcatgatcaagcccttgttggagacaaaacgatagctttctggctaatggataaggacatgtatgatttcatggccgttgatagacaggccactccgcgtgtagaccgtgggattgctttacacaaaatgatccgtctcattacgatgggattgggtggagaaggatacctcaatttcatgggaaacgaatttggacacccagaatggatcgacttcccaaggaccgaccagcaccttcctgatggcagagtcatcgctgggaataatggtagttatgataaatgccgacgtaggtttgatctgggagatgcagaatatcttagataccatggactacaagagtttgatcgagcaatgcaaaatctagaggagacgtatggtttcatgacttcagagcaccagtacatatcccgcaaggatgaaggagacagagtcattgtattcgagagaggtaacttgctcttcgtcttcaacttccactggaccaacagttactctgactaccgtatcggttgctctgttcccggaaagtacaaaatcgttttggactctgataactctttatttggaggcttcaaccggctagatgactccgcggagtttttcacctctgatggaaggcacgacgataggccttgctccttcatggtgtatgcaccgtgcagaaccgctgtagtttacgctgcagtagatgatgatgatgatgatgaacgttcttctcttgtccccataggcctgttacccgaagatgtttag

SEQ ID NO: 696 - protein, 858 aa, Arabidopsis thaliana
MVYTISGVRFPHLPSIKKKNSSLHSFNEDLRRSNAVSFSLRKDSRSSGKVFARKPSYDSDSSSLATTASEKLRGHQSDSSSSASDQVQSRDTVSDDTQVLGNVDVQKTEEAQETETLDQTSALSTSGSISYKEDFAKMSHSVDQEVGQRKIPPPGDGKRIYDIDPMLNSHRNHLDYRYGQYRKLREEIDKNEGGLEAFSRGYEIFGFTRSATGITYREWAPGAKAASLIGDFNNWNAKSDVMARNDFGVWEIFLPNNADGSPAIPHGSRVKIRMDTPSGIKDSIPAWIKYSVQPPGEIPYNGVYYDPPEEDKYAFKHPRPKKPTSLRIYESHVGMSSTEPKINTYANFRDDVLPRIKKLGYNAVQIMAIQEHAYYASFGYHVTNFFAPSSRFGTPDDLKSLIDKAHELGLVVLMDIVHSHASKNTLDGLDMFDGTDGQYFHSGSRGYHWMWDSRLFNYGSWEVLRYLLSNARWWLEEYKFDGFRFDGVTSMMYTHHGLQVEFTGNYNEYFGYSTDVDAVVYLMLVNDLIHGLYPEAIVVGEDVSGMPAFCVPVEDGGVGFDYRLHMAVADKWIELLKKRDEDWQVGDITFTLTNRRWGEKCVVYAESHDQALVGDKTIAFWLMDKDMYDFMAVDRQATPRVDRGIALHKMIRLITMGLGGEGYLNFMGNEFGHPEWIDFPRTDQHLPDGRVIAGNNGSYDKCRRRFDLGDAEYLRYHGLQEFDRAMQNLEETYGFMTSEHQYISRKDEGDRVIVFERGNLLFVFNFHWTNSYSDYRIGCSVPGKYKIVLDSDNSLFGGFNRLDDSAEFFTSDGRHDDRPCSFMVYAPCRTAVVYAAVDDDDDDERSSLVPIGLLPEDV

SEQ ID NO: 697 - DNA, 597 bp, Arabidopsis thaliana
atggtgcacgtttgctactaccgcaactatggaaagaccttcaagggaccacgtcgtccttacgagaaggagcgtcttgattctgaattgaagctggttggtgagtatggtctgcgtaacaagcgtgagctctggagagtgcagtactctcttagccgtatccgtaatgctgctagagatcttttgactcttgatgagaagagtccaagaaggatctttgaaggtgaggctttgctccgtaggatgaaccgttacgggcttcttgatgagagccagaacaagctcgattacgtcttggctttgactgttgagaactttcttgagcgtcgtcttcagactattgtgttcaagtctggtatggctaagtctatccatcactctcgtgtcctcatcaggcagaggcatatcagggttggaaagcaattggtgaacattccatcattcatggtgagacttgattcacagaagcacattgactttgccctcaccagtcccttcggtggtggccgtccaggaagagtgaagagaaggaacgagaagtctgcctccaagaaagcctcaggtggcggtgatgcagacggtgatgacgaagagtaa

SEQ ID NO: 698 - protein, 198 aa, Arabidopsis thaliana
MVHVCYYRNYGKTFKGPRRPYEKERLDSELKLVGEYGLRNKRELWRVQYSLSRIRNAARDLLTLDEKSPRRIFEGEALLRRMNRYGLLDESQNKLDYVLALTVENFLERRLQTIVFKSGMAKSIHHSRVLIRQRHIRVGKQLVNIPSFMVRLDSQKHIDFALTSPFGGGRPGRVKRRNEKSASKKASGGGDADGDDEE

SEQ ID NO: 699 - DNA, 879 bp, Arabidopsis thaliana
atgtactcggcgattcggtcttcgcttcctctagatggcagcttgggagactactctgacggaaccaatcttcccatcgacgcttgtctggtcctaaccactgaccccaagcctcgccttcgttggacctctgagctccatgaaagattcgttgacgccgtcactcagctcggcggacccgacaaagcaacgcctaaaactataatgagaacaatgggagtgaagggtctcactctttaccatctcaaatctcatcttcagaaattccgcttggggaggcaatcttgtaaagaatcaattgacaactctaaggatgtttcttgtgttgcggagagtcaggacactggttcatcttcaacatcatccttaagattggctgctcaagaacagaacgagagttaccaggtcactgaagctttgcgtgcccagatggaagtccaaagaagactacacgagcaactagaggtgcaaaggcgactccagttaaggatcgaggcacaagggaagtacctgcaatcaattctagagaaagcttgcaaggctatagaggagcaagctgttgcatttgctgggttagaggcagctagagaagagctttcagagctagccataaaggcctccatcaccaatgggtgccaaggaacaacaagcaccttcgacacaaccaaaatgatgattccatccttatccgagcttgcagtagcaatagagcacaagaacaactgttcagcagagagctctctgacttccagcactgtaggaagtccggtatcagctgcgttgatgaagaagagacaacgaggagtgtttggaaatggagatagtgtggttgttggtcatgatgctggatgggttatgcctagtagtagcattggatga

SEQ ID NO: 700 - protein, 292 aa, Arabidopsis thaliana
MYSAIRSSLPLDGSLGDYSDGTNLPIDACLVLTTDPKPRLRWTSELHERFVDAVTQLGGPDKATPKTIMRTMGVKGLTLYHLKSHLQKFRLGRQSCKESIDNSKDVSCVAESQDTGSSSTSSLRLAAQEQNESYQVTEALRAQMEVQRRLHEQLEVQRRLQLRIEAQGKYLQSILEKACKAIEEQAVAFAGLEAAREELSELAIKASITNGCQGTTSTFDTTKMMIPSLSELAVAIEHKNNCSAESSLTSSTVGSPVSAALMKKRQRGVFGNGDSVVVGHDAGWVMPSSSIG

SEQ ID NO: 701 - DNA, 798 bp, Arabidopsis thaliana
atgggaagctttctcttcctcatcgtagtcatcttcctcttctcttcatccgttaacgcttgtgatcgatgtcttcaccgttctaaagcagcttatttctcctctgcctctgctctctcttctggagcttgtgcttatggctctatggctacgagtttcttcgccggacatatcgctgcagctatcccttctatctacaaagacggtgctggctgtggagcttgctttcaagtcagatgcaagaaccctaagctgtgtagcactaaaggaaccattgtgatgatcacagacttaaacaagagtaaccaaaccgatcttgtccttagtagcagagcttttagagctatggctaaacctattgttggtgctgacaaagaccttctcaaacaaggcattgtcgacatcgaataccaaagagttccttgcgattacggcaacaagaacatgaacgtgagagtagaagaagcaagcaagaaaccaaactacttagagataaagcttttataccaaggaggtcaaacagaagtagtatccatcgacattgctcaagtcggttcatcgccaaattggggttacatgacaagaagccacggagctgtttgggtaactgacaaagtacccaccggagctatccagttcaggttcgtagtaaccggtggatacgacggtaaaatgatttggtcacagagtgttcttccatccaattgggaagctgggaaaatttacgacgccggtgttcaaatcactgacattgctcaagaaggttgtgatccttgcgatgctcacatctggaactaa

SEQ ID NO: 702 - protein, 265 aa, Arabidopsis thaliana
MGSFLFLIVVIFLFSSSVNACDRCLHRSKAAYFSSASALSSGACAYGSMATSFFAGHIAAAIPSIYKDGAGCGACFQVRCKNPKLCSTKGTIVMITDLNKSNQTDLVLSSRAFRAMAKPIVGADKDLLKQGIVDIEYQRVPCDYGNKNMNVRVEEASKKPNYLEIKLLYQGGQTEVVSIDIAQVGSSPNWGYMTRSHGAVWVTDKVPTGAIQFRFVVTGGYDGKMIWSQSVLPSNWEAGKIYDAGVQITDIAQEGCDPCDAHIWN

SEQ ID NO: 703 - DNA, 1296 bp, Arabidopsis thaliana
atgggactttcattgagagtgagacgtcgtggaggaagtgttagcaagaaagagatcattccggtgacaagttgctcggaggaagtggagataaccataccatcgcagtttcaatgtccgatatcttacgagctaatgaaggatccggtgattattgcctcggggatcacttacgatcgcgaaaacatcgagaagtggttcgagtccgggtaccaaacttgtcccgttacaaacacggttttgacaagtttggaacagattccgaaccatacgattcggaggatgattcaaggttggtgcgggtcgtcactaggcggcgggattgaacgaatcccgacgcctcgtgtacccgtgaccagtcatcaagtctccgagatttgtgagaggttatccgctgctacgcggcgtggagactacgccgcgtgcatggagatggttacgaagatgacgagactaggaaaagagagcgagaggaatcgaaaatgcgttaaggaaaacggcgcgggattggttctttgcgtttgcttcgacgcgttttccgaaaacgcaaatgcgtcattattattggaggagactgtgtctgtgctgacgtggatgcttcccattggtttagaaggtcaatccaaactcaccacgacgtcgtcgtttaatcgtttagtggaactgttgagaaatggtgatcaaaacgctgcgtttttgataaaagagcttcttgagcttaacgtaactcacgttcacgcgttaacaaagatcaatggcgtccaagaagcgttcatgaaatcgattaatcgcgattctacatgcgtcaactcgttaatatcaatccaccatatgatcttgacaaatcaagaaaccgtatcaaggtttcttgaattggatcttgtgaatataacagtggagatgctagtggattcagaaaacagcgtttgcgagaaagcgttaacggtattaaacgtgatttgtgaaactaaagaaggaagagagaaagtgagaagaaacaagctggtgataccgattttggtgaagaagattttgaagatttctgagaagaaagatttggtttctgtgatgtggaaggtttgtaaaagtggtgatgggtctgaagttgaagaagcgttgagattaggtgcgtttaagaagcttgttgtcatgttacaagttggatgtggtgaaggaactaaggagaaagttacagagttgttgaagatgatgaataaagttatgaagatgaatggttttgttgatcgttcttattcttcttcaattgagtttaaacatgttaagaaaccattttaa

SEQ ID NO: 704 - protein, 431 aa, Arabidopsis thaliana
MGLSLRVRRRGGSVSKKEIIPVTSCSEEVEITIPSQFQCPISYELMKDPVIIASGITYDRENIEKWFESGYQTCPVTNTVLTSLEQIPNHTIRRMIQGWCGSSLGGGIERIPTPRVPVTSHQVSEICERLSAATRRGDYAACMEMVTKMTRLGKESERNRKCVKENGAGLVLCVCFDAFSENANASLLLEETVSVLTWMLPIGLEGQSKLTTTSSFNRLVELLRNGDQNAAFLIKELLELNVTHVHALTKINGVQEAFMKSINRDSTCVNSLISIHHMILTNQETVSRFLELDLVNITVEMLVDSENSVCEKALTVLNVICETKEGREKVRRNKLVIPILVKKILKISEKKDLVSVMWKVCKSGDGSEVEEALRLGAFKKLVVMLQVGCGEGTKEKVTELLKMMNKVMKMNGFVDRSYSSSIEFKHVKKPF

SEQ ID NO: 705 - DNA, 747 bp, Arabidopsis thaliana
atgtgtggcggtgctattatttccgattatgcccctctcgtcaccaaggccaagggccgtaaactcacggctgaggaactctggtcagagctcgatgcttccgccgccgacgacttctggggtttctattccacctccaaactccatcccaccaaccaagttaacgtgaaagaggaggcagtgaagaaggagcaggcaacagagccggggaaacggaggaagaggaagaatgtttatagagggatacgtaagcgtccatggggaaaatgggcggctgagattcgagatccacgaaaaggtgttagagtttggcttggtacgttcaacacggcggaggaagctgccatggcttatgatgttgcggccaagcagatccgtggtgataaagccaagctcaacttcccagatctgcaccatcctcctcctcctaattatactcctccgccgtcatcgccacgatcaaccgatcagcctccggcgaagaaggtctgcgttgtctctcagagtgagagcgagttaagtcagccgagtttcccggtggagtgtataggatttggaaatggggacgagtttcagaacctgagttacggatttgagccggattatgatctgaaacagcagatatcgagcttggaatcgttccttgagctggacggtaacacggcggagcaaccgagtcagcttgatgagtccgtttccgaggtggatatgtggatgcttgatgatgtcattgcgtcgtatgagtaa

SEQ ID NO: 706 - protein, 248 aa, Arabidopsis thaliana
MCGGAIISDYAPLVTKAKGRKLTAEELWSELDASAADDFWGFYSTSKLHPTNQVNVKEEAVKKEQATEPGKRRKRKNVYRGIRKRPWGKWAAEIRDPRKGVRVWLGTFNTAEEAAMAYDVAAKQIRGDKAKLNFPDLHHPPPPNYTPPPSSPRSTDQPPAKKVCVVSQSESELSQPSFPVECIGFGNGDEFQNLSYGFEPDYDLKQQISSLESFLELDGNTAEQPSQLDESVSEVDMWMLDDVIASYE

SEQ ID NO: 707 - DNA, 4509 bp, Arabidopsis thaliana
atggagaacagaggccagaaacgaatggaggttgtggaagagttacctgctgataagagagcttgtaactctcaggattttagaccaagcacatccggatcatctgttcaagctcaagctaatgatacgaatccaggacatgaaaacgttgacgctgatatggatacttcttcatctgcttcgccttcgagtcgatcagatgaagaagaacaggaagagcaggataaggaggattcggactatggatcttgcgattctgatgaggaagatccgaggcagagggtgcttcaggattaccagaggcagagatcatctggtgatcatgggaaattgaagtctcttttgttgaatttgactggagaaactgatccttctggacagttatccaggctcactgagttatgtgaagtgttgtcattttctactgaagaatcgctgtccagtgttatggccaacatgctatcaccggtgcttgtaaagttagctaagcatgagaacaatgcagatattatgctcctcgcaattagagctattacttatttgtgtgatgtttatccgccgtcagtagaattccttgtaagacatgataccattcctgctctctgccaaagacttttgactattgagtacttggacgttgctgagcagtgtttgcaagcacttgagaaaatatcccgagatgagccggtagcctgcttgaatgctggagcaattatggcagtgctttcgtttattgatttcttctcaacaagcatacagagagtcgcaatttctactgtggtcaatatatgtaagcagctttcttctgagtctccctcgcctttcatggatgctgttccaatattatgcactcttcttcaatatgaagatcgacagctggtcgagaatgtggctatttgcttgacaaaaatagcagatcaagccagtgagtcaccggcaatgttggatcaactgtgtaggcatggactaattaatgaatcaacacatctcttaaacttgaatagccgcactaccctatctcaacctgtctacaatggtgtgattggaatgctaagaaaactatcttctggttcagctttagctttcagaacgttatatgagcttaacattggctacagtttaaaagaaatcatgtccacgtatgacatttctcattcagtgtcttctacacatcctatcaatgcatgttctaatcaggtgcatgaagtcctgaagttggtgattgagcttcttccagcttcacccgtagaggataatcagctggcatcggaaaaggaaagttttctcgtcaatcagcctgatcttttgcaacaatttggaagagacatgcttcctgtcatgattcaggtgctaaactctggagctaacgtatatgtttcttatggttgcctatcagcaattcacaagctgacttgcttgagtaagtccggtgatattgtcgagttactgaagaacaccaacatgtcaagtgttttggctggcattctgtcaaggaaggatcatcatgtaattgtagtagcactacaggttgcggaagtgcttcttgagaaatacagagatacttttttgaattcttttataaaggaaggtgtttttttcgcgattgaagcactcttaagttctgatagagggcaacaaaatcagggatcagctgacctttcacaaaagcctgttacaaaagagattgtgaaatgcttgtgccaatcttttgaaagatcgctatcctcttcttcacaaacttgtaagattgaaaaggattctgtctacgttcttgcaacacgtatcaaggagggtttctttggacctgaggtattcaactctgagaaaggcttgacagatgtcctccaaaacctcaagaacttgtcggtagcacttagcgagttgatgactgtacccattgatgcgcatgtcctgcatgatgagaaattcttctcaatatggaaccaaatcatggaaaggctgaatggaagggaatctgtgtccacttttgaattcattgagagcggagttgtaaagtcactggcaagttatctttctaatggactctatcaaaggaaacttagcaaagggggtcctgaatgtgatagtttaccatttattggtaagagatttgaggtgttcacaagattgctttggtctgatggagaggcaacttcatccttgttaatacagaagctccaaaattccctttcttctttggaaaacttcccaattgtcctaagccaatttttgaagcagaagaactcatttgcggctattccaaatgggcgttgcactagttatccatgcctaaaagttcgttttctgaaagcagagggggagacttctttgcgtgattactcccaagactttgtcactgttgacccactttgctatttggatgctgtcgatcaatacttgtggcctaaagttaatatagaacctatagattctgtggaagcaaaagatcaagctatagaatgtcaatcttctcaattgcagtcaacttcgatatcttgtcaagctgaaagctcaagtcctatggagattgacagtgagtcttctgatgcgtctcagttgcagggatctcaagtggaagatcagacgcaacttccaggacaacagaatgcttcctcctctgaaacctcctctgaaaaagaggatgcggtacctagacttttgtttcgtctcgaagggcttgaactagaccgttctttgacagtatatcaggcgattctcttgcacaaactaaaatcagaaagtgaagcaaccaacgattcgaagctgagtggaccccacaacatcacttatgaaaggtctgcacaacttggggattctcgtgaaaatctgtttccacctggatctatggaagatgatgagtatcgcccgttcttgtcctatttgtttactcatagacttgctttgcgcctgaaggggtcaagtcatcctccgtatgacatattgtttcttcttaagagtctggagggcatgaacagatttctctttcacctgatttctcttgaacggattaatgcttttggtgaaggtaggctagagaatttggatgatctgagggtacaagttcgtcctgtgccacattctgaatttgttagcagtaagcttacagagaagttagagcagcagcttcgtgattcttttgctgtgtcaacctgcggtctgccaccatggtttaatgatctaatggattcatgtccgtgtttatttagttttgaagccaagtctaaatacttccgacttgcagcctttggttcacagaaaatccgtcatcatccacagcaccttagcagttcaaatgttcatggcgaagcgcgcccagtgactggtagtttacctcgtaaaaagttcttagcttgccgtgaaaacattctagagtctgctgccaaaatgatggagttatatggaaaccagaaggtggtcattgaggttgaatacagtgaagaagtcgggactggtcttgggccaacactggagttctatacgcttgtcagtagggcatttcaaaatcccgatcttggtatgtggagaaatgattgtagttttattgttggaaagccagtcgaacactcgggagttttggcatcttcttcaggactctttccacgcccttggtcaggtacatcaactacgtcagatgtgctgcagaaatttgtcctcttggggacagtggtagcaaaggctttacaagatggacgagtcttagaccttccactttccaaagccttctacaaattaattctcggacaggagttgagttcatttgacatccacttcgttgaccctgaactttgtaaaacactggtggaattgcaagctctggtacgtaggaaaaagcttttcgctgaagcacatggtgattccggagcagccaagtgtgatttaagtttccatggaacaaagattgaggacctttgtcttgaatttgcattgcctggctacacggattatgatctcgctccctattctgcaaatgatatggtaaatttggataacctcgaggaatatatcaagggtattgtcaatgccacagtatgtaatgggatccaaaaacaagtggaagcatttcggtctggatttaatcaggttttctctattgaacatcttcggatattcaacgaagaggagctggaaactatgctgtgtggagaatgtgatctctttagtatgaatgaagtcttggatcacatcaagtttgatcatggatatacttctagcagcccaccagttgaatatttattgcagattctgcatgagtttgatagggagcaacaacgagcctttttgcaatttgtaacaggatctccccggttacctcatggtggtttggcgtctctcagtcccaaactaacaatcgtccgcaagcatggtagcgattcttcagatactgacctccctagtgtgatgacatgcgccaattatctgaagcttcctccttattcatccaaagagaagatgaaggagaagctgatttatgccataacggaaggtcaaggttccttccatctctcttaa

SEQ ID NO: 708 - protein, 1502 aa, Arabidopsis thaliana
MENRGQKRMEVVEELPADKRACNSQDFRPSTSGSSVQAQANDTNPGHENVDADMDTSSSASPSSRSDEEEQEEQDKEDSDYGSCDSDEEDPRQRVLQDYQRQRSSGDHGKLKSLLLNLTGETDPSGQLSRLTELCEVLSFSTEESLSSVMANMLSPVLVKLAKHENNADIMLLAIRAITYLCDVYPPSVEFLVRHDTIPALCQRLLTIEYLDVAEQCLQALEKISRDEPVACLNAGAIMAVLSFIDFFSTSIQRVAISTVVNICKQLSSESPSPFMDAVPILCTLLQYEDRQLVENVAICLTKIADQASESPAMLDQLCRHGLINESTHLLNLNSRTTLSQPVYNGVIGMLRKLSSGSALAFRTLYELNIGYSLKEIMSTYDISHSVSSTHPINACSNQVHEVLKLVIELLPASPVEDNQLASEKESFLVNQPDLLQQFGRDMLPVMIQVLNSGANVYVSYGCLSAIHKLTCLSKSGDIVELLKNTNMSSVLAGILSRKDHHVIVVALQVAEVLLEKYRDTFLNSFIKEGVFFAIEALLSSDRGQQNQGSADLSQKPVTKEIVKCLCQSFERSLSSSSQTCKIEKDSVYVLATRIKEGFFGPEVFNSEKGLTDVLQNLKNLSVALSELMTVPIDAHVLHDEKFFSIWNQIMERLNGRESVSTFEFIESGVVKSLASYLSNGLYQRKLSKGGPECDSLPFIGKRFEVFTRLLWSDGEATSSLLIQKLQNSLSSLENFPIVLSQFLKQKNSFAAIPNGRCTSYPCLKVRFLKAEGETSLRDYSQDFVTVDPLCYLDAVDQYLWPKVNIEPIDSVEAKDQAIECQSSQLQSTSISCQAESSSPMEIDSESSDASQLQGSQVEDQTQLPGQQNASSSETSSEKEDAVPRLLFRLEGLELDRSLTVYQAILLHKLKSESEATNDSKLSGPHNITYERSAQLGDSRENLFPPGSMEDDEYRPFLSYLFTHRLALRLKGSSHPPYDILFLLKSLEGMNRFLFHLISLERINAFGEGRLENLDDLRVQVRPVPHSEFVSSKLTEKLEQQLRDSFAVSTCGLPPWFNDLMDSCPCLFSFEAKSKYFRLAAFGSQKIRHHPQHLSSSNVHGEARPVTGSLPRKKFLACRENILESAAKMMELYGNQKVVIEVEYSEEVGTGLGPTLEFYTLVSRAFQNPDLGMWRNDCSFIVGKPVEHSGVLASSSGLFPRPWSGTSTTSDVLQKFVLLGTVVAKALQDGRVLDLPLSKAFYKLILGQELSSFDIHFVDPELCKTLVELQALVRRKKLFAEAHGDSGAAKCDLSFHGTKIEDLCLEFALPGYTDYDLAPYSANDMVNLDNLEEYIKGIVNATVCNGIQKQVEAFRSGFNQVFSIEHLRIFNEEELETMLCGECDLFSMNEVLDHIKFDHGYTSSSPPVEYLLQILHEFDREQQRAFLQFVTGSPRLPHGGLASLSPKLTIVRKHGSDSSDTDLPSVMTCANYLKLPPYSSKEKMKEKLIYAITEGQGSFHLS

SEQ ID NO: 709 - DNA, 6627 bp, Arabidopsis thaliana
atgtcggcagcttcttctagctccgttcttcacctccgaaccaaccaacaactgttatcactccgatctctcaaaaattccacctccgttgcttctcaattggccgttacgtctggtgttagccgtagaagatcgtgtacggcgcgatgctctgtgaagaaaccggtgattcctgagagtcctttcctagggactcgtgtgcggagatccggatccgagacgcttcagttctggagatcagatggtcctggacggtctgcgaagcttcgaacggtggttaaatcgtcattttccgctgttccggagaagcctcttggtctttatgatccttcctatgataaagactcttgtggtgttggttttgtagcagagttgtccggcgagaccacccgcaaaacggtgactgattcgttggagatgttgatacggatgactcatagaggtgcttgtggttgtgagagcaacactggtgacggcgctgggattcttgttggtctgcctcatgatttctatgcagaggctgcgacagagcttggctttgtacttccttctgctggaaattatgctgttggtatgttcttcttgccaactgttgaaagcaggagagaagaaagcaagaatgttttcactaaggttgctgaatcacttggccactcggttcttggatggagattagtgcctaccgataattctggactgggaaactccgctttgcagactgaaccgattattgcgcaagttttccttactcctacaactaaatctaaagctgactttgagcaacagatgtatatccttagaagggtttctatggttgctattcgagctgcgttgaaccttcaacatggtgcgatgaaggacttctacatctgttcgttgtcttctaggactatcgtctacaaaggacaattgaagcctgatcaactaaaggactattactatgcggatcttgggagtgaaaggtttacgagctacatggccctggttcattctcggttctctaccaatacatttcccagctgggatcgtgctcagccgatgcgtgttttgggccacaatggggagatcaatacactcaggggaaacgtgaactggatgagggcacgtgagggtctgctcaagtgcaatgaacttggattatcaaagaaagagttgaagaagcttctacctattgtggacgttagctcttctgactcaggtgcttttgatggtgttcttgagcttcttgtccgagctggtagaagtcttcctgaagctgttatgatgatgatccctgaagcatggcaaaatgacaaaaacattgatccaagcaggaaagagttttatgaatacttatctgctctaatggagccatgggatggacctgccctcatatcattcactgatggtcgctacttgggtgccacattggaccgtaatggacttcgtcctggtaggttctacataacccacagtggaagggttatcatggctagtgaagttggggtagtggatgtaccacctgaagatgtgatgaggaaaggaagacttaacccgggtatgatgcttcttgtcgattttgagaagcatattgttgttgatgacgatgccttgaagcagcagtattcactggcaaggccttatggtgagtggcttaaaaggcaaaagattgaacttaaagacatcattgagtcagttccggaggctgaacggattgctccttcaatttctggggttgtaccggcctctaatgatgatgactcaatggagagcatgggcattcatggtttattgtctccactaaaagcctttggctacacagttgaggccttggagatgttgctgcttccgatggctaaagatggctctgaagcacttggttctatgggaaatgatacccctctagctgtaatgtcaaacagagaaaaattatgctttgagtacttcaagcaaatgtttgctcaagtaacaaatcctccaattgatcctattcgtgagaaaattgttacatcaatggagtgcatgatcggtccagaaggcgatctaaccgaaacaactgaagagcaatgtcaccgtctctccctaaaaggtcctcttttgaaaatcgaagagatggaagccatcaagaaaatgaactacagaggctggcggactaaagttctggatataacttatgcaaaagaaagaggtacaaaagggttagaggagactttggaccgaatttgtgatgaagcaaatgaagcaataaaggagggctacacattactggttttgtctgatcgagctttctctgcaacacgtgttgctgtgagctccctcatggctgttggtgccgttcatcaccacctggttaagacacttgcgcgcacccaagttggtttggtagtggaatctgctgaaccacgtgaagtgcatcatttctgcacacttgtcggatttggagcagatgctatctgcccatatttggctgtagaggccgtttatagattacaggttgatggcaaaataccacccaaatctaatggggaattccattccaaagaagagttggtcaagaagtattacaaggcaagtaactatggaatgatgaaggttcttgccaaaatgggaatttctactctagcctcatacaaaggtgctcagatatttgaagctcttgggctttcatctgaagtaattcagaaatgttttgccggtaccccaagccgagtggaaggagcaacatttgagatgcttgcacgagatggacttcaattgcatgagttggcctttccaacccgtggctatgccccaggaagtgcagaagcttcagcacttaccaaccctggaaactatcactggaggaaaaatggagagattcatctcaacgatcctcttgcaatagccaaattacaagaggcagcacggaccaacagtgtggccgcctacaaggaatactcaaagcgtatcaatgaattgaacaagcaaagtaatttgcgtgggctcatgaagtttaaagacgcagatgtgaaaattccactagatgaagtcgagcctgccagtgaaattgttaagcggttctgcactggtgccatgagttatggatcaatttctctggaggcgcatacaacccttgcaatggccatgaacaagcttggaggaaagtcgaatacaggtgagggaggggaactgccatcccgtatggagcctcttgcggatggttcaaggaaccccaaaagaagttcgatcaaacaaattgctagtggaagatttggagtttctagctactatcttacaaatgctgatgagctgcagataaagatggctcagggtgccaaacctggggaaggtggggagctaccaggccacaaggtcataggagacattgctataaccagaaattccactgctggtgtaggacttatcagtccacctcctcatcatgatatctactctatcgaggatcttgcccagctaattcacgatcttaagaatgccaatcctggcgcacgtattagtgttaagcttgtatctgaagctggtgttggagttattgctagcggtgtggtgaaggggcatgctgaccatgttctgatagcaggtcatgatggaggtactggtgcatctcgctggaccggtattaaaaatgctggtcttccatgggaactgggtctagctgagacacaccaaactcttgttgccaatgaccttcgtggccgtactgttcttcagacagatggccagctaaaaactggcagagacgttgcagttgctgcacttcttggtgcagaagaatttggttttagtactgcaccccttatcacactagggtgtatcatgatgagaaagtgccacaagaacacctgccctgtgggaattgctacccaagatccagttctccgtgaaaaatttgctggggagcctgaacatgttattaacttcttctttatgcttgctgaggaagttagggagatcatgtctggacttggttttagaactgtaactgagatgattggtcgtgcggatatgcttgaacttgatagggaagttgtcaagaacaacgataagctggagaacattgacctatctcttttgctcagacctgctgctgagattcgtcctggggctgctcagtactgtgttcagaaacaagatcatggtttagacatggctttggatcaagagctgattgcattgtctaaatctgctctggagaaatctcttccggtgtacattgaaactcctatctgcaacgttaaccgtgctgttgggacaatgctgagccatgaggtaaccaaacgttaccacttgactgggcttccaaaggacacaattcatatcaagttcacaggaagtgctgggcagagtcttggagctttcttgtgtcctggaattatgctagaacttgaaggagatagcaatgactatgttggaaaagggctctctggaggtaaagttgttgtttaccctccaaaaggaagcagctttgatccaaaagaaaatatcgttattggtaatgtagcactttacggtgccactagtggtgaagcatacttcaatgggatggctgctgaaaggttctctgttcgtaattctggtgctaaagctgttgtggaaggtcttggtgatcatggttgtgagtacatgactggtggtactgttgtggtgcttggaaagactggtagaaactttgctgctggtatgagtggtggtattgcttatgtccttgatgtggacggaaagtttaacaccagatgcaaccttgaactggttgatttggataaagttgaagatgaggaggacaaaatgacgctcaaaatgatgatccagcaacatcaaagacacaccaacagccaacttgctcaagaagttcttgcagactttgagaatttgctgcccaagtttatcaaggttttcccaagagattacaaacgtgttttatcagccatgaaacacgaagaggtctccaagcaagcaatcgagcgggcttctgaggaagctgacgagactgaagagaaagaactcgaggagaaagatgcatttgcagaactgaagaacatggcagctgcttcgtcaaaagaggagatgtcaggaaacggagtggcagctgaagctagaccttctaaggtagataatgctgttaaaaacggtggtttcattgcttatgagcgtgagggagttaagtacagggatcccaatgttcgtcttaatgactggaacgaagtcatggaggaatcaaaacctggaccactccttacaactcagtcagctcgttgcatggattgtggaactccattctgccaccaggagaactctgggtgtcctctcggtaataagatccctgaattcaatgaacttgtctaccagaacagatggcaagaagccttgaatcgtctacttgagacaaacaactttccagaatttactgggcgagtatgccctgcaccatgtgaaggttcttgtgttcttggaataattgagaaccctgtttctatcaaaagcattgaatgtgctattatcgataaagcctttgaggaagggtggatggtaccaaggcctcctctcaagagaacagggaaaaaggttgctattatcggaagtggaccggctgggttagctgcggctgaccagctgaacaaaatgggccatttagtaaccgtgtatgagcgctcggacagaattggtgggctgatgatgtatggagtaccaaacatgaagactgacaaaattgacgtcgttcaacggcgggttgatcttatgaccaaagaaggtatcaactttgtggtcaatgccaatattggaaaggacccatcttactcccttgatggacttaaggaagagaatgatgcaatcgttcttgctgttggttccacaaaaccaagagatcttccagtgcctggtcgtgatctatctggtgttcactttgccatggagtttcttcatgcaaacaccaaaagtttacttgacagcaatcatgaggatggcaattacatttctgcaaaagggaaaaaggttgttgttattggtggaggtgataccggcacagattgcatcggaacatctatccgccatggatgtaccaacattgtaaacctagaacttcttcctcagccaccctcaacaagagctcctggaaacccttggccacagtggcctcgtgtattccgtattgactacggacatcaagaagctaccaccaaattcggaaaagaccctaggacctatgaggtcttaacgaagaggttcataggagatgacaatggaaacgtgaaggggcttgaacttgtgcgtgtgagttgggagaaggatgaaaccgggaggttccagttcaaggagatcgaaggctctgaggaaatcattgaagcagacctcgttttcttggccatgggtttccttggacctgagccaacacttgctgagaagctaggtctcgaatgtgacaacaggtcaaactttaaggccgagtatggccggttttccacaaccgtggaaggtgttttcgcagcaggtgattgtcggagaggccagtctttggttgtctgggctatctcagaaggacgtcaagctgcagatcaggtagacaaattcctcaccaaaacggatgatgacgaagacgccaagctacaacaagaccttaaccagatgaaacacaacactatcacaaactga

SEQ ID NO: 710 - protein, 2208 aa, Arabidopsis thaliana
MSAASSSSVLHLRTNQQLLSLRSLKNSTSVASQLAVTSGVSRRRSCTARCSVKKPVIPESPFLGTRVRRSGSETLQFWRSDGPGRSAKLRTVVKSSFSAVPEKPLGLYDPSYDKDSCGVGFVAELSGETTRKTVTDSLEMLIRMTHRGACGCESNTGDGAGILVGLPHDFYAEAATELGFVLPSAGNYAVGMFFLPTVESRREESKNVFTKVAESLGHSVLGWRLVPTDNSGLGNSALQTEPIIAQVFLTPTTKSKADFEQQMYILRRVSMVAIRAALNLQHGAMKDFYICSLSSRTIVYKGQLKPDQLKDYYYADLGSERFTSYMALVHSRFSTNTFPSWDRAQPMRVLGHNGEINTLRGNVNWMRAREGLLKCNELGLSKKELKKLLPIVDVSSSDSGAFDGVLELLVRAGRSLPEAVMMMIPEAWQNDKNIDPSRKEFYEYLSALMEPWDGPALISFTDGRYLGATLDRNGLRPGRFYITHSGRVIMASEVGVVDVPPEDVMRKGRLNPGMMLLVDFEKHIVVDDDALKQQYSLARPYGEWLKRQKIELKDIIESVPEAERIAPSISGVVPASNDDDSMESMGIHGLLSPLKAFGYTVEALEMLLLPMAKDGSEALGSMGNDTPLAVMSNREKLCFEYFKQMFAQVTNPPIDPIREKIVTSMECMIGPEGDLTETTEEQCHRLSLKGPLLKIEEMEAIKKMNYRGWRTKVLDITYAKERGTKGLEETLDRICDEANEAIKEGYTLLVLSDRAFSATRVAVSSLMAVGAVHHHLVKTLARTQVGLVVESAEPREVHHFCTLVGFGADAICPYLAVEAVYRLQVDGKIPPKSNGEFHSKEELVKKYYKASNYGMMKVLAKMGISTLASYKGAQIFEALGLSSEVIQKCFAGTPSRVEGATFEMLARDGLQLHELAFPTRGYAPGSAEASALTNPGNYHWRKNGEIHLNDPLAIAKLQEAARTNSVAAYKEYSKRINELNKQSNLRGLMKFKDADVKIPLDEVEPASEIVKRFCTGAMSYGSISLEAHTTLAMAMNKLGGKSNTGEGGELPSRMEPLADGSRNPKRSSIKQIASGRFGVSSYYLTNADELQIKMAQGAKPGEGGELPGHKVIGDIAITRNSTAGVGLISPPPHHDIYSIEDLAQLIHDLKNANPGARISVKLVSEAGVGVIASGVVKGHADHVLIAGHDGGTGASRWTGIKNAGLPWELGLAETHQTLVANDLRGRTVLQTDGQLKTGRDVAVAALLGAEEFGFSTAPLITLGCIMMRKCHKNTCPVGIATQDPVLREKFAGEPEHVINFFFMLAEEVREIMSGLGFRTVTEMIGRADMLELDREVVKNNDKLENIDLSLLLRPAAEIRPGAAQYCVQKQDHGLDMALDQELIALSKSALEKSLPVYIETPICNVNRAVGTMLSHEVTKRYHLTGLPKDTIHIKFTGSAGQSLGAFLCPGIMLELEGDSNDYVGKGLSGGKVVVYPPKGSSFDPKENIVIGNVALYGATSGEAYFNGMAAERFSVRNSGAKAVVEGLGDHGCEYMTGGTVVVLGKTGRNFAAGMSGGIAYVLDVDGKFNTRCNLELVDLDKVEDEEDKMTLKMMIQQHQRHTNSQLAQEVLADFENLLPKFIKVFPRDYKRVLSAMKHEEVSKQAIERASEEADETEEKELEEKDAFAELKNMAAASSKEEMSGNGVAAEARPSKVDNAVKNGGFIAYEREGVKYRDPNVRLNDWNEVMEESKPGPLLTTQSARCMDCGTPFCHQENSGCPLGNKIPEFNELVYQNRWQEALNRLLETNNFPEFTGRVCPAPCEGSCVLGIIENPVSIKSIECAIIDKAFEEGWMVPRPPLKRTGKKVAIIGSGPAGLAAADQLNKMGHLVTVYERSDRIGGLMMYGVPNMKTDKIDVVQRRVDLMTKEGINFVVNANIGKDPSYSLDGLKEENDAIVLAVGSTKPRDLPVPGRDLSGVHFAMEFLHANTKSLLDSNHEDGNYISAKGKKVVVIGGGDTGTDCIGTSIRHGCTNIVNLELLPQPPSTRAPGNPWPQWPRVFRIDYGHQEATTKFGKDPRTYEVLTKRFIGDDNGNVKGLELVRVSWEKDETGRFQFKEIEGSEEIIEADLVFLAMGFLGPEPTLAEKLGLECDNRSNFKAEYGRFSTTVEGVFAAGDCRRGQSLVVWAISEGRQAADQVDKFLTKTDDDEDAKLQQDLNQMKHNTITN

SEQ ID NO: 711 - DNA, 795 bp, Arabidopsis thaliana
atgaggccagtgttcgtcggcaatttcgagtatgaaactcgccagtcggatctggaacggttgttcgacaagtatgggagagtcgaccgagtggacatgaaatctggatatgcttttgtgtactttgaggatgaacgtgatgctgaagacgctattcgcaaactcgacaattttccttttggatatgagaaacgcaggttatcagttgaatgggcaaagggtgaacgtggcaggcctcgtggtgacgcgaaagccccttcaaatctgaagcctacaaagacactgtttgtcattaactttgaccccattagaacaaaagagcacgacattgaaaaacactttgagccctatggtaaggtcaccaacgtgcgtatcagacgcaacttctcatttgttcagtttgaaacacaagaggatgctacaaaagcccttgaagctactcaaagaagcaaaatattggatagggttgtttccgtggagtatgcgttgaaagatgacgatgaaagagatgatcgaaatggtggtcgtagcccgagaaggtctcttagtcctgtgtatcgtaggcgtccaagtccagattatggcaggcgtccaagccctggtcagggtaggcgtccaagtccagattatggtcgtgctcgaagcccagaatacgacagatacaaaggtccagcagcttatgaaagacggaggagtccagattatggacgaaggagttctgattatggtagacaaaggagccctggttatgaccgatacagaagtcgttctccagtcccaagaggaagaccttga

SEQ ID NO: 712 - protein, 264 aa, Arabidopsis thaliana
MRPVFVGNFEYETRQSDLERLFDKYGRVDRVDMKSGYAFVYFEDERDAEDAIRKLDNFPFGYEKRRLSVEWAKGERGRPRGDAKAPSNLKPTKTLFVINFDPIRTKEHDIEKHFEPYGKVTNVRIRRNFSFVQFETQEDATKALEATQRSKILDRVVSVEYALKDDDERDDRNGGRSPRRSLSPVYRRRPSPDYGRRPSPGQGRRPSPDYGRARSPEYDRYKGPAAYERRRSPDYGRRSSDYGRQRSPGYDRYRSRSPVPRGRP

SEQ ID NO: 713 - DNA, 1266 bp, Arabidopsis thaliana
atggcgcctgttaatatgactggcgctgttgttgcagcagcggcgttgttgatgcttacttcttacagcttctttttccgtctctccgagaagaagaagaggaaggagaagttgactatgagaaacgggcttgttgatgccattggcaatactcctctgattcgtatcaatagtctctctgaggctactggatgtgagattcttgggaaatgcgagtttttgaatccaggaggtagtgttaaagatagagttgctgtcaagatcattcaagaggctttggaatctggtaagctattccctggaggaattgtaactgagggtagtgcaggaagtactgccattagccttgctacagttgctccggcttatgggtgtaaatgtcatgttgttatacctgatgatgctgctattgaaaagtctcaaataattgaagcccttggagcttctgttgagagagtgaggccagtgtcaataactcacaaggatcactatgtcaacattgcgaggcgacgggctgacgaagcaaacgagttagcatcaaagagaagactagggagcgaaacaaatggcatacaccaggagaaaactaatggttgcacggttgaggaagtgaaagagccttccttattctcagattcagttaccggtggcttctttgcagatcaatttgaaaacttggcaaattatagggctcattatgaaggtactggccctgaaatctggcaccagactcagggtaatattgacgcctttgttgctgctgcgggtacaggcgggactttagctggtgtttcaaggtttcttcaggataagaatgaaagagttaaatgttttctgattgatcctcctggatctggtctgtacaataaagtaacacggggagtgatgtacacaagagaagaagctgaagggcgtcggctaaagaacccatttgatacaataacagaagggatcggaatcaacaggcttactaaaaacttcctgatggcaaaacttgacggtggttttcgtgggactgataaagaagcggttgagatgtcgaggtttcttctgaagaatgatgggctctttgttggaagctcctcggctatgaactgtgttggggcagtaagggtggctcagacccttggtcctggtcacacaattgtcaccattctttgtgatagcggaatgagacatctaagcaagtttcacgaccctaagtacttgaatttatacgggttaagtccaaccgctatcggattagagttcctcggcataaagtga

SEQ ID NO: 714 - protein, 421 aa, Arabidopsis thaliana
MAPVNMTGAVVAAAALLMLTSYSFFFRLSEKKKRKEKLTMRNGLVDAIGNTPLIRINSLSEATGCEILGKCEFLNPGGSVKDRVAVKIIQEALESGKLFPGGIVTEGSAGSTAISLATVAPAYGCKCHVVIPDDAAIEKSQIIEALGASVERVRPVSITHKDHYVNIARRRADEANELASKRRLGSETNGIHQEKTNGCTVEEVKEPSLFSDSVTGGFFADQFENLANYRAHYEGTGPEIWHQTQGNIDAFVAAAGTGGTLAGVSRFLQDKNERVKCFLIDPPGSGLYNKVTRGVMYTREEAEGRRLKNPFDTITEGIGINRLTKNFLMAKLDGGFRGTDKEAVEMSRFLLKNDGLFVGSSSAMNCVGAVRVAQTLGPGHTIVTILCDSGMRHLSKFHDPKYLNLYGLSPTAIGLEFLGIK

SEQ ID NO: 715 - DNA, 1776 bp, Arabidopsis thaliana
atggtaaccgaagctttcgaattcgtcgccgttcctttcaattccgatggctggggacctccagacgcttccgacgtttcctcctccgcctctcccaccagcgtcgccgccgctaatcttctcccgaacgttcctttcgcttccttctcccgttccgataagctcggccgtgtagctgattggactcgcaatctctctaatccatccgctcgtcctaacaccggatccaaatcagatccgtctgcagttttcgatttctccgctttcgcaatcgacgaaggcttcggtctcgcttcctccggtggtaatcccgacgaagacgcagctttccgtctcgtcgacggtaaacctccgccgcgtcctaaattcggacctaaatggcgtttcaatcctcaccacaatcggaatcagcttcctcaacggcgagatgaagaagttgaagctaagaagcgtgatgctgagaaggaacgagctcgtcgtgatcgtctctacaataacaaccgtaacaacatccatcaccaacgccgtgaagctgccgctttcaaatcatccgttgatattcagccggagtggaacatgcttgagcagatccctttctcaacattctcgaagctctcgtacacagttcaagaaccagaagatcttcttctctgtggtggccttgagtactacaaccgccttttcgatcgcataacgccgaaaaacgaacgcagactcgagcgtttcaagaacaggaacttcttcaaagtcactactagtgatgatcctgtgattaggcgtttagctaaggaagacaaagctactgttttcgctactgatgctatattagctgctcttatgtgtgctcctagatctgtttactcttgggatattgttattcaacgtgttggtaacaaactgttctttgacaagagagatggatcacagcttgatttgttgtctgtgcatgagacatctcaagagccattgcctgagtctaaagatgatatcaattctgctcattctctaggtgtggaagctgcttacatcaatcagaacttttcgcagcaggttttggttagagatggaaagaaggaaacttttgatgaagccaatccatttgctaatgaaggtgaagagattgcttctgttgcttataggtatagaaggtggaagcttgatgataatatgcatcttgttgcgaggtgtgagttacagagtgttgctgatctcaacaaccaaaggtcgtttcttactttgaatgctcttaacgagtttgatcctaagtactctggtgttgattggagacagaagcttgaaactcagagaggtgcggttttagctacagaattgaagaacaatggaaataagttggctaaatggactgcacaagctttattggctaatgctgatatgatgaagattggttttgtctctagggttcatcctcgtgatcatttcaaccatgttatattatctgttttggggtataagccgaaggatttcgctggacagattaatctcaacacttctaacatgtgggggattgtgaaatccatagttgatctgtgtatgaaactaagcgaagggaagtatgttcttgtgaaggatccatcgaagcctcaagtgaggatttatgaggttccacctgatgctttcgagaatgattacgttgaggaaccgttgcctgaagatgaacaggttcagccaactgaggaaaacacagagggagcagaagcaagtgtagctgcaactaaagaaaccgaggagaagaaagctgatgatgctcaagcttga

SEQ ID NO: 716 - protein, 591 aa, Arabidopsis thaliana
MVTEAFEFVAVPFNSDGWGPPDASDVSSSASPTSVAAANLLPNVPFASFSRSDKLGRVADWTRNLSNPSARPNTGSKSDPSAVFDFSAFAIDEGFGLASSGGNPDEDAAFRLVDGKPPPRPKFGPKWRFNPHHNRNQLPQRRDEEVEAKKRDAEKERARRDRLYNNNRNNIHHQRREAAAFKSSVDIQPEWNMLEQIPFSTFSKLSYTVQEPEDLLLCGGLEYYNRLFDRITPKNERRLERFKNRNFFKVTTSDDPVIRRLAKEDKATVFATDAILAALMCAPRSVYSWDIVIQRVGNKLFFDKRDGSQLDLLSVHETSQEPLPESKDDINSAHSLGVEAAYINQNFSQQVLVRDGKKETFDEANPFANEGEEIASVAYRYRRWKLDDNMHLVARCELQSVADLNNQRSFLTLNALNEFDPKYSGVDWRQKLETQRGAVLATELKNNGNKLAKWTAQALLANADMMKIGFVSRVHPRDHFNHVILSVLGYKPKDFAGQINLNTSNMWGIVKSIVDLCMKLSEGKYVLVKDPSKPQVRIYEVPPDAFENDYVEEPLPEDEQVQPTEENTEGAEASVAATKETEEKKADDAQA

SEQ ID NO: 717 - DNA, 942 bp, Arabidopsis thaliana
atgggcgcgaattctattccgacggacgcaaccattgatcttgatgagcagatctcgcagctcatgcagtgcaagcctctctcggagcaacaggttagagcattatgcgagaaagccaaggagatcttaatggatgaaagcaatgttcagcctgtgaaaagccctgtgacaatctgcggtgatattcatggacagttccatgatcttgcagagcttttccgtatagggggaatgtgccctgataccaattacctgtttatgggagactatgtggaccgtggttattattctgttgaaactgttacgctgttagtcgccttaaagatgcgatatcctcagcgaatcactattcttagaggaaaccatgaaagtcgtcagattactcaggtttatggattttatgatgaatgtctacgaaagtacggcaacgcaaatgtttggaaaatctttacagacctcttcgactattttcctctgacagccttggttgagtcagaaatattttgccttcatggtggattatctccatctatcgagacccttgacaacataaggaattttgatcgagttcaagaagtgccccatgaagggccgatgtgtgacttattatggtctgaccccgatgaccgatgtggttggggcatctctcctcggggtgccggatatacatttggtcaggatatatctgaacaattcaatcacacaaacaacttaaagctgatcgcccgagctcaccagttggttatggatggatacaactgggctcacgagcaaaaagtggttactattttcagtgcaccaaactattgttaccgttgtgggaacatggcctcgattcttgaggtcgacgactgcaggaaccacaccttcatccagtttgaaccagcaccgaggagaggagaaccagacgtcacccgaaggactccagactatttcctgtga

SEQ ID NO: 718 - protein, 313 aa, Arabidopsis thaliana
MGANSIPTDATIDLDEQISQLMQCKPLSEQQVRALCEKAKEILMDESNVQPVKSPVTICGDIHGQFHDLAELFRIGGMCPDTNYLFMGDYVDRGYYSVETVTLLVALKMRYPQRITILRGNHESRQITQVYGFYDECLRKYGNANVWKIFTDLFDYFPLTALVESEIFCLHGGLSPSIETLDNIRNFDRVQEVPHEGPMCDLLWSDPDDRCGWGISPRGAGYTFGQDISEQFNHTNNLKLIARAHQLVMDGYNWAHEQKVVTIFSAPNYCYRCGNMASILEVDDCRNHTFIQFEPAPRRGEPDVTRRTPDYFL

SEQ ID NO: 719 - DNA, 1527 bp, Arabidopsis thaliana
atgtcttatagtaattcaaacccggaaaattattcagctgcaacgagctcgccggagcttaaactatatcaagcatttatcttttctgttccaatttgtttcacatttattattctcttcttgttttacttgatctacctccgtcgtagtagctctgatttgtcttctcttggaatgcgaactactttcatccccgggaactctctctccacgattgaattaggattgagcaaagagctgagagagatgcttcccattgttgtctttaaagagagcttcaccgtaatggattcacaatgttcagtgtgccttggggactatcaaccaaatgacaagcttcaacagatcccggtatgtaaacacacttttcacatggactgcattgatctttggctcacatcacataccacttgccctctttgccgcctcgctctaatcccgagtcgttcccgtcaaagccaagatgatcctgttccgagtctcgtaagccctgatgaagaagtgtcgagtcaaccagaatctgagccagtaaaccacagagtagtgtcgactcaaccagaatctgagccagtaaaccacagtggagtctcgagtcaaccagaatctcagccagtagtaaaccacagaggagtctcgagtcaaccggagtctcagccagtaaaccacattaacgatggccatgagcagcaatgtgatcaagatgtagagggctttaaggaaatggaagaggacgaacgaaacaacatcgggacatcgagtgcttgttgtagttgtagaactgttcactactgttgtgtctcaagagacaatcagattatgtacgcttacaacaatgccggagaccaccgcaacaacgagagtcttgcagcgttatgcttggaaaagactccaccttttcacaagtggtacttcgaaacgaggggtaagaagacttttggattcttgatgaaagatgacttcgtttatttcgccattgttgatgatgttttcaagaaatctagcgttcttgattttcttgaaaaactgagagatgagttaaaagaagctaataagaagaattctagaggaagtttctctggtagtatcagttttagcaatgttcaagaccaaattgtccgaagactcatagcttcattagagtttgatcacacttgtcttccattatcatcaccttccattgatggtgctgaacaaagctacgcatctaactccaaagctcctcttttaggaagatccaacaagcaagataagaagaaagggagagatcatgcgcactcactaagaggtattgagatagaggaacaccgaaaatcaaatgatagaggaaacgtaacagaatgttctaatgcttcatctgaatcagcaacgtatgttccaagaaggggacgatctggtggctctcagagcattgagaggaagtggcggcgtcaagtgaagattgttcttgccattgatatagctatttgcttaacgctgcttggtgtttggttggctatttgtcatggcattgagtgtacacgttcttga

SEQ ID NO: 720 - protein, 508 aa, Arabidopsis thaliana
MSYSNSNPENYSAATSSPELKLYQAFIFSVPICFTFIILFLFYLIYLRRSSSDLSSLGMRTTFIPGNSLSTIELGLSKELREMLPIVVFKESFTVMDSQCSVCLGDYQPNDKLQQIPVCKHTFHMDCIDLWLTSHTTCPLCRLALIPSRSRQSQDDPVPSLVSPDEEVSSQPESEPVNHRVVSTQPESEPVNHSGVSSQPESQPVVNHRGVSSQPESQPVNHINDGHEQQCDQDVEGFKEMEEDERNNIGTSSACCSCRTVHYCCVSRDNQIMYAYNNAGDHRNNESLAALCLEKTPPFHKWYFETRGKKTFGFLMKDDFVYFAIVDDVFKKSSVLDFLEKLRDELKEANKKNSRGSFSGSISFSNVQDQIVRRLIASLEFDHTCLPLSSPSIDGAEQSYASNSKAPLLGRSNKQDKKKGRDHAHSLRGIEIEEHRKSNDRGNVTECSNASSESATYVPRRGRSGGSQSIERKWRRQVKIVLAIDIAICLTLLGVWLAICHGIECTRS

SEQ ID NO: 721 - DNA, 1005 bp, Arabidopsis thaliana
atgtccgatgctccgtcgtcttccccggatgccacggcgtcgcactggtgctatcactgcaacaaacgcgtcgtcgttgaaaccttagatgactttgtcgtgtgctgcgaatgtaacaaaggtttcgtcgagtcaattcaaccgactcccgccgcttattcatcgccggcgccaccgcagccactttccccagatctgaatgtagaagactccagtattggctcgcatttcctccagatgctccgcttgttagcccacgcgccttctcagcgttcaccaccacgacaccttgatgttttatcttacgaagatgatttcttcaggttggagctcaatagtagaaacgaaatcgacgatgacgaagacgaagatgaagatgatggagatgaagaagaagaggatgaggaagagaatttaaccgtcaacgacgaagaagacgaagaagatgatctgaggaggagaaatcgttttcctctcacgacgacgcagtcgagaaccggaagaaacagaattctcgattgggctgagattttgatgggaatcgaagacaattcgattgagttccgtatggaatcagatcgatacgcaggaaatccggctgattacatagacgatgcagccggatacgaagctttgctacagaatttagcagaaggagatggtggtggtggcggaggaaggagaggcgcaccaccggctgcgaaatcggcaatagaggcattggagactttcgaggttagttcttcggagggagagatggttatggtttgtgctgtgtgtaaagatggaatggtgatgggagaaactggtaagaagttaccgtgtggacattgttaccacggagattgtattgtgccatggttaggaacaaggaactcttgtcctgtctgtagattccagcttgagactgatgatgctgaatatgaggaagagaggaaaaaaagaacttctaccgtgtcagattctgctgctgcttcttcttcttcttcaacttctcgttactga

SEQ ID NO: 722 - protein, 334 aa, Arabidopsis thaliana
MSDAPSSSPDATASHWCYHCNKRVVVETLDDFVVCCECNKGFVESIQPTPAAYSSPAPPQPLSPDLNVEDSSIGSHFLQMLRLLAHAPSQRSPPRHLDVLSYEDDFFRLELNSRNEIDDDEDEDEDDGDEEEEDEEENLTVNDEEDEEDDLRRRNRFPLTTTQSRTGRNRILDWAEILMGIEDNSIEFRMESDRYAGNPADYIDDAAGYEALLQNLAEGDGGGGGGRRGAPPAAKSAIEALETFEVSSSEGEMVMVCAVCKDGMVMGETGKKLPCGHCYHGDCIVPWLGTRNSCPVCRFQLETDDAEYEEERKKRTSTVSDSAAASSSSSTSRY

SEQ ID NO: 723 - DNA, 2991 bp, Arabidopsis thaliana
atggaaccaacagaaaaaccatcgaccaaaccatcttctcggactctacctagagacactcgtggctctctcgaagtattcaacccgtcaactcagctgacccgacccgataacccggtgttccgtcctgaaccaccagcgtggcaaaacttgagtgatccacgtggcaccagtcctcaaccccgaccacaacaagaaccagctccatccaaccctgttcggtctgatcaagaaatcgctgtcacgacctcatggatggctctgaaagacccatcaccggagacaatctccaagaagacgatcaccgccgagaaaccacagaagtcggcggtggcggctgagcagagagcggcagagtggggattggttttgaagaccgatacaaagacgggaaagccacaaggagtaggcgtgaggaactctggtggaactgagaatgatcctaacgggaaaaagactacatcgcagagaaactcgcaaaactcttgccggagctccggtgagatgtcggacggagatgttcccggcgggaggagtgggattccaagagtatcggaagatctaaaagatgcgttgtcgacgtttcaacaaacgtttgtggtctcagatgctacaaaacctgattatccgattatgtatgcaagtgctggtttcttcaatatgactggttacacttccaaagaagtcgtcggcagaaactgccgatttttacaaggatcaggtacagatgcagatgagttagcaaagataagagagacattagctgctggtaacaattattgtgggcgtatattgaattacaagaaagatgggacctctttttggaatcttctcacgattgctcccattaaagacgagagtggcaaagtcctcaaatttatcggaatgcaagtggaggtgagcaagcacactgaaggggccaaagaaaaggctttgaggcccaatgggcttccggaatctctgattcgatacgatgcccgccaaaaagatatggcgacaaactcagtgacagagctagtagaggcggtgaagagacctcgggcactaagcgaatcgacgaatctccatcccttcatgacaaaatcggagagcgatgaacttccgaaaaaaccagctcggcgaatgtccgaaaatgttgttccgtcaggccgaagaaactctggcggcggaagaagaaactcgatgcagcgaatcaacgaaattcccgagaaaaaatctagaaaatcttccctttccttcatggggatcaagaagaagagcgaatctttggatgaatctatagacgatggatttatagagtatggagaagaagacgatgagattagtgatagggacgagagacctgagagtgtggatgataaagtgagacaaaaggaaatgagaaagggtattgatctagctactacactcgaacgtatcgagaagaatttcgtcatcactgatcctaggcttcccgataatcccattatttttgcatctgatagtttcttggagctcacggaatatagccgtgaagaaattcttggaagaaattgcaggtttctacaaggtccagagactgatctaaccacagtgaagaagattcgaaatgctattgataaccaaaccgaagtgacagttcagctcatcaactacaccaagagcggaaagaagttctggaacattttccacttgcaacctatgcgtgatcagaagggagaagtacaatactttattggagttcaactagacgggagcaagcacgtagaaccagttcgcaatgtcattgaagaaaccgcagtgaaagagggagaagacctggtgaaaaaaacagctgtgaatatcgatgaagcggttcgagaacttcctgatgccaacatgacaccagaggatttatgggcaaaccactcaaaggttgttcattgtaagcctcacaggaaagattcaccaccatggatagctatccaaaaggtgttggaaagtggtgaaccgattggtttgaagcatttcaaaccggtgaaacctttgggttctggtgacacaggaagtgtgcatctagtggaactcgttggaacagatcagttgtttgcaatgaaagcaatggacaaggctgttatgcttaaccgaaacaaagtacatagagctagagctgagagagagatcctagatttgcttgaccatccttttcttcctgcactctacgcttcttttcagacaaaaacacatatatgtcttataacagattactatccaggaggagaactcttcatgctcctagatcgacaacctaggaaggttctcaaagaagatgctgtaagattctatgctgctcaagttgtcgttgcactcgagtatcttcactgtcaaggaataatttaccgagacttgaaaccggaaaacgttttaatccaaggcaatggcgatatctctttgtcggattttgatctgtcttgcttgacatcttgcaaacctcagctgttgattccgagtatagacgagaagaagaagaaaaagcaacaaaagagtcaacaaactccaatcttcatggctgaaccaatgcgtgcatcaaactcatttgttggcactgaagagtacattgctccggaaattatatccggagcaggacatacgagtgcagtagactggtgggctcttggtatacttatgtatgaaatgttatacggatacactccttttagaggaaaaacaagacagaagactttcaccaatgttcttcaaaaagatctcaagtttccagctagcattcctgcaagtcttcaagtgaaacagctgatttttaggctgttacaacgagatccgaagaaaagactaggttgttttgaaggagcaaatgaagtcaagcaacattctttcttcaaaggcataaattgggctctgattcgatgcacgaaccctccagagctcgagactccgatattttctggtgaagctgaaaacggagagaaagttgttgatcctgagctagaagatctgcaaacaaatgttttttga

SEQ ID NO: 724 - protein, 996 aa, Arabidopsis thaliana
MEPTEKPSTKPSSRTLPRDTRGSLEVFNPSTQLTRPDNPVFRPEPPAWQNLSDPRGTSPQPRPQQEPAPSNPVRSDQEIAVTTSWMALKDPSPETISKKTITAEKPQKSAVAAEQRAAEWGLVLKTDTKTGKPQGVGVRNSGGTENDPNGKKTTSQRNSQNSCRSSGEMSDGDVPGGRSGIPRVSEDLKDALSTFQQTFVVSDATKPDYPIMYASAGFFNMTGYTSKEVVGRNCRFLQGSGTDADELAKIRETLAAGNNYCGRILNYKKDGTSFWNLLTIAPIKDESGKVLKFIGMQVEVSKHTEGAKEKALRPNGLPESLIRYDARQKDMATNSVTELVEAVKRPRALSESTNLHPFMTKSESDELPKKPARRMSENVVPSGRRNSGGGRRNSMQRINEIPEKKSRKSSLSFMGIKKKSESLDESIDDGFIEYGEEDDEISDRDERPESVDDKVRQKEMRKGIDLATTLERIEKNFVITDPRLPDNPIIFASDSFLELTEYSREEILGRNCRFLQGPETDLTTVKKIRNAIDNQTEVTVQLINYTKSGKKFWNIFHLQPMRDQKGEVQYFIGVQLDGSKHVEPVRNVIEETAVKEGEDLVKKTAVNIDEAVRELPDANMTPEDLWANHSKVVHCKPHRKDSPPWIAIQKVLESGEPIGLKHFKPVKPLGSGDTGSVHLVELVGTDQLFAMKAMDKAVMLNRNKVHRARAEREILDLLDHPFLPALYASFQTKTHICLITDYYPGGELFMLLDRQPRKVLKEDAVRFYAAQVVVALEYLHCQGIIYRDLKPENVLIQGNGDISLSDFDLSCLTSCKPQLLIPSIDEKKKKKQQKSQQTPIFMAEPMRASNSFVGTEEYIAPEIISGAGHTSAVDWWALGILMYEMLYGYTPFRGKTRQKTFTNVLQKDLKFPASIPASLQVKQLIFRLLQRDPKKRLGCFEGANEVKQHSFFKGINWALIRCTNPPELETPIFSGEAENGEKVVDPELEDLQTNVF

SEQ ID NO: 725 - DNA, 621 bp, Arabidopsis thaliana
atgcaaggtgtgattcgatccttcgtctccggtggaaatgttgtgaaaggctctgtgctgcaacatctccgtgtgattaacccggcgattcagccttctgtgttttgttcacgctctgaatcaactcaacctgcacgtatggaggaatctggattcgagagcacaactatttccgatgtcatgaaatccaaaggcaaaagtgctgatggatcttggctttggtgtactactgatgacactgtttatgatgctgttaaatccatgacacaacacaatgttggtgccttggtggttgtgaaacctggtgagcaacaagctcttgctggtatcattacagagagagattatctacggaagatcattgtgcaagggagatcatccaaatcaacaaaagttggagacattatgactgaagagaataagcttatcactgtgacaccggagaccaaggtcttgcgtgctatgcaactgatgacagataaccgaatcaggcatattccggtaatcaaagacaagggcatgattggaatggtgtccataggagatgttgtccgtgcagtggttcatgagcatagagaggagcttcaacgcctaaatgcgtatattcagggaggttactag

SEQ ID NO: 726 - protein, 206 aa, Arabidopsis thaliana
MQGVIRSFVSGGNVVKGSVLQHLRVINPAIQPSVFCSRSESTQPARMEESGFESTTISDVMKSKGKSADGSWLWCTTDDTVYDAVKSMTQHNVGALVVVKPGEQQALAGIITERDYLRKIIVQGRSSKSTKVGDIMTEENKLITVTPETKVLRAMQLMTDNRIRHIPVIKDKGMIGMVSIGDVVRAVVHEHREELQRLNAYIQGGY

SEQ ID NO: 727 - DNA, 867 bp, Arabidopsis thaliana
atgcttaactctatcactttaacccggaaaccaccactcccgttcaactctgttgggttttcaggtaatcactcttcgtcttttggtcgaagaactataacggaaggtagttcgagcaaggctctttcgtttgggtacaaaaatgttggttcactgaagtgtggtcggagcaattggccggggcgttctgggactgcgtttgggcatctagtccgggtctctgcggtcccaggtgggaattcaggtggctctggcgggttaggtggttcaggcggtggtggtggtggttccggcggcggtggtggtgatggaagcgacggaaaaggaaagaagtggtcacttctctcatggtaccaggctcttctctcaaactctcctgttttgaccaaagctgtgaccgcagcacttttgaacctcgttggagatttgatctgtcagcttactatcaacaagacctcatcgctggacaagaagaggacactcacctttaccttcttgggcttagggctagtcggtccaacattgcatttctggtatttgtatttgagcaaagtggtgacagcttctggattatcaggcgcagttatacgacttctactggatcagtttgtttttgctcctatttttgttggagttttcttatcagcagttgtgacacttgaaggaaaaccatcaaatgtcataccgaagctacaacaggagtggactggtgcaatgatagcaaattggcagctatggataccatttcagtttcttaacttcagatttgttccacagaactaccaggtacttgcttcaaacgtagtggctttggcttggaatgtgattttatcattcaaagctcacaaagaagttgttgcaaagtag

SEQ ID NO: 728 - protein, 288 aa, Arabidopsis thaliana
MLNSITLTRKPPLPFNSVGFSGNHSSSFGRRTITEGSSSKALSFGYKNVGSLKCGRSNWPGRSGTAFGHLVRVSAVPGGNSGGSGGLGGSGGGGGGSGGGGGDGSDGKGKKWSLLSWYQALLSNSPVLTKAVTAALLNLVGDLICQLTINKTSSLDKKRTLTFTFLGLGLVGPTLHFWYLYLSKVVTASGLSGAVIRLLLDQFVFAPIFVGVFLSAVVTLEGKPSNVIPKLQQEWTGAMIANWQLWIPFQFLNFRFVPQNYQVLASNVVALAWNVILSFKAHKEVVAK

SEQ ID NO: 729 - DNA, 1410 bp, Arabidopsis thaliana
atggcttcttctatcttcttcttcttccttatcttcctctccgtcgtctccgccgtcaaactacctctctctcccttctcccactccgaccaatcaccaaaagacccttacctctctctccgtcgtctcgctgaatcctcaatcgctagagctcataaactcaaacacggcacctcaataaaacccgacgaagatgctctctcctccaccaccaccgcatccgccaccgtcgtgaaatctcctctctctgctaaaagctacggcggatactcagtctctctcagcttcggcacaccgtcgcaaacaatcccattcgttttcgataccggaagcagtctcgtttggctaccttgtacctcaagatatctctgctccggttgcgatttctccggtttggatccgactctaatccctagatttatccccaagaactcttcctcttcgaagattatcgggtgtcagagtccaaaatgtcagtttctatacggacccaatgttcaatgcagaggatgtgacccgaatacccgaaactgcaccgtcggttgtccaccgtacattcttcaatacggattaggatcaacggctggggttttaataaccgaaaagcttgatttcccggatctaaccgtacccgatttcgtagtcggatgttcaattatctccacccgacaacccgctggtatcgctgggtttgggcgaggacccgtatcgcttccttcacaaatgaatctcaagagattctctcactgtttggtttctcgtcggtttgacgataccaacgtaaccaccgatcttgatttagataccggatcgggtcataattccgggtctaaaactccgggtctcacatacacgccgtttcggaaaaatcccaatgtctccaacaaagcttttctcgagtattattacctcaatctccggcgaatctacgtcggaagaaagcacgtgaagattccgtataagtatctcgcgccgggaactaacggagacggaggatccattgttgattccggatctacattcactttcatggagcgacccgttttcgagctcgttgctgaagaattcgcttcacagatgtcgaactacactcgtgagaaagacttggagaaggaaacaggacttggaccgtgttttaatatctccgggaagggagatgtgacggtgccggagctgatttttgagtttaaaggtggagcgaagttggaattgccgttatccaattacttcacgttcgttgggaatactgataccgtttgtcttacggtggtttcggataaaaccgttaatccctccggcgggactggaccggcgataattctggggagtttccagcaacagaactatttagttgaatacgatttggagaatgacaggtttgggttcgcgaagaagaagtgtagcccgtga

SEQ ID NO: 730 - protein, 469 aa, Arabidopsis thaliana
MASSIFFFFLIFLSVVSAVKLPLSPFSHSDQSPKDPYLSLRRLAESSIARAHKLKHGTSIKPDEDALSSTTTASATVVKSPLSAKSYGGYSVSLSFGTPSQTIPFVFDTGSSLVWLPCTSRYLCSGCDFSGLDPTLIPRFIPKNSSSSKIIGCQSPKCQFLYGPNVQCRGCDPNTRNCTVGCPPYILQYGLGSTAGVLITEKLDFPDLTVPDFVVGCSIISTRQPAGIAGFGRGPVSLPSQMNLKRFSHCLVSRRFDDTNVTTDLDLDTGSGHNSGSKTPGLTYTPFRKNPNVSNKAFLEYYYLNLRRIYVGRKHVKIPYKYLAPGTNGDGGSIVDSGSTFTFMERPVFELVAEEFASQMSNYTREKDLEKETGLGPCFNISGKGDVTVPELIFEFKGGAKLELPLSNYFTFVGNTDTVCLTVVSDKTVNPSGGTGPAIILGSFQQQNYLVEYDLENDRFGFAKKKCSP

SEQ ID NO: 731 - DNA, 423 bp, Arabidopsis thaliana
atgggtaatcattttttaacgttatctctgcttctcgtaacagtctgcgtttgcgtttctttcatcaccacgaagctaaaccctaaagaagcaatcgtatctgtctcttccgattctgagattcctactgaaattcatggtgtcaagatcttgcgtcaagcttcagataccaaacttgctcaattaggcgttgcctcttggcccaagtgggaaggtgctccaagcaagtttccatgggagtttaagaagacagagacaatatatttcatggaagggaaagtgaaagtgaatgtagacggatacgacgaagaagaagaaacctttgagatagggaaaggagatgttgttgttttccctaaagatatgaaagttgtttgggagataactgaagctgtgaagaagcaatatagcttagaggagtag

SEQ ID NO: 732 - protein, 140 aa, Arabidopsis thaliana
MGNHFLTLSLLLVTVCVCVSFITTKLNPKEAIVSVSSDSEIPTEIHGVKILRQASDTKLAQLGVASWPKWEGAPSKFPWEFKKTETIYFMEGKVKVNVDGYDEEEETFEIGKGDVVVFPKDMKVVWEITEAVKKQYSLEE

SEQ ID NO: 733 - DNA, 1500 bp, Arabidopsis thaliana
atggatctcttattgattatagccggtttagtagcggctgcagccttctttttcctccgtagcacgaccaagaaatctctccggttacctccgggaccaaaaggtcttcctattataggaaaccttcaccagatggagaaattcaacccccaacacttccttttccgtctctccaagctatacggcccgattttcacgatgaaaatcggtggccgtcgcctcgcggtgatctcctcggccgagctagccaaggagctactcaaaactcaagacctcaacttcaccgctcgtcctctcttgaaagggcaacaaaccatgtcgtatcaaggccgtgagcttggtttcggacagtacaccgcgtactaccgtgagatgaggaagatgtgtatggtgaacctcttcagcccgaaccgtgtcgcaagtttcagaccggttagagaagaagagtgtcaacggatgatggacaagatctataaagccgctgatcaatcaggcaccgttgatctaagtgagcttctcttgtctttcactaactgtgtcgtatgtagacaagcttttgggaaacggtacaatgagtacggcacagagatgaagagattcatagatatcttgtacgagacgcaagcacttttgggcactctgtttttctccgaccttttcccttatttcggattccttgacaacctcactggtctcagtgcacgtctcaagaaagctttcaaggagcttgacacttaccttcaagaacttctagacgagactcttgaccctaaccgccctaaacaagaaacagagagtttcattgatcttttgatgcagatctacaaagaccaacctttctccatcaaattcactcacgaaaatgtcaaggccatgatattggatattgttgtgccgggaactgacacggcggctgcagtggtggtatgggccatgacttaccttattaagtaccctgaagcaatgaagaaagctcaagacgaagtgaggagtgtgataggtgacaaaggatatgtctctgaagaagacatacctaatctcccttacctaaaggcagtcatcaaggagtctcttcggctcgaaccagtcatccccattcttctacacagagaaactatcgcagacgcaaagataggtggctatgatattccggccaagaccatcattcaggtgaacgcatgggcggtttctcgtgacacagccgcgtggggagacaaccctaatgagttcattccagagaggttcatgaacgagcacaaaggagtggacttcaagggccaagattttgagctcctacctttcgggtcgggccggagaatgtgcccggccatgcatcttgggattgcaatggtagagatacctttcgctaaccttctctacaaatttgactggagtctacctaaagggattaaaccagaggatataaagatggacgtcatgactggactcgctatgcacaagaaagaacacctcgttcttgcaccaacgaaacacatctga

SEQ ID NO: 734 - protein, 499 aa, Arabidopsis thaliana
MDLLLIIAGLVAAAAFFFLRSTTKKSLRLPPGPKGLPIIGNLHQMEKFNPQHFLFRLSKLYGPIFTMKIGGRRLAVISSAELAKELLKTQDLNFTARPLLKGQQTMSYQGRELGFGQYTAYYREMRKMCMVNLFSPNRVASFRPVREEECQRMMDKIYKAADQSGTVDLSELLLSFTNCVVCRQAFGKRYNEYGTEMKRFIDILYETQALLGTLFFSDLFPYFGFLDNLTGLSARLKKAFKELDTYLQELLDETLDPNRPKQETESFIDLLMQIYKDQPFSIKFTHENVKAMILDIVVPGTDTAAAVVVWAMTYLIKYPEAMKKAQDEVRSVIGDKGYVSEEDIPNLPYLKAVIKESLRLEPVIPILLHRETIADAKIGGYDIPAKTIIQVNAWAVSRDTAAWGDNPNEFIPERFMNEHKGVDFKGQDFELLPFGSGRRMCPAMHLGIAMVEIPFANLLYKFDWSLPKGIKPEDIKMDVMTGLAMHKKEHLVLAPTKHI

SEQ ID NO: 735 - DNA, 567 bp, Arabidopsis thaliana
atgttagtttacggtatcctcaacgacgcctttcacggcggttgggagccgtcttcttcgtcttccgacgaagatcgtagctctttcccgagtgttaagatcgagactccggagagtttcgcggcggtggattctgttccggtcaagaaggagaagacgagtcctgtttcggcggcggtgacggcggcgaagggaaagcattatagaggagtgagacaaaggccgtgggggaaatttgcggcggagattagagacccggcgaagaacggagctagggtttggttaggaacgtttgagacggcggaggacgcggcgttggcttacgacagagctgctttcaggatgcgtggttcccgcgctttgttgaattttccgttgagagttaattcaggagaacccgacccggttcgaatcaagtccaagagatcttctttttcttcttctaacgagaacggagctccgaagaagaggagaacggtggccgccggtggtggaatggataagggattgacggtgaagtgcgaggttgttgaagtggcacgtggcgatcgtttattggttttataa

SEQ ID NO: 736 - protein, 188 aa, Arabidopsis thaliana
MLVYGILNDAFHGGWEPSSSSSDEDRSSFPSVKIETPESFAAVDSVPVKKEKTSPVSAAVTAAKGKHYRGVRQRPWGKFAAEIRDPAKNGARVWLGTFETAEDAALAYDRAAFRMRGSRALLNFPLRVNSGEPDPVRIKSKRSSFSSSNENGAPKKRRTVAAGGGMDKGLTVKCEVVEVARGDRLLVL

SEQ ID NO: 737 - DNA, 795 bp, Arabidopsis thaliana
atgacagacgacagagtttaccctgcatcaaaacctcccgccatcgtcggtggcggtgccccaaccaccaatccaactttcccggcgaacaaagctcagctctacaacgcaaatcgtcccgcttaccgtccaccagctggtcgtcgtcgtactagccatacccgtggatgttgctgccgttgctgttgctggacgatattcgtaatcatcctcttactcctcatcgtcgccgccgcatcagccgtcgtatacctaatctaccgtcctcaacgacctagcttcaccgtctctgaactcaaaatctccactctcaacttcacatccgccgttcgcctcaccaccgccatttccctctccgtcatcgccagaaaccctaacaaaaacgttggattcatctacgacgtcaccgacatcacactctacaaagcatccaccggaggagatgatgacgtagtcattggtaaaggaacgatcgcggcgttttctcacgggaagaagaacacgactacgcttagaagtacgatcggaagtcctccggatgaactcgatgagatctcggcgggtaagctgaaaggagatctgaaggcgaagaaagcagtggcgattaagattgttttgaactcgaaggtgaaagtgaagatgggagctctaaaaactcctaaatcaggaattagggttacttgtgaagggattaaagtggtggctccgacgggaaagaaggcgacgacggctacgacttccgccgctaagtgtaaggttgatccaagatttaagatctggaaaattactttctaa

SEQ ID NO: 738 - protein, 264 aa, Arabidopsis thaliana
MTDDRVYPASKPPAIVGGGAPTTNPTFPANKAQLYNANRPAYRPPAGRRRTSHTRGCCCRCCCWTIFVIILLLLIVAAASAVVYLIYRPQRPSFTVSELKISTLNFTSAVRLTTAISLSVIARNPNKNVGFIYDVTDITLYKASTGGDDDVVIGKGTIAAFSHGKKNTTTLRSTIGSPPDELDEISAGKLKGDLKAKKAVAIKIVLNSKVKVKMGALKTPKSGIRVTCEGIKVVAPTGKKATTATTSAAKCKVDPRFKIWKITF

SEQ ID NO: 739 - DNA, 822 bp, Arabidopsis thaliana; identical to SEQ ID NO: 443

SEQ ID NO: 740 - protein, 273 aa, Arabidopsis thaliana; identical to SEQ ID NO: 444

SEQ ID NO: 741 - DNA, 1884 bp, Arabidopsis thaliana
atgaagtataagcgtaagctaagtctctctgttgtcttcctctttgtcttctatctcgctgcggtgacttcagatctagagtctgaccggagagctttactcgctgttcgtaacagtgtccgtggccgtcctttgctatggaacatgagtgcttcttctccttgtaattggcacggagtccactgcgatgcgggtcgggtcacggctctccgattacccggatctggtttattcggttctttaccaatcggtggtattggtaatctaacccagcttaagactctttctctccggttcaattctctctctggtcctatcccttcggatttctccaaccttgttctcctccgttacttgtatcttcaaggtaatgccttttccggtgagattccgtcgcttctcttcacgcttccgagcataatcagaatcaatctaggggagaataaattctcgggtcggatcccggataatgtcaattctgcgacccggttggttactctgtatttggagaggaatcaactctctggtccgatccctgagatcacgcttcctcttcagcaattcaatgtttcttctaatcagttaaacgggtctattccgagttcgttgtcgtcttggcctcgaactgcttttgaaggtaacactctctgtgggaagcctttagacacttgtgaggcagagagccccaatggtggtgacgctggaggacccaatacgccgccggagaagaaagatagcgacaagttatccgccggagctattgtcgggattgtgatcggatgtgttgttggtctgttactgcttcttttgattctgttctgtctctgtagaaagagaaagaaagaagagaacgttccatctaggaatgttgaagctcctgtcgctgctgcgacttcctccgctgctataccaaaggaaacggtggttgttgtcccgccggctaaggctacggggtcggagagtggtgcggtgaataaagatttgacctttttcgtgaaatctttcggggaattcgatttggatggattgttgaaggcttcagctgaggttcttgggaaaggaacagttgggtcgtcgtataaggcaagctttgagcatgggttagtggtggctgtgaaacggttaagagatgttgtggtgcctgagaaagagttcagagagagattgcatgttttgggatcaatgagtcatgccaatctcgtgactctgatcgcttactatttcagccgtgacgagaagcttcttgtctttgagtacatgtctaaaggaagcttgtctgcgatattgcacgggaacaaaggaaacgggagaactccgttgaactgggaaaccagagccggtatagccttaggagctgcaagagcgattagctacctacattcgcgtgatgggacaacttctcatggaaacattaagtcctcgaacatactattatctgactcctatgaagctaaggtctctgattacggtcttgctcccatcattagttctacatctgcacctaaccgtattgatggctaccgtgcccctgaaatcactgatgctcgcaaaatatcccaaaaagctgatgtctatagctttggcgtcctaatccttgaattactcacaggtaagtctccaacgcatcagcagttgaatgaagaaggcgtagatttgccgagatgggtccaatctgttaccgagcaacaaacaccgtccgatgtgcttgatcccgagctcacaaggtaccaacctgagggcaatgagaacatcattcgtttattgaagatcggtatgagctgtacggctcagttcccagatagtcgtccttcgatggctgaagtcaccagactcattgaggaggtttctcattcatctggctccccaaatcctgtatccgactga

SEQ ID NO: 742 - protein, 627 aa, Arabidopsis thaliana
MKYKRKLSLSVVFLFVFYLAAVTSDLESDRRALLAVRNSVRGRPLLWNMSASSPCNWHGVHCDAGRVTALRLPGSGLFGSLPIGGIGNLTQLKTLSLRFNSLSGPIPSDFSNLVLLRYLYLQGNAFSGEIPSLLFTLPSIIRINLGENKFSGRIPDNVNSATRLVTLYLERNQLSGPIPEITLPLQQFNVSSNQLNGSIPSSLSSWPRTAFEGNTLCGKPLDTCEAESPNGGDAGGPNTPPEKKDSDKLSAGAIVGIVIGCVVGLLLLLLILFCLCRKRKKEENVPSRNVEAPVAAATSSAAIPKETVVVVPPAKATGSESGAVNKDLTFFVKSFGEFDLDGLLKASAEVLGKGTVGSSYKASFEHGLVVAVKRLRDVVVPEKEFRERLHVLGSMSHANLVTLIAYYFSRDEKLLVFEYMSKGSLSAILHGNKGNGRTPLNWETRAGIALGAARAISYLHSRDGTTSHGNIKSSNILLSDSYEAKVSDYGLAPIISSTSAPNRIDGYRAPEITDARKISQKADVYSFGVLILELLTGKSPTHQQLNEEGVDLPRWVQSVTEQQTPSDVLDPELTRYQPEGNENIIRLLKIGMSCTAQFPDSRPSMAEVTRLIEEVSHSSGSPNPVSD

SEQ ID NO: 743 - DNA, 1137 bp, Arabidopsis thaliana
atgaagattttcgtgaagactctcagtggttcgaacttcgagatcgaagtaaaacctgcagataaggtttctgatgttaaaacggctatagaaactgttaaaggtgcagaataccctgctgctaagcagatgctgatccaccaaggaaaggttctaaaggatgagaccacattggaagagaacaatgttgttgagaacagtttcattgttatcatgttgtccaagaccaaggcttctccaagtggggcatcaaccgcatctgcaccagcacctagtgctacacagccacagacagtagctacacctcaggtttctgctcctactgcctcagttccagttcctacaagtggaactgcaaccgctgcagctccagctactgctgcttcggttcagacagatgtgtatggtcaagcagcatcaaaccttgttgctggaactactttagagtccactgttcagcaaattcttgatatgggtggaggtagttgggaccgtgacactgttgttcgtgctctgagagctgcgttcaacaatcctgaaagagctgttgaatacctgtactcgggtatccctgctcaagctgaaatcccaccagttgctcaagccccagctactggggaacaggcagccaatcctctagcacagccccaacaagcagcagctccagcagctgcaactggtggtccaaacgcaaatccattaaacctgttcccccagggcatgcccgctgcagatgctggtgctggagctggtaatcttgatttcctgcgtaacagtcaacagttccaagccttgcgagctatggtacaagcaaacccacaaattctacagcctatgcttcaggagctcggtaaacaaaacccccagcttgtgcgactaattcaagagcaccaggctgacttcctacgcttgataaacgaacctgtcgagggagaagagaatgttatggaacagttggaagcagcaatgccacaagctgttaccgttacacctgaagagcgtgaagccattgaacggcttgaagggatggggtttgatcgtgcgatggtcttggaagtgttctttgcgtgtaacaagaatgaagaacttgcagctaattaccttctagatcacatgcatgagtttgaagatcaataa

SEQ ID NO: 744 - protein, 378 aa, Arabidopsis thaliana
MKIFVKTLSGSNFEIEVKPADKVSDVKTAIETVKGAEYPAAKQMLIHQGKVLKDETTLEENNVVENSFIVIMLSKTKASPSGASTASAPAPSATQPQTVATPQVSAPTASVPVPTSGTATAAAPATAASVQTDVYGQAASNLVAGTTLESTVQQILDMGGGSWDRDTVVRALRAAFNNPERAVEYLYSGIPAQAEIPPVAQAPATGEQAANPLAQPQQAAAPAAATGGPNANPLNLFPQGMPAADAGAGAGNLDFLRNSQQFQALRAMVQANPQILQPMLQELGKQNPQLVRLIQEHQADFLRLINEPVEGEENVMEQLEAAMPQAVTVTPEEREAIERLEGMGFDRAMVLEVFFACNKNEELAANYLLDHMHEFEDQ

SEQ ID NO: 745 - DNA, 651 bp, Arabidopsis thaliana
atggcggttgcgccggcaagagctcgttcagactatgattacctcatcaagcttcttctcatcggcgatagcggtgtggggaagagttgtttgttacttcgattctcagatgatactttcactacaagtttcattactaccattggtattgacttcaagataagaactgttgaacttgatgggaagcgtatcaaattgcagatttgggacactgctggtcaagaacgtttcagaactatcactacagcgtattacaggggagcgatgggtatattgcttgtctacgatgtaacggatgagtcatcttttaacaatattaggaactggatgaagaacattgagcaacatgcctcagataatgtcaacaaaatattggttggtaacaaagctgatatggatgaaagcaaaagggctgttccaacagcaaagggccaagctttggctgatgagtatggaatcaaattctttgagacgagtgcaaaaacaaacctcaatgtcgaaaatgttttcatgtcaatcgcaaaagacataaaacaaagattgacagaaaccgacacgaaggcagagccccaaggcatcaagatcactaaacaagatactgccgcatcgtcttctacagccgagaagtcagcttgctgtagttacgtttag

SEQ ID NO: 746 - protein, 216 aa, Arabidopsis thaliana
MAVAPARARSDYDYLIKLLLIGDSGVGKSCLLLRFSDDTFTTSFITTIGIDFKIRTVELDGKRIKLQIWDTAGQERFRTITTAYYRGAMGILLVYDVTDESSFNNIRNWMKNIEQHASDNVNKILVGNKADMDESKRAVPTAKGQALADEYGIKFFETSAKTNLNVENVFMSIAKDIKQRLTETDTKAEPQGIKITKQDTAASSSTAEKSACCSYV

SEQ ID NO: 747 - DNA, 2664 bp, Arabidopsis thaliana
atggaaacgacagatagcatgaccgataagaaaagtgttgaagacgcggaaaatgtgcctgagcatgcgactgagtccatgcatgtttctcaaaacaacgtgaatgatacttctacagctttggctattgaacacgatcatagagatggcacaatcactgctagtgccaataagattacagatacggttgacgagaaaggtgacaaagatgaggattataaggagaaccttcatggagtgaagttggaagaaactctttatccagatgttcctgaacggttggaagagcttaaggaagtgaagggtaatgatggtgatgccaacaaagcggaagttgaaggcccggaatgtgttgaggaaaatgctctagctaatagaacgcctgcagaatacattagcagtgtatcggatagctccgtccacaaatgcaaggataaaggcaaaaattctgatgtccctcttacacatttagttggaaatgctctcttttctgaaagcaagactgaggatcttcatgacaaggataaagatgaaaaagatgacaacttcggaggaccgagtatcagagggtttgaactgttctctagttctccggttaggagagcaaaaaaaactgagcagtcaggtgtcaataagcacaaggatgagaagttgttgttggagccactggatctgtcacttagcctaccagatgtattgttgccgattggtggccaggatactaatcagctggggtcaccagtccgttctggaagtgttcggtctttgacagacacgttttgtaccaattctgatggctttacaatgtctatgtccttttcaggttcccgttcgttcaatcataatccaagctgttcgctgagtcacaatattggagacaatgagcagtcagttcatagccgacctatatttcagggtatagattggcaggcactgtctcataatgattcaaagtacaatgagaatacagtctatcaaagactgatggaaaatggaaatggttcagttcaacctcgagcaatgaaaggcaatttaatttcgggtcaagctgatgaagagcatcttagattgcccgatgggagctctaaggcagcaaatatacttgagaaacaattgagtttccagaaaagtgttgatgttagatcagcatgtccaagaacgggctctcttgaaaatggttcaaagtttactgttgagaagaaaacggccaaggacttttacagtggtagtaattcgtggataactgggctggaagccggtgggcatgattttgttgagaccgtcatcagatacattctctccgattcgatgcctgtaatgaccaagagatttcatgaaatgcccactcgaaacatcactagcctgaaggaaaacattcggcagatgatgctgaacatggataagaatgtacaacttggtgcttttcaagatgctttgcagaacaggactgatataacactggaattgcttacaaaatctcatcgcgctcagttggagatcttggtcgcactgaaatctgggcgttctgatttccttcttttggacaacagcatctcgtcttcccatttagctgagattttcatgaacatgagatgcaaaaatctttcttgtagggttctgttgcctgtggacgaatgcgattgcagggtttgttcaaggaaggatggattttgtagtgcttgcatgtgtcttgtgtgctcaaattttgatatggcatccaacacctgtagctgggttgggtgtgatgtgtgcctacactggtgccacacagattgtgggataaaagagtcttacatccggaatgggatcaatgcttctggtgctccaggaatgaccgagatgcaatttcactgtgttgcctgtaaccatccctcagagatgtttggctttgtcaaagaagtgtttctgaattttgcaagggaatggaaatttgagcgcttttgcaaggaactggagtatgtcaataaaatattttcatcaagcaaagactctagagggaaacagctgagacaagctgctgatgcgatgctggcaagtttgaaaagtaaattgataggccttcctgaagcttgcaatcgcatattgggtttcatttcagactgtgattcctccactcctgctgaaactagtgcaccgttcatatacgaacagccaaaacccaggcatgagaggggaagccctagtcaggacacggcgtggctgagatcggtgtgctcagataacccgcataatcagctgaaaaggtcagcgagcgtagctgatgcattccacagagagaggcaagttgaaatatgtgcagtggagatggagttggaaaggggttcaccaaaggaacctcgtttcgaagagctagagagcattgtgagaatgaagcaagcagaggcagaaatgttccaagggcgggccgatgatgcacgaagagaagcagagggactgaaacgaatagcaatagcgaagaaggagaagatagaagaagagtacaatcggagaatggggaagttgagtatggaggatgcacaggagagaaggaggaggaggtacgaggagttagaggcaatgcagagagggcagagagagttttatgaaatgaagatgagaatggaggaagagatgagagggcttctcaccaaaatggaaatgacgaagcagagtctggccttgtaa

SEQ ID NO: 748 - protein, 887 aa, Arabidopsis thaliana
METTDSMTDKKSVEDAENVPEHATESMHVSQNNVNDTSTALAIEHDHRDGTITASANKITDTVDEKGDKDEDYKENLHGVKLEETLYPDVPERLEELKEVKGNDGDANKAEVEGPECVEENALANRTPAEYISSVSDSSVHKCKDKGKNSDVPLTHLVGNALFSESKTEDLHDKDKDEKDDNFGGPSIRGFELFSSSPVRRAKKTEQSGVNKHKDEKLLLEPLDLSLSLPDVLLPIGGQDTNQLGSPVRSGSVRSLTDTFCTNSDGFTMSMSFSGSRSFNHNPSCSLSHNIGDNEQSVHSRPIFQGIDWQALSHNDSKYNENTVYQRLMENGNGSVQPRAMKGNLISGQADEEHLRLPDGSSKAANILEKQLSFQKSVDVRSACPRTGSLENGSKFTVEKKTAKDFYSGSNSWITGLEAGGHDFVETVIRYILSDSMPVMTKRFHEMPTRNITSLKENIRQMMLNMDKNVQLGAFQDALQNRTDITLELLTKSHRAQLEILVALKSGRSDFLLLDNSISSSHLAEIFMNMRCKNLSCRVLLPVDECDCRVCSRKDGFCSACMCLVCSNFDMASNTCSWVGCDVCLHWCHTDCGIKESYIRNGINASGAPGMTEMQFHCVACNHPSEMFGFVKEVFLNFAREWKFERFCKELEYVNKIFSSSKDSRGKQLRQAADAMLASLKSKLIGLPEACNRILGFISDCDSSTPAETSAPFIYEQPKPRHERGSPSQDTAWLRSVCSDNPHNQLKRSASVADAFHRERQVEICAVEMELERGSPKEPRFEELESIVRMKQAEAEMFQGRADDARREAEGLKRIAIAKKEKIEEEYNRRMGKLSMEDAQERRRRRYEELEAMQRGQREFYEMKMRMEEEMRGLLTKMEMTKQSLAL

SEQ ID NO: 749 - DNA, 888 bp, Arabidopsis thaliana
atggcggtttctcaccgtctcctcaggccggcgacgacgacgataaagaatactttttcttctctctttattaggtctctctcttcttcttcgtctgggtcctcgctagaccccaaaatcgatctggaggaggctgcggctcagctcgggaagtcttcgtctacgtcaacgtctccatacaaaggcagaaatttccactgggtgtttcttggatgtcctggtgttggtaaaggaacctatgcctctcgtctctcttctctcctcggcgttcctcatattgccactggtgatctcgttcgtgaagagctctcctcctctggcctcctctcctctcagctcaaggagcttgttaaccatggaaaactagttcctgatgaattcataataagtttgttatcaaagcgtctccaagctggcaaagacaagggtgaatctggatacattcttgatggttttccacgcaccgtgactcaagcggaaatactggagggagtaactaatatcgatctggtgattaacctgaagctacgagaagaggcattgcttgcgaaatgtttaggaagaagaatttgcagcgagtgtggtggaaactataacgttgcctgcattgatatcaaaggtgatgatgatactcccagaatgtatatgcctcctcttcttcctccgccaaactgtgaatcgaagcttataagccgagctgatgacactgaagaagttgtcaaggaaagactcaggatttacaacaaaatgactcaaccagtggaggaattctacaagaaacgcgggaagctgttggaatttgaattgcccggtggaatcccagagtcatgggcaaggctccttagggcattacaccttgaagacgataaacagtctgcaatagcctaa

SEQ ID NO: 750 - protein, 295 aa, Arabidopsis thaliana
MAVSHRLLRPATTTIKNTFSSLFIRSLSSSSSGSSLDPKIDLEEAAAQLGKSSSTSTSPYKGRNFHWVFLGCPGVGKGTYASRLSSLLGVPHIATGDLVREELSSSGLLSSQLKELVNHGKLVPDEFIISLLSKRLQAGKDKGESGYILDGFPRTVTQAEILEGVTNIDLVINLKLREEALLAKCLGRRICSECGGNYNVACIDIKGDDDTPRMYMPPLLPPPNCESKLISRADDTEEVVKERLRIYNKMTQPVEEFYKKRGKLLEFELPGGIPESWARLLRALHLEDDKQSAIA

SEQ ID NO: 751 - DNA, 1470 bp, Arabidopsis thaliana
atgggacctcgttgctctaagctctctctctgttggtggccgacccatctcaaatcaactcacaacgaagcttctgatctagataacggaacggacgatttgccgtcgtttacggagtttagtttcgaccaactacgagctgctacttgtggattctctacagacagtattgtctccgaacatggtgttaaagctcctaatgttgtgtataaaggcagacttgaagatgaccgatggatcgctgttaaacgattcaatagatccgcttggcctgatactcgtcaatttcttgaagaagcaaaagctgtggggcagttgaggaatgagaggttggcgaatttgattggattctgttgtgaaggagacgagagattgctcgttgctgagtttatgccttttgaaactctctcgaagcatctctttcactgggatagtcagccaatgaagtggtctatgaggttgagagtggctttgtatcttgcacaagcacttgagtattgtagcagcaaaggtcgcgccttgtaccacgatcttaatgcttacaggatcttgtttgaccaggatggtaacccgagattatcttgctttggtcttatgaagaatagtagggatgggaagagttacagtacaaatttggctttcacacctcctgaatacctaagaacagggagagtgattccggagagtgtggtctacagcttcggaacgctgttgctagatcttctcagcggcaaacacataccaccaagccatgcgcttgatctgattcgtgggaagaatttcctgatgctgatggactcgtgtctagatggccatttctcaaacgatgatggaaccgatttggttcgtttagcttcccgttgtttgcagtatgaagctcgtgaaaggccaaatgtgaaatctctcgtgtcctcactcgctcctcttcagaaagaaactgatattccgtctcatgttttaatggggattccacatggagctgcttctccaaaggaaacaacttcgcttacccctcttggtgacgcttgttcacgacatgatctcacagcaatacatgaaattctcgaaaaggttggatacaaagatgacgagggtgtagcaaatgagctctcgttccaagtgtggaccgaccagattcaggagactctaaactccaagaaacaaggagatgctgcgttcaaaggcaaagactttgtcactgctgttgaatgttacacgcagttcatcgaagatggcacaatggtatcgccaacagtttttgcaaggaggtgtttgtgttatctgatgagcaatatgcctcaagaggctcttggtgatgcaatgcaggcgcaagtagtgtctcctgaatggccaacggctttctatcttcaggccgctgctctcttcagccttggaatggataaagacgcctgtgaaaccctaaaagatggaacttccttggaagccaagaaacataacaacagaaactga

SEQ ID NO: 752 - protein, 489 aa, Arabidopsis thaliana
MGPRCSKLSLCWWPTHLKSTHNEASDLDNGTDDLPSFTEFSFDQLRAATCGFSTDSIVSEHGVKAPNVVYKGRLEDDRWIAVKRFNRSAWPDTRQFLEEAKAVGQLRNERLANLIGFCCEGDERLLVAEFMPFETLSKHLFHWDSQPMKWSMRLRVALYLAQALEYCSSKGRALYHDLNAYRILFDQDGNPRLSCFGLMKNSRDGKSYSTNLAFTPPEYLRTGRVIPESVVYSFGTLLLDLLSGKHIPPSHALDLIRGKNFLMLMDSCLDGHFSNDDGTDLVRLASRCLQYEARERPNVKSLVSSLAPLQKETDIPSHVLMGIPHGAASPKETTSLTPLGDACSRHDLTAIHEILEKVGYKDDEGVANELSFQVWTDQIQETLNSKKQGDAAFKGKDFVTAVECYTQFIEDGTMVSPTVFARRCLCYLMSNMPQEALGDAMQAQVVSPEWPTAFYLQAAALFSLGMDKDACETLKDGTSLEAKKHNNRN

SEQ ID NO: 753 - DNA, 864 bp, Arabidopsis thaliana
atgggaagagaagttgttgaggtgcttatggaccgaaacgccgacgtttcaagcgctagagttcatgttgctcctaagatagctgcagaggagactgatgaggaatttgaagtcaaagaatgcacagaggagaagtctctttctgagaatgcaccaaatgttggatctgctgagagagttggagctcagaaatcacctaaaacccgtaatggaaatgctaaagtttcaaagcagcaggatgctcctcttctcgcggtgaggaagccattgcaacccgagaacaagaagcatattgatgacgaagataattgctccattgcttcttccgttgcaacttccatgaggatgggtaagtctggattgacttatggaagtgctccaacgtttaggagtgctcaacgtgctgagaaacgcaaggagtattaccaaaagctcgaggagaaaaaccaagcgcttgaagctgagaggaacgagcttgaacagaggcaaaaggatgaacaagaagcagccttgaagcaacttagaaagaatctcaagttcaaggctaaacccgtccccaacttctactacgaggcacctcctgcgaaacctgagctcaagaagcttcctttgacacgtcccaagtcgccaaaactgatcctttctcggagaaaaagcttcagcgacgcagtcagctcgtcttcccgtgaagagattctgaagacagtctctaaccggaaccgacacagcactggaacagttcagaacaaagacgatgatcacaggaacaagaacaccaatgctgcgcacgacagccctcgtgtcagatcaggcaaaggtaaatccggattgaaaccagtgaacgagtcctcagaagaagcttga

SEQ ID NO: 754 - protein, 287 aa, Arabidopsis thaliana
MGREVVEVLMDRNADVSSARVHVAPKIAAEETDEEFEVKECTEEKSLSENAPNVGSAERVGAQKSPKTRNGNAKVSKQQDAPLLAVRKPLQPENKKHIDDEDNCSIASSVATSMRMGKSGLTYGSAPTFRSAQRAEKRKEYYQKLEEKNQALEAERNELEQRQKDEQEAALKQLRKNLKFKAKPVPNFYYEAPPAKPELKKLPLTRPKSPKLILSRRKSFSDAVSSSSREEILKTVSNRNRHSTGTVQNKDDDHRNKNTNAAHDSPRVRSGKGKSGLKPVNESSEEA

SEQ ID NO: 755 - DNA, 780 bp, Arabidopsis thaliana
atggaccggaggctcaagaaatgctcgacatccaccgatgttgaatcagttcatgatgttagtaaggtcacggatcctttgcagaaagctaagagagagttggataatgtggaaatcaaagaaaaacagaagaagcagaagaaccaaaatgaaacatctgagaaggaaactaaaaaattcagcaccgtttacgaaaagtttaatgatactattaaagaactagacagggtttctggaacatgtcccatacgacctgccattccattcacgcccccaaaggaaaaggtggaaccgatatatcacaatgagtgcaatttcgatgataaagctcatctgggagtatctgacagcgccctttttgtacaaggatttgatacttcccatccaaggcatgaaatcaagacagcattgtggaatcatttctcttcatgtggtaaggtctatctgatttatgttcccattgcgtgttctaccggtgcttcggtgggatatgctttcattgatatgaaaaatgaaaccaaggggttgacactcaatggaagtcatttgggaggacggaagatcgatgttatgttcgccatagatagagaagagttttacttctcttctaacttaaaacactgtcaacgctgccgtaattataggccatggcttgttttaaaagccatgtcagatgcctgctttgaatatcaccagaggattaaaccgcggatcgttggcactccccatagcaagattggtcgttttacagccattattggtcgtcgctcttacagctag

SEQ ID NO: 756 - protein, 259 aa, Arabidopsis thaliana
MDRRLKKCSTSTDVESVHDVSKVTDPLQKAKRELDNVEIKEKQKKQKNQNETSEKETKKFSTVYEKFNDTIKELDRVSGTCPIRPAIPFTPPKEKVEPIYHNECNFDDKAHLGVSDSALFVQGFDTSHPRHEIKTALWNHFSSCGKVYLIYVPIACSTGASVGYAFIDMKNETKGLTLNGSHLGGRKIDVMFAIDREEFYFSSNLKHCQRCRNYRPWLVLKAMSDACFEYHQRIKPRIVGTPHSKIGRFTAIIGRRSYS

SEQ ID NO: 757 - DNA, 2433 bp, Arabidopsis thaliana
atggcgcagcatctgttgcacgggactttacatgctaccatctatgaagttgatgccctccatggtggtggtgttaggcaaggcttccttggcaagattctggcaaatgtagaagagacgattggtgttggtaaaggagaaacacagttgtatgcgacgattgatctgcaaaaagctagagttgggagaaccaggaagatcaaaaatgaacctaagaacccaaagtggtatgagtcgtttcatatttactgtgctcacttggcttctgatatcatcttcactgttaaagatgataatcccattggagctacccttatcggaagagcttacattcctgttgatcaagtcattaacggcgaggaagtggatcagtgggttgagatcttggataatgacagaaaccctattcagggaggatcaaagattcatgtcaagcttcaatatttccatgttgaggaggatcgtaactggaacatgggtatcaaaagtgccaagttccctggagtgccatacacattcttctcgcagagacaaggctgcaaagtttctctgtaccaagatgctcatattccagacaactttgtccctagaattcctctcgctggagggaagaactatgagcctcaaagatgttgggaggatatttttgatgctattagcaatgcaaaacacttgatctacattactggttggtctgtttacgctgagattgctttagtgagggactcgaggaggcctaagcctggaggtgatgtgaccattggtgagctactcaagaagaaggctagtgaaggtgtcagggttcttttgcttgtttgggatgacagaacttctgttgatgtgctgaagaaagatgggctcatggctactcatgatgaagagaccgagaatttcttcaggggaagtgatgtccattgtattctgtgccctcgtaacccggatgacggtggtagcatagtccaaagtttgcagatctctactatgttcacgcatcatcagaaaatcgttgttgtggacagcgagatgccaagcagaggaggatcagaaatgaggagaattgtgagttttgttggcggtattgatctttgtgatggaagatacgacactccgttccactccttgttcaggacattggacacagtccaccatgatgacttccatcaacctaacttcactggtgctgctatcactaaaggtggtccaagggagccttggcatgacattcactcccgtcttgaaggtccaattgcttgggatgtcatgtacaacttcgagcagagatggagcaagcagggtggtaaagacattctggttaagttgagagatcttagtgatattattatcaccccttctcctgttatgttccaagaggaccacgatgtgtggaatgtccaattgtttaggtccattgatggaggagctgctgctgggtttcccgagtcgcctgaagctgctgcggaagccgggcttgtaagtgggaaagataacatcattgataggagtatccaagatgcttacattcatgcaatcagacgtgctaaggatttcatctacgttgaaaaccagtacttccttgggagttcttttgcttgggcagccgatggtattactcctgaggacatcaatgccctgcacttaatcccaaaagagttgtcgctgaagatagttagcaagattgagaaaggagagaagttcagggtctatgttgtggttccaatgtggccagaaggtctcccagagagtggatcagtgcaagctatattagactggcagaggaggaccatggagatgatgtacaaggatgtgattcaggctctcagggcccagggtcttgaggaagatccaagaaactatctgacattcttctgtcttggaaaccgtgaggtcaagaaagatggagagtatgagcctgctgagaaaccagaccccgacactgattacatgagggcgcaagaagcacgccgtttcatgatttacgtccacaccaaaatgatgatcgttgacgatgaatacattatcattgggtctgctaacatcaaccagaggtcaatggacggtgcaagagactctgagatagcaatgggaggttatcaaccacatcacttgtcccatagacaaccagctcgtggccagatccatgggtttcgtatgtcactctggtacgaacacctgggaatgctcgatgaaaccttcctcgatccatcaagcttggaatgcattgagaaagttaaccgcatttctgacaagtattgggacttttactcaagtgagtcactcgaacatgaccttcctggtcacttgctccgctacccgatcggtgtagccagcgaaggcgacatcactgagcttccaggatttgaattcttcccggacacaaaggcccgtatcctcggcaccaaatcagactacctgcctccaatccttacaacctaa

SEQ ID NO: 758 - protein, 810 aa, Arabidopsis thaliana
MAQHLLHGTLHATIYEVDALHGGGVRQGFLGKILANVEETIGVGKGETQLYATIDLQKARVGRTRKIKNEPKNPKWYESFHIYCAHLASDIIFTVKDDNPIGATLIGRAYIPVDQVINGEEVDQWVEILDNDRNPIQGGSKIHVKLQYFHVEEDRNWNMGIKSAKFPGVPYTFFSQRQGCKVSLYQDAHIPDNFVPRIPLAGGKNYEPQRCWEDIFDAISNAKHLIYITGWSVYAEIALVRDSRRPKPGGDVTIGELLKKKASEGVRVLLLVWDDRTSVDVLKKDGLMATHDEETENFFRGSDVHCILCPRNPDDGGSIVQSLQISTMFTHHQKIVVVDSEMPSRGGSEMRRIVSFVGGIDLCDGRYDTPFHSLFRTLDTVHHDDFHQPNFTGAAITKGGPREPWHDIHSRLEGPIAWDVMYNFEQRWSKQGGKDILVKLRDLSDIIITPSPVMFQEDHDVWNVQLFRSIDGGAAAGFPESPEAAAEAGLVSGKDNIIDRSIQDAYIHAIRRAKDFIYVENQYFLGSSFAWAADGITPEDINALHLIPKELSLKIVSKIEKGEKFRVYVVVPMWPEGLPESGSVQAILDWQRRTMEMMYKDVIQALRAQGLEEDPRNYLTFFCLGNREVKKDGEYEPAEKPDPDTDYMRAQEARRFMIYVHTKMMIVDDEYIIIGSANINQRSMDGARDSEIAMGGYQPHHLSHRQPARGQIHGFRMSLWYEHLGMLDETFLDPSSLECIEKVNRISDKYWDFYSSESLEHDLPGHLLRYPIGVASEGDITELPGFEFFPDTKARILGTKSDYLPPILTT

SEQ ID NO: 759 - DNA, 1599 bp, Arabidopsis thaliana
atgtcactgagacccaacgctaagacggaggttcgccggaaccgatacaaagttgcagtggatgcggaggaaggacgacggaggagagaagacaacatggttgagatccgtaaaagcaagcgtgaggagagtttgatgaagaagagacgtgaaggtatgcaagctcttcagggtttcccttcagcttccgccgcctccgtcgataagaagttggatagtctgaaggatatggtcgctggggtttggtccgatgaccctgccttgcagcttgagtccactactcagttcaggaagcttctctctattgagagaagtcctccaatcgaggaagtgataagtgctggtgttgttcctaggtttgttgagtttcttaagaaagaagattaccccgccattcagtttgaggcagcttgggctctaacaaacattgcatctggaacatcggatcacactaaggttgtaatcgatcacaatgctgttccaatctttgttcagcttcttgcttcccctagcgatgatgttcgtgaacaggctgtatgggctttgggtaacgttgctggtgattcaccacggtgccgtgatcttgttcttggatgtggggcactgcttccgctgctcaatcagcttaatgagcatgctaaattgtccatgcttcgaaatgccacttggaccttgtcaaacttctgtcgtggcaagcctcagcctcactttgaccaggtcaaacctgctcttcccgcccttgaacgactaattcattcagatgatgaagaagtcttgacagatgcctgttgggctctttcttacctctctgatgggaccaatgacaaaatccagactgtcatccaggccggtgttgtcccaaaacttgttgaacttctcctccatcattctccatctgtgctaattcctgctcttcgcactgttggaaatatagttactggagatgatatacaaacacagtgcgtgatcaatagtggtgctctaccttgtcttgccaacctgctcactcaaaaccataagaaaagcataaagaaggaagcttgctggacgatttcaaacatcacagcaggcaacaaagatcagatccagacggtagttgaggctaatttgatttccccgttggtgagtctgcttcaaaatgctgaatttgacattaagaaggaagctgcatgggcaatttcaaatgcaacttcaggtggttctcatgatcaaataaaatacctggtggagcaagggtgcataaaaccattatgcgatctcctggtttgcccagatccaagaatcataactgtctgccttgaaggattggaaaacattttgaaggtgggagaggcagagaagaacttgggtcacacaggagacatgaactattacgctcagctgattgatgatgcagaagggctagaaaagatcgagaaccttcagagccatgacaacaatgagatctatgagaaggctgttaaaattctggagacatactggcttgaagaggaagatgatgagacacagcaacctccaggtgttgatggttctcaggctgggttccagtttggagggaatcaagctccagtaccatccggaggattcaacttcagctga

SEQ ID NO: 760 - protein, 532 aa, Arabidopsis thaliana
MSLRPNAKTEVRRNRYKVAVDAEEGRRRREDNMVEIRKSKREESLMKKRREGMQALQGFPSASAASVDKKLDSLKDMVAGVWSDDPALQLESTTQFRKLLSIERSPPIEEVISAGVVPRFVEFLKKEDYPAIQFEAAWALTNIASGTSDHTKVVIDHNAVPIFVQLLASPSDDVREQAVWALGNVAGDSPRCRDLVLGCGALLPLLNQLNEHAKLSMLRNATWTLSNFCRGKPQPHFDQVKPALPALERLIHSDDEEVLTDACWALSYLSDGTNDKIQTVIQAGVVPKLVELLLHHSPSVLIPALRTVGNIVTGDDIQTQCVINSGALPCLANLLTQNHKKSIKKEACWTISNITAGNKDQIQTVVEANLISPLVSLLQNAEFDIKKEAAWAISNATSGGSHDQIKYLVEQGCIKPLCDLLVCPDPRIITVCLEGLENILKVGEAEKNLGHTGDMNYYAQLIDDAEGLEKIENLQSHDNNEIYEKAVKILETYWLEEEDDETQQPPGVDGSQAGFQFGGNQAPVPSGGFNFS

SEQ ID NO: 761 - DNA, 1128 bp, Arabidopsis thaliana
atggagggagcgggagagacgacgacgtcggaggggcatttgacttcggcagcagcttttgtggaagggggaattcaagatgcttgtgatgatgcttgtagcatttgtcttgaatccttctgcgaaagcgatccttctactttgactagttgcaagcatgagtatcatcttcaatgcattcttgagtggtgtcaaagaagctcacagtgccctatgtgttggcaatcaattagtctcaaagaccccacaagtcaggagttgcttgaggctgtggaacaggagaggaatttccgcttcaatccaactagaaatgccaccatatttcgtcatccaactcttggtgattttgaattacaacatcttccagtgggggtggataatgctgagattgaagaacgaatcattcagcacttggctgctgctgctgctatgggacgagcaagacatggggtaagaagggaaggccacagaagcaggtcgtcaagtcaaggacatcaacagttcatggtgttctcttcgcaacctaatgcttcttctcctccacctcatcctcccatgccttcttctccatctcagagagatgagagtgacacagtgtcaaaccttcctcacaatgctttaggggagggttctcatcagtcaaacacgcagccaccaacttcttctcatccccgccaggtttctccctcagcatctgattcaaacagcaggcctcttaatcaatcttccccaagtgaacaagatagagctggaccatcagaactccagtcattttcggaatcacttaagtctcgattaaacgctgtctccacgagatacaaagaatcgatatcaaagaatacaaggaactggaaagatagacttttttctcgcaacacgtccatggcagatcttggctctgaggttaaaagagaggtcagtgccggaatcgccactgtgtcccgcatgatggaacgtttagaaacgagagaaaacagtagacccagcactgcatctgtatcagatgtctctgaaaatcacactcctgaaacaaacaatgagcacaatagagcagcagcgggtgatgaacattctgtgaatgaaagaggtgttaaagaaacatgtgcgactggttctggttcaagctaa

SEQ ID NO: 762 - protein, 375 aa, Arabidopsis thaliana
MEGAGETTTSEGHLTSAAAFVEGGIQDACDDACSICLESFCESDPSTLTSCKHEYHLQCILEWCQRSSQCPMCWQSISLKDPTSQELLEAVEQERNFRFNPTRNATIFRHPTLGDFELQHLPVGVDNAEIEERIIQHLAAAAAMGRARHGVRREGHRSRSSSQGHQQFMVFSSQPNASSPPPHPPMPSSPSQRDESDTVSNLPHNALGEGSHQSNTQPPTSSHPRQVSPSASDSNSRPLNQSSPSEQDRAGPSELQSFSESLKSRLNAVSTRYKESISKNTRNWKDRLFSRNTSMADLGSEVKREVSAGIATVSRMMERLETRENSRPSTASVSDVSENHTPETNNEHNRAAAGDEHSVNERGVKETCATGSGSS

SEQ ID NO: 763 - DNA, 939 bp, Arabidopsis thaliana
atgaaggagagggaaagtgtacaagatcagtctgatccgagtgagacagactctgaggagctattgcagttagatggaaagagtatatctgagtgggtgagtgaaatagatgcaatttccaaagaagtagaggcagagttagtctcacgagatatcggctgtcacttggttcaagttcttgaagctgtaaatacagttctcttcgatctgagaggcttcaagaggacatctattactttagacccggagaattcctaccttcactctgtacttaactgtagatgcagcactgcgtttctgattagtgtaatatacattgaagtttgtaagcgcctgaatgtaccaattgttggatctccagttggggaagattttctgatttggcctaaaacggagtatcctgaggaactctttaaagcaacttcaggacagagcttgttctctattgtcaatggaaggtgtgttgatgatcctggatcaatggcatcagacttaactgcaaaatcacttcaagacctcgacatggcaacaaacagagacattatagggattgctctagccaatttgattaggcttcactggagacgtgcttctaagtcatcccatggacttatgctgacttctcctcttagtcaacttaacaacatcagtagttctaatttcccattgttgcggcctcaagatcttaggttggctattgcggctgcagaaaggttgttgattttgcaacctcataactgggcacttcgcagagaccttggtatgatgctgtactacgacaggcaatatggagaggcggtacaagagctgagcatatgtatggcatttgctcctcctgaagaagaagctgtgttggagccatttgtagaaagacttcatctccttcgtctcatatcttcattgaagcctcttggttctgatcgcttgaccgttccttga

SEQ ID NO: 764 - protein, 312 aa, Arabidopsis thaliana
MKERESVQDQSDPSETDSEELLQLDGKSISEWVSEIDAISKEVEAELVSRDIGCHLVQVLEAVNTVLFDLRGFKRTSITLDPENSYLHSVLNCRCSTAFLISVIYIEVCKRLNVPIVGSPVGEDFLIWPKTEYPEELFKATSGQSLFSIVNGRCVDDPGSMASDLTAKSLQDLDMATNRDIIGIALANLIRLHWRRASKSSHGLMLTSPLSQLNNISSSNFPLLRPQDLRLAIAAAERLLILQPHNWALRRDLGMMLYYDRQYGEAVQELSICMAFAPPEEEAVLEPFVERLHLLRLISSLKPLGSDRLTVP

SEQ ID NO: 765 - DNA, 1134 bp, Arabidopsis thaliana
atgagaatcagaaaaggaagtagagttgaggtatttagcaacaaagaggcgccttatggtgcgtggcgatgtgctgagattgtctcgggtaatggacatacctacaatgttagattttactctttccaaattgaacacgaggaggcagttatggagaaagttccaaggaagataattaggccttgtcctccacttgtggatgttgagagatgggatactggtgaattggtggaagttcttgataatttttcctggaaagctgccacagttcgagaggagttatctggacattactatgtggttcgcttacttgggactccagaagaactcacatttcacaaagttaacctcagggcccgaaagtcgtggcaagatgagagatgggttgcaattggaaagatatctggttctctgaagtcatccacactgactggatcagacgtacatcagaagctacagccccacaggaacagcatgcctctccacgagcctagcgtggtctctgctagattgttaaagaggccgtcaccttacaactggtctgaatgtgctgaatcatgtacaggaaaccctaagaagatgcgttcattggaaaaagaaggacagcagcaaaaggtagatgccatttcttgccgaccagaaaacaggggtggtaaatctcacgtgcaagcttccttaaacaatcacaaaactggttactgtcaaattgtcagggtaagatcaaaagggtttagtgagagtgttcgtgctgatgattgttctgatagcgatgtatgctcagttggtagttgtagtgctactagttatgatgagagtaacatgccaccttgtatgctagatggctctactcaacaggcagactcatgtagcagcgatgctgaatcttcttgtggcctgggggaagaaccaaggtggaaacattcatcagttggtgatggagcaagaaattcttgtaggtcggaactatattcttaccgcagtactctgggggaattattttcttctggtcccctaagttgggagcaagaagcatcattaactgatcttcgtctttctcttaatatatcagatgatgaacatttgatggaggtaagaaatttgatatctactggtacccgcagtcaattttgttag

SEQ ID NO: 766 - protein, 377 aa, Arabidopsis thaliana
MRIRKGSRVEVFSNKEAPYGAWRCAEIVSGNGHTYNVRFYSFQIEHEEAVMEKVPRKIIRPCPPLVDVERWDTGELVEVLDNFSWKAATVREELSGHYYVVRLLGTPEELTFHKVNLRARKSWQDERWVAIGKISGSLKSSTLTGSDVHQKLQPHRNSMPLHEPSVVSARLLKRPSPYNWSECAESCTGNPKKMRSLEKEGQQQKVDAISCRPENRGGKSHVQASLNNHKTGYCQIVRVRSKGFSESVRADDCSDSDVCSVGSCSATSYDESNMPPCMLDGSTQQADSCSSDAESSCGLGEEPRWKHSSVGDGARNSCRSELYSYRSTLGELFSSGPLSWEQEASLTDLRLSLNISDDEHLMEVRNLISTGTRSQFC

SEQ ID NO: 767 - DNA, 870 bp, Arabidopsis thaliana
atgaccggtagagaaatcctccacaagatgaaggaatccgtcaaggagaaagttgggcttggtgcatctgcttcatctgcagattcagggaaaggtaagagcaagatgttgaagcagatcacacatggttttcatttggtgaaagggaaagcttttcacgagatggaagattatgtggttgccaaattcaaggaagttgatgataatgagcttggtctgtttgctatcttcgatggccatcttagccacgagattccggactacttgtgctcccatttgtttgagaacatcttgaaagagccgaatttctggcaagaacctgagaaagcgataaagaaagcttactatataacggatacaacgattctagacaaggcagatgatttgggaaaaggaggttctactgctgtgactgcgatattgatcaattgccagaagctggtggttgctaatgttggtgactctcgagctgttatttgccaaaatggtgttgcgaagccactctcagttgatcatgagccgaacatggagaaggatgaaatcgagaacagaggaggattcgtttctaactttcctggggatgttcctcgagttgatggtcaactggctgtggcaagggcatttggtgataagagtttaaagatgcatttgagttcagaaccatatgttacggtggagataattgatgatgatgcagaatttcttatcctagcaagtgatggactatggaaggtcatgtcaaaccaagaagccgttgactcaatcaagggaataaaagatgcgaaggctgcagcaaagcaccttgcagaggaggctgttgcaaggaaaagctcagacgatatctcagtcgtcgtcgtgaaatttcagtga

SEQ ID NO: 768 - protein, 289 aa, Arabidopsis thaliana
MTGREILHKMKESVKEKVGLGASASSADSGKGKSKMLKQITHGFHLVKGKAFHEMEDYVVAKFKEVDDNELGLFAIFDGHLSHEIPDYLCSHLFENILKEPNFWQEPEKAIKKAYYITDTTILDKADDLGKGGSTAVTAILINCQKLVVANVGDSRAVICQNGVAKPLSVDHEPNMEKDEIENRGGFVSNFPGDVPRVDGQLAVARAFGDKSLKMHLSSEPYVTVEIIDDDAEFLILASDGLWKVMSNQEAVDSIKGIKDAKAAAKHLAEEAVARKSSDDISVVVVKFQ

SEQ ID NO: 769 - DNA, 831 bp, Arabidopsis thaliana
atgggaactgatacagttatgtctggacgagtaaggaaagatctatcaaaaacgaatccaaatgggaatattcctgagaatcgttctaattcacgtaagaagatccaacgacggagtaagaaaaccctaatctgtccggttcaaaaactattcgatacttgtaagaaagttttcgctgatggcaaatctggtaccgtcccttctcaagaaaacattgagatgcttcgagccgttttggatgaaatcaagcctgaggatgttggcgtaaatcctaagatgtcgtattttcgatctacagtgaccggacgatctccgttagtgacgtatcttcacatctatgcatgtcatagattctcgatttgcattttctgtttacctccatctggtgttatccctcttcacaatcacccggagatgactgtgtttagtaagctcttgtttggtacaatgcatatcaaatcctatgattgggtccctgattctccccagccgagttcagatactcgtttggcgaaagtgaaagtagattcggactttaccgcaccttgtgatacttctatactgtacccggctgatggagggaatatgcattgcttcaccgcgaaaacggcttgcgcggttcttgatgttattggtcctccatactctgatcccgcaggacgtcattgtacttactatttcgattatccgttctctagtttctcggtcgatggagtcgtggttgccgaggaggagaaggaaggctatgcatggttgaaggagagggaagagaagccagaggatttaacggttactgcattgatgtatagtggaccaaccatcaaagaatga

SEQ ID NO: 770 - protein, 276 aa, Arabidopsis thaliana
MGTDTVMSGRVRKDLSKTNPNGNIPENRSNSRKKIQRRSKKTLICPVQKLFDTCKKVFADGKSGTVPSQENIEMLRAVLDEIKPEDVGVNPKMSYFRSTVTGRSPLVTYLHIYACHRFSICIFCLPPSGVIPLHNHPEMTVFSKLLFGTMHIKSYDWVPDSPQPSSDTRLAKVKVDSDFTAPCDTSILYPADGGNMHCFTAKTACAVLDVIGPPYSDPAGRHCTYYFDYPFSSFSVDGVVVAEEEKEGYAWLKEREEKPEDLTVTALMYSGPTIKE

SEQ ID NO: 771 - DNA, 615 bp, Arabidopsis thaliana
atgggtgcgtacaagtatgtatctgagctatggaggaagaaacagtccgatgtgatgagattcctccagagggttaggtgctgggagtacagacagcaaccttcgattgttcgtctcgtcaggcctactcgtcctgataaggctcgtcgtttgggttacaaggccaagcagggctttgttgtgtaccgtgtacgtgtgagacgtggtggacgcaagaggccagtgcctaagggtattgtgtatggtaagccaacaaaccagggagtgacacaactcaagttccagcgtagcaagcgttctgttgctgaggagcgtgctggcaggaaattgggtggtctcagagttgtcaactcttactggctcaatgaggattcgacctacaagtactacgagatcatcttggttgacccagcacacaatgctgtgcgtaatgacccgagaatcaactggatctgcaacccagttcacaagcaccgtgagctcagaggacttacctcagagggaaagaagaacagaggtctccgcggaaagggtcacaacaaccacaagaaccgtccatctcgcagggctacatggaagaaaaacaactctctcagccttcgtcgttaccgttga

SEQ ID NO: 772 - protein, 204 aa, Arabidopsis thaliana
MGAYKYVSELWRKKQSDVMRFLQRVRCWEYRQQPSIVRLVRPTRPDKARRLGYKAKQGFVVYRVRVRRGGRKRPVPKGIVYGKPTNQGVTQLKFQRSKRSVAEERAGRKLGGLRVVNSYWLNEDSTYKYYEIILVDPAHNAVRNDPRINWICNPVHKHRELRGLTSEGKKNRGLRGKGHNNHKNRPSRRATWKKNNSLSLRRYR

SEQ ID NO: 773 - DNA, 369 bp, Arabidopsis thaliana
atggttctgctagagaagctttgggatgatgttgtggctggacctcagcctgaccgtggccttggccgcctccgtaagatcaccacccaacccattaatatccgagatataggagaagggagcagcagtaaggtggtgatgcataggtcgttgaccatgccggcggcagtgagccctggaactccaacgactccaaccactccgacgacgccacgtaaggataacgtgtggaggagcgtctttaatccgggaagcaacctcgccactagagccatcggctccaacatctttgataaacccacccatccaaattctccctccgtctacgactggttgtacagcggtgactcaaggagtcagcaccgttag

SEQ ID NO: 774 - protein, 122 aa, Arabidopsis thaliana
MVLLEKLWDDVVAGPQPDRGLGRLRKITTQPINIRDIGEGSSSKVVMHRSLTMPAAVSPGTPTTPTTPTTPRKDNVWRSVFNPGSNLATRAIGSNIFDKPTHPNSPSVYDWLYSGDSRSQHR

SEQ ID NO: 775 - DNA, 525 bp, Arabidopsis thaliana
atggcgtacgagaaagtcaacgagcttaaccttaaggacacagagctatgtcttggattacccggaagaacagagaagatcaaagaagaacaagaggtttcttgcgttaaaagtaacaacaagcgtctatttgaggaaactcgtgatgaagaagaatctacacctcctaccaaaactcaaatcgttggttggccaccagtgagatcttcccgtaagaacaacaacagtgtgagctacgtgaaagtgagtatggacggagctccttaccttcgcaagatcgatctcaagacatacaaaaactaccccgagcttctcaaagcgttagagaatatgttcaaagtcatgattggtgaatattgtgagagagaaggatacaaaggatctggatttgtaccaacatacgaagataaagatggtgactggatgttggttggtgatgttccatgggacatgttctcttcttcttgtaagagactcagaatcatgaagggatccgacgctcctgctctagactcttccttatga

SEQ ID NO: 776 - protein, 174 aa, Arabidopsis thaliana
MAYEKVNELNLKDTELCLGLPGRTEKIKEEQEVSCVKSNNKRLFEETRDEEESTPPTKTQIVGWPPVRSSRKNNNSVSYVKVSMDGAPYLRKIDLKTYKNYPELLKALENMFKVMIGEYCEREGYKGSGFVPTYEDKDGDWMLVGDVPWDMFSSSCKRLRIMKGSDAPALDSSL

SEQ ID NO: 777 - DNA, 1053 bp, Arabidopsis thaliana; identical to SEQ ID NO: 77

SEQ ID NO: 778 - protein, 350 aa, Arabidopsis thaliana; identical to SEQ ID NO: 78

SEQ ID NO: 779 - DNA, 1440 bp, Arabidopsis thaliana
atggacttgaaaatggataatgttattgggggaaagtttaaacttggtcggaagatcggtggtggctcttttggagaactttttcttgccgtaagtttgcaaaccggagaggaagcagctgttaagctggagcctgcgaaaactaagcatccccaacttcattatgagtcgaagatatacatgcttctacaaggaggaagtggcatccccagccttaagtggtttggggttcagggagactacaatgcgatggtcattgatctgcttgggccgagtttggaagacttgttcaactactgcaataggaggcttactttgaaggcagttttgatgcttgcagatcaactgattagcagagttgaatatatgcattcaagggggtttcttcaccgtgacatcaaacctgacaatttcttgatgggacttggtcgcaaagcaaaccaggtgtatatcattgattttgggcttgcaaagaagtatagggatctccaaacacataggcatatcccctatagagaaaacaagaaccttacgggcacagctcggtatgctagtgtcaacactcacctaggagttgagcaaagtaggagggatgatctggagtctcttggttacgtactcatgtatttcctgagaggaagcttaccgtggcagggactaaaagctggcacaaagaagcaaaagtatgacagaattagcgagaagaaagtatcaactcctatagaggtcttgtgcaagtcatatccacccgaattcgtatcatactttcaatactgcagatctctgcgattcgaagacaaaccagactactcatatctaaagagacttttccgagacttgtttatccgtgaaggttatcagtttgattatgtattcgactggactgcattgaaacaccctcagagtagtgccaggtcccattccagtacacatgaaaggcatcgtaccggtaaaccagggatgggtgcgggaccgtctgctgaaaaacctgaaaggatttcagtagggaacatccgcgataaattctcaggtgcggtcgaagcatttgcgagaaggaacgttagaggacccagtccccatcaaaaccataccagacatcgaactcttgacgaaattccttcaatgaaacctgctgtgaatatggtatctgagaaaggaagaaacacttccagatacggcagtgcttcgaggagagcagtagcctcaggaagtagaccaagctcatcaggtgaacaaagggagagccgggactcgagccgcgtagcctcaagcggtggcggtgtccgaccatcagtcttccaaagaacccaagcagcagctgctgtgagtggatacgagtcaaagacagcatctgcctttaaccgcgaccgagtagccgcttcaagaacagcacgagacgaggctctcagaagcttcgagcttctttcgatccgcaaatga

SEQ ID NO: 780 - protein, 479 aa, Arabidopsis thaliana
MDLKMDNVIGGKFKLGRKIGGGSFGELFLAVSLQTGEEAAVKLEPAKTKHPQLHYESKIYMLLQGGSGIPSLKWFGVQGDYNAMVIDLLGPSLEDLFNYCNRRLTLKAVLMLADQLISRVEYMHSRGFLHRDIKPDNFLMGLGRKANQVYIIDFGLAKKYRDLQTHRHIPYRENKNLTGTARYASVNTHLGVEQSRRDDLESLGYVLMYFLRGSLPWQGLKAGTKKQKYDRISEKKVSTPIEVLCKSYPPEFVSYFQYCRSLRFEDKPDYSYLKRLFRDLFIREGYQFDYVFDWTALKHPQSSARSHSSTHERHRTGKPGMGAGPSAEKPERISVGNIRDKFSGAVEAFARRNVRGPSPHQNHTRHRTLDEIPSMKPAVNMVSEKGRNTSRYGSASRRAVASGSRPSSSGEQRESRDSSRVASSGGGVRPSVFQRTQAAAAVSGYESKTASAFNRDRVAASRTARDEALRSFELLSIRK

SEQ ID NO: 781 - DNA, 456 bp, Arabidopsis thaliana
atgaagcgcagtactaccgactctgatttggccggtgatgctcacaacgagacaaacaagaagatgaagagtacagaggaagaagaaatcggattctccaatttagacgagaatctagtgtacgaggtgttgaaacacgtcgacgcaaagaccttagctatgtcatcttgcgtgagcaagatctggcacaaaacggcacaagacgagcggctttgggagctgatctgtactcgtcactggactaacatcggctgcgggcagaaccagctcagatctgttgtgttggcgcttggtggcttccgaagactccactctctttacctctggcctctctctaaacccaatccgcgtgctaggttcggtaaggacgagcttaaactcactctttctcttctctcaattcgatactacgagaagatgagtttcactaagagacctcttccagaatccaaataa

SEQ ID NO: 782 - protein, 151 aa, Arabidopsis thaliana
MKRSTTDSDLAGDAHNETNKKMKSTEEEEIGFSNLDENLVYEVLKHVDAKTLAMSSCVSKIWHKTAQDERLWELICTRHWTNIGCGQNQLRSVVLALGGFRRLHSLYLWPLSKPNPRARFGKDELKLTLSLLSIRYYEKMSFTKRPLPESK

SEQ ID NO: 783 - DNA, 1269 bp, Arabidopsis thaliana
atggccttctcttctctcctcagatctgccgcctcctacacggttgccgctcctcgccctgactttttctcgtcgccggcgtctgatcattctaaggtgttgtcaagtcttggatttagtcgcaacctgaagccatcaagattttcttctgggatatcttcatctctacaaaatggcaatgcaagaagtgtgcaacccatcaaggccacggctacagaagtgccatctgcagttcgaaggtcaagtagcagtggaaagacaaaggttgggatcaacggttttggtcggattggaaggttggtcctccgcattgcaacatcaagggatgatattgaggttgtagcagtgaatgacccattcattgatgccaagtacatggcttacatgttgaagtatgattctactcatggaaatttcaagggaagcatcaatgtcattgatgattctactttggagatcaatgggaagaaggtcaatgttgtcagcaagagagatccatctgagatcccatgggctgatcttggagctgattatgttgttgagtcttccggtgtattcaccaccctgtcaaaggctgcatcccatttgaagggcggtgccaagaaagttataatttctgccccttctgctgacgcacctatgtttgttgttggagtaaacgagcacacataccaaccaaacatggatatagtctccaatgcaagttgtaccaccaattgtcttgcccctcttgccaaggtggtgcatgaggaatttggtattcttgaaggcttgatgacaactgtccacgcaactacagctactcagaaaactgttgatgggccatcaatgaaggactggagaggaggtcggggcgctagtcaaaacatcattcctagctcaaccggcgccgcgaaggctgtaggtaaagttcttccagaactgaatgggaaacttacgggaatggccttccgtgtaccaacatcgaatgtttctgtggtggatttaacttgtcgacttgagaagggtgcctcttacgaagatgttaaggcagccattaagcatgcctcagaaggacctcttaaaggcattctcgggtacacagatgaagatgtcgtctccaatgatttcgtcggtgattcaaggtccagtatctttgacgccaatgctggtattggattgagcaagtcctttgtgaaacttgtctcttggtacgacaacgaatggggttacagcaaccgagttcttgaccttatagagcacatggctttggtagctgccagccactaa

SEQ ID NO: 784 - protein, 422 aa, Arabidopsis thaliana
MAFSSLLRSAASYTVAAPRPDFFSSPASDHSKVLSSLGFSRNLKPSRFSSGISSSLQNGNARSVQPIKATATEVPSAVRRSSSSGKTKVGINGFGRIGRLVLRIATSRDDIEVVAVNDPFIDAKYMAYMLKYDSTHGNFKGSINVIDDSTLEINGKKVNVVSKRDPSEIPWADLGADYVVESSGVFTTLSKAASHLKGGAKKVIISAPSADAPMFVVGVNEHTYQPNMDIVSNASCTTNCLAPLAKVVHEEFGILEGLMTTVHATTATQKTVDGPSMKDWRGGRGASQNIIPSSTGAAKAVGKVLPELNGKLTGMAFRVPTSNVSVVDLTCRLEKGASYEDVKAAIKHASEGPLKGILGYTDEDVVSNDFVGDSRSSIFDANAGIGLSKSFVKLVSWYDNEWGYSNRVLDLIEHMALVAASH

SEQ ID NO: 785 - DNA, 2103 bp, Arabidopsis thaliana
atggtttcaagatcgtattcaaatctgttggagttagcttcaggagactcaccaacgtttggacgcatgaaccgacaaatcccacgaatcatggccgttgctggaatcatgtcaaacatcgataatgactctaaagacactgatctgtctcctaaagatcgtatcatcattgtagccaatgaattacctatacgagctcagagaagggttgatggtaatggtagtggtagtagtagtagtagtacttgttgtagcaaaggttggaacttttcttgggatgagaattcacttcttctccaattgaaagatgggttaggagatgaagctattgaagttatctatgttggttgtttgaaagaagagattcctcttaatgagcaagaagaagtgtatcagattcttcttgagagtttcaagtgtgtgcctacgtttttgcctttggatttgtacactagatactaccatggattctgtaagcaacagctttggcctttgtttcattacatgttgccactttctcctgatcttggaggtaggtttgataggactttgtggcaagcttatgtctctgtgaacaagatttttgctgatagaattatggaggtgattaatcctgaggatgattttgtgtggatacatgattatcatttgatggttttgcctactttcttgaggaagaggtttaacagagtcaagcttggtttcttccttcatagtccatttccatcgtctgagatttacaaaactttgcctattcgtgaagagcttcttcgggctttgctaaactcggatttgatagggttccatacttttgactacgctaggcatttcttgtcttgttgtagtcgaatgcttggtcttacttatgaatctaagagaggatacattggacttgagtattatggtagaaccgtgagtatcaaaattctacctgttggaatccacatgggtcagcttcagtcggttttgagcttacccgagactgaaaggaaagtcggggaacttattgaacggtatggtcgaaaaggcaggacgatgctgcttggtgtggatgatatggacattttcaaagggattactttaaagctgttggctatggagcagctgcttatgcaacatcctgaatggcaagggaaggttgtgttggtgcagatagctaatccggcgagagggaaagggaaagatgttaaagagatgcaagctgagacgtattcaactgttaagcggattaatgaaacgtttgggagacccggttacgatcctatagtattgatcgatgcaccgttgaagttctatgaaagggttgcttattacgtagtagctgagtgttgtttggtgacagcggttagggatgggatgaatcttataccttatgagtacatagtttctcgtcaaggaaatgagaaactggacaaaattctgaagctggaggcgaataatcgtaacaagaaaagcatgctggtggtttctgagtttattggttgctctccatcgctaagcggagccattcgtgttaatccatggaatgttgatgcagtagctgatgcaatggatagtgcccttgaagtagctgaaccggagaagcagctaagacatgagaagcattacaagtatgtgagcacacatgatgttggctattgggctcgtagcttcctccaagatcttgagaggagttgtggtgagcatggacgaaggaggtgttggggaattgggtttggtctcagtttcagagttgtggcactagaccagagcttcaggaagctgtcaatggaacacatagtatcagcttataagaggacaaagacacgggctatccttttagactatgatgatactttaatgccacaaggctcgatcgataaaaggccttcatcgaagtcaatcgacatattgaacaccttgtgtagggacaagggcaatctggtgttcattgttagtgctaaaagccgagaaactctatcggactggtttagtccttgtgagaagcttggtattgctgctgaacatggctattttctgaggtattcaaccaaaactttttattttctagcattacctttatatcttataactcaagctccatctaactactacacaggctaa

SEQ ID NO: 786 - protein, 700 aa, Arabidopsis thaliana
MVSRSYSNLLELASGDSPTFGRMNRQIPRIMAVAGIMSNIDNDSKDTDLSPKDRIIIVANELPIRAQRRVDGNGSGSSSSSTCCSKGWNFSWDENSLLLQLKDGLGDEAIEVIYVGCLKEEIPLNEQEEVYQILLESFKCVPTFLPLDLYTRYYHGFCKQQLWPLFHYMLPLSPDLGGRFDRTLWQAYVSVNKIFADRIMEVINPEDDFVWIHDYHLMVLPTFLRKRFNRVKLGFFLHSPFPSSEIYKTLPIREELLRALLNSDLIGFHTFDYARHFLSCCSRMLGLTYESKRGYIGLEYYGRTVSIKILPVGIHMGQLQSVLSLPETERKVGELIERYGRKGRTMLLGVDDMDIFKGITLKLLAMEQLLMQHPEWQGKVVLVQIANPARGKGKDVKEMQAETYSTVKRINETFGRPGYDPIVLIDAPLKFYERVAYYVVAECCLVTAVRDGMNLIPYEYIVSRQGNEKLDKILKLEANNRNKKSMLVVSEFIGCSPSLSGAIRVNPWNVDAVADAMDSALEVAEPEKQLRHEKHYKYVSTHDVGYWARSFLQDLERSCGEHGRRRCWGIGFGLSFRVVALDQSFRKLSMEHIVSAYKRTKTRAILLDYDDTLMPQGSIDKRPSSKSIDILNTLCRDKGNLVFIVSAKSRETLSDWFSPCEKLGIAAEHGYFLRYSTKTFYFLALPLYLITQAPSNYYTG

SEQ ID NO: 787 - DNA, 741 bp, Arabidopsis thaliana
atggcgaccggtggtgctgcggcggatttggaagatgttcagacggtggatctcatgtcggagctcctccgccgcctcaagtgttctcagaagcccgacaaacgcctcatcttcattggacctccagggtcagggaaaggtactcaatctccagtagtgaaggatgagtattgcttgtgtcacttatccactggagacatgttaagagctgctgttgcttctaagacccctcttggtgtcaaggctaaagaagctatggaaaaaggagagctcgtctctgatgatttggttgttggtataattgatgaagccatgaacaagccaaaatgtcaaaaaggatttatccttgatgggttccccaggactgttactcaggcagagaagctcgatgagatgcttaagaggcgaggaactgaaattgacaaagttctcaactttgctattgatgacgcaatcttggaggaaagaataaccgggcgatggatccacccatcgagtggcaggagttaccacaccaaatttgctcctcccaaaacccctggagttgatgatattactggagagcctctgatccaacgtaaagatgataacgctgatgttctaaagtcgaggcttgcagctttccacagtcaaactcaaccggtgattgattactacgcaaagaaggccgttctcacaaacatccaggccgagaaggctccccaagaagttacatcagaggttaaaaaagcattgtcatga

SEQ ID NO: 788 - protein, 246 aa, Arabidopsis thaliana
MATGGAAADLEDVQTVDLMSELLRRLKCSQKPDKRLIFIGPPGSGKGTQSPVVKDEYCLCHLSTGDMLRAAVASKTPLGVKAKEAMEKGELVSDDLVVGIIDEAMNKPKCQKGFILDGFPRTVTQAEKLDEMLKRRGTEIDKVLNFAIDDAILEERITGRWIHPSSGRSYHTKFAPPKTPGVDDITGEPLIQRKDDNADVLKSRLAAFHSQTQPVIDYYAKKAVLTNIQAEKAPQEVTSEVKKALS

SEQ ID NO: 789 - DNA, 1167 bp, Arabidopsis thaliana
atggcgggtaagcagatcggcggagacggaggtttaccggcaaatctcgccggaatgactaaaagtcagctctatgatattatgtctcaaatgaagacgttgattgatcaaaaccatcaacaagcgagggagattctgattcggaaccctcttttgacgaaggctcttttccaggcacaaatcatgctcggaatggttcagcctcctcaagtgactccgaaagttgagccacaagctgtacaacaacctcaacaatctcatcaatctatcccgccaaagccaaacgttcaagctcatatgtcttctttccaaggcggtggcagtgtacatgagccagccaatacgatgcagccacaagccccgattcgaaaacacccaacaccacaaccaatgcctatgcctccaccaccgccttctgtttctgcaaatagtgctcaatcacagcctcgtttttcgcatccccagcgtcagggacatctgaatcctgctgtcacttctatgtctcatccacagtcttctcaagttcaaaacgcgcctcctccggcttcccatcatccaacatcccagcaacctccttttcatcatcttgatataccagcttcctccactcagttgcaacaacaaccaatgcactctggtggaggtcctcatgtggcacagcaacagtctagaccatatcatcatcaatatggacaagctcaaactggtccaaacactggatttcagcaccatggcgcacctactcagcatctttctcaacccatgtatcattcaggcaacagaccccctgcttccggtggacctcaattcccgcagggacagccacatctgcctagtcagccaacatatcagggaggaggtcaatatcgtggagactacaacaataaccaattagcaggtctgatggctcaagacagaggtccttcttggatggctggccaatcagagagctcgaacattactcatctgccaggcttaggaccggtgcctccaccaagccaagttgggcctggaggtggcccaccacctcgccctgcaccgatatctgcagagatggagaaggcactacttcaacaagtgatgagccttacaccagagcagatcaatctgctgccaccagaacagagaaaccaagtccttcagcttcaacagattctccgacagtga

SEQ ID NO: 790 - protein, 388 aa, Arabidopsis thaliana
MAGKQIGGDGGLPANLAGMTKSQLYDIMSQMKTLIDQNHQQAREILIRNPLLTKALFQAQIMLGMVQPPQVTPKVEPQAVQQPQQSHQSIPPKPNVQAHMSSFQGGGSVHEPANTMQPQAPIRKHPTPQPMPMPPPPPSVSANSAQSQPRFSHPQRQGHLNPAVTSMSHPQSSQVQNAPPPASHHPTSQQPPFHHLDIPASSTQLQQQPMHSGGGPHVAQQQSRPYHHQYGQAQTGPNTGFQHHGAPTQHLSQPMYHSGNRPPASGGPQFPQGQPHLPSQPTYQGGGQYRGDYNNNQLAGLMAQDRGPSWMAGQSESSNITHLPGLGPVPPPSQVGPGGGPPPRPAPISAEMEKALLQQVMSLTPEQINLLPPEQRNQVLQLQQILRQ

SEQ ID NO: 791 - DNA, 1020 bp, Arabidopsis thaliana
atgtgtagcaacaaagcaagtccggtcgtcggagaagaaaaacagagtacgagatcatcgaagaggatcaagaagagaaaaaacagagaagctaccaccaccatggaggataagtcttcttccaatcttgacgcgtctcgtaagatcagaacaaaaacgaaaaaacccaaatttctcagtctcaagctcgagctcaacacttctcacgagatcaacgagaatcccagaagcaagaagagcaagaagaagaacaacaacaaaaaacagagcaagaagaaagaaccggatacgacgccgtttaaggagaagaagagagcagagactactactacactggggggaggagagaaagaagaagagcaatacgacaccgttgcagcttacctcttcaattccgccaccgacagtacaatttcttcgatccacgatctcctcccttcctccgcggccaccgatgtagattgcggcggagaaaggaataatctttctccgtatgatcgtcaagaccacggatcgtcgtcgtcttcccttctaaggacggcgatgaggaaaggagcgagcgaggaggaggagacgacggaggagcggtgggtgagttattcagaggttgtggaggaagtgatgagtcggagcgggactccacgttgttgcggcggaggcgatggaaacgatggccggccttcgttggctctgaagcttgattatgagcagatcatggaggcttggtcggataaaggtacgctttatgtcgacggagaaccgccgcagacagtgccggacttgcatgcttccgctgatgggtttaatgacggcggagaggcggggaatttatgggcagtgccggagatggaaacgacggagaggttatggagagggcatagagaagccagcttgctccggtataaagagaaacggcaaaaccgtcttttctctaagcggattcgatatcaagttcgtaaactcaatgccgagaaacgtcctcgtgttaaaggccggtttgtaaaaagagaggattcataa

SEQ ID NO: 792 - protein, 339 aa, Arabidopsis thaliana
MCSNKASPVVGEEKQSTRSSKRIKKRKNREATTTMEDKSSSNLDASRKIRTKTKKPKFLSLKLELNTSHEINENPRSKKSKKKNNNKKQSKKKEPDTTPFKEKKRAETTTTLGGGEKEEEQYDTVAAYLFNSATDSTISSIHDLLPSSAATDVDCGGERNNLSPYDRQDHGSSSSSLLRTAMRKGASEEEETTEERWVSYSEVVEEVMSRSGTPRCCGGGDGNDGRPSLALKLDYEQIMEAWSDKGTLYVDGEPPQTVPDLHASADGFNDGGEAGNLWAVPEMETTERLWRGHREASLLRYKEKRQNRLFSKRIRYQVRKLNAEKRPRVKGRFVKREDS

SEQ ID NO: 793 - DNA, 1293 bp, Arabidopsis thaliana
atgatcaccgatcttccaaaggatttgatagaagaaatcctttcaagggtttccatgacatctatgagagttgtgcgattaacttgcaaaagttggaatactttatccaatagtgagagctttaagaagatgcacattggtaaagttacatcaacgagagaaggagaatctagggtgatcatgttgatagattacaatctttttttgatgagcgctgtcctcatggatgacgttgatccatctatagagtttaaaggtaaacttagttgtcttaaggaacaagtcaagatatctcaagtctttcactgtgagggtttattgttatgcatcttgaaagacgatactaggattgttgtttggaatccgtataggcaggaaacaaggtggatcatacctagatattctcaccgtccatacgtaatgaacaatatcagatatgctcttggatacgagaataataaatctggtcgtagccttaaattattgaggtttatagattattgctacaccgaaaagcacatttgttggcatgaaatctacgattttgactctgatttatggacaactcttgatgtcactccacattggtatatattgtctaattggtcttgtgtccaaggcgtctctctcaaagggaacacttactggtgtgctagagaagaaaactcagatggttacaatcatataatctgttttgattttacaagagagagatttggtccgcttctgcctctaccggttaacgttatagataatgaatatgaatatgtgacttcatcttgtgttagagaagggaagattgcggctttatttcagcacaacgattcatatccatatgagcttgagatatggattacgactaagattgaggcggaaatggtgtcgtggaacaagttcttgagaattgacattgaacctaacaataacataatggttccatttatatatgggggtttcttcattgacgaggagaagaagaaagtcgccttggggtttgatgaagagttcggtcgcaaaacatttaacattattggagaggatggatattttagagaattcgatcgcataacatttaacattattgaagaggctggagaacgtgcaggcgtaaactgtggttcatatgtgtgctcttatgttccaagtttggtccgaattaagaaacctgcacaaggcaaaaggaaaagacaaagcagtttagaaaagcttcgatttgatcaaaacacgtggatatttgacagcatttatcaagccactgccagtcaaatacgtaggaggaggccaacaagatga

SEQ ID NO: 794 - protein, 430 aa, Arabidopsis thaliana
MITDLPKDLIEEILSRVSMTSMRVVRLTCKSWNTLSNSESFKKMHIGKVTSTREGESRVIMLIDYNLFLMSAVLMDDVDPSIEFKGKLSCLKEQVKISQVFHCEGLLLCILKDDTRIVVWNPYRQETRWIIPRYSHRPYVMNNIRYALGYENNKSGRSLKLLRFIDYCYTEKHICWHEIYDFDSDLWTTLDVTPHWYILSNWSCVQGVSLKGNTYWCAREENSDGYNHIICFDFTRERFGPLLPLPVNVIDNEYEYVTSSCVREGKIAALFQHNDSYPYELEIWITTKIEAEMVSWNKFLRIDIEPNNNIMVPFIYGGFFIDEEKKKVALGFDEEFGRKTFNIIGEDGYFREFDRITFNIIEEAGERAGVNCGSYVCSYVPSLVRIKKPAQGKRKRQSSLEKLRFDQNTWIFDSIYQATASQIRRRRPTR

SEQ ID NO: 795 - DNA, 1506 bp, Arabidopsis thaliana
atgtcgattcttctgtatttcttctttctccccgttattttatcgttaatattcatgaagaaattcaaagactcgaaacgaaatcttcctccgagcccaccgaagctaccaattatcggaaacttacaccagcttcgaggattgtttcatagatgtcttcatgatctctccaagaaacacggtccggtgttacttctccgtctaggttttatcgatatggttgtgatctcatcaaaagaagcagcggaagaagttctcaaagtacatgaccttgagtgttgtactagacctaagaccaacgcctcatcaaaattctcgcgtgatggtaaagacatcgcctttgcgccatacggggaggtttcgagagagttgcggaagctttccttaatcaactttttcagcacgcaaaaggttcgatcttttaggtacatcagagaggaagaaaatgatttgatggtcaagaaactaaaggaatcagctaagaagaagaatacagtggatttgagccaaacacttttctatctagttgggagtatcatattcagggctacctttgggcagcgtttagaccagaacaagcatgtcaataaggaaaagatcgaagaactcatgtttgaggtccagaaagttgggtctctaagcagctctgatattttccctgctggtgtgggatggtttatggactttgtgtcaggacgacataagacacttcacaaagttttcgtcgaggttgatactttgctaaatcatgtaattgatggtcacttgaagaatcctgaagacaaaacaaatcaagatcgccctgatatcatcgactcgatcttagagactatttataaacaagaacaagatgaatctttcaaactcaccattgatcatctcaaaggaattatccaaaatatatatcttgctggagtagacacaagtgccatcaccatgatttgggcaatggcagagcttgttaagaacccacgggtaatgaagaaagctcaagaagagatccgaacatgcattggaatcaaacagaaggagagaatcgaagaagaagatgtcgataagcttcagtacttgaagcttgtgatcaaagaaaccttaagactacacccaccagcacctcttttacttccaagagagacaatggctgatatcaagattcaaggctacgacattcctcggaaaaccattcttttggttaatgcatggtcgataggacgaaaccctgaactctgggaaaaccctgaggaatttaacccggagagatttatcgattgtcctatggattacaaaggaaatagttttgagatgttaccatttggttctggtcggaagatatgtccagggatagcttttggaatagcgaccgttgaactgggactattgaacttgctttactactttgattggagattggctgaggaggataaagatattgacatggaagaggctggtgatgccacaattgttaagaaagttcctcttgaacttgtcccaattattcatcattga

SEQ ID NO: 796 - protein, 501 aa, Arabidopsis thaliana
MSILLYFFFLPVILSLIFMKKFKDSKRNLPPSPPKLPIIGNLHQLRGLFHRCLHDLSKKHGPVLLLRLGFIDMVVISSKEAAEEVLKVHDLECCTRPKTNASSKFSRDGKDIAFAPYGEVSRELRKLSLINFFSTQKVRSFRYIREEENDLMVKKLKESAKKKNTVDLSQTLFYLVGSIIFRATFGQRLDQNKHVNKEKIEELMFEVQKVGSLSSSDIFPAGVGWFMDFVSGRHKTLHKVFVEVDTLLNHVIDGHLKNPEDKTNQDRPDIIDSILETIYKQEQDESFKLTIDHLKGIIQNIYLAGVDTSAITMIWAMAELVKNPRVMKKAQEEIRTCIGIKQKERIEEEDVDKLQYLKLVIKETLRLHPPAPLLLPRETMADIKIQGYDIPRKTILLVNAWSIGRNPELWENPEEFNPERFIDCPMDYKGNSFEMLPFGSGRKICPGIAFGIATVELGLLNLLYYFDWRLAEEDKDIDMEEAGDATIVKKVPLELVPIIHH

SEQ ID NO: 797 - DNA, 3504 bp, Arabidopsis thaliana
atggctacctcatcctcggtggtcagcagtgtacctcagcagcaccaagtgttcctcaatttccgtggggacgaacttcgtaataatttcgtcagccatctggataaggccttaagagggaaacagatcaatgtcttcatagatgaggctgtggaaaaaggtgaaaatctagataaccttttcaaggagatcgaaaaatctagaatcgcgctggctatcatttcccaaaagtacacagagtcaaaatggtgcttgaacgagctggttaaaatgaaagaactcgagggcaaactcgtgacgattcccatcttctacaatgtggaacctgctacggttaggtatcagaaggaagcgtttggtgctgcgctcacaaaaacgcaggaaaatgatagtgatggccagatgaagaaatggaaagaggctttgacgtatgttagtctcctggtgggcttcccgtttaacagtaaaagcaaggagaaggagaccacgctcatcgataaaatcgtcgacgccgttttgcaaaagctgagtaaaatatcgtcggaagaaagcacaagtggatcagtggatcaaggtcggggagaagaagtagaagaagcaaaggctgataagatttccgggctcaaccagcgcctaaaggaactggaagaaaaggtagccattacgggtgacaagagagacgagactcgtattgtcgaagttgttgggatgcctggcattggtaaatccactctcttgaaggccttctatgagacatggaaaaccaggttcttgagcagcgccttactccaaaatataagcgaacttgtaaaagcaatgggattgggacgcttgactgggatgctcttgaaggagttgctcccagatgaaaacatagacgaggagacatacgaaccatacaaggagaaactacttaaaaacacagttttcattgttctagatggcataagtgacgagacacatatacaaaaacttcttaaggatcatcgaaaatgggctaagaaaggaagcaagattgtgattgcaagacgcgcagtgactcgtgatctgcttcatgaggattcaatggtccgttatacttattttgtaccgctgttgagccatcgagatgggttaaatcacttttgtcactatgcgttccgtcattttgcggcccaccaaaacaacaaggaagctttcatgaaggagtcaaaagagtttgtgcgttacgcgagaggccacccactaattctcaagctattgggtgaagagcttcgtgagaaaagcctctcttactgggaagagaaactaaaatcactcccaaaaagtctcagccaaaatattcgagaccgtgtcttgcaggtaacttatgatgaactgagtcaagtgcaaaaggatgcgtttcttgacatagcttgtttcagatcccatgatttggtttatgtaaagagcttactggattcatctggtcccgccttttctaaagcgacagttacaatagacgctctcaaagacatgttcatgatttacatttctgatagtcgagtggagatgcatgatcttttgtatacgtttgccatggaacttggtccagaagccagggatgacgatggaagagggagacaccggatatggcatcatcacaaccaagataataaaggcaggctcaataggctgctaaaaagaccaggaggcagcaccagtgtgagaagttttttcctcgatatgtatgtcatgaagacggacgtgaccttaggcactgattacctcaagaacatgcgaaatctccggtacctcaagttttacagttctcattgtcctcaggaatgtacgcctaaggaaaacatacacatccctggagaacttgagcttccacttgaagaggtccgatgtttgcattggctaaatttccccaaagatgaacttccacaagatttcatccccaagaatctcgtagatcttaagctcccttacagtaagattagacagatttggagagaagagaaggatgcaccaaaactaaggtgggtcgatctcaatcactcaagtaagttggaaaacttgtcagggctatcacaggctctaaatcttgaaagattgaaccttgaaggttgcacagcactgaaaacgttgcttctgggtccggaaaatatggcaagtcttgttttcctgaatttgaaagggtgcacgggtcttgagtctcttcccaagattaatttgagatctctgaagactctcatcctcagcaactgttcaaacttggaggagttttgggtgatttcagaaactttatatacgctatatttggatggcactgcaataaaaacacttcctcaagacatggtaaagctaacaagcctcgtcaaattatacatgaaagactgcgagatgctcgttaagcttcccgaagaatttgacaagctgaaagttctgcaagaactagtatgctctggttgtaaaagactcagtagtctcccagatgtgatgaagaacatgcaatgcttgcagattttactgcttgatggaacagcaataacaaagattcctcatatatcctcacttgagcgtctatgcttaagcagaaacgagaagatcagttgtctttcgaatgatattcgtctgctttctcaactgaaatggctggacttgaagtactgtacgaaacttgtgtctattccagagcttccaacaaatcttcagtgcttagatgcaaacggatgtgaatcattaacaacagttgcgaatccactggctactcatttgccaacggagcagattcattccacattcattttcacaaactgcgacaaattagaccgtactgcaaaggagggttttgttccagaggctttgttcagcacttgcttccctgggtgtgaagtaccttcatggttttgtcatgaagcagttggatccgtcttaaagctcaacctgctcccacattggaacgaaaataggtttgtcggaatagctttatgtgctgttgtgggatccttaccaaattgccaagaacaaaccaactcttgttcagtgacatgcacgtttaacatagcaagtaaagattccaagaaaggggatccttacaaaatctcctttgatcgactggttgggcgttggaacaaacatggcaacaaactagacaagaaaggcaacaaactaaagaagacggaatcagatcatgtctttatctgctataccagatgctcaaacagcataaaatgtcttcaagaccagcactcaggtacatgtactccaaccgaagctttccttgaatttggtgtgacagataaggaatctcgactcgaggtgctcaagtgtgggttaagattggtatatgcatctgatgaaccccagaagacaaactcagatatggatctttcattatcatcatctgattcaactccgacaaggaacggcagttccaacactactacatctagtggaagtgtatctaccaataccattagagaagaagattccaatatcttacatgaagcacaatctcaaaatgggagaggactttga

SEQ ID NO: 798 - protein, 1167 aa, Arabidopsis thaliana
MATSSSVVSSVPQQHQVFLNFRGDELRNNFVSHLDKALRGKQINVFIDEAVEKGENLDNLFKEIEKSRIALAIISQKYTESKWCLNELVKMKELEGKLVTIPIFYNVEPATVRYQKEAFGAALTKTQENDSDGQMKKWKEALTYVSLLVGFPFNSKSKEKETTLIDKIVDAVLQKLSKISSEESTSGSVDQGRGEEVEEAKADKISGLNQRLKELEEKVAITGDKRDETRIVEVVGMPGIGKSTLLKAFYETWKTRFLSSALLQNISELVKAMGLGRLTGMLLKELLPDENIDEETYEPYKEKLLKNTVFIVLDGISDETHIQKLLKDHRKWAKKGSKIVIARRAVTRDLLHEDSMVRYTYFVPLLSHRDGLNHFCHYAFRHFAAHQNNKEAFMKESKEFVRYARGHPLILKLLGEELREKSLSYWEEKLKSLPKSLSQNIRDRVLQVTYDELSQVQKDAFLDIACFRSHDLVYVKSLLDSSGPAFSKATVTIDALKDMFMIYISDSRVEMHDLLYTFAMELGPEARDDDGRGRHRIWHHHNQDNKGRLNRLLKRPGGSTSVRSFFLDMYVMKTDVTLGTDYLKNMRNLRYLKFYSSHCPQECTPKENIHIPGELELPLEEVRCLHWLNFPKDELPQDFIPKNLVDLKLPYSKIRQIWREEKDAPKLRWVDLNHSSKLENLSGLSQALNLERLNLEGCTALKTLLLGPENMASLVFLNLKGCTGLESLPKINLRSLKTLILSNCSNLEEFWVISETLYTLYLDGTAIKTLPQDMVKLTSLVKLYMKDCEMLVKLPEEFDKLKVLQELVCSGCKRLSSLPDVMKNMQCLQILLLDGTAITKIPHISSLERLCLSRNEKISCLSNDIRLLSQLKWLDLKYCTKLVSIPELPTNLQCLDANGCESLTTVANPLATHLPTEQIHSTFIFTNCDKLDRTAKEGFVPEALFSTCFPGCEVPSWFCHEAVGSVLKLNLLPHWNENRFVGIALCAVVGSLPNCQEQTNSCSVTCTFNIASKDSKKGDPYKISFDRLVGRWNKHGNKLDKKGNKLKKTESDHVFICYTRCSNSIKCLQDQHSGTCTPTEAFLEFGVTDKESRLEVLKCGLRLVYASDEPQKTNSDMDLSLSSSDSTPTRNGSSNTTTSSGSVSTNTIREEDSNILHEAQSQNGRGL

SEQ ID NO: 799 - DNA, 654 bp, Arabidopsis thaliana
atggatcaacaaggacaatcatcagctatgaactatggttcaaacccatatcaaaccaacgccatgaccactacaccaaccggttcagaccatccagcttaccatcagatccaccagcaacaacaacaacagctcactcaacagcttcaatctttctgggagactcaattcaaagagattgagaaaaccactgatttcaagaaccatagccttccattggcaagaatcaagaaaatcatgaaagctgatgaagatgtgcgtatgatctcggccgaggcgcctgttgtgttcgccagggcctgcgagatgtttattctggagcttacgttaaggtcttggaaccatactgaggagaacaagagaaggacgttgcagaagaatgatatcgcggctgcggtgactagaactgatatttttgattttcttgtggatattgttcctcgggaggatcttcgtgatgaagtcttgggtggtgttggtgctgaagctgctacagctgcgggttatccgtatggatacttgcctcctggaacagctccaattgggaacccgggaatggttatgggtaacccgggcgcgtatccgccgaacccgtatatgggtcagccaatgtggcaacaaccaggacctgagcagcaggatcctgacaattag

SEQ ID NO: 800 - protein, 217 aa, Arabidopsis thaliana
MDQQGQSSAMNYGSNPYQTNAMTTTPTGSDHPAYHQIHQQQQQQLTQQLQSFWETQFKEIEKTTDFKNHSLPLARIKKIMKADEDVRMISAEAPVVFARACEMFILELTLRSWNHTEENKRRTLQKNDIAAAVTRTDIFDFLVDIVPREDLRDEVLGGVGAEAATAAGYPYGYLPPGTAPIGNPGMVMGNPGAYPPNPYMGQPMWQQPGPEQQDPDN

SEQ ID NO: 801 - DNA, 1389 bp, Arabidopsis thaliana
atggagaaagcgatcgagagacaacgcgttcttcttgagcatctccgaccttcttcttcttcttcgcacaattacgaggcttctctatctgcttctgcttgcttggctggggacagtgctgcatatcagaggacctctctctatggagatgatgttgtcattgtcgcggcacataggactccactatgcaagtccaaacgtggcaatttcaaggatacatatcccgatgatttgctcgcacctgttttgagggcattgatagagaagacgaatctaaacccaagtgaagtaggtgacattgttgtgggtactgttttggcacctggatctcagagagccagtgaatgcaggatggctgcgttctatgctggtttccctgaaaccgtggctgtcagaactgtgaatagacagtgctcatctgggcttcaggctgttgctgatgtagccgctgccattaaagcgggattttatgacattggtatcggggctggtttggagtccatgactaccaatccaatggcatgggaagggtcagtcaacccagcggtgaagaagtttgcacaagcgcagaattgtcttcttcctatgggtgttacgtcagaaaatgtagcacaacgctttggtgtctcaaggcaggagcaagatcaagctgctgttgactcgcacagaaaggcagctgctgctactgctgctggtaaattcaaggatgagatcattcctgttaagaccaagcttgttgacccgaagactggtgatgagaaacccattacagtttctgttgatgatggtatccgaccaaccacaactcttgcttctcttgggaagctgaagccagtgtttaagaaggatggcaccactactgctggaaattccagccaagtaagtgatggtgcaggagcggttctcctaatgaagagaagtgttgcaatgcaaaaaggacttcccgttcttggtgtattcaggacatttgctgcagttggtgttgaccctgcaatcatgggtatcggtccagcagttgccattcctgctgcagttaaggcggctggtttagaacttgatgacatcgacttgtttgagatcaatgaggcatttgcatctcagtttgtttattgccgtaacaaattgggacttgacccagagaaaatcaatgtcaacggaggtgcaatggccataggccatcctttgggcgctacaggagcgcgttgtgttgctacattgttgcacgagatgaaacgccgtggtaaagactgccgttttggagtagtgtcaatgtgcattgggacggggatgggtgcagcagctgtgtttgagagaggagatggagttgatgagcttcgcaacgcaaggaaagttgaagcgcaaggtcttttgtccaaggacgctcgctag

SEQ ID NO: 802 - protein, 462 aa, Arabidopsis thaliana
MEKAIERQRVLLEHLRPSSSSSHNYEASLSASACLAGDSAAYQRTSLYGDDVVIVAAHRTPLCKSKRGNFKDTYPDDLLAPVLRALIEKTNLNPSEVGDIVVGTVLAPGSQRASECRMAAFYAGFPETVAVRTVNRQCSSGLQAVADVAAAIKAGFYDIGIGAGLESMTTNPMAWEGSVNPAVKKFAQAQNCLLPMGVTSENVAQRFGVSRQEQDQAAVDSHRKAAAATAAGKFKDEIIPVKTKLVDPKTGDEKPITVSVDDGIRPTTTLASLGKLKPVFKKDGTTTAGNSSQVSDGAGAVLLMKRSVAMQKGLPVLGVFRTFAAVGVDPAIMGIGPAVAIPAAVKAAGLELDDIDLFEINEAFASQFVYCRNKLGLDPEKINVNGGAMAIGHPLGATGARCVATLLHEMKRRGKDCRFGVVSMCIGTGMGAAAVFERGDGVDELRNARKVEAQGLLSKDAR

SEQ ID NO: 803 - DNA, 2109 bp, Arabidopsis thaliana
atgggggctcttgctcaagttgttccgtggatacccgaagacgacctgctgctaaagaatgctgtcgaggctggtgcttctttggaatcgcttgctaaaggtgctgtgcagttttctagaagattttctattagagaattgcaagatcgatggcatgcactgctttatgatccagtagtttctgtagaggcggcttttcggatggctgagcttgaacgtactaaccctaattttcctactaagtttggtagaactggatattcaaaagaaaacaaaagttcatctaggaagaggaatgctgaaaggctcagaagtacttatcattccttgcggaagaaatttaggactgagccattcaattccttggatctaggtttcctcgttccaccaaatgatagccatttcatggataatggtgatgcaacacatcttggtcttgaggactctcacatggatattatccacaacgcgtttccagaaatcttggctgaaggtggttgcgtgacaactcatgttctgccagaagataatttacagggagacattccttacgtagaaggagaaaatctcacattcactgaacacgcaggtctatcagtatgtgatgtggttcatcaagattccgagcagaaactagagaatactgctcacgaggcaaaaaacacaatggctagcactgatttcctggcacagctttcaacttctcttttcgaagaagacatggaaccgttcatggaagtagatggcaaagaagttgacaagtcatattatgatggtcttagctcactgttggtgaactctacaaatgatacaaaccgcgaggcttttcctaaccccaccgagcaagaaccttccattgcaccaactcatccaggagaggcaaccctggatgatcatgtgatgcttgagctagatggtacaatcgctttagatcctcatcctgagattgttgggggtgtaatctgctgtttattaaacgaagaggatcctgatattccgtgtaatgatgacattttcctgtccaacaactcccgtccgatgtcagtttcttctttagcccggcggaactttaaggataccaatagtccaataactacatgtgtaagagacgtctccgccagtaaggaaaaaagtgagggatattcactccaggctcaaaagaaaaaaccaggacgtttacaggggtctactcaaggaaagccagagatgggccaaccaagtaaaggtagcaaattcagggcatcgactagtactgagttaaagaatactgtagctcctggtggttcttcctctgcacaggcttgctctaatactctactttctactggtaccggtgcaaaagatggaaagaaagaaactgctactggaacactctttgtcggatctgatggccatggcaaccacccagagaaggatagtgaaaattgtaaagagaaaaatgttgtaccacctgttaatgaatcgccacatgctaaagatactgatgatggcttgatagagattacagtccctgagctggagatcacccgtgcagaagcagaagcagaagcagaagcgcatgtttgtgagagtgatgaggacttacccaattattctgacattgaggctatgatacttgacatggacttggaacctgatgatcaagataattttgatctcgaagtctccaagtatcagagccaagacatgaaaagaacaatcataagacttgagcaggctgctcattcatatatgcaaagagccattgcttcccgtggtgcattcgctgttttatatggcagatattcaaaacactatatcaagaagcctgaggttttggtgggtagatcaacagaagacctcgctgtggacattgatttgggaagagaaaagcggggtagcaaaatatctcgacgacaggcgatcatacggctgggtgatgacggttcgtttcatataaaaaacctggggaagtattcaatctcagtaaatgagaaggaagtagatcctggacagagtttaatcctcaaatccgattgtctagttgagatacggggaatgccttttatatttgaaacaaaccaaagttgcatgcaagagtacctgaagagaagagggaaagtgaactga

SEQ ID NO: 804 - protein, 702 aa, Arabidopsis thaliana
MGALAQVVPWIPEDDLLLKNAVEAGASLESLAKGAVQFSRRFSIRELQDRWHALLYDPVVSVEAAFRMAELERTNPNFPTKFGRTGYSKENKSSSRKRNAERLRSTYHSLRKKFRTEPFNSLDLGFLVPPNDSHFMDNGDATHLGLEDSHMDIIHNAFPEILAEGGCVTTHVLPEDNLQGDIPYVEGENLTFTEHAGLSVCDVVHQDSEQKLENTAHEAKNTMASTDFLAQLSTSLFEEDMEPFMEVDGKEVDKSYYDGLSSLLVNSTNDTNREAFPNPTEQEPSIAPTHPGEATLDDHVMLELDGTIALDPHPEIVGGVICCLLNEEDPDIPCNDDIFLSNNSRPMSVSSLARRNFKDTNSPITTCVRDVSASKEKSEGYSLQAQKKKPGRLQGSTQGKPEMGQPSKGSKFRASTSTELKNTVAPGGSSSAQACSNTLLSTGTGAKDGKKETATGTLFVGSDGHGNHPEKDSENCKEKNVVPPVNESPHAKDTDDGLIEITVPELEITRAEAEAEAEAHVCESDEDLPNYSDIEAMILDMDLEPDDQDNFDLEVSKYQSQDMKRTIIRLEQAAHSYMQRAIASRGAFAVLYGRYSKHYIKKPEVLVGRSTEDLAVDIDLGREKRGSKISRRQAIIRLGDDGSFHIKNLGKYSISVNEKEVDPGQSLILKSDCLVEIRGMPFIFETNQSCMQEYLKRRGKVN

SEQ ID NO: 805 - DNA, 2667 bp, Arabidopsis thaliana
atgaggactttttacccttctgattcttgtaaagaatcacaactcgattccttgaatccacagtcatggcttcaagttgagagagggaagctatcttcctctgcttcttcatctgctccactgtgtagagaatcatttatcaaagttcccgagcctcagatactgccgcattataagcctctcgactatgtagaagttctagctcagattcatgaagaactcgacacttgccctttgcaggagagatcgattctgtatttgttgcagtatcaagtgtttagaggtcttggagagaccaaacttagacggagaagccttcaatcagcttggcaagaggctactactgtccatgagaaagttgtgtttggatcttggttgaggtatgagaaacaaggagaagaagttatcacagatttgctttcctcttgtggtaaatattctgaagaatttgtgccactagatattgcatcctatttcccagctactactgcttcttcccctgaggcagcatctgtgaagacgaaccgcagtgtatctaaaaatgttgtgtttaagataggagaagagaagatagcttgccaaaggcggaaaattgcgagtctttcagctccatttcatgctatgctttatggtaatttcacggaatcgcttcttgatgagatagatatgtcagaaaaccatgtatcctcatcagctatgcgggttgttagagatttcagcgttgttggtgtactaatcggagtttccaagaaccttcttttggaagttttagttttcgcaaacaagttttgctgcgagcgacttaaagatgcatgcgatagagaattggcatctttgatttcttctatggaatgtgccattgagcttatggactttgcacttgaagagaattcccccatcctagcttcatcgtgtctgcaagtttttctttatgagatgcctgatagtttgaatgatgagcgtgttgttgaggttttgactcgagttaatagatctcaagtctcaaccatggcaggaaaagctccattctccttatattcttgtttaagtgaagtctcgatgtgtatagatcctcggtctgacagaacactcggtttcttggagaaattagttgactttgcagaaaatgaccggcaacaagtattggggttccatcggttaggttgtatgaggctattgaggaaagaataccgggaggctgaagaagcttttgaaacagcttttaacttaggccatgtgtattccgctactggtttagcaagactaggatacatccaagggcatcggctttgggcttatgagaagctaagctcggtaatctcctctgtttcgccgcctctcgggtggatgtatcaggaaaggtctttctattgtgagggtgacaagaaattggaagatctcgagaaggcaaccgaattggatccgactttgacatatccttacatgtatagagctgtcacacgaatgtcgaaacaaaatgctaaggctgctcttgaagaaatcaatcggatcttggggtttaaacttgctttagaatgcttagaaattcggttttgtctttatcttggtatggatgactatgaagcggctcttcgtgatattcaggctgctcttacgctgtgtcctgattatagaatgttcgatgggaaagtagctgggaggcagctccagacgcttgtgtatgagcatgtcgagaattggacaaccgcagattgttggatgcagctatatgagaaatggtctaatgttgatgatataggttctctttctgtaatctatcagatgctcgaatccgatgcttgcaaaggtgttctctacttcaggcaatctttgcttctcctaaggttgaattgtccagaagcagcgatgcgcagtttacagttagcccgcgagcatgcctcaagtgaccacgagcgtctagtttacgaaggatggatcttgtatgatacaggtcactgcgaagaagggcttcaaaaggctaaggaatccattggaataaagagatcatttgaagcttatttcctccaagcttatgccttagcagaatctagccttgatccatcgagttcttctactgttgtttcacttcttgaagatgctcttaaatgcccctctgataggttgcgcaaaggtcaggctctgaacaatctcgggagtgtctatgtcgattgcgagaagctagatttagctgcggattgctatataaacgctctcaaggtaagacacacgcgtgcacaccaaggtctagctcgtgtccatttccttagaaacgacaaagctgcagcctacgaagaaatgaccagactaatcgaaaaggctcaaaacaatgcatccgcctacgagaaaagatctgagtattgtgatcgtgaactcgccaaatctgatcttgaaatggtcacccggttagaccctctccgggtttatccttaccgatatcgcgccgcagtgttgatggatagtcggaaagagagagaggctatcacagagttatcccgagctatcgcctttaaagcagatcttcatcttcttcacttacgagcggctttccacgagcatatcggtgatgtcacgagtgcgttgcgggactgtcgtgcagcgctctcggtcgaccccaaccatcaggagatgctcgaactccatagccgtgttaatagccatgaaccttga

SEQ ID NO: 806 - protein, 888 aa, Arabidopsis thaliana
MRTFYPSDSCKESQLDSLNPQSWLQVERGKLSSSASSSAPLCRESFIKVPEPQILPHYKPLDYVEVLAQIHEELDTCPLQERSILYLLQYQVFRGLGETKLRRRSLQSAWQEATTVHEKVVFGSWLRYEKQGEEVITDLLSSCGKYSEEFVPLDIASYFPATTASSPEAASVKTNRSVSKNVVFKIGEEKIACQRRKIASLSAPFHAMLYGNFTESLLDEIDMSENHVSSSAMRVVRDFSVVGVLIGVSKNLLLEVLVFANKFCCERLKDACDRELASLISSMECAIELMDFALEENSPILASSCLQVFLYEMPDSLNDERVVEVLTRVNRSQVSTMAGKAPFSLYSCLSEVSMCIDPRSDRTLGFLEKLVDFAENDRQQVLGFHRLGCMRLLRKEYREAEEAFETAFNLGHVYSATGLARLGYIQGHRLWAYEKLSSVISSVSPPLGWMYQERSFYCEGDKKLEDLEKATELDPTLTYPYMYRAVTRMSKQNAKAALEEINRILGFKLALECLEIRFCLYLGMDDYEAALRDIQAALTLCPDYRMFDGKVAGRQLQTLVYEHVENWTTADCWMQLYEKWSNVDDIGSLSVIYQMLESDACKGVLYFRQSLLLLRLNCPEAAMRSLQLAREHASSDHERLVYEGWILYDTGHCEEGLQKAKESIGIKRSFEAYFLQAYALAESSLDPSSSSTVVSLLEDALKCPSDRLRKGQALNNLGSVYVDCEKLDLAADCYINALKVRHTRAHQGLARVHFLRNDKAAAYEEMTRLIEKAQNNASAYEKRSEYCDRELAKSDLEMVTRLDPLRVYPYRYRAAVLMDSRKEREAITELSRAIAFKADLHLLHLRAAFHEHIGDVTSALRDCRAALSVDPNHQEMLELHSRVNSHEP

SEQ ID NO: 807 - DNA, 1701 bp, Arabidopsis thaliana
atgaatatgagtgatttaggttgggatgatgaagataaatcggtggttagtgctgttttagggcatttagcttctgattttcttcgagcaaactctaattcgaatcagaatctctttcttgttatgggaactgatgatactctgaataagaagctctctagtctcgttgattggccaaactcggagaatttcagctggaactacgctattttctggcaacaaaccatgtctagatccggacaacaagtcttaggttggggagatgggtgttgtcgagagcctaatgaggaagaggaatcaaaagttgttaggtcttataattttaacaacatgggggcagaggaagagacatggcaagatatgaggaagagagtgttgcagaagcttcataggttgtttggtggatctgatgaagacaattatgctttgagcttagagaaagttactgctactgagattttcttcttagcttccatgtatttcttcttcaatcacggtgaaggcggtcctgggaggtgttattcttcagggaaacatgtgtggctctctgatgcagttaactctgagtctgactattgtttcaggtcttttatggcgaaatctgcgggaatcagaacgatcgttatggttcctactgatgctggtgttcttgagcttggttctgtttggtctttgcctgaaaacattggcttggttaagtctgttcaagctttgttcatgaggagagttacgcaaccagtaatggtgacttcaaacactaacatgactggagggattcacaagcttttcgggcaggatttgagtggagctcacgcgtatcctaagaagctcgaagtgagaagaaacttggatgagagattcactcctcaaagttgggaaggctataataacaataaaggtccaacatttggttacacacctcagagggatgatgtgaaagtgctagagaatgtgaatatggttgtagataataacaattacaagacgcagattgagtttgcgggatcatcagttgctgcttcttcgaatccatctacaaacactcagcaagaaaaatcagaatcttgtacagagaaaagaccagtgagcttgttagcaggagcaggaatagtttctgttgttgatgagaagagaccgagaaagagagggagaaagcctgcaaacggaagagaagagccattgaaccatgtggaagctgagaggcagagacgcgagaagcttaaccaaagattctacgctttacgatcagttgttccaaacatttctaaaatggacaaggcttctctacttggagacgcaatttcttacatcaaagagcttcaagagaaagtcaagataatggaagatgaaagagtaggaacagataagagcttatcagaatcaaacacaataacagtagaagaaagtccagaagttgacattcaagctatgaatgaagaggttgttgtaagagtaatctcgcctttggattcacatccagcttcaagaatcatacaagcaatgagaaactcaaatgttagtctaatggaggctaagttatcattagctgaagacacaatgtttcacacttttgtgataaagtctaacaacgggtcggatccattgacgaaagagaagcttatagcagcgttttaccccgagaccagctcgacgcaaccgccattgccttcttctagttcacaggtctctggtgatatataa

SEQ ID NO: 808 - protein, 566 aa, Arabidopsis thaliana
MNMSDLGWDDEDKSVVSAVLGHLASDFLRANSNSNQNLFLVMGTDDTLNKKLSSLVDWPNSENFSWNYAIFWQQTMSRSGQQVLGWGDGCCREPNEEEESKVVRSYNFNNMGAEEETWQDMRKRVLQKLHRLFGGSDEDNYALSLEKVTATEIFFLASMYFFFNHGEGGPGRCYSSGKHVWLSDAVNSESDYCFRSFMAKSAGIRTIVMVPTDAGVLELGSVWSLPENIGLVKSVQALFMRRVTQPVMVTSNTNMTGGIHKLFGQDLSGAHAYPKKLEVRRNLDERFTPQSWEGYNNNKGPTFGYTPQRDDVKVLENVNMVVDNNNYKTQIEFAGSSVAASSNPSTNTQQEKSESCTEKRPVSLLAGAGIVSVVDEKRPRKRGRKPANGREEPLNHVEAERQRREKLNQRFYALRSVVPNISKMDKASLLGDAISYIKELQEKVKIMEDERVGTDKSLSESNTITVEESPEVDIQAMNEEVVVRVISPLDSHPASRIIQAMRNSNVSLMEAKLSLAEDTMFHTFVIKSNNGSDPLTKEKLIAAFYPETSSTQPPLPSSSSQVSGDI

SEQ ID NO: 809 - DNA, 738 bp, Arabidopsis thaliana
atgtctgaagatccggagtaccgttgcttcattggtgggcttgcttggacaacgtctgatcgtggtctcagagatgcctttgagaagtatggtcacctcgttgaggccaaggtggttcttgacaagttttctggtcgctcccgtggttttggattcatcactttcgatgagaaaaaagctatggatgaagctattgcagcaatgaatggaatggatttggatgggcgaactatcactgttgataaagctcagcctcatcagggtggtgcaggcagagataatgatggtgaccgtggtcgagaccgtggatatgatcgtgatcgcagtcgtccctctggtgggcgaggtggtggagattgctttaaatgtggcaagcctggacattttgcaagagagtgtccttctgaaagtagtagagatggtggtggaaggttcagctcaaaggatgataggtacagttcgaaggacgataggtatggtgcaaaagatgataggtatggtgcaaaggaggataggtatggtgcaaaggatgataggtacagctccaaggatgataggtacagctccaaggatgataggtatggtagtagggatggtggaggtagtcgctatggacctgatcgcagtggtgaacgcgctggaggacgcagccgggatggtggcagccgtggagctccaggaggtgagaggcacagtcgtgctccatatgaccgccccagagctggtggtttccactag

SEQ ID NO: 810 - protein, 245 aa, Arabidopsis thaliana
MSEDPEYRCFIGGLAWTTSDRGLRDAFEKYGHLVEAKVVLDKFSGRSRGFGFITFDEKKAMDEAIAAMNGMDLDGRTITVDKAQPHQGGAGRDNDGDRGRDRGYDRDRSRPSGGRGGGDCFKCGKPGHFARECPSESSRDGGGRFSSKDDRYSSKDDRYGAKDDRYGAKEDRYGAKDDRYSSKDDRYSSKDDRYGSRDGGGSRYGPDRSGERAGGRSRDGGSRGAPGGERHSRAPYDRPRAGGFH

SEQ ID NO: 811 - DNA, 942 bp, Arabidopsis thaliana
atggaaccgcagagttttgacaagagtgttgctctgtttggagattcgaagctggtcaatgacagttcttcgattcagctgactgactcagtgaatcggaccgagggacgagtcttttacaagaaacccatcaatctattccaaggtaaagagaggaactccgttattttctcgacttacttctcgttttcgatgcccaatgagattggtgatgtcttggcttttgtaatggttccaagtactttggatcttagtctgtttggtaagaaagattacagttcctctgctttagggtttctattagagtatgcaaagaacgagacagttgttgcttttgagtttgatatctccaagagaggaaaccgtgcaagagtcttaattggtagacctgagtctgccaaaattagaaacctttcgtttgtgggtgacttgatgatggatgatggagggattttgagctgtatgattgattatgaggcaagttctaagagaatgagggttcgtttcagaaaacgtggttcgataaagatgtttgatccgttcttctctttctcggtagacttggagaagctttggaaaggtggtgaagtcatggtgggtttaagctctgctaatgggaactcttccaagccacattttctccattcatggagctttgaaatatggcatcttgatccgatatgggtgcaaccagcgccattaggaccaaatgaaggtttgaagccggacgtttccacggaaatggaagagggccgagaaaatagtgagtgtatatggagaatgcttggtgctctggtcttggctgcagtatgtggagccgtaggggcaatgtcagctatgtatctttggactatttgcagtgttaggcggtcaatggccgtggttccagaggaatgtgcagtgagcattgtggtcgttgcagttaaagatggcaagaagtaa

SEQ ID NO: 812 - protein, 313 aa, Arabidopsis thaliana
MEPQSFDKSVALFGDSKLVNDSSSIQLTDSVNRTEGRVFYKKPINLFQGKERNSVIFSTYFSFSMPNEIGDVLAFVMVPSTLDLSLFGKKDYSSSALGFLLEYAKNETVVAFEFDISKRGNRARVLIGRPESAKIRNLSFVGDLMMDDGGILSCMIDYEASSKRMRVRFRKRGSIKMFDPFFSFSVDLEKLWKGGEVMVGLSSANGNSSKPHFLHSWSFEIWHLDPIWVQPAPLGPNEGLKPDVSTEMEEGRENSECIWRMLGALVLAAVCGAVGAMSAMYLWTICSVRRSMAVVPEECAVSIVVVAVKDGKK

SEQ ID NO: 813 - DNA, 876 bp, Arabidopsis thaliana
atgggtcgaatcttgaaccgtaccgtgttaatgactcttctagtcgtaacaatggccggaacagcattctccggtagcttcaacgaagagtttgacttaacttggggtgaacacagaggcaaaatcttcagtggaggaaaaatgttgtcactctcactagaccgggtttccgggtcgggttttaaatccaagaaagaatatttgttcggaagaatcgacatgcagcttaaactcgtcgccggtaactccgctggaaccgtcactgcctactacttgtcatcggaaggaccaacacacgacgagatagactttgagtttcttggtaatgaaacagggaagccttatgttcttcacactaatgtatttgctcaaggcaaaggaaacagagaacaacagttttatctctggtttgatccaaccaagaacttccacacttattctcttgtctggagaccacaacacatcatatttatggtagataatgttccaatcagagtattcaacaatgcagagcaacttggtgttccatttcccaagaaccaaccaatgaagatatactcgagtttatggaatgcagatgattgggctacaagaggtggtttggttaagacagattggtctaaagctcctttcacagcttactacagaggctttaacgctgcagcttgtactgtttcttcagggtcatctttctgtgatcctaagtttaagagttcttttactaatggtgaatctcaagtggctaatgagcttaatgcttatgggagaagaagattaagatgggttcagaagtattttatgatttatgattattgttctgatttaaaaaggtttcctcaaggattcccaccagagtgtaggaagtctagagtctaa

SEQ ID NO: 814 - protein, 291 aa, Arabidopsis thaliana
MGRILNRTVLMTLLVVTMAGTAFSGSFNEEFDLTWGEHRGKIFSGGKMLSLSLDRVSGSGFKSKKEYLFGRIDMQLKLVAGNSAGTVTAYYLSSEGPTHDEIDFEFLGNETGKPYVLHTNVFAQGKGNREQQFYLWFDPTKNFHTYSLVWRPQHIIFMVDNVPIRVFNNAEQLGVPFPKNQPMKIYSSLWNADDWATRGGLVKTDWSKAPFTAYYRGFNAAACTVSSGSSFCDPKFKSSFTNGESQVANELNAYGRRRLRWVQKYFMIYDYCSDLKRFPQGFPPECRKSRV

SEQ ID NO: 815 - DNA, 1116 bp, Arabidopsis thaliana
atggagaaacagtacctcactttcatttctttttgtttctccatcaccatttgtgggttcctcatagtttcttggctggcaagaagcataatccgtaatgggattagaacattaacatggagaaaggaaacgaagaggaagaaaaagaatcaagaagatgaaaacaaaatgtctctcctggatttgccggacttaaccttagactgcatattagagaagctctcaccatcagagctctgtgcaatgactagtgtttgctccgagctaagagataagtgtgtaagcgatcatctatgggagaagcatatggagacaaaatggggaagattgatgggtgatgcagcgattcaagagtggaaatctcacgttgctacgataatgagatgtctcacaagtagtagtagtagtagtagaaagagtaaaccaaactggagttcgaggtttgttgcgaatttgaaaccctttgcatggttaagttcaaaccatggttgtgaaaacagaggatcatcatcatatttggcacctatagattctgtgatgtattggtactcgaatcttgaaaatggcaagttttggttccctgctcaagtctacaatcgcgagaacggacatgttggattcatgatgtcttgttacgatgctaagatcagatacgatttcaagactgatacatttcaagctagatactcggcacatggccggcgagcggcggaggaaaaggtgacgtggcagaggctgagaccgtctcaagacgacacaaagtcacgtgatctgcacgtgtcagattgtttgcacggacttcgacctggtgaccatttcgagatccaatggcgacgaaccaaagagttcccttatggttggtggttcggaatcgttggtcatctacaaaactgcgacggcgtacaaaattgtcgttgcgactctgacgagaatgtggtgatggagttcagacaattcagaccggaatcaccgtggagaagaacggtgataaagaggaaagaccaccgtgagacgggaaatgaagaaaacggtttctacggcggagtaaagaaattgggtacggaggaagagatttctacgtggaagcaattgtggccatcacaagccttggagtag

SEQ ID NO: 816 - protein, 371 aa, Arabidopsis thaliana
MEKQYLTFISFCFSITICGFLIVSWLARSIIRNGIRTLTWRKETKRKKKNQEDENKMSLLDLPDLTLDCILEKLSPSELCAMTSVCSELRDKCVSDHLWEKHMETKWGRLMGDAAIQEWKSHVATIMRCLTSSSSSSRKSKPNWSSRFVANLKPFAWLSSNHGCENRGSSSYLAPIDSVMYWYSNLENGKFWFPAQVYNRENGHVGFMMSCYDAKIRYDFKTDTFQARYSAHGRRAAEEKVTWQRLRPSQDDTKSRDLHVSDCLHGLRPGDHFEIQWRRTKEFPYGWWFGIVGHLQNCDGVQNCRCDSDENVVMEFRQFRPESPWRRTVIKRKDHRETGNEENGFYGGVKKLGTEEEISTWKQLWPSQALE

SEQ ID NO: 817 - DNA, 1698 bp, Arabidopsis thaliana
atggcggaggtcgacatctcacactcgaagaagaagaagcaagacaaaacggagaacgatgccgccgacaccggagactacatgatcaagccacagagtttcactccagccatcgacacttctcagtggcccatcctcctcaagaactacgaccgcctcaacgtccgtaccggtcactacactccaatcagcgccggtcactctcctctgaaacgtcctcttcaagagtatatcaggtacggtgtcatcaatctcgataaacccgcgaacccttcttctcacgaggtcgttgcttggattaagcgtatcctccgtgttgagaaaaccggtcacagtggtactcttgacccaaaagtcactggaaacctcattgtctgtattgaccgagccacacggcttgtgaaatcgcagcaaggtgcgggtaaagagtacgtttgtgttgctcggcttcactcagctgtccctgatgttgctaaagtagctagagctcttgaatcgctcactggagctgtgtttcagaggcctcctttgatctctgctgttaaaagacagcttaggattaggacaatctatgaaagcaagctgcttgagtatgatgctgataggcatttggttgttttctgggtttcttgtgaggcgggtacttacattaggactatgtgtgttcacttgggtttacttcttggggttggtgggcatatgcaggagcttaggagggttaggtctgggattttgggtgagaataataacatggttactatgcatgatgtgatggatgcccaatttgtgtatgacaactccagagatgagtcttatcttaggagggtgattatgcctcttgagatgatattgacgagttacaagagacttgttgtcaaggattctgctgtgaatgctatctgttatggtgctaagttgatgattcctgggttgttgagattcgagaatgacattgatgttggtactgaagtcgttcttatgactaccaagggtgaggcgattgccgttgggattgctgagatgacaacatctgtgatggctacttgtgatcatggtgtggtagctaagatcaagcgtgtggtgatggatagagatacctacccgaggaagtggggattgggaccaagggcttctatgaagaagaagcttattgctgatgggaaattggataagcatgggaagcctaatgagaagactccggttgagtggagcaggaatgtggttttgcctaccggtggagatgctataattgctggtgctgctgctgctcctgaggagataaaggctgacgctgagaatggagaagcaggggaagcgcgtaagcgtaagcatgatgatagcagtgatagccctgctcctgtaacaaccaagaaatctaaaaccaaagaagttgaaggagaagaggctgaagagaaggtgaagtcttctaagaagaagaagaagaaggataaggaagaggagaaagaagaggaagccgggtctgagaagaaggaaaagaagaagaagaaagataagaaggaggaggttatagaagaggtagcttcaccaaagtctgagaagaagaagaaaaagaagagcaaagacaccgaagctgctgttgacgcagaagatgaatcagcagcagagaagagtgagaagaaaaagaaaaagaaggataagaagaagaagaacaaagacagtgaggatgatgaggaatga

SEQ ID NO: 818 - protein, 565 aa, Arabidopsis thaliana
MAEVDISHSKKKKQDKTENDAADTGDYMIKPQSFTPAIDTSQWPILLKNYDRLNVRTGHYTPISAGHSPLKRPLQEYIRYGVINLDKPANPSSHEVVAWIKRILRVEKTGHSGTLDPKVTGNLIVCIDRATRLVKSQQGAGKEYVCVARLHSAVPDVAKVARALESLTGAVFQRPPLISAVKRQLRIRTIYESKLLEYDADRHLVVFWVSCEAGTYIRTMCVHLGLLLGVGGHMQELRRVRSGILGENNNMVTMHDVMDAQFVYDNSRDESYLRRVIMPLEMILTSYKRLVVKDSAVNAICYGAKLMIPGLLRFENDIDVGTEVVLMTTKGEAIAVGIAEMTTSVMATCDHGVVAKIKRVVMDRDTYPRKWGLGPRASMKKKLIADGKLDKHGKPNEKTPVEWSRNVVLPTGGDAIIAGAAAAPEEIKADAENGEAGEARKRKHDDSSDSPAPVTTKKSKTKEVEGEEAEEKVKSSKKKKKKDKEEEKEEEAGSEKKEKKKKKDKKEEVIEEVASPKSEKKKKKKSKDTEAAVDAEDESAAEKSEKKKKKKDKKKKNKDSEDDEE

SEQ ID NO: 819 - DNA, 1887 bp, Arabidopsis thaliana
atgtctcagatctttagttttgccggtgaaaatgatttttaccgtcgtggcgcaatatacccaaacccaaaggatgctagtcttttgttatcgcttggtagtttcgctgatgtttatttccctccaagcaagagatcacgtgttgttgcacctacgatcttcagtgctttcgagaaaaagccagtttccattgatgtgctaccagatgagtgtctttttgagatctttaggcgtttgtctggaccacaagagaggagtgcttgcgcttttgtctccaaacagtggcttacgcttgtaagtagcatccgtcaaaaggagattgatgttccttccaagataactgaagatggtgatgattgtgaagggtgtttgtctaggagcttagatgggaagaaggcaacagatgttagattggcagcaattgctgttggaactgctggtcgtgggggacttggaaaattgtcgattcgaggtagcaactctgctaaagtttcagatcttggtcttcggtctattggtcgtagctgcccttctctcgggtctctttcactgtggaacgtttctaccattactgacaatggacttttggagattgctgagggttgtgctcaacttgagaagcttgagctgaaccgctgctctacaatcactgacaagggtttggtagctattgctaagagctgccccaacttgactgagctgacattggaggcttgttcaagaattggagatgagggtttgctagccattgcaagatcctgctccaagctgaagtcagtctcgatcaagaactgtcctcttgtcagggatcaaggaatcgcctctctactgtctaacaccacctgttccttggcaaaacttaagcttcagatgctgaatgtcactgatgtgtctcttgctgttgtgggtcattacggcttgtcgatcactgatcttgtgctcgctggattatcacacgtgagcgagaagggattctgggtcatgggaaatggtgtcgggctgcaaaaattaaactctctgaccatcacagcctgccaaggagtgactgacatggggcttgaatctgttggaaagggctgcccgaacatgaaaaaggcgatcatcagtaaatcccctttgttatctgacaacgggttggtctcttttgcaaaagcttctttatcacttgagagtcttcagcttgaagaatgccacagggttacccaatttgggttttttggttcccttttgaactgtggtgaaaagttgaaggctttctctctggtgaactgtttgagtattagagatctcaccacaggattgcctgcttcatctcattgcagcgctctgcgctctttgtctattcgtaactgccctggctttggtgatgcaaatcttgcagccatcgggaagttgtgccctcagctcgaggatattgatctgtgtgggctcaaggggataacagagtctggtttcctacatctgattcagagctctcttgtgaagatcaacttcagtggttgttccaatttgactgatagagtgatctctgccatcactgctcgtaacgggtggactcttgaagtcttaaacatcgatggatgttccaatatcactgacgccagcctggtctccattgcagcaaactgccagattctcagtgatttggatatttcgaaatgcgcaatctcagattcagggattcaagcattggcctcctctgataagctcaaactgcagatcctatcagttgcaggttgctctatggttacagacaagagcttgccagccatcgtcgggttgggttccactctattgggattaaacctccaacagtgtcgatccatttccaattccactgtcgacttcttagtcgagcgtctttacaaatgtgacatcctctcctga

SEQ ID NO: 820 - protein, 628 aa, Arabidopsis thaliana
MSQIFSFAGENDFYRRGAIYPNPKDASLLLSLGSFADVYFPPSKRSRVVAPTIFSAFEKKPVSIDVLPDECLFEIFRRLSGPQERSACAFVSKQWLTLVSSIRQKEIDVPSKITEDGDDCEGCLSRSLDGKKATDVRLAAIAVGTAGRGGLGKLSIRGSNSAKVSDLGLRSIGRSCPSLGSLSLWNVSTITDNGLLEIAEGCAQLEKLELNRCSTITDKGLVAIAKSCPNLTELTLEACSRIGDEGLLAIARSCSKLKSVSIKNCPLVRDQGIASLLSNTTCSLAKLKLQMLNVTDVSLAVVGHYGLSITDLVLAGLSHVSEKGFWVMGNGVGLQKLNSLTITACQGVTDMGLESVGKGCPNMKKAIISKSPLLSDNGLVSFAKASLSLESLQLEECHRVTQFGFFGSLLNCGEKLKAFSLVNCLSIRDLTTGLPASSHCSALRSLSIRNCPGFGDANLAAIGKLCPQLEDIDLCGLKGITESGFLHLIQSSLVKINFSGCSNLTDRVISAITARNGWTLEVLNIDGCSNITDASLVSIAANCQILSDLDISKCAISDSGIQALASSDKLKLQILSVAGCSMVTDKSLPAIVGLGSTLLGLNLQQCRSISNSTVDFLVERLYKCDILS

SEQ ID NO: 821 - DNA, 1005 bp, Arabidopsis thaliana
atggcagctgctatgaatttgtacacttgtagcagatcgtttcaagactctggtggtgaactcatggacgcgcttgtaccttttatcaaaagcgtttccgattctccttcttcttcttctgcagcgtctgcgtctgcgtttcttcacccctctgcgttttctctccctcctctccccggttattacccggattcaacgttcttgacccaaccgttttcatacgggtcggatcttcaacaaaccgggtcattaatcggactcaacaacctctcttcttctcagatccaccagatccagtctcagatccatcatcctcttcctccgacgcatcacaacaacaacaactctttctcgaatcttctcagcccaaagccgttactgatgaagcaatctggagtcgctggatcttgtttcgcttacggttcaggtgttccttcgaagccgacgaagctttacagaggtgtgaggcaacgtcactggggaaaatgggtggctgagatccgtttgccgagaaatcggactcgtctctggcttgggacttttgacacggcggaggaagctgcgttggcctatgataaggcggcgtacaagctgcgcggcgatttcgcccggcttaacttccctaacctacgtcataacggatctcacatcggaggcgatttcggtgaatataaacctcttcactcctcagtcgacgctaagcttgaagctatttgtaaaagcatggcggagactcagaaacaggacaaatcgacgaaatcatcgaagaaacgtgagaagaaggtttcgtcgccagatctatcggagaaagtgaaggcggaggagaattcggtttcgatcggtggatctccaccggtgacggagtttgaagagtccaccgctggatcttcgccgttgtcggacttgacgttcgctgacccggaggagccgccgcagtggaacgagacgttctcgttggagaagtatccgtcgtacgagatcgattgggattcgattctagcttag

SEQ ID NO: 822 - protein, 334 aa, Arabidopsis thaliana
MAAAMNLYTCSRSFQDSGGELMDALVPFIKSVSDSPSSSSAASASAFLHPSAFSLPPLPGYYPDSTFLTQPFSYGSDLQQTGSLIGLNNLSSSQIHQIQSQIHHPLPPTHHNNNNSFSNLLSPKPLLMKQSGVAGSCFAYGSGVPSKPTKLYRGVRQRHWGKWVAEIRLPRNRTRLWLGTFDTAEEAALAYDKAAYKLRGDFARLNFPNLRHNGSHIGGDFGEYKPLHSSVDAKLEAICKSMAETQKQDKSTKSSKKREKKVSSPDLSEKVKAEENSVSIGGSPPVTEFEESTAGSSPLSDLTFADPEEPPQWNETFSLEKYPSYEIDWDSILA

SEQ ID NO: 823 - DNA, 1395 bp, Arabidopsis thaliana
atggagacaactacaactcctctgctccccggtgatcgcagcagatgcgggtggctccgtcgccgtctccgcctcaaaaaccctctttcttctgaactctccggcgctgtcggtgatctcggcaccttcatccccatcgtccttacactaactctagtctccaatcttgatctctccaccactctcatcttcactggtttctacaacatcgccaccggtctcctctttgacatccctatgcccgtccagcccatgaaatccatcgccgctgtcgctgtctccgaatccccgcatctaactccttctcagattgccgccgctggtgcatccactgccgccacgctcctcctccttggcgccaccggagctatgtctttcctctacaacatcatccctctcccagttgtacgcggcgtccagctttctcaaggtcttcagttcgccttcaccgccatcaaatacgtcaggtttaattacgatactgccactctcaaaccctcttcttctcctcgtatttggcttggcctcgacggccttatcttggctctagctgctctgctcttcatcattttgtccaccggctctggcaacgacagagaagctgaagatggagatctcgccgagacttccagcaacgaaagccagtctcgccggaggagactgcgtcttctgtcttcgattccatctgcgctgatcgtgttcgcactcgggttagtgctctgtttcatacgtgatccatccattttcaaagaccttaaattcggtccctcgaagttccacattctgagaatcagttgggatgattggaaaatcgggtttctgagggcggcgattcctcagattccactctctgtactgaactcagtgatcgcagtttgtaaattatccaatgacttgtttgacaaggaactctctgcgactacagtctccatcagcgttggggtgatgaacttaatagggtgctggtttggcgctatgcccgtctgtcacggtgctggtgggttagctggtcagtatcggtttggggcaaggagtggattatccgttatttttctcggaatcgggaaactgattgtgggtctggtgtttggaaactcctttgtaaggattctgagtcagtttccgattggaattttaggggttctgttgctattcgcgggaatcgaactggcaatggcttccaaagacatgaactccaaagaagattccttcatcatgctggtctgcgccgctgtgtcgatgactggctcgagtgccgccttaggatttggttgtggagttgttctttacttgttactgaagctaagaacgttagactgttcttcagtaactctgttttcccggtcaagtgatgagtcgcaggtcgattccgaagccgctcctcgtgatgtctaa

SEQ ID NO: 824 - protein, 464 aa, Arabidopsis thaliana
METTTTPLLPGDRSRCGWLRRRLRLKNPLSSELSGAVGDLGTFIPIVLTLTLVSNLDLSTTLIFTGFYNIATGLLFDIPMPVQPMKSIAAVAVSESPHLTPSQIAAAGASTAATLLLLGATGAMSFLYNIIPLPVVRGVQLSQGLQFAFTAIKYVRFNYDTATLKPSSSPRIWLGLDGLILALAALLFIILSTGSGNDREAEDGDLAETSSNESQSRRRRLRLLSSIPSALIVFALGLVLCFIRDPSIFKDLKFGPSKFHILRISWDDWKIGFLRAAIPQIPLSVLNSVIAVCKLSNDLFDKELSATTVSISVGVMNLIGCWFGAMPVCHGAGGLAGQYRFGARSGLSVIFLGIGKLIVGLVFGNSFVRILSQFPIGILGVLLLFAGIELAMASKDMNSKEDSFIMLVCAAVSMTGSSAALGFGCGVVLYLLLKLRTLDCSSVTLFSRSSDESQVDSEAAPRDV

SEQ ID NO: 825 - DNA, 1152 bp, Arabidopsis thaliana
atgggcttactctgcagtagaagtcgacatcatactgaagatactgatgagaatacacaggctgctgaaatcgaaagacggatagagcaagaagcaaaggctgaaaagcatattcggaagcttttgctacttggtgctggggaatctggaaaatctacaatttttaagcagataaaacttctattccaaacgggatttgatgaaggagaactaaagagctatgttccagtcattcatgccaatgtctatcagactataaaattattgcatgatggaacaaaggagtttgctcaaaatgaaacagattctgctaaatatatgttatcttctgaaagtattgcaattggggagaaactatctgagattggtggtaggttagactatccacgtcttaccaaggacatcgctgagggaatagaaacactatggaaggatcctgcaattcaggaaacttgtgctcgtggtaatgagcttcaggttcctgattgtacgaaatatctgatggagaacttgaagagactatcagatataaattatattccaactaaggaggatgtactttatgcaagagttcgcacaactggtgtcgtggaaatacagttcagccctgtgggagagaataaaaaaagtggtgaagtgtaccgattgtttgacgtgggtggacagagaaatgagaggaggaaatggattcatctgtttgaaggtgtaacagctgtgatattttgtgctgccatcagcgagtacgaccaaacgctctttgaggacgagcagaaaaacaggatgatggagaccaaggaattattcgactgggtcctgaaacaaccctgttttgagaaaacatccttcatgctgttcttgaacaagttcgacatatttgagaagaaagttcttgacgttccgttgaacgtttgcgagtggttcagagattaccaaccagtttcaagtgggaaacaagagattgagcatgcatacgagtttgtgaagaagaagtttgaggagttatattaccagaacacggcgccggatagagtggacagggtattcaaaatctacaggacgacggctttggaccagaagcttgtaaagaaaacgttcaagctcgtagatgagacactaagaaggagaaatttactggaggctggccttttatga

SEQ ID NO: 826 - protein, 383 aa, Arabidopsis thaliana
MGLLCSRSRHHTEDTDENTQAAEIERRIEQEAKAEKHIRKLLLLGAGESGKSTIFKQIKLLFQTGFDEGELKSYVPVIHANVYQTIKLLHDGTKEFAQNETDSAKYMLSSESIAIGEKLSEIGGRLDYPRLTKDIAEGIETLWKDPAIQETCARGNELQVPDCTKYLMENLKRLSDINYIPTKEDVLYARVRTTGVVEIQFSPVGENKKSGEVYRLFDVGGQRNERRKWIHLFEGVTAVIFCAAISEYDQTLFEDEQKNRMMETKELFDWVLKQPCFEKTSFMLFLNKFDIFEKKVLDVPLNVCEWFRDYQPVSSGKQEIEHAYEFVKKKFEELYYQNTAPDRVDRVFKIYRTTALDQKLVKKTFKLVDETLRRRNLLEAGLL

SEQ ID NO: 827 - DNA, 1206 bp, Arabidopsis thaliana
atggcccttcaagctgcttctttggtctcctctgctttctctgttcgcaaagatgcgaagttgaatgcttcttcatcatctttcaaggactcgagtctttttggtgcctccattaccgaccaaatcaaatccgaacatggatcttcctcgttaagattcaagagagaacagagcttaaggaatctagcaattcgagcccaaaccgctgcgacttcaagccctacagttacaaaatccgtggacggcaagaaaacgttgaggaaaggaaatgtggtggtcactggagcctcgtctgggttaggtctagccacggctaaagctctagctgagacagggaaatggaacgtgataatggcgtgcagagacttccttaaagccgagagagctgctaaatccgtagggatgcctaaagacagctacacagtgatgcatttagacttagcctcgttggacagcgtgagacagtttgttgataatttcaggagaacagagacgcctctcgatgttttggtctgcaatgctgcggtttatttcccgacagctaaagagcctacttacagtgctgaagggtttgagcttagtgttgcgacgaaccatttgggacattttcttctcgcaaggttgttgcttgatgacttgaagaaatctgattacccttcaaagcgtctcatcatcgtcggatccattaccgggaacacgaatacattggcgggtaatgtaccaccgaaggcgaatctcggtgatttgaggggtttagccggcggattaaacggtttaaacagctcagctatgattgatggaggagatttcgacggtgcaaaggcttacaaagacagtaaagtctgcaatatgttgacaatgcaagagtttcacaggcgtttccatgaagaaactggagtcactttcgcttcgctttaccccggttgcatcgcctccacaggtttattccgagagcacattcctctcttccgtgccctcttccctccctttcagaagtacatcactaaaggatatgtctccgaaacagagtcaggcaaaagacttgctcaggtggtgagtgatccaagcttgacgaaatcaggggtttattggagctggaacaatgcttcggcttcttttgagaaccagttatcagaagaagcaagtgacgttgagaaggctcgtaaagtgtgggagatcagtgagaagctcgtgggcttggcctaa

SEQ ID NO: 828 - protein, 401 aa, Arabidopsis thaliana
MALQAASLVSSAFSVRKDAKLNASSSSFKDSSLFGASITDQIKSEHGSSSLRFKREQSLRNLAIRAQTAATSSPTVTKSVDGKKTLRKGNVVVTGASSGLGLATAKALAETGKWNVIMACRDFLKAERAAKSVGMPKDSYTVMHLDLASLDSVRQFVDNFRRTETPLDVLVCNAAVYFPTAKEPTYSAEGFELSVATNHLGHFLLARLLLDDLKKSDYPSKRLIIVGSITGNTNTLAGNVPPKANLGDLRGLAGGLNGLNSSAMIDGGDFDGAKAYKDSKVCNMLTMQEFHRRFHEETGVTFASLYPGCIASTGLFREHIPLFRALFPPFQKYITKGYVSETESGKRLAQVVSDPSLTKSGVYWSWNNASASFENQLSEEASDVEKARKVWEISEKLVGLA

SEQ ID NO: 829 - DNA, 1419 bp, Arabidopsis thaliana
atgaacgtgatgcgtcgtctcaagagcattgcttcgggtcggacctccatttcttcggatcctggtggggactatgcgttgaagagagctaagctggatcaagagaacgacaacttgtgtgttgatccaatgcaggttgaccaaaatagttcttgttttgagatgaaagctgacgttttgtcacaagaaagtgttgctggaacgtcaaatgtgcctgctgtatcggaaaaacccgtggatgatcagcttcccgatgttatgatcgaaatgaagattagagacgagcgaaatgccaaccgcgaggataaggatatggaaacaactgttgtaaacggcagtgggaccgaaacgggacaagttattacgacgacagttgggggtagagatggaaagccaaagcagactatctcatacatggcccagcgagtggttggaaccggctcattcggagtagtgttccaggccaagtgcctggaaacgggtgaacaagttgcaattaagaaggttctgcaggataaaagatacaagaacagagaacttcagatcatgcgtttgcaagaccatcccaacgttgtgcggctgaggcattctttcttttcaacaactgacaaggatgagctgtatctcaaccttgtccttgagtatgttcccgaaactgtatacagagcatcgaagcactataccaaaatgaatcagcatatgccaattatctttgttcagctctatacttatcagatttgccgtgcgctgaactacttacatcgcgtggttggggtgtgtcaccgtgacattaagccacaaaatctactggttaatccccaaactcatcaattaaaaatatgcgattttggaagcgcaaagatgttggtacccggtgaacctaacatatcctatatatgctcccggtactacagggccccagaacttatatttggggcgacagagtataccaatgccattgacatgtggtccggcggttgtgtcatggcagagcttttacttggtcaaccactgtttcccggggaaagtggcattgatcagctggtggagataatcaagattcttgggacgcctacaagagaagaaatacggtgtatgaatccgaattacacagagttcaagtttcctcaaatcaaagctcacccgtggcacaagattttccacaagcgaatgccacctgaagcagtagacctcgtctcaagactccttcagtactcaccaaaccttcgttgcactgcattggaagcttgtgcacaccccttctttgatgacttacgggatccaaatgtttcactgccaaatggaagagcactgcctccattgtttaacttcactgcccaagaacttgcgggtgcatcaacagagctgcgacagcgtctaattccagcacattgccagggaacgggaagtagctcttag

SEQ ID NO: 830 - protein, 472 aa, Arabidopsis thaliana
MNVMRRLKSIASGRTSISSDPGGDYALKRAKLDQENDNLCVDPMQVDQNSSCFEMKADVLSQESVAGTSNVPAVSEKPVDDQLPDVMIEMKIRDERNANREDKDMETTVVNGSGTETGQVITTTVGGRDGKPKQTISYMAQRVVGTGSFGVVFQAKCLETGEQVAIKKVLQDKRYKNRELQIMRLQDHPNVVRLRHSFFSTTDKDELYLNLVLEYVPETVYRASKHYTKMNQHMPIIFVQLYTYQICRALNYLHRVVGVCHRDIKPQNLLVNPQTHQLKICDFGSAKMLVPGEPNISYICSRYYRAPELIFGATEYTNAIDMWSGGCVMAELLLGQPLFPGESGIDQLVEIIKILGTPTREEIRCMNPNYTEFKFPQIKAHPWHKIFHKRMPPEAVDLVSRLLQYSPNLRCTALEACAHPFFDDLRDPNVSLPNGRALPPLFNFTAQELAGASTELRQRLIPAHCQGTGSSS

SEQ ID NO: 831 - DNA, 1473 bp, Arabidopsis thaliana
atgggtttcgattctgttaaagttatggagaattggcaatccaagacatctaatgagaatgagaagaagaagaagaagcggaggaggaagaagaacaacaatgtcagaaacagtgaacattatgaagaagaagcaaatgggtgttgggtcaaatttaggtatatagtctgttgcgcttcttcaacatcagacgttgagacctctctcactctctctactagcactgtgggaagtcagtccgcaattgtgcaatcaaatgaccaaccggttggcccagtctcttctactactacaactagcaatgcagaaagctctttgtccactcctatcataagtgaagaacttaacatctattctcaccttaagaagttttctttcattgatctcaagttggctactagaaatttcagacctgaaagccttctcggagaaggtggctttggttgtgtcttcaaaggctgggtcgaggagaacggaactgctcctgttaagcctggcactggccttactgttgccgtcaaaaccttaaatcctgatggccttcagggtcataaagagtggcttgctgagattaattatcttggtaatcttctccatcccaatcttgttaaactggtgggttattgtatcgaagatgatcaaaggctgcttgtatatgagtttatgcctcgaggaagtttggagaatcaccttttcagaaggtccttgcctcttccatggtcaattcggatgaagattgcattaggtgctgcaaagggtctcagtttccttcacgaagaagctttaaagccggtcatttatcgagatttcaaaacctcaaatattttactggatggggagtacaatgctaaattatcagattttgggcttgccaaagatgctcctgatgaaggcaaaactcatgtgtctactcgagtcatgggcacttatggttacgctgcccccgagtatgtaatgaccggtcacttgacatcaaaaagcgacgtttacagtttcggtgtggttcttctcgaaatgctgactggtagaagatcaatggacaaaaatcgaccaaacggtgaacacaacctcgttgaatgggcgagaccgcatctcctggacaaaagaagattctaccggttacttgatccgaggctggagggtcatttctcagttaaaggagcacaaaaagtgactcagcttgcagcacaatgccttagccgtgactccaaaataagacccaaaatgagtgaagtggtggaagtacttaagcctctcccacacctcaaggacatggctagcgcttcttactacttccagacaatgcaagctgaacgtttgaaagctggttctggttctggttctggtcgtggattcgggtcaagaaacgggcaaccagtgtttcggacattgtctagtcctcatggtcaagctggttcgtcgccttatcgtcatcagattccgtctcctaagcctaaaggtgcaactacttag

SEQ ID NO: 832 - protein, 490 aa, Arabidopsis thaliana
MGFDSVKVMENWQSKTSNENEKKKKKRRRKKNNNVRNSEHYEEEANGCWVKFRYIVCCASSTSDVETSLTLSTSTVGSQSAIVQSNDQPVGPVSSTTTTSNAESSLSTPIISEELNIYSHLKKFSFIDLKLATRNFRPESLLGEGGFGCVFKGWVEENGTAPVKPGTGLTVAVKTLNPDGLQGHKEWLAEINYLGNLLHPNLVKLVGYCIEDDQRLLVYEFMPRGSLENHLFRRSLPLPWSIRMKIALGAAKGLSFLHEEALKPVIYRDFKTSNILLDGEYNAKLSDFGLAKDAPDEGKTHVSTRVMGTYGYAAPEYVMTGHLTSKSDVYSFGVVLLEMLTGRRSMDKNRPNGEHNLVEWARPHLLDKRRFYRLLDPRLEGHFSVKGAQKVTQLAAQCLSRDSKIRPKMSEVVEVLKPLPHLKDMASASYYFQTMQAERLKAGSGSGSGRGFGSRNGQPVFRTLSSPHGQAGSSPYRHQIPSPKPKGATT

SEQ ID NO: 833 - DNA, 738 bp, Arabidopsis thaliana
atggcaaaagtttcgtttaaggattctctgaaagctcttgaagctgatattcaacacgctaacactgtagctttagattatcctcgggagaaggatggagcgcgtgttcaaatgaggctatcgtacactccagctgctcagtttttactttttcttgtacaatggactgattgccatcttgctggtacactcggtctgctcagagttctgatttacatgacctatgcggatgggaaaaccacaatgtcggtttatgagagaaaaacaagtattaaagatttctatgctgtgatatttccgtcgttgttacaactagaaagaggtatcacagacctggatgatcgtaaacagaaagaagtctgcaaaatacggtacagaaataaagatgagactgaaaaggtcaagctctcggagattgacatcgagagagaagaagaatgcgggatttgtatggagatgaacaacatggtggttctccctaattgtacgcattctttatgcatcaagtgttaccgcgattggcacgggaggtcagaatcatgccctttttgccgagacagtcttaagagagtaaactcaggggacttatggatgttaatggagaaatccgatacggttaatatgtatacaattgagcgggagaataagaagaggttgtttgtgtatatagagaagctacctctagtggttccagatcaagtgtttgcttcttctccttatgattgccatgtcaagtaa

SEQ ID NO: 834 - protein, 245 aa, Arabidopsis thaliana
MAKVSFKDSLKALEADIQHANTVALDYPREKDGARVQMRLSYTPAAQFLLFLVQWTDCHLAGTLGLLRVLIYMTYADGKTTMSVYERKTSIKDFYAVIFPSLLQLERGITDLDDRKQKEVCKIRYRNKDETEKVKLSEIDIEREEECGICMEMNNMVVLPNCTHSLCIKCYRDWHGRSESCPFCRDSLKRVNSGDLWMLMEKSDTVNMYTIERENKKRLFVYIEKLPLVVPDQVFASSPYDCHVK

SEQ ID NO: 835 - DNA, 1299 bp, Arabidopsis thaliana
atggattcagatgcatgggaaattatccatatacctgaaaagccttcattgtcacctgaccatcagcccactgtgaaggtatatgctagcctaatcaaacccagatttgccaatacgatagtgaggcatttatgtaagattgctcctctagaagatcttcgtcatgttaaaagggtgaagaagaagattctgccagattgcggtgaaactcagttgactgtcatcttatgtctagcacctgagcacaacgatcagttgagtgacatgccacctgatgtgcagagactcgttgatccctatgagttgagtccttttattacacaagtaggttatttttctcttatctcaccactatttgcttcaagggtttttgattcatttagcttccaagtatgcaaatatgctgcggtatccaaagaagagtgggaagaacaaacaatatatgtctttgtttatagtgcaacagtcaatgattttttactttttgcatttggcaatgatagcaatatagatggcatcggtgggttcagcgaggaggaaacacaatcaatctgcaagttcatgagagttgttattgatatggcagtatctggtcatacaccacttgtgaatgctgcagtgatagttgatccttcagttaggcgaataatagctagtgaaactgatcaagtatatgcatcatctgctcctcgtgacatgactagcgcagagaccaggcccttcgaggaaacaggggaaatatgtttaaatgacacacttgaaaaacagaatggttcattgtctgctctttcttgtctgaatccctggcaatggagtttgcagccgcatgacactgaaaattgtagccagtggcatcctcttaggcatgcttccatggttgccattgaatcctcttctgccagagatagaaatctgtttcccaatccatccaagatttttgatcaggatcatgttccgccctcaaatacagattctccggctaaaaagcagaaaacaagcagtcagagtccagacgtccaaaatgacagcagagaagagactgttagagatccttcaatggaaaggccgtacctctgcactggttatgacattttcctcctgttggagccttgtacaatgtgtgctatggcgcttgtgcatcaaagaataaaacggattttctatgcttttccaaacaccacggcaggtggtctcgggagtgttcatagacttcaaggggaaaagagtttgaaccatcattatgcagtgtttagagttttgctgcctgatgacgcacttagacaaatgaccacggtctaa

SEQ ID NO: 836 - protein, 432 aa, Arabidopsis thaliana
MDSDAWEIIHIPEKPSLSPDHQPTVKVYASLIKPRFANTIVRHLCKIAPLEDLRHVKRVKKKILPDCGETQLTVILCLAPEHNDQLSDMPPDVQRLVDPYELSPFITQVGYFSLISPLFASRVFDSFSFQVCKYAAVSKEEWEEQTIYVFVYSATVNDFLLFAFGNDSNIDGIGGFSEEETQSICKFMRVVIDMAVSGHTPLVNAAVIVDPSVRRIIASETDQVYASSAPRDMTSAETRPFEETGEICLNDTLEKQNGSLSALSCLNPWQWSLQPHDTENCSQWHPLRHASMVAIESSSARDRNLFPNPSKIFDQDHVPPSNTDSPAKKQKTSSQSPDVQNDSREETVRDPSMERPYLCTGYDIFLLLEPCTMCAMALVHQRIKRIFYAFPNTTAGGLGSVHRLQGEKSLNHHYAVFRVLLPDDALRQMTTV

SEQ ID NO: 837 - DNA, 774 bp, Arabidopsis thaliana
atggacgaaaccaacggacgaagagaaactcacgatttcatgaacgtcaacgttgaatccttctctcagcttcctttcatccgccgtactcctcccaaagaaaaagccgccattattcgtctcttcggccaagagctcgtcggtgataactccgacaacttatccgcagaaccttctgatcatcaaaccactaccaagaacgatgagagctctgagaatatcaaggacaaagacaaagaaaaagataaggacaaagacaaagataacaacaacaacaggagattcgagtgtcactactgcttcagaaacttcccaacttctcaagccctaggtggacatcaaaacgctcacaaacgtgaacgtcaacacgccaaacgcggttccatgacatcataccttcatcatcatcagcctcatgaccctcaccacatctacggcttcctcaacaaccaccaccaccgtcactatccgtcttggacgacggaagctagatcatactacggcggagggggacatcaaacgccgtcgtactactcaaggaatactcttgctcctccttcttctaacccaccgacaatcaacggaagtcctttaggtttgtggcgtgtaccgccttccacgtcaacaaatactattcaaggcgtttactcatcttcaccagcttcagcgtttaggtcgcatgagcaagagactaataaggagcctaataactggccgtacagattgatgaaacccaatgtgcaagatcatgtgagtctcgatcttcatctctga

SEQ ID NO: 838 - protein, 257 aa, Arabidopsis thaliana
MDETNGRRETHDFMNVNVESFSQLPFIRRTPPKEKAAIIRLFGQELVGDNSDNLSAEPSDHQTTTKNDESSENIKDKDKEKDKDKDKDNNNNRRFECHYCFRNFPTSQALGGHQNAHKRERQHAKRGSMTSYLHHHQPHDPHHIYGFLNNHHHRHYPSWTTEARSYYGGGGHQTPSYYSRNTLAPPSSNPPTINGSPLGLWRVPPSTSTNTIQGVYSSSPASAFRSHEQETNKEPNNWPYRLMKPNVQDHVSLDLHL

SEQ ID NO: 839 - DNA, 1134 bp, Arabidopsis thaliana
atgtctgtctccgagctcaaagaacgccacgccgtcgctacggagaccgttaataacctccgtgaccagcttagacagagacgcctccagctcctcgataccgatgtggcgaggtattcagcggcgcaaggacgtactcgggtgagcttcggagcaacggatctggtttgttgtcgtactcttcagggacacaccggaaaggtttattcattagattggacaccggagaggaaccggattgtcagtgcatctcaagatgggagattaatcgtgtggaatgctctaacgagtcagaaaactcatgctattaaactcccttgtgcatgggttatgacatgtgctttctctccaaatggtcagtcggttgcgtgtggtggattagacagtgtatgttctatctttagccttagctcaacggcggacaaggatggaactgtaccggtttcaagaatgctcactggtcacaggggatatgtttcgtgctgtcagtatgtcccaaatgaggatgcccaccttatcaccagttcaggtgatcaaacttgtatcttatgggatgtaactactggtctcaaaacttctgtttttggcggtgaatttcagtctggacatactgctgatgtactaagcgtctcaatcagtggatcaaacccaaactggtttatatctggttcatgcgattccacagcacggttgtgggacactcgtgctgcaagccgagcagtgcgtacctttcatggtcacgagggagatgttaatacggtcaagttctttccggatgggtatagatttgggactggatcagacgatggaacatgcaggctgtatgacataaggactggtcaccaactccaggtctatcagccacatggtgatggtgagaacggacctgtcacctccattgcattctctgtgtcagggagacttcttttcgctggctatgcgagcaacaacacttgctacgtttgggataccctcttgggagaggttgtattggatttgggattacagcaggattcacacaggaatagaataagctgtttggggttgtcagcagatggaagtgccttgtgtacaggaagttgggattcaaatctaaagatatgggcgtttggaggacacaggagagtgatttga

SEQ ID NO: 840 - protein, 377 aa, Arabidopsis thaliana
MSVSELKERHAVATETVNNLRDQLRQRRLQLLDTDVARYSAAQGRTRVSFGATDLVCCRTLQGHTGKVYSLDWTPERNRIVSASQDGRLIVWNALTSQKTHAIKLPCAWVMTCAFSPNGQSVACGGLDSVCSIFSLSSTADKDGTVPVSRMLTGHRGYVSCCQYVPNEDAHLITSSGDQTCILWDVTTGLKTSVFGGEFQSGHTADVLSVSISGSNPNWFISGSCDSTARLWDTRAASRAVRTFHGHEGDVNTVKFFPDGYRFGTGSDDGTCRLYDIRTGHQLQVYQPHGDGENGPVTSIAFSVSGRLLFAGYASNNTCYVWDTLLGEVVLDLGLQQDSHRNRISCLGLSADGSALCTGSWDSNLKIWAFGGHRRVI

SEQ ID NO: 841 - DNA, 2052 bp, Arabidopsis thaliana
atgttaaacggctggagaagagctttttgcacttccattcccaaagaaactaaccaaaacgacgtcgacgacgacggactcgttggtctccgccacaaatcaacctctcgattcggctttttctcaactccttctacgcctcgttctgattccggcaccggaacttacagcctccgttgcaggacttcaacagccaccgccgtctccactacttcatctcttcccggaactccaaagcttaagtgcaaaaccaccaccaccggagaaacaactcccagaaacagaagccttgtctctcttttaacaccttcttcttcttctatttctccggcgagcttcactctcctcaaatccaaactccgattcaagcagagtagcagtaacaaatgtggaatctgtttacagagtgtgaaatcaggtcaaggtacggcgattttcacggcggagtgttctcacacgtttcattttccttgcgtaacctcacgcgccgccgcgaatcataaccgtcttgcttcttgtccggtttgcggatcctcgcttttgcctgagattcgaaattacgctaaaccggaatctcaaatcaaaccggaaattaaaaacaagtcgttgagagtttacaacgatgacgaagctttgatttcatctccgatatctcccgccggatttcacacaatacttgaatcagatgagaacgaagactgcgaggagtttacaggattttccgttaatactccgtcacctttaacggcgaaattgttaacggatcgaaacgtggacgttaagctctctccggaatcggctatcgttgcgtcgggtaaaggctacgagacttactccgtcgtcatgaaggtgaaatcgccaccgtttccgacggcgcgtggatttgcgcgtagagtgccggtggatttggttgctgttttagacgtaagcgggagaaattccggtgggaaattggagatgttgaaacaaacgatgaggattgtgctttcgaatctccgggagatggatcgtttatcgattattgcgttttcgtccagctcgaaacggttatcgccgttacggaggatgacggcgaacgggaggagatcggcgcgaagaatcgtagatatcatcaccgttcctggttctgtctccggcgtcggaattgatttctccggtgaagggatgagtgtgaacgacgcgttgaagaaagcggttaaggtgttagacgatcgccggcagaaaaaccctttcaccgccgtgttcgttttaacggaccgtcaagcccatcaagtggcccaattagcccattcgagaatccctatacacaccatatggcttagccacgcgattcccgaagacgcgtttgcgaggaccatcaacggttatttgagtttgtcggttcaggatctcggtttacagctcgggatagtttccgggttgggtcaaggagagataacttctgtttactctctttccggtcgacccgcttggcttggaaccggttcaatccggttaggtgatatgtatgcggaggaagaaagagcgttgctggttgaaatcaaatcaccggttaacaattccttaaccggtagtagatctcacaaaatcatgaccgttagatctcgttacgtggatccaacaactcaggaattaagaaaccccgaagatcgcgcgcttttaatacctactcctctaactgtccgatcatcatcaaatcccaacatctcacggctcagaaacctccacgtcagcactcgagccgtcgcggagtctcggcggctaatagagcgtaaccattactccggagctcatagattgctgacgtcagctagagcattgcttgtgcagcacggtttgagctcgagcgatgcgtgtatacgtggactggacgcagagatagctgatcttaatagtgtgaaaggaagacacgtggcggcatcagagagtttggagtcgcttactccgacgtcggcttggaaagcggcggagaggttggctaaagtggcgatggtgaggaaacatatgaacagagtcagtgacttgcatggtttcgaaaacgctagattttag

SEQ ID NO: 842 - protein, 683 aa, Arabidopsis thaliana
MLNGWRRAFCTSIPKETNQNDVDDDGLVGLRHKSTSRFGFFSTPSTPRSDSGTGTYSLRCRTSTATAVSTTSSLPGTPKLKCKTTTTGETTPRNRSLVSLLTPSSSSISPASFTLLKSKLRFKQSSSNKCGICLQSVKSGQGTAIFTAECSHTFHFPCVTSRAAANHNRLASCPVCGSSLLPEIRNYAKPESQIKPEIKNKSLRVYNDDEALISSPISPAGFHTILESDENEDCEEFTGFSVNTPSPLTAKLLTDRNVDVKLSPESAIVASGKGYETYSVVMKVKSPPFPTARGFARRVPVDLVAVLDVSGRNSGGKLEMLKQTMRIVLSNLREMDRLSIIAFSSSSKRLSPLRRMTANGRRSARRIVDIITVPGSVSGVGIDFSGEGMSVNDALKKAVKVLDDRRQKNPFTAVFVLTDRQAHQVAQLAHSRIPIHTIWLSHAIPEDAFARTINGYLSLSVQDLGLQLGIVSGLGQGEITSVYSLSGRPAWLGTGSIRLGDMYAEEERALLVEIKSPVNNSLTGSRSHKIMTVRSRYVDPTTQELRNPEDRALLIPTPLTVRSSSNPNISRLRNLHVSTRAVAESRRLIERNHYSGAHRLLTSARALLVQHGLSSSDACIRGLDAEIADLNSVKGRHVAASESLESLTPTSAWKAAERLAKVAMVRKHMNRVSDLHGFENARF

SEQ ID NO: 843 - DNA, 1068 bp, Arabidopsis thaliana
atgggattcggcttagagagtatcaaatcaatctccggcggatggggcgcggcggcgcgttcctgtgacgcttgtaaatcagttaccgccgccgtgttctgtcgagttgactcagctttcttatgcatagcatgtgacacaagaatccattccttcactcgccacgagcgcgtgtgggtttgtgaagtttgtgaacaagctcccgccgccgtcacttgcaaagccgacgccgccgctctttgcgtcagttgtgatgccgatattcactctgctaatcctctcgctagccgtcacgaacgtgtccccgtcgaaactttcttcgactcagccgaaaccgccgtcgccaaaatctcagcttcttcgacttttggtatccttggctcatccaccaccgttgatttaaccgctgttccggttatggctgatgatctcggtttatgtccgtggttacttcctaatgatttcaacgaaccggctaaaatcgaaatcggaactgaaaacatgaaaggttcttctgactttatgttttctgatttcgatcggcttattgatttcgagtttccgaattcgttcaatcatcatcaaaacaacgccggaggagatagtcttgttccggttcagacgaaaacagagcctctcccgttaactaacaatgatcattgcttcgatattgatttctgcagatcaaagctctctgctttcacttacccttctcaatcagtcagccacagtgtttcgacttcttctattgaatacggtgtagttcctgacggaaacacaaacaactctgttaaccggagcacgatcactagctcgacgactggtggtgatcatcaagcgagctctatggatagagaagctagggttttgaggtacagagagaagagaaagaacaggaaatttgagaagacgattcgttacgcttcgaggaaagcttatgcagagtcacggccaaggatcaaaggccggtttgcgaaaagaacagagacagaaaacgacgacattttccttagtcatgtttatgcttcagcagcacacgcacagtacggtgtcgtaccaacgttctga

SEQ ID NO: 844 - protein, 355 aa, Arabidopsis thaliana
MGFGLESIKSISGGWGAAARSCDACKSVTAAVFCRVDSAFLCIACDTRIHSFTRHERVWVCEVCEQAPAAVTCKADAAALCVSCDADIHSANPLASRHERVPVETFFDSAETAVAKISASSTFGILGSSTTVDLTAVPVMADDLGLCPWLLPNDFNEPAKIEIGTENMKGSSDFMFSDFDRLIDFEFPNSFNHHQNNAGGDSLVPVQTKTEPLPLTNNDHCFDIDFCRSKLSAFTYPSQSVSHSVSTSSIEYGVVPDGNTNNSVNRSTITSSTTGGDHQASSMDREARVLRYREKRKNRKFEKTIRYASRKAYAESRPRIKGRFAKRTETENDDIFLSHVYASAAHAQYGVVPTF

SEQ ID NO: 845 - DNA, 708 bp, Arabidopsis thaliana
atgaggagagttttcggcgcgaaaaagaacacagagcctcctccgtccattcaggatgcctctgatcggataaataaaagaggagattcggtagaagataagataaagaagcttgatgttgagctctgcaaatacaaagaacagctcaaaaagaccagacctggtcctgctcaagaagctgtcaaagctcgtgctatgcgagttctcaagcagaagaaaatgtatgaaggacaacgcgacatgctctataatcagacattcaatctcgatcaagtttcattcgccgctgaaggactcaaagatgctcaacaaactatgacagcactaaaatctgcgaacaaggagttgaaaggaatgatgaaaaccgtcaagattcaagatattgataatttacaagacgagatgatggatctgatggatgttagttctgaaattcaagaatcacttggtaggagctacaatattcctgatggccttgacgaggatgacctcatgggagagcttgatgctcttgaagctgacatgggaaacgagaccgaagcagatggaatgccttcttatctccaacctgatacagaaactgattacgatagcgagcttaacttgcctgcagcaccaacaggacacaatggagctccacatggaagagctcaggctgaggacgaatttggattaccagcagtgccacgagcttctctccggggttaa

SEQ ID NO: 846 - protein, 235 aa, Arabidopsis thaliana
MRRVFGAKKNTEPPPSIQDASDRINKRGDSVEDKIKKLDVELCKYKEQLKKTRPGPAQEAVKARAMRVLKQKKMYEGQRDMLYNQTFNLDQVSFAAEGLKDAQQTMTALKSANKELKGMMKTVKIQDIDNLQDEMMDLMDVSSEIQESLGRSYNIPDGLDEDDLMGELDALEADMGNETEADGMPSYLQPDTETDYDSELNLPAAPTGHNGAPHGRAQAEDEFGLPAVPRASLRG

SEQ ID NO: 847 - DNA, 2115 bp, Arabidopsis thaliana
atggagtctactgctaacgcactcgtcgtcaaggtgagctatggaggtgtgcttaggcgtttcagggtgcctgttaaagctaatggacagcttgatcttgaaatggctggtcttaaggaaaagatcgctgctctctttaacctctctgcggatgctgaattgagtctgacttactctgatgaggatggggatgtggttgcccttgttgatgacaacgatctctttgatgttactaatcagcgtcttaagttcttaaagatcaatgtgaacgctggcgtgtccactaactctgctgctccagagagtagtgggagttccacacctgcgggtatgcctaacccggtttccaaaatccagaagggtataaatgatgttctgatggctgtacctaacccgatgcgtgataccatatcaaaggtgtacatggaccttgcatccaaggcctcaacttctagtcctgtagttggtgagatgcttgattgcatttccaagctagggcagctctcaattcctcaggaaagtagtccttgctcacctgttaccaagcctggttcttcaggtgcttccctgagcagggatgttccttccgctggtggaaagaaggatatctctgagaggacccagaccggaaggaaacctgttaatctgaatgaacccactggcgctcattcaaagacttctggtcatgtaccaaactcgtctggactgggtgctaatttcaacgagtgtccctttagtggcagtaccatgaattactcctgtccaaatccagttaacctcaacaagcatcctcgtcgtgtttgtcattccaaaaagagcaccaatggtgattactggacttcattgggtgtattccataagggcatccgttgtgacggatgtggagttcttccaattactgggcctagatttaagtcgaaagttaaagaagactatgatctgtgcaccatctgctattcggtgatgggtaacgagggggattacacaagaatggataagcctgtatccgttcaacatctgcatccttttagaggaccgtttacccaatttcctaatccttggttgagccaccctgtgccacgagcaaccaatggaggtgcacctctcaggtgtactcgccctaaactagacagtcggtttgtccttgatgtgaatgtaattgatggaaccgttgttgctccatccgccccatttactaagatttggaaaatgaggaacagtggttcgctggtgtggccacagggcacacagattgtctggatcggtggggacaggttctgcaactccttgtcagttgatttacagattccaaaggagggtgtgcctatctatagtgaacttgacgtcaaagttgattttgttgcaccagagttacctggtcgatacatttcttattggaggatggctacctctgacggtgctaagtttgggcaacgtgtttgggtgttgatacatgttgatgcatctctgaagaattctgttgtgaatgagtttcatggactgaaccttaatgcctccccctcccttgatgagaattttccaagcgaatttctagggattatgaattatgagtcagctcaacctggcagctccagtgtcaatcctgggaccgtgaaaggtactgatctagagggcgaagttggtgaaacacaggccgtggaaaaagaaaaccttttggttggtgaagctcatcctgctatccctcacggtcattctccttcatcttcatcttcttcatttaacatggtcgacttcccaagcatgcctgctgttgaggtcttgtctggtggttcttcatctactacaaaagacgtgccagttcctcttcaggaggatatagaaaagaatgacgtggagataaccatgctcaaggagctcgaggaaatgggtttcaaggagatagatttgaacaaggagatcttgagggataacgagtacaacctggagcagtctgttgatgctctttgtggagttagcgagtgggatccaatcctagaggagcttcaggagatgggcttctgtgatgatgtgacgaacaagagactgctgaagaagaacaatggaagcatcaaaggcgtggtaatggatctcctcacaggggagaaggaggcttga

SEQ ID NO: 848 - protein, 704 aa, Arabidopsis thaliana
MESTANALVVKVSYGGVLRRFRVPVKANGQLDLEMAGLKEKIAALFNLSADAELSLTYSDEDGDVVALVDDNDLFDVTNQRLKFLKINVNAGVSTNSAAPESSGSSTPAGMPNPVSKIQKGINDVLMAVPNPMRDTISKVYMDLASKASTSSPVVGEMLDCISKLGQLSIPQESSPCSPVTKPGSSGASLSRDVPSAGGKKDISERTQTGRKPVNLNEPTGAHSKTSGHVPNSSGLGANFNECPFSGSTMNYSCPNPVNLNKHPRRVCHSKKSTNGDYWTSLGVFHKGIRCDGCGVLPITGPRFKSKVKEDYDLCTICYSVMGNEGDYTRMDKPVSVQHLHPFRGPFTQFPNPWLSHPVPRATNGGAPLRCTRPKLDSRFVLDVNVIDGTVVAPSAPFTKIWKMRNSGSLVWPQGTQIVWIGGDRFCNSLSVDLQIPKEGVPIYSELDVKVDFVAPELPGRYISYWRMATSDGAKFGQRVWVLIHVDASLKNSVVNEFHGLNLNASPSLDENFPSEFLGIMNYESAQPGSSSVNPGTVKGTDLEGEVGETQAVEKENLLVGEAHPAIPHGHSPSSSSSSFNMVDFPSMPAVEVLSGGSSSTTKDVPVPLQEDIEKNDVEITMLKELEEMGFKEIDLNKEILRDNEYNLEQSVDALCGVSEWDPILEELQEMGFCDDVTNKRLLKKNNGSIKGVVMDLLTGEKEA

SEQ ID NO: 849 - DNA, 1461 bp, Arabidopsis thaliana
atggcacccgtgagggggattcttggcttgcaaagggcagtgtccatttggaaggaaagtaacagactgactccagctttgagatcattcagcactcaagctgcatccacttccaccactccacagcctcctccacctcctccgcctccggaaaagactcatttcggtggtctcaaggatgaagatcggatttttactaatctctatggtctgcatgacccatttctcaaaggcgcgatgaagagaggtgattggcataggaccaaagatttggtgctcaagggtactgattggattgtcaatgaaatgaagaaatctggacttcgtggacgtggtggtgctggtttcccttctggtcttaagtggtcctttatgcctaaagtttctgatggccgtccctcctatttggttgtcaatgctgatgagagtgagcctggaacttgtaaagatagggagatcatgcgtcatgaccctcacaaattgttggaagggtgtttgattgctggtgttggaatgagagctagtgctgcgtatatttacatcaggggtgaatatgtgaatgagcgtttgaatctagagaaggctagaagagaagcgtatgcagctggtctcttggggaagaatgcatgtggttctggttatgattttgaagtttatatccactttggtgctggtgcgtacatttgtggtgaagagactgcgcttcttgaaagccttgaagggaagcaaggaaaacctaggttgaagcctccgttccctgctaatgctggtttatatggttgtcccacaactgttaccaatgtggaaacagtggctgtttcgcctaccattttaaggcgtggacctgagtggttttctagtttcggtaggaagaataacgctgggacaaagctcttttgtatatcaggccatgtaaacaagccatgcacggtggaagaggagatgagtatacctctcaaggaactgattgagaggcattgtggaggtgttaggggtggatgggacaatctacttgctatcatccctggtggttcatctgttcctctgatccctaagaacatttgcgaggatgtgctgatggatttcgatgcgctcaaggctgtccaatcagggttaggaactgcagcagtcattgtgatggataaatcaaccgatgttgtggatgcaattgcaaggctctcttacttctacaagcatgaaagctgtgggcagtgcactccttgcagagagggaacaggttggctttggatgatcatggagagaatgaaagttggcaatgcaaagctggaagagattgatatgctgcaggaggtaaccaaacagatcgaaggacacacaatctgtgcattgggtgatgcagctgcatggcctgtgcaaggtctgataagacactttaggccagagctcgagagaaggatcagggaacgcgctgaaagggagttgctacaggctgctgcttaa

SEQ ID NO: 850 - protein, 486 aa, Arabidopsis thaliana
MAPVRGILGLQRAVSIWKESNRLTPALRSFSTQAASTSTTPQPPPPPPPPEKTHFGGLKDEDRIFTNLYGLHDPFLKGAMKRGDWHRTKDLVLKGTDWIVNEMKKSGLRGRGGAGFPSGLKWSFMPKVSDGRPSYLVVNADESEPGTCKDREIMRHDPHKLLEGCLIAGVGMRASAAYIYIRGEYVNERLNLEKARREAYAAGLLGKNACGSGYDFEVYIHFGAGAYICGEETALLESLEGKQGKPRLKPPFPANAGLYGCPTTVTNVETVAVSPTILRRGPEWFSSFGRKNNAGTKLFCISGHVNKPCTVEEEMSIPLKELIERHCGGVRGGWDNLLAIIPGGSSVPLIPKNICEDVLMDFDALKAVQSGLGTAAVIVMDKSTDVVDAIARLSYFYKHESCGQCTPCREGTGWLWMIMERMKVGNAKLEEIDMLQEVTKQIEGHTICALGDAAAWPVQGLIRHFRPELERRIRERAERELLQAAA

SEQ ID NO: 851 - DNA, 582 bp, Arabidopsis thaliana
atgaggttccggtacgcaatggtttgttcgtcgaatcagaaccggagcatggaagctcacgctcttcttaagagacaaggactcgacgttgcttcgtacgggactgggtcacatgtaaaactacctggaccatctctgagagagccaaacgtttacgactttggaactccttacaagcagatgttcgatgagctcaggcgcaaagatcctgaactatacaagcggaatggtattttgcagatgattaagaggaatttatccgtgaaacttgctcctcaaagatggcaagataatgctggtgatggtgtgtttgatgtggttatgacttttgaagaaaaggttttcgattcagtccttgaagatctcaacaacagagaacaatcacttacgaaaacaatacttgtgatgaacttggaggttaaagataaccacgaagaagcagctataggtggccgacttgccttggaactctgtcaagagattgaagggaatgaaacatgggaagatacgatcgatgacattgttgcgggttttgaaaaacaacacaggcggaaactggtctacagcatctcattctactga

SEQ ID NO: 852 - protein, 193 aa, Arabidopsis thaliana
MRFRYAMVCSSNQNRSMEAHALLKRQGLDVASYGTGSHVKLPGPSLREPNVYDFGTPYKQMFDELRRKDPELYKRNGILQMIKRNLSVKLAPQRWQDNAGDGVFDVVMTFEEKVFDSVLEDLNNREQSLTKTILVMNLEVKDNHEEAAIGGRLALELCQEIEGNETWEDTIDDIVAGFEKQHRRKLVYSISFY

SEQ ID NO: 853 - DNA, 1545 bp, Arabidopsis thaliana
atggccggagggttcgtcagtcaaacgccgggtgttcggaactacaattacaaactgacaccgaaagtgtttgtgacatgtttcatcggtgcttttggtggtctcatcttcggatacgatctcgggatctcaggaggggtaacctcaatggagccattcttggaagagttcttcccttacgtctacaagaagatgaagagcgcacatgagaacgagtactgtcgatttgatagtcagcttctcactctcttcacttcgtctctctatgtggcggctttggtgtcttctctctttgcctccaccattactagagttttcggaaggaaatggtcgatgtttctcggtggtttcaccttcttcatcggttctgctttcaacggctttgcccaaaacatcgctatgcttctcattggtcgtatcctacttggtttcggagtcggattcgccaatcaatctgtaccggtttatttatcagaaatggctcctccgaatctaagaggagctttcaacaacgggtttcaagtagcgattatctttggtattgtggttgcaacgatcatcaattacttcaccgcacagatgaaaggaaacatcggatggagaatctctctcggattagcttgtgtccctgcagtgatgatcatgatcggagctctgatccttcccgacactcccaactctctcatcgaacgtggctacaccgaagaggccaaggaaatgcttcagtccatccgaggaaccaatgaagtcgatgaagagtttcaagatctcattgatgcaagtgaggagtccaagcaagtgaaacacccatggaagaacatcatgcttcctcgttacagaccacaattgatcatgacttgcttcattcctttctttcaacaacttaccggaatcaatgtcattaccttctacgccccggttttgttccaaaccctcgggttcggtagcaaagcttccctcctatcagctatggtaacgggtatcatcgagctcttgtgtaccttcgtctctgtttttacagtggataggtttggaagaagaatcttgttcctccaaggaggtatccagatgcttgtctctcagatcgctattggagccatgattggagtcaaatttggagtggctggaacaggaaacatagggaaaagtgatgccaatctaatcgtggcactgatctgcatctatgtagcgggtttcgcctggtcatggggaccgttgggatggttggttcctagtgagatatctccactagagatccgatcagcagctcaagccataaacgtttcggtcaacatgttcttcacattccttgtggctcagctcttcctcactatgctttgtcacatgaaattcggactattcttcttcttcgccttctttgttgtcataatgacaatattcatctacttgatgttgcctgagacaaagaatgtgccaatcgaagagatgaacagagtgtggaaggcacattggttctggggaaagtttattcctgatgaagctgtcaatatgggtgctgctgagatgcaacagaagtccgtatga

SEQ ID NO: 854 - protein, 514 aa, Arabidopsis thaliana
MAGGFVSQTPGVRNYNYKLTPKVFVTCFIGAFGGLIFGYDLGISGGVTSMEPFLEEFFPYVYKKMKSAHENEYCRFDSQLLTLFTSSLYVAALVSSLFASTITRVFGRKWSMFLGGFTFFIGSAFNGFAQNIAMLLIGRILLGFGVGFANQSVPVYLSEMAPPNLRGAFNNGFQVAIIFGIVVATIINYFTAQMKGNIGWRISLGLACVPAVMIMIGALILPDTPNSLIERGYTEEAKEMLQSIRGTNEVDEEFQDLIDASEESKQVKHPWKNIMLPRYRPQLIMTCFIPFFQQLTGINVITFYAPVLFQTLGFGSKASLLSAMVTGIIELLCTFVSVFTVDRFGRRILFLQGGIQMLVSQIAIGAMIGVKFGVAGTGNIGKSDANLIVALICIYVAGFAWSWGPLGWLVPSEISPLEIRSAAQAINVSVNMFFTFLVAQLFLTMLCHMKFGLFFFFAFFVVIMTIFIYLMLPETKNVPIEEMNRVWKAHWFWGKFIPDEAVNMGAAEMQQKSV

SEQ ID NO: 855 - DNA, 1071 bp, Arabidopsis thaliana
atggagttggatcttacacctaagttgcccaagaaggtttacggaggagatggtggatcttactctgcctggtgcccagaggagttgccgatgctcaaacagggtaacattggagccgctaagcttgctcttgagaagaatggcttcgctgtccctcgttactctgattcctctaaggtcgcttatgttcttcaaggatctggaactgctggaattgttctcccagagaaggaggagaaggtgatcgcaatcaagcaaggtgattcgattgctcttccctttggtgtggtcacatggtggttcaacaacgaggatcctgagcttgttatcctcttccttggtgaaacccacaagggtcacaaagcagggcagttcactgagttctatcttactggcacaaacggtatcttcactggtttctccactgagtttgttggcagagcctgggaccttgatgagaacaccgtgaagaaacttgttggttctcaaaccggtaatggcattgtgaagcttgatgcgggctttaagatgccacagcccaaggaggagaaccgtgctgggtttgtcttgaactgtttggaggctcctcttgatgtagacatcaaggatggaggcagggtcgttgtcttgaacaccaagaaccttcctttggttggagaggttggctttggagctgatcttgttcggatcgatgcacactccatgtgttcgcctggtttctcttgtgactctgctcttcaggtgacttacattgtgggtggaagtggaagagtccaggtggttggtggtgatgggaaaagagttcttgagacccatatcaaagctggttctctcttcattgttccaaggttctttgtggtttctaagattgctgatgctgatggcatgtcttggttctccattgtcaccactcctgatccgatcttcacacatttggccgggaatacatcggtgtggaagtctttgtcccctgaggttttgcaggcagcgtttaaggtggctccggaggtggagaagtccttccgatccacgaggacttcatcagccattttcttccctccttccaactga

SEQ ID NO: 856 - protein, 356 aa, Arabidopsis thaliana
MELDLTPKLPKKVYGGDGGSYSAWCPEELPMLKQGNIGAAKLALEKNGFAVPRYSDSSKVAYVLQGSGTAGIVLPEKEEKVIAIKQGDSIALPFGVVTWWFNNEDPELVILFLGETHKGHKAGQFTEFYLTGTNGIFTGFSTEFVGRAWDLDENTVKKLVGSQTGNGIVKLDAGFKMPQPKEENRAGFVLNCLEAPLDVDIKDGGRVVVLNTKNLPLVGEVGFGADLVRIDAHSMCSPGFSCDSALQVTYIVGGSGRVQVVGGDGKRVLETHIKAGSLFIVPRFFVVSKIADADGMSWFSIVTTPDPIFTHLAGNTSVWKSLSPEVLQAAFKVAPEVEKSFRSTRTSSAIFFPPSN

SEQ ID NO: 857 - DNA, 2430 bp, Arabidopsis thaliana
atgtctaccccagctgaatcttcagactcgaaatcgaagaaagatttcagtactgctattctcgagaggaagaagtctccgaaccgtctcgtcgtcgatgaggctatcaacgatgataactccgtcgtctctcttcaccctgcaaccatggagaagcttcagctcttccgtggtgataccattctcatcaagggtaagaagaggaaggacactgtctgcattgctcttgctgatgagacatgtgaggagccaaagatcagaatgaataaagtagtcagatctaacttgagggttagactgggagatgttatatctgttcaccaatgcccagacgtcaagtacggaaagcgtgttcacatcctgcctgttgatgatactgttgaaggagtgactggaaacctatttgatgcttacctgaaaccttatttccttgaggcataccgtccagtgaggaagggtgatctcttcctagtcagaggaggaatgaggagtgtggagttcaaagttatagagacagatcctgctgagtactgcgtggttgctccagacacagagattttctgtgagggtgagcctgtgaagagagaggatgaagaaaggctagatgatgtaggttatgatgatgttggtggtgtcaggaaacagatggctcagattagggaacttgttgaacttcccttgaggcatccacagctattcaagtcgattggtgttaagccaccgaagggaattcttctttatggaccacctgggtctggaaagactttgatcgctcgtgctgtggctaatgaaacgggtgcctttttcttctgtatcaacggacctgagatcatgtccaaattggctggtgagagtgagagcaacctcaggaaagcattcgaggaggctgagaaaaatgcgccttcaatcatattcattgatgagatcgactctattgcaccgaaaagagagaagactaatggagaggttgagaggaggattgtctctcagctccttacgctaatggatggactgaaatctcgtgctcatgttatcgtcatgggagcaaccaatcgccccaacagtatcgacccagctttgagaaggtttggaagatttgacagggagatcgatattggagttcctgacgaaattggacgtcttgaagttctgaggatccatacaaagaacatgaagctggctgaagatgtggatctcgaaaggatctcaaaggacacacacggttacgtcggtgctgatcttgcagctttgtgcacagaggccgccctgcaatgcatcagggagaagatggatgtgattgatctggaagatgactccatagacgctgaaatcctcaattccatggcagtcactaatgaacatttccacactgctctcgggaacagcaacccatctgcacttcgtgaaactgttgtggaggttcccaacgtctcttggaatgatattggaggtcttgagaatgtcaagagagagctccaggagactgttcaatacccagtcgagcacccagagaagtttgagaaattcgggatgtctccatcaaagggagtccttttctacggtcctcctggatgtgggaaaacccttttggccaaagctattgccaacgagtgccaagctaatttcatcagtgtcaagggtcccgagcttctgacaatgtggtttggagagagtgaagcaaatgttcgtgaaatcttcgacaaggcccgtcaatccgctccatgtgttcttttctttgatgagctcgactccattgcaactcagagaggaggtggaagtggtggcgatggaggtggtgctgcggacagagtcttgaaccagcttttgactgagatggacggaatgaatgccaagaaaaccgtcttcatcatcggagctaccaacagacctgacattatcgattcagctcttctccgtcctggaaggcttgaccagctcatttacattccactaccagatgaggattcccgtctcaatatcttcaaggccgccttgaggaaatctcctattgctaaagatgtagacatcggtgcacttgctaaatacactcagggtttcagtggtgctgatatcactgagatttgccagagagcttgcaagtacgccatcagagaaaacattgagaaggacattgaaaaggagaagaggaggagcgagaacccagaggcaatggaggaagatggagtggatgaagtatcagagatcaaagctgcacactttgaggagtcgatgaagtatgcgcgtaggagtgtgagtgatgcagacatcaggaagtaccaagcctttgctcagacgttgcagcagtctagagggttcggttctgagttcaggttcgagaattctgctggttcaggtgccaccactggagtcgcagatccgtttgccacgtctgcagccgctgctggggacgatgatgatctctacaattag

SEQ ID NO: 858 - protein, 809 aa, Arabidopsis thaliana
MSTPAESSDSKSKKDFSTAILERKKSPNRLVVDEAINDDNSVVSLHPATMEKLQLFRGDTILIKGKKRKDTVCIALADETCEEPKIRMNKVVRSNLRVRLGDVISVHQCPDVKYGKRVHILPVDDTVEGVTGNLFDAYLKPYFLEAYRPVRKGDLFLVRGGMRSVEFKVIETDPAEYCVVAPDTEIFCEGEPVKREDEERLDDVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTNGEVERRIVSQLLTLMDGLKSRAHVIVMGATNRPNSIDPALRRFGRFDREIDIGVPDEIGRLEVLRIHTKNMKLAEDVDLERISKDTHGYVGADLAALCTEAALQCIREKMDVIDLEDDSIDAEILNSMAVTNEHFHTALGNSNPSALRETVVEVPNVSWNDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGGGSGGDGGGAADRVLNQLLTEMDGMNAKKTVFIIGATNRPDIIDSALLRPGRLDQLIYIPLPDEDSRLNIFKAALRKSPIAKDVDIGALAKYTQGFSGADITEICQRACKYAIRENIEKDIEKEKRRSENPEAMEEDGVDEVSEIKAAHFEESMKYARRSVSDADIRKYQAFAQTLQQSRGFGSEFRFENSAGSGATTGVADPFATSAAAAGDDDDLYN

SEQ ID NO: 859 - DNA, 1461 bp, Arabidopsis thaliana
atggcgttagcatcaaccacgttgccgacgaagtccggattatctctttggtgtccgtcttctccgtctctcgctcgccgatttcccgctcgtttttctccgatcggttctagaatcgcttccagaagcctcgtcactgcttcgttcgctaacgagaatcgcgagtttgtgattgttggtggaggaaatgctgctggttatgctgctagaacttttgtggaaaatggaatggctgatggtcggctatgcattgtgaccaaagaggcttacgcaccttatgagagaccggctttgacaaaagcttacttgttcccaccagagaagaagccagctcgtttaccaggatttcatacttgcgttggaggtggtggagaaaggcaaacaccagattggtataaggagaaaggaattgaggtaatatatgaagatccagtggctggagctgattttgaaaagcaaacactcaccacagacgcagggaagcagttaaaatatggatctctaattatcgctacagggtgtacagcctcaaggttcccagataaaatcggtgggcacttgccaggggttcactatattcgggaggttgcagatgctgattcactgatagcatctctgggaaaggcaaagaaaattgtcattgttggtggtggctacatcggcatggaggttgctgctgcagctgttgcgtggaatctagatacaacgattgtattccctgaagatcagcttttgcaaagattgttcactccatcgcttgctcagaaatatgaagaactgtaccgtcaaaatggtgttaagtttgtcaagggcgcttccataaataacttggaagcaggttcggatgggcgtgtatcagctgttaagcttgctgatgggtctacaattgaggcagacacggttgtaattggaattggagctaagcctgctattggcccctttgaaactttggccatgaacaaatcaattggaggaattcaggtcgatggcttgttcaggacaagtacccctggaatttttgctattggagatgtcgcagccttccctttgaagatatatgataggatgactcgagttgaacatgttgatcacgcccgccgctctgcacaacactgtgtgaaatcactactcacggcacacactgacacgtacgattatcttccatatttctactcaagagtattcgagtatgaaggaagcccaagaaaagtgtggtggcagtttttcggagataatgtgggagaaacagtggaggttgggaactttgacccgaaaatcgctaccttctggattgaatctggcaggttgaaaggtgttctagtagaaagcggatcgcctgaggagttccagcttctaccaaagctagcaagaagccaaccacttgtcgataaggctaaactcgcaagcgcatcttcagtcgaagaagctctcgagattgctcaagccgctctacagagttag

SEQ ID NO: 860 - protein, 486 aa, Arabidopsis thaliana
MALASTTLPTKSGLSLWCPSSPSLARRFPARFSPIGSRIASRSLVTASFANENREFVIVGGGNAAGYAARTFVENGMADGRLCIVTKEAYAPYERPALTKAYLFPPEKKPARLPGFHTCVGGGGERQTPDWYKEKGIEVIYEDPVAGADFEKQTLTTDAGKQLKYGSLIIATGCTASRFPDKIGGHLPGVHYIREVADADSLIASLGKAKKIVIVGGGYIGMEVAAAAVAWNLDTTIVFPEDQLLQRLFTPSLAQKYEELYRQNGVKFVKGASINNLEAGSDGRVSAVKLADGSTIEADTVVIGIGAKPAIGPFETLAMNKSIGGIQVDGLFRTSTPGIFAIGDVAAFPLKIYDRMTRVEHVDHARRSAQHCVKSLLTAHTDTYDYLPYFYSRVFEYEGSPRKVWWQFFGDNVGETVEVGNFDPKIATFWIESGRLKGVLVESGSPEEFQLLPKLARSQPLVDKAKLASASSVEEALEIAQAALQS

SEQ ID NO: 861 - DNA, 2322 bp, Arabidopsis thaliana
atgcagagaccacctcctgaagatttctccttgaaggagacgagacctcatctaggtggaggaaaactctctggagataagcttaccagtacttatgaccttgttgagcaaatgcagtatctctatgttcgtgtggttaaggcaaaggagttacctggcaaggatatgactggtagttgtgacccttatgttgaggttaagcttggaaactacaaaggcaccactaggcatttcgagaagaaatctaatcctgagtggaaccaagttttcgccttttctaaagataggattcaagcttctttccttgaagctactgtcaaggacaaggattttgtcaaagatgatttgattggtcgggttgtctttgatttgaatgaggtacctaagagagttcctcctgatagtcccttggctccgcaatggtataggctcgaggataggaaaggtgataaagtcaagggagagcttatgttggctgtttggtttggtactcaagctgatgaagctttccctgaagcttggcactctgatgctgcaactgttagtggtactgatgctcttgccaacatccgttccaaggtttatctttctcctaagctttggtacctcagggttaatgtaattgaagctcaagatttgataccaactgataagcaaagatatcccgaggtttatgtgaaggctatagtgggaaaccaggcgttgaggactagagtatcgcagagcaggactattaatcccatgtggaatgaggatttgatgtttgtcgcagcagagccatttgaggaacctttgatcctcagcgtggaagatagagttgctccaaacaaagatgaagtcttggggagatgtgcgatcccgttgcagtatttggacagaagatttgaccataaaccggtgaacagcaggtggtacaatctcgagaagcatattatggtcgatggagagaagaaggagaccaaattcgctagcaggattcacatgagaatatgtttggaaggagggtatcacgttctcgatgagtctacgcattacagcagtgatcttagaccaacagcgaagcaactatggaagcctaatatcggtgtactggagttggggatactgaatgctacaggtctgatgcctatgaaaaccaaagacggccggggaaccacagatgcatattgtgtggcgaagtacggacagaaatggattcgaactcggacaatcattgacagctttacaccaagatggaatgagcaatatacttgggaggtttttgatccgtgcaccgttgttactgttggagtttttgataactgccatctccatggaggtgagaagattggaggagcaaaagattcaagaatcgggaaggtaagaatcaggctttctactctcgagactgatcgagtttatacacattcataccctcttttggtgctccatcctaacggagtcaagaaaatgggagaaattcacttagctgtgagattcacttgctcttcattgctcaacatgatgtatatgtactcacagcctctcttaccgaagatgcattatatccatccactgacggttagccagcttgataacttgaggcatcaagcgactcagattgtatcgatgaggctgacccgagcagaaccacctctaaggaaagaagtagttgagtatatgcttgatgtgggttctcacatgtggagtatgcggagaagcaaagcaaactttttcaggattatgggagttttgagtgggttaatcgcagtaggaaaatggtttgaacaaatctgcaactggaagaatccaatcacaacagtcttgatccatctcttgttcatcatccttgtgctctatcccgaactaatcttgcccaccatcttcctctacctcttcctcatcggtatctggtactaccgttggagaccgaggcatcctcctcacatggacacacgtctctctcacgctgactcagcccaccccgacgagctagatgaagagttcgacacttttcctacttcccgaccatctgacatagtcaggatgaggtatgacaggttgaggagtattgctggtaggattcagacagtggtaggtgatctagcaactcaaggagaaaggcttcagtctctgctaagctggcgtgatccgcgtgcaacagcgctcttcgtcttgttctgcttgattgccgcagtcattctctatgtgacacctttccaggttgtggctctttgtattggaatctatgctctgagacatccgaggttcagatacaaactaccatccgttcctctcaatttcttcagaaggcttcctgcaagaactgattgcatgctctga

SEQ ID NO: 862 - protein, 773 aa, Arabidopsis thaliana
MQRPPPEDFSLKETRPHLGGGKLSGDKLTSTYDLVEQMQYLYVRVVKAKELPGKDMTGSCDPYVEVKLGNYKGTTRHFEKKSNPEWNQVFAFSKDRIQASFLEATVKDKDFVKDDLIGRVVFDLNEVPKRVPPDSPLAPQWYRLEDRKGDKVKGELMLAVWFGTQADEAFPEAWHSDAATVSGTDALANIRSKVYLSPKLWYLRVNVIEAQDLIPTDKQRYPEVYVKAIVGNQALRTRVSQSRTINPMWNEDLMFVAAEPFEEPLILSVEDRVAPNKDEVLGRCAIPLQYLDRRFDHKPVNSRWYNLEKHIMVDGEKKETKFASRIHMRICLEGGYHVLDESTHYSSDLRPTAKQLWKPNIGVLELGILNATGLMPMKTKDGRGTTDAYCVAKYGQKWIRTRTIIDSFTPRWNEQYTWEVFDPCTVVTVGVFDNCHLHGGEKIGGAKDSRIGKVRIRLSTLETDRVYTHSYPLLVLHPNGVKKMGEIHLAVRFTCSSLLNMMYMYSQPLLPKMHYIHPLTVSQLDNLRHQATQIVSMRLTRAEPPLRKEVVEYMLDVGSHMWSMRRSKANFFRIMGVLSGLIAVGKWFEQICNWKNPITTVLIHLLFIILVLYPELILPTIFLYLFLIGIWYYRWRPRHPPHMDTRLSHADSAHPDELDEEFDTFPTSRPSDIVRMRYDRLRSIAGRIQTVVGDLATQGERLQSLLSWRDPRATALFVLFCLIAAVILYVTPFQVVALCIGIYALRHPRFRYKLPSVPLNFFRRLPARTDCML

SEQ ID NO: 863 - DNA, 660 bp, Arabidopsis thaliana
atggctgctaattcgataatggcttcctccaaacccctaatctccctgtcatccaaccaacaaccaaaccgagtccaaattcccaaattcgccaaacttccccaaattcccaaatccctcacttcctccaccgatctccgtagcaaagcactatcactctcctccgccaccgccaaatccttagctttaatcgccgctttcgctcctccgtcgatggcggaggcgatggagaaagcacagctcttcgatttcaatctcacgcttccgatcatcgttgttgagtttctcttcttgatgttcgctctcgacaaggtctattactctccgcttggtaacttcatggatcaaagagacgcttccatcaaagagaagctcgcgagtgttaaggacacttcgactgaagtaaaggagctcgatgagcaagccgccgccgtgatgagagcagctagggctgagatcgccgccgcgcttaacaagatgaagaaggagactcaggttgaagtcgaggagaagctagcggagggaaggaagaaggtggaggaagagctaaaagaagctttggcgagcttggagagtcagaaagaagaaaccattaaagctttggattctcagattgctgctcttagtgaagacattgtcaagaaggttcttccttcttaa

SEQ ID NO: 864 - protein, 219 aa, Arabidopsis thaliana
MAANSIMASSKPLISLSSNQQPNRVQIPKFAKLPQIPKSLTSSTDLRSKALSLSSATAKSLALIAAFAPPSMAEAMEKAQLFDFNLTLPIIVVEFLFLMFALDKVYYSPLGNFMDQRDASIKEKLASVKDTSTEVKELDEQAAAVMRAARAEIAAALNKMKKETQVEVEEKLAEGRKKVEEELKEALASLESQKEETIKALDSQIAALSEDIVKKVLPS

SEQ ID NO: 865 - DNA, 1740 bp, Arabidopsis thaliana
atggaatctccaatattcattctcatcacactatcattctttcttcaatcagttcttgcttcttctcaaactctatcaaactcttcaacaatctgcaaaacgacgccggatccaaagtattgcaaatccgtttttccacatagccaaggcaatgttcaacaatacggctgtttctctatccgcaaatcgctatcgcaatcgcgaaaatttattcgcaccgtcgatagatatatcaaacgcaacgctcatttatctcaacctgccgttatcagagctctccaagattgccgttttctcgccggtctaacaatggattacctcttaacgtcgttcgaaaccgttaacgacacgtcagcaaaaacctctttcaaaccgctgtcgtttcccaaagccgacgacatccaaacgcttctttccgcggcgctgactaatgagcagacgtgtcttgaaggacttaccacggccgcttcttattccgccacgtggactgtaagaaccggcgtcgctttgcctctcgtcaatgacacgaagctcttgggcgtctcactcgctctcttcaccaaaggttgggttccaaagaagaagaaacgggccgggtttgcttgggcccaaccgagatccggttcatcgacccacactaaaccattccgtctgttccgtaacggagctctaccgttaaagatgacagagaaaacaaaagcggtttacgagtcactcagcagaagaaaactcgccgacggtgacagtaacggtgatggagacgacggaagcatggttctgataagcgatatcgttaccgtgagccaagacggaacaggaaatttcaccaacatcacggcagctgtagcggcggcgccgaacaacaccgacggaagcgccggtttctttttgatctatgtgacggcgggaatctacgaagagtatatctcaatcgcgaagaacaaaaggtacatgatgatgataggtgacgggattaatcagacggtggtcaccggaaatagaagcgtcgtcgacggttggactactttcaattccgccacatttgctgtgacagcaccgaactttgttgcggtgaacataacgttccggaacacggccggaccggagaagcaccaggctgttgcgttacggagcggcgcagatttctcaatcttctatagttgtagtttcgaggcttatcaagatacactctacacacattctctaagacagttttatagagaatgcgatgtctatggaacggtcgattttatatttggaaacgcggcagttgtgtttcaaaactgtaatttatacccgaggaaaccgatgccaaatcagttcaatgctatcaccgcccaaggccggtctgatccgaaccagaacactggtacatcaatccaaaactgtacgattaagccggcggatgatcttgtttcgagtaactatacagttaaaacgtatttgggtcgaccgtggaaagagtattcaaggacggtttacatgcaatcgtacattgatggtttcgttgaaccggttggttggagagaatggaacggtgattttgcgttaagtacattgtactatgcagagtataacaataccggaccgggctcaaacactacaaaccgggttacatggcctggttaccacgtgattaattccactgatgcagctaatttcacggtcactggtttatttatcgaagctgattggatttggaagacaggagtgccttacaccagcggtctaatttcatag

SEQ ID NO: 866 - protein, 579 aa, Arabidopsis thaliana
MESPIFILITLSFFLQSVLASSQTLSNSSTICKTTPDPKYCKSVFPHSQGNVQQYGCFSIRKSLSQSRKFIRTVDRYIKRNAHLSQPAVIRALQDCRFLAGLTMDYLLTSFETVNDTSAKTSFKPLSFPKADDIQTLLSAALTNEQTCLEGLTTAASYSATWTVRTGVALPLVNDTKLLGVSLALFTKGWVPKKKKRAGFAWAQPRSGSSTHTKPFRLFRNGALPLKMTEKTKAVYESLSRRKLADGDSNGDGDDGSMVLISDIVTVSQDGTGNFTNITAAVAAAPNNTDGSAGFFLIYVTAGIYEEYISIAKNKRYMMMIGDGINQTVVTGNRSVVDGWTTFNSATFAVTAPNFVAVNITFRNTAGPEKHQAVALRSGADFSIFYSCSFEAYQDTLYTHSLRQFYRECDVYGTVDFIFGNAAVVFQNCNLYPRKPMPNQFNAITAQGRSDPNQNTGTSIQNCTIKPADDLVSSNYTVKTYLGRPWKEYSRTVYMQSYIDGFVEPVGWREWNGDFALSTLYYAEYNNTGPGSNTTNRVTWPGYHVINSTDAANFTVTGLFIEADWIWKTGVPYTSGLIS

SEQ ID NO: 867 - DNA, 651 bp, Arabidopsis thaliana
atgaagctcgccgctagcctcaaccgcctcagccccaaacgtctcttccgtaccaaatcaaaagcttccgtctccagatctgagccttcttccttcagctccaatgcttcttcctcttcctctgatggatcttacggtaacctcaaacaaggtccaaccgcgactccgatcagtgttctccctcaaaactccggcgatttttacactgagcttgttcaagcttttaaactgatcgatcgtgatgacgacggtgttgtttccagaggagatctcgcggcgttgattagcaggttaagtcatgaaccaccgagtcaagaagaggtgagtttgatgctaagagaagtagacggcggagacggtggttgtatcagccttgaagatcttgctagccgtgtcgctggtacttccggtgaaggctctgttgagacggaggagctgagagaggtgttcgagatttttgacgtggatcgtaacggaaaaatatcggcggaggagttacacagagtttttggagtgatcggagatgaacggtgcacgttagaagagtgtatgcgtatgatagcgacggttgatggaaacggtgacggttttgtttgcttcgatgacttttgccgcatgatggttccagcgatgaatgatcatcatcattag

SEQ ID NO: 868 - protein, 216 aa, Arabidopsis thaliana
MKLAASLNRLSPKRLFRTKSKASVSRSEPSSFSSNASSSSSDGSYGNLKQGPTATPISVLPQNSGDFYTELVQAFKLIDRDDDGVVSRGDLAALISRLSHEPPSQEEVSLMLREVDGGDGGCISLEDLASRVAGTSGEGSVETEELREVFEIFDVDRNGKISAEELHRVFGVIGDERCTLEECMRMIATVDGNGDGFVCFDDFCRMMVPAMNDHHH

SEQ ID NO: 869 - DNA, 519 bp, Arabidopsis thaliana
atggcgagattcacggtgctgattacggcggttgtgctagcttttctaatggcggcgccgatgccaggagtgacggccaagaagtatacagtcggcgagaacaagttttggaaccccaacattaactacaccatctgggctcagggcaagcatttctacctcggagactggctctatttcgtgttcgacagaaaccagcacaatattcttgaagtgaacaagactgactatgaaggatgtatcgccgaccacccaatacgcaactggacacgtggagctgggagagacattgtcactctcaaccagaccaagcattactaccttctcgacggaaagggtggatgttacggtggcatgaagctatctgttaaagtagagaagcttcctcctccaccaaaatctgcacctgtcaagaacattggatcggtttcaatggtcacaggtctcgctcaattcatgattccggtatctctattcgctttccctgcaatgtgggatgtgatctcaaggatgtggtag

SEQ ID NO: 870 - protein, 172 aa, Arabidopsis thaliana
MARFTVLITAVVLAFLMAAPMPGVTAKKYTVGENKFWNPNINYTIWAQGKHFYLGDWLYFVFDRNQHNILEVNKTDYEGCIADHPIRNWTRGAGRDIVTLNQTKHYYLLDGKGGCYGGMKLSVKVEKLPPPPKSAPVKNIGSVSMVTGLAQFMIPVSLFAFPAMWDVISRMW

SEQ ID NO: 871 - DNA, 648 bp, Arabidopsis thaliana
atggtgttgacaatctatgctcctttattcgcttcttcaaagagagctgttgtgacattggtggagaagggagtatcattcgaaactgtcaatgtcgatctcatgaaaggagaacagagacagcctgagtatctcgcgattcagcctttcggtaaaatcccagtcctcgtcgacggagactacaaaatcttcgagtcgcgtgcgatcatgaggtatatagcagagaagtatagatcacaaggacctgatcttttggggaagactattgaagagagaggacaagtagagcaatggttagacgttgaggctacaagttaccatccaccactattggctttaacgctcaacattgtctttgcaccacttatgggtttccctgctgatgagaaagttattaaggagagtgaagagaagcttgcagaagtgcttgatgtctatgaagctcagctttctaagaacgaatacttggctggtgattttgtgagtctagctgatttggctcaccttcctttcaccgagtatcttgttggtcctattgggaaggctcatttgatcaaagataggaagcatgttagcgcttggtgggataagattagtagccgtgctgcgtggaaggaggtttccgctaagtactcactacctgtttaa

SEQ ID NO: 872 - protein, 215 aa, Arabidopsis thaliana
MVLTIYAPLFASSKRAVVTLVEKGVSFETVNVDLMKGEQRQPEYLAIQPFGKIPVLVDGDYKIFESRAIMRYIAEKYRSQGPDLLGKTIEERGQVEQWLDVEATSYHPPLLALTLNIVFAPLMGFPADEKVIKESEEKLAEVLDVYEAQLSKNEYLAGDFVSLADLAHLPFTEYLVGPIGKAHLIKDRKHVSAWWDKISSRAAWKEVSAKYSLPV

SEQ ID NO: 873 - DNA, 1410 bp, Arabidopsis thaliana
atggccatgaaagctcccgatcccggcggatctggggaaattctcccgagcactccctctctttccgaaactacgtctggaggcgccgcagcagcttctaagtcggctcaattgccgtcttcttcttccgatatcgataatattcacgtacctagctactccagttggttttcatggaccgacattaacgattgcgaggtccggtcactgccggaatttttcgattcgagatcttcatccaaaaaccctaagttttatctctacttgaggaactcgattattaagcagtacagagacgaccatcctcggaagattagtttcactgacgttcggagaactctcgtcagtgatgttgtctctattcgtcgcgtctttgatttcctcgattcatggggacttatcaactataatagctccgcctctgctaagccgctcaagtgggaagaaaaagaggccggaaaatccgccggagatgctgcttctgagccagccacaactgtcaaagaaactgccaagagaaactgcaatggctgcaaagcaatttgcagcatagcttgtttcgcctgtgataagtatgacttgacattgtgtgcgaggtgctatgttcgtagtaattatcgtgttggtattaactcctcggagtttaaacgagttgagattagtgaggagtcaaagccagagtggtctgataaggaaattctgctgctgctggaagctgttatgcactatggagatgattggaagaaggttgcatcgcatgttattggtagaacggagaaggattgtgtttctcagtttgtcaagcttccgtttggggaacagtttgtaaaagagtctgactctgaggatggtttagagatgtttgatcagatcaaggactctgatattcctgaatctgaaggaatagataaagacggttcttctcccaacaagcggatcaaattaacacctcttgcagatgcaagcaacccaataatggctcaggctgcttttctttcagctttggctggcacaaatgttgcagaagcagcagctcgagcggcagtgagagctttatctgatgtagactacgaggctgacaaaaacgccagtagagacccaaatcgacaagatgccaatgctgcatcgagtggtgaaaccactagaaacgaatctgaaagagcttgggcagatgcaaagtctttaattgagaaggaagagcatgaggtagaaggagcaatcaaagagactgttgaagttgagatgaagaagatccgagataggattgttcatttcgagaaattggatttggaaatggagagaagccggaaacaattggaggaggtgaggaatctgcttttcgttgatcaattaaacattttcttccacaccagaaaagcccggaaaactgaagatagaatagagtgttag

SEQ ID NO: 874 - protein, 469 aa, Arabidopsis thaliana
MAMKAPDPGGSGEILPSTPSLSETTSGGAAAASKSAQLPSSSSDIDNIHVPSYSSWFSWTDINDCEVRSLPEFFDSRSSSKNPKFYLYLRNSIIKQYRDDHPRKISFTDVRRTLVSDVVSIRRVFDFLDSWGLINYNSSASAKPLKWEEKEAGKSAGDAASEPATTVKETAKRNCNGCKAICSIACFACDKYDLTLCARCYVRSNYRVGINSSEFKRVEISEESKPEWSDKEILLLLEAVMHYGDDWKKVASHVIGRTEKDCVSQFVKLPFGEQFVKESDSEDGLEMFDQIKDSDIPESEGIDKDGSSPNKRIKLTPLADASNPIMAQAAFLSALAGTNVAEAAARAAVRALSDVDYEADKNASRDPNRQDANAASSGETTRNESERAWADAKSLIEKEEHEVEGAIKETVEVEMKKIRDRIVHFEKLDLEMERSRKQLEEVRNLLFVDQLNIFFHTRKARKTEDRIEC

SEQ ID NO: 875 - DNA, 1092 bp, Arabidopsis thaliana
atgaagaaaggtggattcagcaataatctcaagctcgcaattcctgttgctggcgagcaatccatcaccaaattcctgactcaaagcggtacgtttaaggatggagatctacgtgttaacaaggatggagttcgaatcatttctcaattggagcctgaagtcctgtctccaattaagccagctgatgatcagctgagcttgtcggatttggatatggttaaagtcattggcaaaggaagtagtggtgttgttcagctggttcaacacaaatggactggccaatttttcgccttgaaggtcattcaactaaatattgatgaagcaattcgcaaggcaattgcacaagagctcaaaataaatcaatcgtcacagtgtccaaatcttgttacctcgtaccagtcattttatgacaatggcgcaatctcactaatcttggagtacatggacggaggatctctagcagactttctcaagtcagttaaagccatccctgactcctatctttctgccatctttagacaagtgcttcaaggattaatctatcttcatcacgataggcatatcatccatcgtgacttgaaaccatccaatctgttgatcaaccacagaggagaagtcaaaataactgactttggtgtgagtaccgttatgacaaacaccgcaggtttagcaaacacatttgtggggacttacaattatatgtctccagagagaatcgttggaaacaagtacggaaataaaagtgatatatggagcttgggtttagtagtactcgaatgtgcaacaggaaagttcccttatgcacctccgaatcaagaggaaacatggaccagtgttttcgagttgatggaagccattgttgaccaaccgccacccgctcttccttcaggaaatttctcccctgagttatcttcattcatctccacatgtttgcagaaggatccaaacagtcgaagctctgcaaaggaactgatggaacatcctttcttgaacaaatacgactactcggggatcaatctcgcgtcctacttcacagatgcaggatcgccacttgcaacacttgggaacctgtctggtacgttctccgtgtaa

SEQ ID NO: 876 - protein, 363 aa, Arabidopsis thaliana
MKKGGFSNNLKLAIPVAGEQSITKFLTQSGTFKDGDLRVNKDGVRIISQLEPEVLSPIKPADDQLSLSDLDMVKVIGKGSSGVVQLVQHKWTGQFFALKVIQLNIDEAIRKAIAQELKINQSSQCPNLVTSYQSFYDNGAISLILEYMDGGSLADFLKSVKAIPDSYLSAIFRQVLQGLIYLHHDRHIIHRDLKPSNLLINHRGEVKITDFGVSTVMTNTAGLANTFVGTYNYMSPERIVGNKYGNKSDIWSLGLVVLECATGKFPYAPPNQEETWTSVFELMEAIVDQPPPALPSGNFSPELSSFISTCLQKDPNSRSSAKELMEHPFLNKYDYSGINLASYFTDAGSPLATLGNLSGTFSV

SEQ ID NO: 877 - DNA, 1458 bp, Arabidopsis thaliana
atggcgttgctcgtcgagaagacctcaagtggccgtgaatacaaggtcaaagacatgtctcaagccgatttcggtcgtctcgaactcgagctcgccgaagttgagatgcctggactcatggcttgtcgtaccgaattcggaccttctcagccattcaaaggcgctagaatcaccggatctcttcacatgaccatccaaaccgccgtactcatcgaaaccctaactgctctcggtgctgaagtcagatggtgttcctgcaacatcttttccactcaagaccacgccgccgcagccatcgctcgtgactccgccgctgttttcgcctggaaaggtgagactcttcaggagtactggtggtgtaccgagcgtgctctagattggggtccaggtggtggtcctgatctgattgttgatgatggtggtgacgctactcttttgattcatgagggtgttaaagctgaggagatctttgagaagactggtcaagttcctgatcctacttctactgataaccctgagtttcagatcgtgttgtctattatcaaggaaggtcttcaagttgatcctaagaagtaccacaagatgaaggagagacttgttggtgtctctgaggaaactaccactggtgttaagaggctttaccagatgcagcaaaatggaactcttttgttccctgccattaacgttaacgactctgtcaccaagagcaagttcgacaacttgtatggttgccgtcactcactccctgatggtctcatgagggccactgatgtcatgatcgctggaaaggttgctgttatctgtggatatggtgatgttggaaagggttgtgctgctgccatgaagactgctggtgctagagtcattgtgactgagattgatcccatctgtgcccttcaagctttgatggaaggacttcaggttcttacccttgaggatgttgtctcagaagctgatatctttgtcaccaccaccggtaacaaagacatcatcatggtcgaccacatgaggaagatgaagaacaacgctattgtgtgcaacattggtcactttgacaatgagattgacatgcttggacttgagacttaccctggtgtgaagcgtatcaccatcaagccacagactgacaggtgggtgttcccagagaccaaggctggaatcattgtcttggctgagggtcgtctgatgaacttgggttgtgccactggtcacccaagtttcgtgatgtcttgctctttcaccaaccaggtgattgcccagctcgagctctggaacgagaaagcaagcggaaagtacgagaagaaggtgtacgttcttcccaagcatttggatgagaaggttgcattacttcacttgggcaagcttggagccaggcttacaaagctgtcaaaggaccaatctgactacgtcagcattccaattgagggaccatacaagcctcctcactacaggtactga

SEQ ID NO: 878 - protein, 485 aa, Arabidopsis thaliana
MALLVEKTSSGREYKVKDMSQADFGRLELELAEVEMPGLMACRTEFGPSQPFKGARITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEIFEKTGQVPDPTSTDNPEFQIVLSIIKEGLQVDPKKYHKMKERLVGVSEETTTGVKRLYQMQQNGTLLFPAINVNDSVTKSKFDNLYGCRHSLPDGLMRATDVMIAGKVAVICGYGDVGKGCAAAMKTAGARVIVTEIDPICALQALMEGLQVLTLEDVVSEADIFVTTTGNKDIIMVDHMRKMKNNAIVCNIGHFDNEIDMLGLETYPGVKRITIKPQTDRWVFPETKAGIIVLAEGRLMNLGCATGHPSFVMSCSFTNQVIAQLELWNEKASGKYEKKVYVLPKHLDEKVALLHLGKLGARLTKLSKDQSDYVSIPIEGPYKPPHYRY

SEQ ID NO: 879 - DNA, 291 bp, Arabidopsis thaliana
atggcggaaccaaagacaaaagttgcagaaatcagggaatggatcatcgaacataagcttcgtaccgttggttgcttatggctaagtggtatctctggttcaattgcttataattggtctaaacctgccatgaaaaccagtgtcagaatcatccacgctaggttgcatgctcaggcgctgacattagccgctctggctggagcagctgcagtggagtactatgatcacaaatctggagccactgatcgaatcccgaaatttctgaagcctgataacttaaataaggactag

SEQ ID NO: 880 - protein, 96 aa, Arabidopsis thaliana
MAEPKTKVAEIREWIIEHKLRTVGCLWLSGISGSIAYNWSKPAMKTSVRIIHARLHAQALTLAALAGAAAVEYYDHKSGATDRIPKFLKPDNLNKD

SEQ ID NO: 881 - DNA, 1122 bp, Arabidopsis thaliana
atgcaaaaggtcttcttggccatggatacttgtgctctagtaatccatcagtctctgtctcgcatcaaactttctcctcccaaatcttcttcttcttcttcttctgctttctcccctgaatccttaccgatcagacggatcgagctgtgtttccgaggagctatatgtgccgccgtacaaagaaactacgaagaaacgacctcctccgtggaagaggcagaggaagatgatgagtcatcatcatcgtacggagaagtgaacaagatcattggaagccgaacggcgggggaaggagccatggagtaccttatcgagtggaaggacggccattctccgtcgtgggttccatcgagctacatcgcagcagacgtagtgtcggagtacgagacaccctggtggacggcagctagaaaagccgacgagcaggccctgtcacagctcctggaggaccgagacgtcgatgccgtggacgaaaacggccggacggctctgcttttcgtggcaggtctggggtcggacaagtgcgtaaggcttctggcggaggctggagccgatctcgaccaccgagacatgaggggaggcttgacggcgctgcacatggcggctggttacgtgaggccggaggtggtggaggcgctggtggagctgggagctgatattgaagtggaagacgagagagggttaacggcgttggaactagcgagggagattctgaagacgacgccgaaggggaatccgatgcagttcgggaggagaattgggttagagaaagtgatcaatgtcctggaaggacaagtgttcgagtacgccgaggtggatgagatcgtagagaaacgagggaaaggcaaagacgttgaatatctggtcagatggaaggacggtggagattgcgagtgggtgaaaggtgtacacgtggcggaagatgtggctaaggactacgaggatgggctggagtacgctgtagcggagagtgtgatcgggaagagggtgggagacgatgggaagaccatcgagtatcttgtcaaatggactgatatgtctgatgccacttgggagcctcaggacaatgtcgactctactcttgttctactctaccaacaacaacaaccaatgaatgaatga

SEQ ID NO: 882 - protein, 373 aa, Arabidopsis thaliana
MQKVFLAMDTCALVIHQSLSRIKLSPPKSSSSSSSAFSPESLPIRRIELCFRGAICAAVQRNYEETTSSVEEAEEDDESSSSYGEVNKIIGSRTAGEGAMEYLIEWKDGHSPSWVPSSYIAADVVSEYETPWWTAARKADEQALSQLLEDRDVDAVDENGRTALLFVAGLGSDKCVRLLAEAGADLDHRDMRGGLTALHMAAGYVRPEVVEALVELGADIEVEDERGLTALELAREILKTTPKGNPMQFGRRIGLEKVINVLEGQVFEYAEVDEIVEKRGKGKDVEYLVRWKDGGDCEWVKGVHVAEDVAKDYEDGLEYAVAESVIGKRVGDDGKTIEYLVKWTDMSDATWEPQDNVDSTLVLLYQQQQPMNE

SEQ ID NO: 883 - DNA, 1125 bp, Arabidopsis thaliana
atgggtcttgaagttgggtccttatgcttcaaacttaaagacggaggcttgacatcaagaaccaacagtttcaagagagacgatactaataggcaccagaattctcctaagagtactatggagcggtcgttgagtttcaacagctgggaggttcctaaagagaccaagactgattcagattttgaggtcttggagacaaagaagtcaacgcctaacactttgaatggaagaaactgtgagagaatccaaatcaagaaacctacagttactccaccagagccatttgtgttcttctctcctagacctgtcaccgagcttgatgcagctgcaactacgttacaaaaggtgtacaagagttacaggaccagaaggaacttagcagattgtgcggtcgttgttgaggagctctggtggaggactttggaaggtgcagctttggatttgagctctgtgtctttctttggagaagaaaaacatgagaccgctgtttcgaaatgggcacgagctagaaaacgagctgctaaggttgggaaaggcttatctaaagatgaaaaggctcagaaattagctcttcagcattggcttgaagctgtaagtccccataacctaaatatctttgtaacttcatatcaaagacaagtaccctacttgacatccaaagctatcattgaatatactctaatgatccatctcttgaaattacagattgacccacgtcatcgttacggccacaacttgcacttctattatgatgtctggtcagcgagcaagagcacacaaccattcttttactggttggatataggagacggcaaagatgtaaatcttgagaaacaccctagaagtgttctgcaaaaacaatgcatcagatacttaggaccgatggagagagaagcatatgaagtgatagtagaagatgggagactaatgtataaacagggcatgactctgatcaattcaacagaggaagccaagtcgatttttgtacttagtactactagaaacttatacgtagggattaaaaagaaaggtcttttccagcactctagtttcttatctggaggtgccacaaccgcagcaggaaggttagtcgcccgcgatgggatccttgaggtacttgaataa

SEQ ID NO: 884 - protein, 374 aa, Arabidopsis thaliana
MGLEVGSLCFKLKDGGLTSRTNSFKRDDTNRHQNSPKSTMERSLSFNSWEVPKETKTDSDFEVLETKKSTPNTLNGRNCERIQIKKPTVTPPEPFVFFSPRPVTELDAAATTLQKVYKSYRTRRNLADCAVVVEELWWRTLEGAALDLSSVSFFGEEKHETAVSKWARARKRAAKVGKGLSKDEKAQKLALQHWLEAVSPHNLNIFVTSYQRQVPYLTSKAIIEYTLMIHLLKLQIDPRHRYGHNLHFYYDVWSASKSTQPFFYWLDIGDGKDVNLEKHPRSVLQKQCIRYLGPMEREAYEVIVEDGRLMYKQGMTLINSTEEAKSIFVLSTTRNLYVGIKKKGLFQHSSFLSGGATTAAGRLVARDGILEVLE

SEQ ID NO: 885 - DNA, 564 bp, Arabidopsis thaliana
atggcgtcgacgactctctcaatcgcaacaacaatccgttcctcttctcctctcacttccgcttccactcatcacttcctttccaaacccaccgcaatcgaattcccatttcgtctcagctcttcttctagccaccgtgcaatcaacctccgtcctatctccgccgtcgaagctccggagaaaatcgagaaaatcggatccgaaatctcctccttaaccctcgaagaagctcgtatcctcgtcgactatctccaagacaaattcggtgtctccccactctccttagcccccgcagcagcggccgttgcagctccagccgacggtggcgcggcggctgtagtggaggagcaaacagagttcgatgtggttatcaatgaagttccgagtagttctcgtattgcagtaattaaagctgttagggctttgactagcttggcgttgaaggaagctaaggagctaatcgaaggattaccaaagaagtttaaagaaggtatcactaaagatgaagctgaagaagctaagaagactcttgaagaagctggtgctaaagtctccattgcttaa

SEQ ID NO: 886 - protein, 187 aa, Arabidopsis thaliana
MASTTLSIATTIRSSSPLTSASTHHFLSKPTAIEFPFRLSSSSSHRAINLRPISAVEAPEKIEKIGSEISSLTLEEARILVDYLQDKFGVSPLSLAPAAAAVAAPADGGAAAVVEEQTEFDVVINEVPSSSRIAVIKAVRALTSLALKEAKELIEGLPKKFKEGITKDEAEEAKKTLEEAGAKVSIA

SEQ ID NO: 887 - DNA, 1200 bp, Arabidopsis thaliana
atgaccgacgtcgatgaatccgttagacgccgtacagccgccgtttccgagtaccggaaaaagctcctccaacataaggaactcgaatcccgtgttcgaacagctagggagaacttaagaggagctaaaaaggaattcaacaaaaccgaggatgatctcaagtctcttcaaagtgttgggcagattattggagaagtgcttcgacccctggataatgaaagattgattgtgaaagcgagcagtggtccacgttatgtggtgggttgccgaagcaaagtggataaggaaaagctaacctccggaactcgagttgttctcgatatgacaacactaacaattatgcgagcccttccccgagaagttgatcctgttgtttataacatgcttcatgaagaccctggcaacattagctactccgctgtcggagggttaggtgatcagatcagagaactcagggaatctattgagctccctctcatgaatcctgagcttttcctcagagtagggatcaaacctccaaagggtgtccttctgtatggacctccaggtactggaaaaactctactagccagggctattgccagcaacatcgatgctaacttcttgaaggttgtatccagtgcaatcatagacaagtacattggagaaagtgctaggctgattcgggagatgtttaactatgcccgtgaacatcagccttgtatcatattcatggatgaaatcgatgctattggtgggcgtcgttttagtgagggaactagtgctgatcgtgaaattcaaagaacgcttatggagttactcaaccagcttgatgggtttgacaacctcggaaaggtgaaaatgataatggccacaaacaggcctgatgtgcttgatcctgcgcttctccgtccgggaaggttagatagaaagattgagatccctttgccaaacgagcagtcaagaatggatattcttaagatccatgcagctggtatcgccaaacatggtgaaatcgattacgaggctattgtcaaacttgcagagggattcaatggtgctgatctgcgtaacatatgcacggaagctggaatgtttgcaatccgagcagagcgggattatgtgatccatgaagatttcatgaaggcggtgagaaagctgagtgaggccaagaaactggagtccagttcgcactataacgctgattttggaaaagagtga

SEQ ID NO: 888 - protein, 399 aa, Arabidopsis thaliana
MTDVDESVRRRTAAVSEYRKKLLQHKELESRVRTARENLRGAKKEFNKTEDDLKSLQSVGQIIGEVLRPLDNERLIVKASSGPRYVVGCRSKVDKEKLTSGTRVVLDMTTLTIMRALPREVDPVVYNMLHEDPGNISYSAVGGLGDQIRELRESIELPLMNPELFLRVGIKPPKGVLLYGPPGTGKTLLARAIASNIDANFLKVVSSAIIDKYIGESARLIREMFNYAREHQPCIIFMDEIDAIGGRRFSEGTSADREIQRTLMELLNQLDGFDNLGKVKMIMATNRPDVLDPALLRPGRLDRKIEIPLPNEQSRMDILKIHAAGIAKHGEIDYEAIVKLAEGFNGADLRNICTEAGMFAIRAERDYVIHEDFMKAVRKLSEAKKLESSSHYNADFGKE

SEQ ID NO: 889 - DNA, 1086 bp, Arabidopsis thaliana
atgggaggggtgacgtcatcggtggcggcgaagtttgccttcttcccgccgagtccaccgtcttacaaggtggtgaccgacgagctcaccggactgttgcttctcagccctttcccccaccgcgaaaacgtagaaatcgtaaagcttcggaccaggagaggcacagagatcgtgggcatgtacgtgaggcatccgatggctacctccacgctcctctactcccatggcaacgccgccgatctgggacagatgtatgagctcttcattgagcttagcatccatctcaaggttaatcttatgggatacgattactccgggtatggacaatctactggaaagccgagtgagcataacacgtatgctgatatcgaagctgtttataagtgtcttgaagaaacctttggctctaagcaggaaggtgtcatcctctacggccaatctgtaggcagcggacctacgttagatcttgcttcccggttgcctcaacttagagccgtcgtccttcacagccccattctctccggtttaagagttatgtattccgtcaagaaaacctactggttcgacatctacaagaatatcgacaaaatcccatatgtcgattgcccggttctcatcattcatggaacttcggatgaggtagtggattgttctcatgggaaacaactatgggaactctgcaaagacaagtacgagccgctctgggtgaaaggagggaaccactgtgatcttgaacactaccctgaatacattagacacctcaagaagttcatagcaacagtagagagattaccatgtccgaggatgagcagcgaccaatcagagagagtgagagatgcgcccccgaggagaagtatggacaggagagtgaagccgaggcagagcacagagcgtagagagaaagagaagccaccaaagagtcagtcgaagatgagtagcagcagcagcaagctcaagatctcgtttgatcaacttgatcgctcgcggaggagcgttgactgccatgaaaagactcggaagagcgttgaccagattgagagggggaggaagagtgtggataggttggatagagttcgctccgagtaa

SEQ ID NO: 890 - protein, 361 aa, Arabidopsis thaliana
MGGVTSSVAAKFAFFPPSPPSYKVVTDELTGLLLLSPFPHRENVEIVKLRTRRGTEIVGMYVRHPMATSTLLYSHGNAADLGQMYELFIELSIHLKVNLMGYDYSGYGQSTGKPSEHNTYADIEAVYKCLEETFGSKQEGVILYGQSVGSGPTLDLASRLPQLRAVVLHSPILSGLRVMYSVKKTYWFDIYKNIDKIPYVDCPVLIIHGTSDEVVDCSHGKQLWELCKDKYEPLWVKGGNHCDLEHYPEYIRHLKKFIATVERLPCPRMSSDQSERVRDAPPRRSMDRRVKPRQSTERREKEKPPKSQSKMSSSSSKLKISFDQLDRSRRSVDCHEKTRKSVDQIERGRKSVDRLDRVRSE

SEQ ID NO: 891 - DNA, 1899 bp, Arabidopsis thaliana
atggttgcttttttatcagcttggccttgggaaaactttggcaatctcaagtatcttctctacgctccattagctgcacaagtagtgtactcgtgggtctatgaagaagatatctcaaaggttctttggtgtattcatattctcataatctgcggtctcaaagcacttgttcatgaactatggagcgttttcaacaacatgcttttcgtgactcgtactctaaggattaaccctaaagggatcgactttaaacagattgatcacgaatggcactgggacaattacataatcctacaagcaataatagtgagcctgatctgttacatgtcaccaccattgatgatgatgataaacagtcttcctctgtggaacacgaaaggactcatcgcattaattgtgctacatgtgactttctcagagcctttatactactttctgcacagatctttccatcgtaacaactacttcttcacacattaccactctttccaccactcatctcctgttccacatcccatgactgctggaaacgcaacgttattggaaaacattatcctctgtgtcgtagctggtgttccattgattggatgttgcttgtttggtgttggatcattaagtgcgatctacggttacgctgttatgtttgatttcatgaggtgtttaggacattgtaacgttgagatattctctcacaagctgttcgagattcttccagtcttacgatatctcatctatactccaacgtaccatagtctgcatcatcaagaaatggggaccaacttttgtctatttatgcctctctttgatgttttgggcgatacacaaaacccaaactcatgggaactccaaaagaagattcgtttgagtgcaggggaacggaagagagtgccggagtttgtgttcttagctcacggagttgatgtaatgtcggcgatgcatgcaccgttcgtgttcagatcttttgcttcaatgccatataccacaaggatattcttgctaccgatgtggccattcacgttctgtgttatgttgggcatgtgggcttggtcaaagacttttcttttcagcttctataccctcaggaacaatctttgtcagacttggggcgttcctagattcggattccaatacttcttaccgtttgctacaaaaggaattaatgatcaaattgaggctgcgattcttagagctgataagattggtgttaaagttataagcttggctgctctcaacaagaacgaagctctaaatggtggtggaacactgtttgtcaacaagcatcctgaccttagagttcgtgtggttcatgggaacactttaactgcagcagtgattctctatgaaattccaaaagatgtgaatgaggttttcttgactggagccacttctaagctgggaagagctattgctctttacctttgtcgccgtggagtgagagttctcatgttgacattgtctatggaaaggttccaaaagattcagaaagaggctcctgttgagttccagaacaaccttgtacaagtgaccaaatacaatgctgctcaacactgcaagacttggatcgttggaaaatggttaacaccaagagagcagagctgggctcctgcagggacgcatttccatcagtttgtggtgccaccaatccttaagtttagaaggaactgcacttacggtgatctagcagctatgaagctccctaaagatgttgaaggactcggaacttgcgagtacacgatggagagaggggtggtacatgcgtgccatgcaggaggagtggttcatatgcttgagggttggaagcatcatgaggttggagccattgatgttgaccgtatcgatttggtgtgggaagcagccatgaagtatggtcttagtgctgtttcttcactcacaaattga

SEQ ID NO: 892 - protein, 632 aa, Arabidopsis thaliana
MVAFLSAWPWENFGNLKYLLYAPLAAQVVYSWVYEEDISKVLWCIHILIICGLKALVHELWSVFNNMLFVTRTLRINPKGIDFKQIDHEWHWDNYIILQAIIVSLICYMSPPLMMMINSLPLWNTKGLIALIVLHVTFSEPLYYFLHRSFHRNNYFFTHYHSFHHSSPVPHPMTAGNATLLENIILCVVAGVPLIGCCLFGVGSLSAIYGYAVMFDFMRCLGHCNVEIFSHKLFEILPVLRYLIYTPTYHSLHHQEMGTNFCLFMPLFDVLGDTQNPNSWELQKKIRLSAGERKRVPEFVFLAHGVDVMSAMHAPFVFRSFASMPYTTRIFLLPMWPFTFCVMLGMWAWSKTFLFSFYTLRNNLCQTWGVPRFGFQYFLPFATKGINDQIEAAILRADKIGVKVISLAALNKNEALNGGGTLFVNKHPDLRVRVVHGNTLTAAVILYEIPKDVNEVFLTGATSKLGRAIALYLCRRGVRVLMLTLSMERFQKIQKEAPVEFQNNLVQVTKYNAAQHCKTWIVGKWLTPREQSWAPAGTHFHQFVVPPILKFRRNCTYGDLAAMKLPKDVEGLGTCEYTMERGVVHACHAGGVVHMLEGWKHHEVGAIDVDRIDLVWEAAMKYGLSAVSSLTN

SEQ ID NO: 893 - DNA, 732 bp, Arabidopsis thaliana
atgatcggccaacttatgaacctcaaggccacggagctctgtctcggcctccccggcggcgctgaagcagttgagagtcctgccaaatcggcggtgggaagcaagagaggcttctccgaaaccgttgatctcatgctcaatcttcaatctaacaaagaaggctccgttgatctcaaaaacgtttctgctgttcccaaggagaagactacccttaaagatccttctaagcctcctgctaaagcacaagtggtgggatggccacctgtgaggaactacaggaagaacatgatgactcagcagaagaccagtagtggtgcggaggaggccagcagtgagaaggccgggaactttggtggaggagcagccggagccggcttggtgaaggtctccatggacggtgctccatatctgaggaaagttgacctcaagatgtacaaaagctaccaggatctttctgatgcattggccaaaatgttcagctcctttactatgggaaactatggagcacaaggaatgatagatttcatgaacgagagcaagctaatgaatctgctgaatagctctgagtatgtgccaagctacgaggacaaagatggtgactggatgctcgttggcgatgtcccatgggaaatgtttgtcgagtcttgcaaacgtttgcgcattatgaagggatctgaagcagttggacttgctccgagagcaatggagaagtactgcaagaacagatcttga

SEQ ID NO: 894 - protein, 243 aa, Arabidopsis thaliana
MIGQLMNLKATELCLGLPGGAEAVESPAKSAVGSKRGFSETVDLMLNLQSNKEGSVDLKNVSAVPKEKTTLKDPSKPPAKAQVVGWPPVRNYRKNMMTQQKTSSGAEEASSEKAGNFGGGAAGAGLVKVSMDGAPYLRKVDLKMYKSYQDLSDALAKMFSSFTMGNYGAQGMIDFMNESKLMNLLNSSEYVPSYEDKDGDWMLVGDVPWEMFVESCKRLRIMKGSEAVGLAPRAMEKYCKNRS

SEQ ID NO: 895 - DNA, 453 bp, Arabidopsis thaliana
atggcgccgaaagcagagaagaagcccgctgagaagaaaccagcttccgagaagccggtggaggagaaatcaaaagccgagaaagctccggcggagaagaaaccaaaggccggaaagaagctcccgaaggaagctggtgccggaggcgacaagaagaaaaagatgaagaagaagagtgtcgagacttacaagatctacatcttcaaggtgcttaagcaagttcatcccgatatcggaatctccagcaaagcgatggggatcatgaacagtttcattaacgatatcttcgagaagcttgctcaagaggcgtcgaagcttgcgaggtacaataagaaacctacgatcacttctcgggagattcagactgctgtgagattggtgcttcctggagagttggcgaagcatgccgtttctgaggggactaaagccgtcacgaaattcaccagctcttga

SEQ ID NO: 896 - protein, 150 aa, Arabidopsis thaliana
MAPKAEKKPAEKKPASEKPVEEKSKAEKAPAEKKPKAGKKLPKEAGAGGDKKKKMKKKSVETYKIYIFKVLKQVHPDIGISSKAMGIMNSFINDIFEKLAQEASKLARYNKKPTITSREIQTAVRLVLPGELAKHAVSEGTKAVTKFTSS

SEQ ID NO: 897 - DNA, 3267 bp, Arabidopsis thaliana
atggccacaacagaagatactccagcttctgctggtccaagatatgctccagaggacccaactcttccccaaccatggaagggacttattgatggaagcacaggaattctctattactggaatcctgaaaccaatgtcactcagtatgaaagaccttctgcgcctcctccccactctgccacaacaccgaagctagctcagattcctgtaccctcttcaggacaaggtcaccaagctcagcatgaacaagcaaaaccagttggtcatgtgtctcagcagcatggtttccaacaacagccacagcaatttccatcccaacatgtaagaccccaaatgatgcagcagcatccggcccagcaaatgcctcaacaatcaggtcaacagtttccccaacaacagagccaatcgatggtgccgcacccacatgggcatccttctgtacagacttatcagccaacgacgcagcagcagcagcaagggatgcagaatcagcattcacaaatgcctcagcagctgagccatcagtatgctcattcacaacaacattacatgggttttcggcctcacatgcaaacgcaaggacttcaaaattcacatcagacacctcagggtggtccccatggtcagcagtttccgagccagcaagagtacaactcattggctccgaagagggagggggatgagttccatgggggtaagaaaactgggttttctcaaccccatttaccaaattctgaacgttcaccatctcaaaatacccactttgaagccaatgcagcatcacaaaagacgaatgcaaacttggctatggctcagaaatgcaatggacctcaagcaaatgctgcagtcacacagtttcaacagccaggggcgaacctaattcaccagcaacttggacctagggcgccaaatcaaatggaccagacaatgttgcaccagaagtctcacgtttcccctttccaatcaaataatacttatgagaataatctacaatctaggcctggtaatgactcgtacgttaacatgagaatggaagtgccggttaggggtgcccaaccacttcatcctgcagcaatgcctaaggatataaggataagtggtggtccaccaacaaatgctgatcccgccatggggcaaacagggcatggaacatatggacacgctggtccagcttttccaaataaatccttggtgcggcctcattttgtcacatctcctgatgttccccatctctctcccgttgaaatataccgaaaacaacatgaagtcacaacaactggcgagaacattccagcaccatacatcacatttgaatctagtggtctcccacctgaaatccttagagagttgctttctgctggatttccatcgccaacaccgatccaggcccaaacatggccaattgctctgcaaagcagggatatagttgcaattgcaaaaactggttctggtaaaacattgggatacttgatccctgccttcattcttctaaggcactgtcgtaacgactcccgcaatggccccacagttttgatcctagctcctactcgggagctagccacacaaatacaagacgaagcactaaggtttggacggtcttccaggatatcatgcacttgtttgtatggtggagctccaaagggtcctcaattgaaagagttggaacgaggagctgatattgtggtggcaactcctgggcgtctaaatgatatactggagatgaagatgattgatttccagcaggtttcccttcttgtgcttgacgaggcagaccgaatgcttgacatgggttttgaaccccaaatccgtaagattgtgaatgaaatacctcctcggagacagactcttatgtacacagccacttggccaaaagaagtaagaaaaattgcaagcgatcttcttgtgaaccctgtccaagttaacataggcagggtagatgagttggctgctaacaaagcaataacgcagtatgttgaagtagtcccacaaatggagaaagagagacgtttggagcaaatccttaggtcacaagaacgaggttcaaaagttataatattttgctccacgaagaggctttgtgaccatcttgcacgtagtgtcggacgtcattttggcgctgttgtgatccatggagacaagactcaaggtgagagagattgggtgcttaaccagttccgaagcgggaagtcttgtgtactgatagctactgacgttgctgcccggggactcgacataaaagacatacgagttgtgatcaactacgattttccaactggagttgaagactatgtccaccgtattgggagaaccggtcgagctggtgcaactggagttgcattcactttctttacagagcaagattggaaatacgcacctgatttgatcaaagtcctggaaggagcgaaccagcaagtaccgcctcaagtaagagatattgcaatgcgtggtggtggtggtggtggtcccggttatagccaggatcgaagaggtatggttaaccggtttgactctggcggtggtggtacccgttgggattctggtggtgggtttggtgggcgtggtggtgggtttagtggccgtgagggtgggtttggaggccgtgagggtggatttgggggccgtgagggtggatttggaggccgtgggggaagatttggaatgagagatgactcatttggacgtggcgggaatcgtggtcggggttttactggtcctgatgctggtcatatgaatgtgggtggtagaggcggatttggtcggtttggcaataataataatatggagagccgaggctttggtcgtggtagtggtagaggctttggtcgtggtgttggacggtttgacaacagaagaggtagaagtcgcagcagaagtcctgatttggttcggccacggcgccgtagctcgagctatagccggagtcgaagccggagcgggagctatagtcgtagccgtagccgtagcaggagctggtcacgttcaaggagtcgcagccctagacatagccgtgaccgaggtggtcataacaggagcagaagctatagccgtagtcctagtccggtttatgaaagacgagatagagcgccacgtgtttctgggtttgatattaaaccaccagttgaatctgtagtgaacctggacatgaatgccgcggcagcgattgaaaacgtggttcctacatccttgtctgagagacaagggaatggggttgttgaatcggaggtagaagcggctttagtacgaccagtggttgatgaagaaccctaa

SEQ ID NO: 898 - protein, 1088 aa, Arabidopsis thaliana
MATTEDTPASAGPRYAPEDPTLPQPWKGLIDGSTGILYYWNPETNVTQYERPSAPPPHSATTPKLAQIPVPSSGQGHQAQHEQAKPVGHVSQQHGFQQQPQQFPSQHVRPQMMQQHPAQQMPQQSGQQFPQQQSQSMVPHPHGHPSVQTYQPTTQQQQQGMQNQHSQMPQQLSHQYAHSQQHYMGFRPHMQTQGLQNSHQTPQGGPHGQQFPSQQEYNSLAPKREGDEFHGGKKTGFSQPHLPNSERSPSQNTHFEANAASQKTNANLAMAQKCNGPQANAAVTQFQQPGANLIHQQLGPRAPNQMDQTMLHQKSHVSPFQSNNTYENNLQSRPGNDSYVNMRMEVPVRGAQPLHPAAMPKDIRISGGPPTNADPAMGQTGHGTYGHAGPAFPNKSLVRPHFVTSPDVPHLSPVEIYRKQHEVTTTGENIPAPYITFESSGLPPEILRELLSAGFPSPTPIQAQTWPIALQSRDIVAIAKTGSGKTLGYLIPAFILLRHCRNDSRNGPTVLILAPTRELATQIQDEALRFGRSSRISCTCLYGGAPKGPQLKELERGADIVVATPGRLNDILEMKMIDFQQVSLLVLDEADRMLDMGFEPQIRKIVNEIPPRRQTLMYTATWPKEVRKIASDLLVNPVQVNIGRVDELAANKAITQYVEVVPQMEKERRLEQILRSQERGSKVIIFCSTKRLCDHLARSVGRHFGAVVIHGDKTQGERDWVLNQFRSGKSCVLIATDVAARGLDIKDIRVVINYDFPTGVEDYVHRIGRTGRAGATGVAFTFFTEQDWKYAPDLIKVLEGANQQVPPQVRDIAMRGGGGGGPGYSQDRRGMVNRFDSGGGGTRWDSGGGFGGRGGGFSGREGGFGGREGGFGGREGGFGGRGGRFGMRDDSFGRGGNRGRGFTGPDAGHMNVGGRGGFGRFGNNNNMESRGFGRGSGRGFGRGVGRFDNRRGRSRSRSPDLVRPRRRSSSYSRSRSRSGSYSRSRSRSRSWSRSRSRSPRHSRDRGGHNRSRSYSRSPSPVYERRDRAPRVSGFDIKPPVESVVNLDMNAAAAIENVVPTSLSERQGNGVVESEVEAALVRPVVDEEP

SEQ ID NO: 899 - DNA, 681 bp, Arabidopsis thaliana
atgtctgatgtcccttcttgttctagcggtaatgatacaaacaacaatgattcgagtaacttcgaatgtaacatctgcttagacttggctcaagatcctattgtcactctctgtggtcacttgttctgttggccttgtttatacaaatggctccatctccattctcaatctaaggactgtcctgtttgcaaagccgtgatcgaagaagacagattggttcctttgtacggtagaggtaaatcgtctgctgaccctcggtccaagtccattccgggtctcgaagtgcctaaccgtccatcgggacagagacccgaaactgcacaacctcctgatcctaaccatggttttgctcatcatcatgggtttggagggttcatgggaggttttgctgctccgatggcgagtgcgcggttcgggaatgttacattgtctgcagcgtttggcggtttgattccttctttgttcaacctccatttccatggtttccctgatgcagccatgtatggagctgctgcttctggcggcttccctcacggtttctcgaatccgtttcatggaggacactcgcatatgcatagttaccagcggcacacgggtcgacaaggacaacaagaccatcacttgaggatattgttactcattgttttcgtcgttgttgtgttttctctcttcttgagctag

SEQ ID NO: 900 - protein, 226 aa, Arabidopsis thaliana
MSDVPSCSSGNDTNNNDSSNFECNICLDLAQDPIVTLCGHLFCWPCLYKWLHLHSQSKDCPVCKAVIEEDRLVPLYGRGKSSADPRSKSIPGLEVPNRPSGQRPETAQPPDPNHGFAHHHGFGGFMGGFAAPMASARFGNVTLSAAFGGLIPSLFNLHFHGFPDAAMYGAAASGGFPHGFSNPFHGGHSHMHSYQRHTGRQGQQDHHLRILLLIVFVVVVFSLFLS

SEQ ID NO: 901 - DNA, 228 bp, Arabidopsis thaliana
atgtcaggtgcgcttgcatggcaggtcaaaaaactgatcctcaataaaaaaaagattttgtgggttttggagaggaggtcgcacgggttattattttttcccgggatctcttctcctctgtgtgtgtcgtcttgcctctgctctatctctctccctgctctttcacatttcatatctttcttaaatgctcatatacactcaaaaaccgatcataagcagagtttgtaa

SEQ ID NO: 902 - protein, 75 aa, Arabidopsis thaliana
MSGALAWQVKKLILNKKKILWVLERRSHGLLFFPGISSPLCVSSCLCSISLPALSHFISFLNAHIHSKTDHKQSL

SEQ ID NO: 903 - DNA, 606 bp, Arabidopsis thaliana
atggcggtttcagtttcaatcctcaccgtcgtcactgctcttcacctccttgctttcgtcttcgccttcggtgccgagcgtcgccgtagcaccgctgtgccggttccggatcagtacgatgagaagactatttgtaagtacggaactgaggcgtcgacagtgtacggtatgtcggcgtttgggttgcttcttgttagccaagcggtggttaacggtgttactaagtgtctctgttttggaaagggtcttgttactggtacttcttacactgtctgggctattgtcttcttcgttgtttcttgggtaagctttttaggagctgaggcgtgcttgttgggtggatcagcgaggaacgcgtaccacactaaaagtgaaggcatttacaaagggaaagagctttcgtgtgccgtcttacccgttggagtctttgctgctggagctgctttcactctcatgtctttgattgcaaccattctttactacttggctcattctaaggctgatactggcggatgggagaagcatcagaacgatggcattaacattggtatgaccactccttcagatgctccaaagcaacaaaacaccgagtttaacaaggtctaa

SEQ ID NO: 904 - protein, 201 aa, Arabidopsis thaliana
MAVSVSILTVVTALHLLAFVFAFGAERRRSTAVPVPDQYDEKTICKYGTEASTVYGMSAFGLLLVSQAVVNGVTKCLCFGKGLVTGTSYTVWAIVFFVVSWVSFLGAEACLLGGSARNAYHTKSEGIYKGKELSCAVLPVGVFAAGAAFTLMSLIATILYYLAHSKADTGGWEKHQNDGINIGMTTPSDAPKQQNTEFNKV

SEQ ID NO: 905 - DNA, 1263 bp, Arabidopsis thaliana
atgttagctctgtctccggcgacaagagatggttgcgacggagcgtcagagtttcttgatacgtcgtgtggattcacgattataaacccggaggaggaggaggagtttccggatttcgctgaccacggtgatcttcttgacatcattgacttcgacgatatattcggtgtggccggagatgtgcttcctgacttggagatcgaccctgagatcttatccggggatttctccaatcacatgaacgcttcttcaacgattactacgacgtcggataagactgatagtcaaggggagactactaagggtagttcggggaaaggtgaagaagtcgtaagcaaaagagacgatgttgcggcggagacggtgacttatgacggtgacagtgaccggaaaaggaagtattcctcttcagcttcttccaagaacaatcggatcagtaacaacgaagggaagagaaaggtgaaggtggattggacaccagagctacacaggagattcgtggaggcagtggaacagttaggagtggacaaagctgttccttctcgaattctggagcttatgggagtccattgtctcactcgtcacaacgttgctagtcacctccaaaaatataggtctcatcggaaacatttgctagctcgtgaggccgaagcggctaattggacacgcaaaaggcatatctatggagtagacaccggtgctaatcttaatggtcggactaaaaatggatggcttgcaccggcacccactctcgggtttccaccaccaccacccgtggctgttgcaccgccacctgtccaccaccatcattttaggcccctgcatgtgtggggacatcccacggttgatcagtccattatgccgcatgtgtggcccaaacacttacctccgccttctaccgccatgcctaatccgccgttttgggtctccgattctccctattggcatccaatgcataacgggacgactccgtatttaccgaccgtagctacgagatttagagcaccgccagttgccggaatcccgcatgctctgccgccgcatcacacgatgtacaaaccaaatcttggatttggtggtgctcgtcctccggtagacttacatccgtcaaaagagagcgtggatgcagccataggagatgtattgacgaggccatggctgccacttccgttgggattaaatccgccggctgttgacggtgttatgacagagcttcaccgtcacggtgtctctgaggttcctccgaccgcgtcttgtgcctga

SEQ ID NO: 906 - protein, 420 aa, Arabidopsis thaliana
MLALSPATRDGCDGASEFLDTSCGFTIINPEEEEEFPDFADHGDLLDIIDFDDIFGVAGDVLPDLEIDPEILSGDFSNHMNASSTITTTSDKTDSQGETTKGSSGKGEEVVSKRDDVAAETVTYDGDSDRKRKYSSSASSKNNRISNNEGKRKVKVDWTPELHRRFVEAVEQLGVDKAVPSRILELMGVHCLTRHNVASHLQKYRSHRKHLLAREAEAANWTRKRHIYGVDTGANLNGRTKNGWLAPAPTLGFPPPPPVAVAPPPVHHHHFRPLHVWGHPTVDQSIMPHVWPKHLPPPSTAMPNPPFWVSDSPYWHPMHNGTTPYLPTVATRFRAPPVAGIPHALPPHHTMYKPNLGFGGARPPVDLHPSKESVDAAIGDVLTRPWLPLPLGLNPPAVDGVMTELHRHGVSEVPPTASCA

SEQ ID NO: 907 - DNA, 1020 bp, Arabidopsis thaliana
atggcgccagttcttcagagctcacagccatgggttgagaaataccggccgaagcaggttaaggacgtggctcaccaggaagaggtggttcgtgtcctcaccaacactctccagactgctgactgcccgcacatgctcttctatggaccaccaggcactggaaaaaccactactgctcttgccatcgctcaccagctctttggacctgaactatacaagtctagggtgttggagcttaatgcaagtgatgacagaggtattaatgttgttcggactaagatcaaggattttgctgctgttgctgttgggtctaatcatcgtcaaagtggttatccttgcccatcgtttaagatcatcatcctagatgaggctgattcgatgacagaagatgctcagaatgccttgaggcgcacaatggaaacttactccaaagtcaccagattctttttcatatgtaattacatcagcaggatcatagagccccttgcttccaggtgtgcgaagttcaggtttaaaccactttccgaagaagtcatgagtaaccgtatattgcatatttgtaatgaagaaggtctcagccttgatggagaggctctttcaactttgagctccatatcacaaggtgatctccgtagggccatcacatatctgcagagtgctactcggttgtttggatcaacaataacttctacagatttactcaatgtgtctggggtagttcctctagaggtagtcaataaactttttactgcatgcaaaagtggtgatttcgatattgcaaacaaggaagtggataacatagttgcagaaggatatcctgcatctcaaatcatcaatcagctattcgatatagttgcggaggctgacagtgacataacagacatgcaaaaggctaagatctgcaaatgtttagctgaaactgataagcgacttgtagacggggcggatgagtacttgcagcttctggatgtggcaagcagtacaatttgtgccctctcagaaatggctcaagacttctaa

SEQ ID NO: 908 - protein, 339 aa, Arabidopsis thaliana
MAPVLQSSQPWVEKYRPKQVKDVAHQEEVVRVLTNTLQTADCPHMLFYGPPGTGKTTTALAIAHQLFGPELYKSRVLELNASDDRGINVVRTKIKDFAAVAVGSNHRQSGYPCPSFKIIILDEADSMTEDAQNALRRTMETYSKVTRFFFICNYISRIIEPLASRCAKFRFKPLSEEVMSNRILHICNEEGLSLDGEALSTLSSISQGDLRRAITYLQSATRLFGSTITSTDLLNVSGVVPLEVVNKLFTACKSGDFDIANKEVDNIVAEGYPASQIINQLFDIVAEADSDITDMQKAKICKCLAETDKRLVDGADEYLQLLDVASSTICALSEMAQDF

SEQ ID NO: 909 - DNA, 852 bp, Arabidopsis thaliana
atggcagagcatttagcttcaatctttggtactgaaaaggatagagtgaattgtccgttttactttaagattggtgcttgtcgtcacggtgaccggtgctcacggcttcataaccgtcccaccatctcgccgacgcttctcctctcgaacatgtaccagagacctgacatgataactccaggtgtggatcctcagggacagccgttagacccgagtaagatccaagaccactttgaggatttctacgaagatattttcgaagaactcaacaagtttggtgaagtggagagtctcaatgtttgtgacaatcttgctgatcatatgattgggaatgtgtatgttctgtttaaggaggaggatcacgcagctgctgcgttgcaggctttgcaggggagattttattccggtcgtcctatcattgctgatttctctcctgtgacggattttagggaagctacttgtaggcagtatgaagaaaacagctgtaaccgtggtgggtactgtaatttcatgcatgtgaagcagatttcgagggagcttaggaggaaattgtttgggaggtatcgtcgttcataccgtcggggaagcagaagtcgaagcaggagtataagccctcgacgtaagagagagcattcgcgagagcgagagagaggggacgttagggaccgtgaccggcatggaaatgggaaaaggagcagtgatagatcagagaggcatgatcgggatggtggtggaaggaggagacatggaagcccgaaacggagcagaagcccacgaaatgtgagagaaggaagcgaggaaaggagggcgagaattgagcaatggaaccgagaacgtgatgagggagtttaa

SEQ ID NO: 910 - protein, 283 aa, Arabidopsis thaliana
MAEHLASIFGTEKDRVNCPFYFKIGACRHGDRCSRLHNRPTISPTLLLSNMYQRPDMITPGVDPQGQPLDPSKIQDHFEDFYEDIFEELNKFGEVESLNVCDNLADHMIGNVYVLFKEEDHAAAALQALQGRFYSGRPIIADFSPVTDFREATCRQYEENSCNRGGYCNFMHVKQISRELRRKLFGRYRRSYRRGSRSRSRSISPRRKREHSRERERGDVRDRDRHGNGKRSSDRSERHDRDGGGRRRHGSPKRSRSPRNVREGSEERRARIEQWNRERDEGV

SEQ ID NO: 911 - DNA, 1065 bp, Arabidopsis thaliana
atgttgtgggtcgacaagtacaggccgaaatcactcgacaaggtcatagttcatgaagatatcgcccaaaaactcaagaaattggtttccgagcaagattgtccacatttgctcttttatgggccgtcaggttctggtaagaaaaccctaattatggctcttctcaagcagatatatggggccagtgcagagaaggtgaaagtggagaacagggcatggaaagttgatgctgggagtagaactattgatctggagctcactacattatcaagcaccaatcatgtggaacttactccaagtgatgcaggctttcaggacagatatattgttcaggagataattaaagaaatggccaagaacagaccaattgacacgaaaggaaagaagggatataaggtgttggtattaaatgaggttgacaagctctcacgagaagctcaacattctctgcggagaacaatggagaaatacagctcatcttgccgtctcatcttatgctgcaacagctcttcgaaggttaccgaagccattaagtctcgttgtctcaatgtgcgcataaatgcaccttcgcaggaagagatagtgaaagtgttggagttcgttgcaaagaaagaaagtctgcaactgccccagggttttgctgctcgtattgctgaaaaatcaaatcgcagtctaagaagagctattttgtcacttgaaacttgtcgtgtccaaaactatccgttcacaggtaaccaagtgatatctcccatggattgggaagagtatgttgctgaaatagcaactgacatgatgaaagaacaaagccctaaaaagttatttcaggtgcgtggaaaggtgtacgaattactagttaattgtattccaccagaagtcattctaaagagactccttcatgaattgctgaagaaactggactcagagctaaagcttgaagtctgccactgggctgcatattatgaacatcggatgcgattaggtcagaaagccatatttcacatagaagcatttgtggccaagtttatgagcatatacaaaaacttcctcatttcaacgtttgggtag

SEQ ID NO: 912 - protein, 354 aa, Arabidopsis thaliana
MLWVDKYRPKSLDKVIVHEDIAQKLKKLVSEQDCPHLLFYGPSGSGKKTLIMALLKQIYGASAEKVKVENRAWKVDAGSRTIDLELTTLSSTNHVELTPSDAGFQDRYIVQEIIKEMAKNRPIDTKGKKGYKVLVLNEVDKLSREAQHSLRRTMEKYSSSCRLILCCNSSSKVTEAIKSRCLNVRINAPSQEEIVKVLEFVAKKESLQLPQGFAARIAEKSNRSLRRAILSLETCRVQNYPFTGNQVISPMDWEEYVAEIATDMMKEQSPKKLFQVRGKVYELLVNCIPPEVILKRLLHELLKKLDSELKLEVCHWAAYYEHRMRLGQKAIFHIEAFVAKFMSIYKNFLISTFG

SEQ ID NO: 913 - DNA, 1128 bp, Arabidopsis thaliana
atggcggcgttgatggagtcagtcgtcggccgagctctaaaattctcatcgacggcgaatttcaggtcaatccgacgcggcgaaacaccaacactctgtatcaaatcattctccaccattatgtcaccaccgtcaaaagccatcgtctacgaagaacacggctctcccgattccgtcaccagattggtgaatctcccgccggtggaagtgaaagaaaacgacgtttgtgttaaaatgatcgccgctccgatcaacccctccgatatcaatcgaattgaaggtgtgtatccggtgaggccaccggtaccagcggttggtggttatgaaggtgttggtgaagtttatgcagttggctccaatgttaatggtttttctcctggtgattgggtcattccatctccaccttcttcagggacttggcagacttatgttgtgaaggaagagagtgtgtggcacaaaatcgataaagagtgtccaatggagtatgcagcgacgattactgttaatccattgacggctttgaggatgcttgaggactttgtgaacttgaattctggggattctgttgtacagaatggtgcaacaagtattgtgggtcagtgtgtcattcagttggcaagactccgtggcatcagtaccatcaaccttattcgtgacagggctgggtcggatgaagcaagagagcagctgaaagctctaggtgcagatgaagtcttttcagagagtcaactgaatgtaaagaatgtgaaaagtcttttgggtaacttacctgaaccagctctgggattcaactgtgttggtggcaatgctgcctctcttgtcctcaaatatctcagggaaggaggaaccatggtaacatatggtgggatgtctaagaagccaatcactgtgtcaacaacatctttcatctttaaggatttggccttaagaggattttggctgcagagttggttgagtatgggtaaagtaaaagaatgcagagagatgatagactatctcctcgggcttgcacgagacgggaagctaaaatacgaaacggaattggttcccttcgaagagttccctgttgctctcgataaagctctcgggaagctaggaaggcaacctaaacaagtcatcacattctga

SEQ ID NO: 914 - protein, 375 aa, Arabidopsis thaliana
MAALMESVVGRALKFSSTANFRSIRRGETPTLCIKSFSTIMSPPSKAIVYEEHGSPDSVTRLVNLPPVEVKENDVCVKMIAAPINPSDINRIEGVYPVRPPVPAVGGYEGVGEVYAVGSNVNGFSPGDWVIPSPPSSGTWQTYVVKEESVWHKIDKECPMEYAATITVNPLTALRMLEDFVNLNSGDSVVQNGATSIVGQCVIQLARLRGISTINLIRDRAGSDEAREQLKALGADEVFSESQLNVKNVKSLLGNLPEPALGFNCVGGNAASLVLKYLREGGTMVTYGGMSKKPITVSTTSFIFKDLALRGFWLQSWLSMGKVKECREMIDYLLGLARDGKLKYETELVPFEEFPVALDKALGKLGRQPKQVITF

SEQ ID NO: 915 - DNA, 1182 bp, Arabidopsis thaliana
atgtcgtcgcgtttttctttgacggtggtgtgtttgattgctctgttaccgtttgttgttggtatacggttgattccggcgaggatcacgagtgtcggtgatggcggcggcggaggaggtaataatgggtttagtaaacttggtccgtttatggaagctccggagtatagaaacggcaaggagtgtgtatcttcatcagtgaacagagagaacttcgtgtcgtcttcttctagttctaatgatccttcgcttgttcacatcgctatgactttggactcagagtatctccgtggatcaatcgcagccgttcattctgttcttcgccacgcgtcttgtccagagaacgtcttcttccatttcatcgctgctgagtttgactctgcgagtcctcgtgttctgagtcaactcgtgaggtcgacttttccttcgttgaactttaaagtctacatttttagggaagatacggtgatcaatctcatatcttcttcgattagactagctttggagaatccgttgaactatgctcggaactatctcggagatattcttgatcgaagtgttgaacgagtcatttatcttgactcggatgttataactgtggatgatatcacaaagctttggaacacggttttgaccgggtcacgagtcatcggagctccggagtattgtcacgcgaacttcactcagtatttcacttccgggttctggtcagacccggctttaccgggtctaatctcgggtcaaaagccttgctatttcaacacaggagtgatggtgatggatcttgttagatggagagaagggaattacagagagaagttagagcaatggatgcaattgcagaagaagatgagaatctacgatcttggatcattaccaccgtttcttttggtgtttgcgggtaatgttgaagctattgatcatagatggaaccaacatggtttaggaggagacaatatacgaggaagttgtcggtcattgcatcctggtcctgtgagcttgttgcattggagtggtaaaggtaagccatgggttagacttgatgagaagaggccttgtccgttggatcatctttgggagccatatgatttgtataagcataagattgagagagctaaagatcagtctctgcttgggtttgcttctctgtcggagttgactgatgattcaagcttcttgtga

SEQ ID NO: 916 - protein, 393 aa, Arabidopsis thaliana
MSSRFSLTVVCLIALLPFVVGIRLIPARITSVGDGGGGGGNNGFSKLGPFMEAPEYRNGKECVSSSVNRENFVSSSSSSNDPSLVHIAMTLDSEYLRGSIAAVHSVLRHASCPENVFFHFIAAEFDSASPRVLSQLVRSTFPSLNFKVYIFREDTVINLISSSIRLALENPLNYARNYLGDILDRSVERVIYLDSDVITVDDITKLWNTVLTGSRVIGAPEYCHANFTQYFTSGFWSDPALPGLISGQKPCYFNTGVMVMDLVRWREGNYREKLEQWMQLQKKMRIYDLGSLPPFLLVFAGNVEAIDHRWNQHGLGGDNIRGSCRSLHPGPVSLLHWSGKGKPWVRLDEKRPCPLDHLWEPYDLYKHKIERAKDQSLLGFASLSELTDDSSFL

SEQ ID NO: 917 - DNA, 453 bp, Arabidopsis thaliana
atggagtcatcacaagcaacgacgaagccaacgagaggagcaggaggaaggaaaggtggagataggaagaagagtgttagtaaatctgttaaagctggtcttcaatttcccgttggtcgtatcgctcgttacttgaagaaaggtcggtacgctctccgatacggttccggtgctccggtttacctcgccgccgttctcgaatacctagccgccgaggtacttgagctagctgggaacgcagcgagagataataagaagaacaggataaaccctaggcatctatgtttagcgataaggaacgatgaggaattggggagattgcttcatggagttactattgctagtggtggtgttcttccaaacattaatccagttcttcttcctaagaaatcaacagcttcttcttctcaagcggagaaagcttctgctaccaaatctcctaagaaggcttga

SEQ ID NO: 918 - protein, 150 aa, Arabidopsis thaliana
MESSQATTKPTRGAGGRKGGDRKKSVSKSVKAGLQFPVGRIARYLKKGRYALRYGSGAPVYLAAVLEYLAAEVLELAGNAARDNKKNRINPRHLCLAIRNDEELGRLLHGVTIASGGVLPNINPVLLPKKSTASSSQAEKASATKSPKKA

SEQ ID NO: 919 - DNA, 1929 bp, Arabidopsis thaliana
atgcctaatttctcagttaacgttccccaactctcatctctttacagtacaaaaacgcccaaagtgagaatgaatctatgtgccgatcaggtgttcgataaaaagcttctgtggagagatatgtcaacgaagatgaaatttccttctttttctgctgcggaattacctgatttgaggaaaagtaacaagaggaggggatctcttaggatgatcaagtgcagagccgccggagctgacggtggacgcgtggctgttggggatgatgtgttttcggttactacttcttctaagtatgaagttgactatctgggtcaaagtactaagggagatttgaatctcaagcttgaccctcttcagtcatttggagatgggcaggctacattggagggtcccattgaggaggtagcgagaacagaggctcaagcggctgaaaatttgattagagagttgggtatccaaggccctttctctgcacagcactctcctcggggtatattttgtagtcgtacattgaatcttcggtccattagtgcaattggatatgatatggattacactttgatgcactacaatgtcatggcttgggaaggaaaggcttatgactattgcatggaaaatctaaagagcatgggtttccctgttgatggacttgcttttgatccggaactggttatcaggggtctcatgattgacaaagagaaaggtaatttagttaaggccgatagatttgggtatgtgaagagagccatgcacggtacaaagatgttatcaaataaagctgtcagtgagatctatggaagggagttagttgacctgcggaaccagagtcgatgggagtttctcaatacatttttttcagtttcagaggctctggcttatgcacagatggttgatagattggatgatggatttatttcggcagatcttggcactcttgattataaaggactgtataaggctgttgcaaaagctctcttcagagcacatgttgaaggacaacttaagagtgagataatgtccaagccggaactatttgtcgagccagacccagaactacctttagctcttttagatcaaaaggaggctggtaagaagctcttgcttatcacaaactcggattatcactacacagacaaaatgatgaagcattcatttaacaaattccttcccaatgacatggactggcgagatctttttgacatggtgatagtttctgcgaggaaaccagagttcttccagatgtcgcaccctctatatgaggttgtgactggagagggtttgatgcgtccatgcttcaaggctgaaacaggaggtttgtactcaggaggaagtgctcaaatgatagagagttcactcaacgttcatggagatgagattttgtatgttggtgaccacatctacactgatgtcagcgtatccaaagtccatctcaggtggcgaactgcgctgatttgccgtgaactggaagaagagtatatggctctaattggcagtcgtggtcaccgagaagagctaatagagcttataaatcaaaaagaggttgttggggatctctttaaccaacttcggcttgctcttcaaagacgaagcaaaggccgtcctgctcagactctcgctgctaccaacttggatgatcaagaactgacagagaccatgcaaaagcttcttattgtaatgcaaagactagatgacaagattggtctaatgctggaaacagatggcgagctctttaacaaaaggtggggcttcctctcacgcgcgggtttgtgggataaaagccacttgatgagacaaatcgaaaagtatgcggatatatacacatcaagagtctccaacttcctcaactacacacccttcatgtatttccgctcacaagagcagtcactggctcacgattctccgcttccagatgcgggtatagaaaactag

SEQ ID NO: 920 - protein, 642 aa, Arabidopsis thaliana
MPNFSVNVPQLSSLYSTKTPKVRMNLCADQVFDKKLLWRDMSTKMKFPSFSAAELPDLRKSNKRRGSLRMIKCRAAGADGGRVAVGDDVFSVTTSSKYEVDYLGQSTKGDLNLKLDPLQSFGDGQATLEGPIEEVARTEAQAAENLIRELGIQGPFSAQHSPRGIFCSRTLNLRSISAIGYDMDYTLMHYNVMAWEGKAYDYCMENLKSMGFPVDGLAFDPELVIRGLMIDKEKGNLVKADRFGYVKRAMHGTKMLSNKAVSEIYGRELVDLRNQSRWEFLNTFFSVSEALAYAQMVDRLDDGFISADLGTLDYKGLYKAVAKALFRAHVEGQLKSEIMSKPELFVEPDPELPLALLDQKEAGKKLLLITNSDYHYTDKMMKHSFNKFLPNDMDWRDLFDMVIVSARKPEFFQMSHPLYEVVTGEGLMRPCFKAETGGLYSGGSAQMIESSLNVHGDEILYVGDHIYTDVSVSKVHLRWRTALICRELEEEYMALIGSRGHREELIELINQKEVVGDLFNQLRLALQRRSKGRPAQTLAATNLDDQELTETMQKLLIVMQRLDDKIGLMLETDGELFNKRWGFLSRAGLWDKSHLMRQIEKYADIYTSRVSNFLNYTPFMYFRSQEQSLAHDSPLPDAGIEN

SEQ ID NO: 921 - DNA, 393 bp, Arabidopsis thaliana
atgtcaggccaatattctttgaagagtgacatttacagttttggagtagtgatgcttgaacttttaactgggagaaaaccatttgacagcacaaggtcaagatctgagcagtcactggttcgatgggcgacaccacaacttcacgacattgatgctttagccaaaatggttgatccagctcttaaagggctttatcctgtcaaatccctttctcgatttgcagatgttatcgctctctgtgtccagccggagccggagtttagaccaccaatgtctgaagttgtgcaggctctagttgtgttagtgcagagagctaacatgagcaagagaactgtcggagttgatccatcgcaacgtgctggtagtgccgacacgaccagtgattacatgtaa

SEQ ID NO: 922 - protein, 130 aa, Arabidopsis thaliana
MSGQYSLKSDIYSFGVVMLELLTGRKPFDSTRSRSEQSLVRWATPQLHDIDALAKMVDPALKGLYPVKSLSRFADVIALCVQPEPEFRPPMSEVVQALVVLVQRANMSKRTVGVDPSQRAGSADTTSDYM

SEQ ID NO: 923 - DNA, 732 bp, Arabidopsis thaliana
atgaagcgtgattatgcctttgttgaatttagtgatcctcgtgatgctgatgacgcaagatattacttggatggacgggatttcgatggaagtcgcatcactgtggaggcatcaagaggggctcctcgtggttcgcgggacaatggtagcagaggcccacctcctggttctggtcgctgttttaattgtggtgtcgatggccactgggcccgagactgcacagcaggagactggaagaataaatgttaccgctgtggtgaaagaggacacattgagagaaactgcaaaaacagtcctagtccaaagaaggccaggcagggtggaagctattccaggtcaccagtcaaatcccgctcccctcgtcgccgaaggagcccaagccgtagccgtagttacagtcgaggtcgcagctacagtcgatcgcgatccccagtgagaagagagaaaagcgtggaggacagatcacgcagtcctaaggcaatggagcgatctgtatctcccaaaggtagggaccaaagcctgagtccagaccgaaaagtgatagatgcaagcccaaagcgtggatcagactatgatggtagcccaaaagagaatggtaatggcaggaactctgcgagtcccattgttggaggtggtgaaagtcctgttggacttaatggtcaagacaggagcccgattgatgatgaggctgagcttagccgtccttcccctaaaggcagtgagtcaccttga

SEQ ID NO: 924 - protein, 243 aa, Arabidopsis thaliana
MKRDYAFVEFSDPRDADDARYYLDGRDFDGSRITVEASRGAPRGSRDNGSRGPPPGSGRCFNCGVDGHWARDCTAGDWKNKCYRCGERGHIERNCKNSPSPKKARQGGSYSRSPVKSRSPRRRRSPSRSRSYSRGRSYSRSRSPVRREKSVEDRSRSPKAMERSVSPKGRDQSLSPDRKVIDASPKRGSDYDGSPKENGNGRNSASPIVGGGESPVGLNGQDRSPIDDEAELSRPSPKGSESP

SEQ ID NO: 925 - DNA, 993 bp, Arabidopsis thaliana
atggcttcttctttagctcaatctagaatctcgaatctccagaatcatctttcacctcttgaagcaaacaacaagctcaggagtctggtcaagatttctccccaagtatctgaagccttgtctaatggacgtgctgttgtcgctcttgagtcaaccattatctcccatgggatgccttaccctcaaaatctgcaaacagcaaaagaggtggagtcaattgtgagagaaaatggagcaatccctgcaacaattgctatccttaatggagtaccttgcataggtctgagcgaggaagaactagaacgtcttgcatctctcggaaaaagtgtccaaaagacagcgggaagggacatagcaaatgttgtggctacaagaggaaacggtgcaactacagtctctgcaacgttgtttttcgcttcaatggttggcatccaagtttttgtgacgggcgggataggtggtgtccatagacatgccaaccattcgatggacatatcatctgatcttactgcacttgggaggactccaatagcagtgatatcagcaggcgttaaatcaatacttgatattccaaagactcttgaatatttggaaactcaagaagtgtatgttgctgcatacaagagcgatgagtttccagcatttttcacagaaaaaagtggctgtaaggcaccttcccgtgtaaatagccctgaagactgtgctagagtaatagatgcaaacatgaagctaaaccgtcaggcggggattctatttgccattccaattccgaaacaccattcagccgctggaaatcttatcgaatcagcaacacagcgtgctcttacagaagcaagggaacaaaacgttactggaaatgcagaaactccattcttacttgcacgggtaaatgagttaaccggaggcacatcacttgcagcaaacattgcgcttgtgaaaaacaatgcccttatcggttctcagattgcagtagccctttctcagctgatgtga

SEQ ID NO: 926 - protein, 330 aa, Arabidopsis thaliana
MASSLAQSRISNLQNHLSPLEANNKLRSLVKISPQVSEALSNGRAVVALESTIISHGMPYPQNLQTAKEVESIVRENGAIPATIAILNGVPCIGLSEEELERLASLGKSVQKTAGRDIANVVATRGNGATTVSATLFFASMVGIQVFVTGGIGGVHRHANHSMDISSDLTALGRTPIAVISAGVKSILDIPKTLEYLETQEVYVAAYKSDEFPAFFTEKSGCKAPSRVNSPEDCARVIDANMKLNRQAGILFAIPIPKHHSAAGNLIESATQRALTEAREQNVTGNAETPFLLARVNELTGGTSLAANIALVKNNALIGSQIAVALSQLM

SEQ ID NO: 927 - DNA, 636 bp, Arabidopsis thaliana
atggcttcaaattcagcacttctcatgaaaacaatcttcctcgtactcatttttgtctcttttgcaatctctccagcaacttcaactgcgccggaagaatgtggaagcgagtcagcgaacccgtgcgtcaacaaagctaaagctttgcctctcaaagtcatagcaatcttcgtaatcctcattgcaagcatgattggtgttggagctcctctctttagccgtaacgtttcgttcctccaaccagacggaaacatcttcactatcattaagtgtttcgcctccgggatcatccttggaaccggttttatgcacgttttacctgattctttcgaaatgttgtcatctatatgtcttgaagagaacccgtggcataaatttcctttctccggatttctcgctatgttatcgggtctaatcactctagccattgactccatggccacgagcctatacaccagcaagaacgcagttggtatcatgccccatggtcatggtcatggtcacggccccgcaaatgatgttaccttaccaataaaagaagatgattcgtcaaatgcacagctcttgcgataccgagtcattgccatggttcgtacgcacatatatacataccgaatatcattgtattttaaatga

SEQ ID NO: 928 - protein, 211 aa, Arabidopsis thaliana
MASNSALLMKTIFLVLIFVSFAISPATSTAPEECGSESANPCVNKAKALPLKVIAIFVILIASMIGVGAPLFSRNVSFLQPDGNIFTIIKCFASGIILGTGFMHVLPDSFEMLSSICLEENPWHKFPFSGFLAMLSGLITLAIDSMATSLYTSKNAVGIMPHGHGHGHGPANDVTLPIKEDDSSNAQLLRYRVIAMVRTHIYTYRISLYFK

SEQ ID NO: 929 - DNA, 1131 bp, Arabidopsis thaliana
atgacgaagaaactcaatccactggaagatccaccaacggcaacttcaagcgacgaagatgacgtcgagacttccgaagctggtgaagcttcagacgattcctcttcatctgaagaagacgtaccaatcaaaattcgaatcaaatccccttccgccacaaccgccgccgctcctccagctaaatccaccgccgtctccaccgccgctgattcagattctggatccgagactgaaacagattcggattctgaatcaacaaatccaccgaattctggatctgggaagacaatcgctttaaacacagtgaatctaaagaagaaagaggatccaacgtcgtcgtcagctactttagctttaccggcgatgaaatcaggaacaaaacggccagcgagtgaagctgctgctacgacttcaacgaaacgagtgaagaaagatgaagagagtgtgaagaaaccaggaggttttcaaagactatggagtgaagaagacgaaatcttagtgttacaaggaatgattgatttcaaagctgatacagggaagtctccttatgtagatactaatgcgttttacgatttcttgaagaaatcgattagctttgaggttagtaagaatcaattcatggataagattaggagtttaaggaagaagtatattggtaaagaaggaaggaacgaacctagttttgtgaaagctcatgataagaaagcttttgaattgtctaagtttatttggggacctaaaggaatagctcttgattctaatgttaagtcgaacggtgtatcgaaaaagagtgtggcgaagaagaagattgattctgttaagcaagagttggtgtttgccggtggttcttcaactaatggtaaaaaagttgaagaagatggtggtgatgatggatgtgattggtttgataactcgtctcttgttaggatgattgctagtttgggtgttgatgagtattatgtgaagcagcaatggagtttggtttcggttgagagtaagaagattgttgaagagaagtataagttgttgcaagctaaggagttggaatttgtgttggagaagactaagtttttgaatgaggttgcttctatgttcgttgaagcttctaagaacaagccattagatacatag

SEQ ID NO: 930 - protein, 376 aa, Arabidopsis thaliana
MTKKLNPLEDPPTATSSDEDDVETSEAGEASDDSSSSEEDVPIKIRIKSPSATTAAAPPAKSTAVSTAADSDSGSETETDSDSESTNPPNSGSGKTIALNTVNLKKKEDPTSSSATLALPAMKSGTKRPASEAAATTSTKRVKKDEESVKKPGGFQRLWSEEDEILVLQGMIDFKADTGKSPYVDTNAFYDFLKKSISFEVSKNQFMDKIRSLRKKYIGKEGRNEPSFVKAHDKKAFELSKFIWGPKGIALDSNVKSNGVSKKSVAKKKIDSVKQELVFAGGSSTNGKKVEEDGGDDGCDWFDNSSLVRMIASLGVDEYYVKQQWSLVSVESKKIVEEKYKLLQAKELEFVLEKTKFLNEVASMFVEASKNKPLDT

SEQ ID NO: 931 - DNA, 1581 bp, Arabidopsis thaliana
atggcggtttatcctaacgttaatggcgataagaagcactggtggttcactcacagaaagcttgttgataagtatataaaggatgcaacaactttaatggcaagtgaggaggcaaacgacgtcgcttcagctcttcatttactagacgcagccttatctatctccccgcgtttggaaactgcgttagagctcaaggctagatctctcctcttcctccgtcgtttcaaggatgtcgccgatatgcttcaggattatatccccagtcttaaactcgacgacgaaggatccgcttcttctcaaggctcttcttcctccgacggtatcaaccttctctccgacgcctcttcccctggctcctttaaatgcttctctgtttccgacttgaagaagaaagtcatggcaggcatttgtaaaaaatgcgacaaagaagggcaatggaggtatgtggtgttgggtcaagcttgttgccatctaggactaatggaggatgccatggttctcctacaaaccggtaaacgcctcgcctccgccgagttccgtcgccggagtatttgctggtccgacgatagcttccttctcctctccgaatcctcctctgcttcttctccaccacccgagagcgagaacttcacccatctcctcgctcacatcaagcttcttctccgtcgtcgcgccgctgcaatcgccgctctcgacgctggactgttctccgagtcgatccgtcacttctccaagatcgtcgatggccgtcgccctgcgcctcaaggattcctcgccgaatgctacatgcatcgagccgccgcttatagatccgccggtagaatcgcggaagcgatcgccgattgcaataaaaccctagctcttgaaccctcgtgtatccaggcgttagaaaccagagccgcgcttctagaaacggtcaggtgttttccagattcgcttcacgatctagaacacttgaagcttctctacaacaccattttacgcgatcggaagcttccgggtccggtgtggaagcggcacaacgtgaaatacagagagattcctgggaaattgtgcgttttgacaacgaaaacgcagaaacttaagcagaaaatcgcaaacggagaaactgggaatgtcgattattacggcttgatcggagtcagacgcggatgcaccagatcggagctcgatcgagctcatctattgctatgtctcagatacaaacccgatagagcctcttctttcatcgaacggtgcgagttcaccgatcaaaacgacgtcgattcggttagagatcgagccaaaatgtcgtctctgttgctttaccgtttgattcagaaaggatacaccgccgtgacagcgatcatagccgaggagcagaggaagaacgccattgctcacgctcaaaagattgaagaacgcaaaccggttgaaaaatccggttctattaagagaaccggaaacgctgaaacgaaaccggtaaattccaatgcgtaccaaggagtattctgtagagatctcgctgcggttgggaatctactaaccagggctggtttcaaccatccaatcccggttaaatacgaagcgctcacctgctaa

SEQ ID NO: 932 - protein, 526 aa, Arabidopsis thaliana
MAVYPNVNGDKKHWWFTHRKLVDKYIKDATTLMASEEANDVASALHLLDAALSISPRLETALELKARSLLFLRRFKDVADMLQDYIPSLKLDDEGSASSQGSSSSDGINLLSDASSPGSFKCFSVSDLKKKVMAGICKKCDKEGQWRYVVLGQACCHLGLMEDAMVLLQTGKRLASAEFRRRSICWSDDSFLLLSESSSASSPPPESENFTHLLAHIKLLLRRRAAAIAALDAGLFSESIRHFSKIVDGRRPAPQGFLAECYMHRAAAYRSAGRIAEAIADCNKTLALEPSCIQALETRAALLETVRCFPDSLHDLEHLKLLYNTILRDRKLPGPVWKRHNVKYREIPGKLCVLTTKTQKLKQKIANGETGNVDYYGLIGVRRGCTRSELDRAHLLLCLRYKPDRASSFIERCEFTDQNDVDSVRDRAKMSSLLLYRLIQKGYTAVTAIIAEEQRKNAIAHAQKIEERKPVEKSGSIKRTGNAETKPVNSNAYQGVFCRDLAAVGNLLTRAGFNHPIPVKYEALTC

SEQ ID NO: 933 - DNA, 201 bp, Arabidopsis thaliana
atgtcagagaccaacaagaatgccttccaagccggtcaggccgctggcaaagctgaggagaagagcaatgttctgctggacaaggccaaggatgctgctgctgcagctggagcttccgcgcaacaggcgggaaagagtatatcggatgcggcagtgggaggtgttaacttcgtgaaggacaagaccggcctgaacaagtag

SEQ ID NO: 934 - protein, 66 aa, Arabidopsis thaliana
MSETNKNAFQAGQAAGKAEEKSNVLLDKAKDAAAAAGASAQQAGKSISDAAVGGVNFVKDKTGLNK

SEQ ID NO: 935 - DNA, 345 bp, Arabidopsis thaliana
atggcgtcgtttgatgaagcaccaccaggaaacgccaaggccggtgagaagatcttcaggaccaagtgtgctcagtgtcacaccgtcgaagcaggcgccggtcacaaacaaggacccaatctaaacggtctatttggaagacaatctggtacaactgctggttactcttactctgctgctaacaagaacaaagctgtggaatgggaagagaaggccttgtacgattacttgctcaaccccaagaagtacataccaggtaccaagatggtgttccctgggctaaagaagccgcaagaccgtgctgatctcatcgcctacttgaaggaatctactgcgcctaagtga

SEQ ID NO: 936 - protein, 114 aa, Arabidopsis thaliana [sequence omitted]

SEQ ID NO: 937 - DNA, 1479 bp, Arabidopsis thaliana
atggcgtggtcgtcggaaacgccgtcgtattgcggctggaatgagcgacatgtgaagaacacgaaagaaaagatggaggttcattattatctcgagaggaaagatggaattgcagatctagctgttattgggaggttgaagaattctaaacgcatgtcttttagatacgctttgaagaagaatcgctctgtcttgaaaaagcttaattctaaagatgatgttgcgctttggctcgattctattgtttctggtgagatacctcatgtagcagatgtaccagctactgttatgactgaaaaagatgctggagggttcaatatgagcacttttatgaataggaaatttcaggagcctattcagcagatcaaaacgttctcttggatgggtttttcttggacttgcaggaaacggcgtaagcattatcagtcttatctccggaatggtgtcagaatatctgtgaatgattttgtgtatgttttagcggagcaacataagagacttgttgcatatatagaagacctttatgaggattctaaaggcaagaagatggttgtggtacgatggtttcacaaaactgaggaggttggttctgttttatctgatgatgataatgacagagagatatttttttctcttaatcggcaagatatcagtattgagtgcatagattacttggctactgtccttagtcctcagcattatgagaaatttcttaaggtgccgatgcatgttcagacagtagctttcttctgccagaaattatatggagatgatggtttaaagccgtatgacattacacaactagaaggttactggagacaagaaatgcttagatacttgaatgtatctattttaaaatcatttgaaggtgctcaagcccctggtactgacccaggattaaaagctccattggttggttgtgttgggattagatcaaggaaaagacgccgtcctagtcctgttggtactttgaatgtatcatacgcaggtgacatgaaaggtgactgcaaatctagtccagattctgttttggctgttacagatgcttctatattcaagggtgacgaagatggttcttcccatcacattaaaaagggttcacttattgaagttctttctgaagatagtggcatcagaggttgttggtttaaggctctggtattaaagaaacacaaagataaggttaaggtccagtaccaagatattcaggatgcagacgatgaatctaaaaagctagaggaatggattttgacatctcgggttgctgctggtgatcatctgggggatcttagaatcaaaggacggaaagtagtaagaccaatgctgaagcccagcaaagaaaatgatgtatgtgtcatcggggttggtatgcctgtggatgtgtggtggtgtgatggatggtgggaagggatcgtggtgcaggaagtttctgaagagaaatttgaagtttacttgccaggtgagttaagacacctctga

SEQ ID NO: 938 - protein, 492 aa, Arabidopsis thaliana
MAWSSETPSYCGWNERHVKNTKEKMEVHYYLERKDGIADLAVIGRLKNSKRMSFRYALKKNRSVLKKLNSKDDVALWLDSIVSGEIPHVADVPATVMTEKDAGGFNMSTFMNRKFQEPIQQIKTFSWMGFSWTCRKRRKHYQSYLRNGVRISVNDFVYVLAEQHKRLVAYIEDLYEDSKGKKMVVVRWFHKTEEVGSVLSDDDNDREIFFSLNRQDISIECIDYLATVLSPQHYEKFLKVPMHVQTVAFFCQKLYGDDGLKPYDITQLEGYWRQEMLRYLNVSILKSFEGAQAPGTDPGLKAPLVGCVGIRSRKRRRPSPVGTLNVSYAGDMKGDCKSSPDSVLAVTDASIFKGDEDGSSHHIKKGSLIEVLSEDSGIRGCWFKALVLKKHKDKVKVQYQDIQDADDESKKLEEWILTSRVAAGDHLGDLRIKGRKVVRPMLKPSKENDVCVIGVGMPVDVWWCDGWWEGIVVQEVSEEKFEVYLPGELRHL

SEQ ID NO: 939 - DNA, 3444 bp, Arabidopsis thaliana
atggatagaaacagaccaccacatccgttccagcaacatgctatggaacctggatatgtgaatgactctgtcccacaaggatttacgcctgatcaaacgggtctctcgaatgcaaatgtccgacctaatcctgcagatgttaagccggggcttcattactccatacaaacaggagaggaattttctcttgagtttctgcgtgatcgtgtcatttctcaaaggtctgcaaatcccattgcagctggagatatcaattatcccacaggttataacgggcacgcagggtctgaatttggttcagatgtttccaggatgagcatggtgggaaatggcatcaggcagtatgagagaacaaaccccccggttcacgagtttggaaataaactcgggcatatccattcagcaccagaagcttcattatgtcaagatagaagtttaggaaatttccatggatatgcatcttcttcagcctcaggtagtttaacagcaaaggttaaagtcctttgtagctttggtgggaaaatacttccacgtccaggtgattcaaagcttagatatgttggaggtgaaacacacattatttccataagaaaggacatttcttggcaggagctcaggcaaaaagttcttgaaatctactatcggactcatgttgtcaagtatcaacttcctggtgaagatcttgatgccttggtgtctgtatcatgtgacgaagatctactgaatatgatggaggagtataatgagatggaaaaccgtgggggttcgcaaaagcttagaatgtttctgttctctgtgagtgatttggatggtgctcttttgggggttaacaaaagtgatgttgactctgagttccagtatgttgtagctgtaaatgacatggaccttggatcaagaagcaactcaacccttaatggactggacagctcttctgcaaacaatttagctgagctggatgtcaggaacaccgagggaatcaatggtgttggcccttcgcagttaacagggatagattttcaacaatcctctatgcagtattctgagtctgctccaccaacctcctttgctcagtatcctcaatctatcccacacaatggtgcatttcagtttcagcaagctgttcccccaaatgctactcttcagtatgccccgtccaatccaccaagttcgtctgtccactatcctcaatctattctaccaaattccactctccagtatccacaatcgatctcatccagctcgtatggattatacccacaatattatggagaaaccgagcaatttccaatgcagtatcatgatcacaattcttctaattactctattcccatacctttcccagggcagccataccctcaccctggcatcacacagcaaaacgcacctgttcaggtagaggagccaaacataaaacctgagacgaaagttcgtgattatgtggagcctgaaaatcgtcatattctggcaactaatcaccagaatccccctcaagctgatgatactgaggttaagaatcgggagccatcagttgcaacaactgtacccagccaggatgctgcacatatgttgcccccaagaagagacacacggcagaacactcctgtgaagccttctacttaccgtgatgctgttataactgagcaggtcccagtatccggtgaagatgatcagctttcaacatcaagtggtacctgtggtcttgttcataccgactctgagtcgaatctaattgatcttgattatccagaacctttacagcccacccggagagtatatcgttcggagaggatacctcgtgaacagttagaaatgctaaatcgcttgtccaagtctgatgactcacttggttctcagttcttaatgtctcatccacaagctagcactggacagcaagaaccagcaaaagaagcagcaggtatatcacatgaagattcacatattgtaaatgatgtggaaaacatctctggaaatgtagtggcatcaaatgaaaccttggacaaaagaacggtctctggtggaggtattgagacggaagctcgtaacttgagccatgtagacacagaaaggagtcatgatatccctgaaaagcaaacttcttcaggtgttcttattgatatcaatgacaggttccctcaggacttcctttctgaaatattcgcaaaggcactctctgatgatatgccgtcaggtgccaatccatatcagcatgatggagctggtgttagcttgaatgtagagaatcatgatcctaaaaattggtcttattttcggaatctggccgatgaacagtttagcgatagggatgttgcttatattgaccgaacccctggctttccatctgacatggaagatggtggagaaattgccagattgcatcaggttgctccgttgacagaaaaccgtgtggatcctcagatgaaggtcacagagagtgaggaatttgatgctatggttgagaatttaaggacctcagactgtgaacaagaggatgaaaagtcagaaacaaggaacgctggacttcccccagttggcccgtctctggcagattacgacacgagtggcttgcagatcattatgaatgacgatctcgaggagctaaaggagcttggttctggcacattcggtacagtgtatcatggtaaatggagaggatcagatgttgccatcaaaaggataaagaagagttgctttgctggccgatcatctgagcaagaaagattaactggtgaattctggggagaagctgaaattctttcaaagcttcatcatccaaatgtggttgcattttatggtgttgtaaaagatggacctggtgcaacattggctactgtaacagagtacatggttgatggttctctgagacatgttctagtcaggaaagatagacacctggatcgtcgtaagagactaatcattgccatggatgctgcctttggaatggaatacttgcacgccaaaaacattgttcacttcgatttgaaatgtgacaatttacttgtgaacctcaaagatccttctcgcccaatctgcaaggttggtgatttcggtttgtcgaaaatcaaaagaaatacattggtatctggtggtgtacgcggaaccttaccatggatggcaccagagcttctcaatggtagcagcagcaaagtttcagagaaggtcgatgtcttctcttttggtatagtcttgtgggagattctaaccggcgaggaaccatatgctaatatgcactacggtgctataataggtgggatagtgaacaacacactgaggccgaccataccgagctactgtgactcggactggcgaatattaatggaggagtgttgggcgcctaacccaacagcaaggccatccttcacggagatagctggtcggttacgtgttatgtcaactgcagctacttcgaaccaatccaaaccaccagctcacaaggcttcaaagtga

SEQ ID NO: 940 - protein, 1147 aa, Arabidopsis thaliana
MDRNRPPHPFQQHAMEPGYVNDSVPQGFTPDQTGLSNANVRPNPADVKPGLHYSIQTGEEFSLEFLRDRVISQRSANPIAAGDINYPTGYNGHAGSEFGSDVSRMSMVGNGIRQYERTNPPVHEFGNKLGHIHSAPEASLCQDRSLGNFHGYASSSASGSLTAKVKVLCSFGGKILPRPGDSKLRYVGGETHIISIRKDISWQELRQKVLEIYYRTHVVKYQLPGEDLDALVSVSCDEDLLNMMEEYNEMENRGGSQKLRMFLFSVSDLDGALLGVNKSDVDSEFQYVVAVNDMDLGSRSNSTLNGLDSSSANNLAELDVRNTEGINGVGPSQLTGIDFQQSSMQYSESAPPTSFAQYPQSIPHNGAFQFQQAVPPNATLQYAPSNPPSSSVHYPQSILPNSTLQYPQSISSSSYGLYPQYYGETEQFPMQYHDHNSSNYSIPIPFPGQPYPHPGITQQNAPVQVEEPNIKPETKVRDYVEPENRHILATNHQNPPQADDTEVKNREPSVATTVPSQDAAHMLPPRRDTRQNTPVKPSTYRDAVITEQVPVSGEDDQLSTSSGTCGLVHTDSESNLIDLDYPEPLQPTRRVYRSERIPREQLEMLNRLSKSDDSLGSQFLMSHPQASTGQQEPAKEAAGISHEDSHIVNDVENISGNVVASNETLDKRTVSGGGIETEARNLSHVDTERSHDIPEKQTSSGVLIDINDRFPQDFLSEIFAKALSDDMPSGANPYQHDGAGVSLNVENHDPKNWSYFRNLADEQFSDRDVAYIDRTPGFPSDMEDGGEIARLHQVAPLTENRVDPQMKVTESEEFDAMVENLRTSDCEQEDEKSETRNAGLPPVGPSLADYDTSGLQIIMNDDLEELKELGSGTFGTVYHGKWRGSDVAIKRIKKSCFAGRSSEQERLTGEFWGEAEILSKLHHPNVVAFYGVVKDGPGATLATVTEYMVDGSLRHVLVRKDRHLDRRKRLIIAMDAAFGMEYLHAKNIVHFDLKCDNLLVNLKDPSRPICKVGDFGLSKIKRNTLVSGGVRGTLPWMAPELLNGSSSKVSEKVDVFSFGIVLWEILTGEEPYANMHYGAIIGGIVNNTLRPTIPSYCDSDWRILMEECWAPNPTARPSFTEIAGRLRVMSTAATSNQSKPPAHKASK

SEQ ID NO: 941 - DNA, 1899 bp, Arabidopsis thaliana
atggcggacgaatctcaatactcatcggatacttactccaacaaacgcaaatacgaagaaccaaccgctcctcctccatcaactcgcagacctaccggcttctcttctggtccgatcccatctgcttcagttgatcccaccgcacctaccggtcttccaccttcttcttacaacagcgttcctcctccgatggatgaaatccagattgctaaacaaaaagcacaagaaatcgctgctcgtcttcttaatagcgctgatgctaaacgtcctcgtgttgacaatggtgcttcttatgattatggtgacaacaaaggatttagctcatatccctctgagggtaagcagatgtcagggacggttccgtcttcgataccggtttcgtatggtagctttcaaggaactactaagaagattgatattccgaatatgagagttggtgttatcattggtaaaggtggagagactattaagtatcttcagcttcagtctggagctaagattcaggttactagagatatggatgcagaccctaattgtgctactaggactgttgacctaactggtacccctgatcagatctcaaaggctgaacagttgatcactgacgtccttcaagaggctgaggcaggcaatacagctggttcaggtggaggaggcggccgtaggatgggtggacaagcaggggctgatcaatttgttatgaaaattccgaataacaaggttggtttgataattggtaaaggaggtgaaacaatcaaatctatgcaagctaagactggagctagaattcaggttattcctttacatttgccccctggagacccaacgccagaacggactttgcagattgatgggataaccgaacagattgaacatgctaaacaattagttaatgaaatcatcagtggcgagaaccgtatgagaaactcagcaatgggtggaggctatccacaacaaggtggttatcaagcccgcccaccctcaagctgggcaccacctggtggtccgccagcacaacctggttatggtggttacatgcaaccaggagcatatccaggtccacctcagtatggtcaatcaccttacggaagttaccctcaacaaacttcagctggttactatgatcagtcctctgtgccaccatcccagcagagcgcgcaaggtgagtatgattattacggtcagcaacagtctcagcaaccaagcagtggtggtagctcagccccaccaacagataccacagggtacaattactaccagcatgcttctggttatggccaagctggtcagggataccagcaagatgggtatggagcttacaatgcctcgcagcaatcgggatatggtcaagctgctgggtatgatcaacagggtggttacggcagcaccactaatccaagtcaagaggaagatgcatctcaagccgctccaccatcgtcagctcagtctggacaggctgggtatggtacaactggtcaacagccgcctgctcaaggtagtactggtcaggcagggtatggagctcctccaacttctcaggctggttacagcagccagccagcagcagcttacaattctgggtatggagcaccaccacctgcttcaaagccaccgacttatggccagagccagcagtctccaggtgctcctgggagctatggtagtcagtctgggtatgcccaaccagcagcttcagggtatggacaacctccagcgtatgggtatggtcaagcgccacagggatatgggtcttatggaggatacacacaacctgctgctggtggaggttactcttcagacgggtctgctggagccactgctggtggtggtggtggtacaccagcttcacagagtgctgctccacctgctggaccgcccaaagcatccccgaaaagttga

SEQ ID NO: 942 - protein, 632 aa, Arabidopsis thaliana
MADESQYSSDTYSNKRKYEEPTAPPPSTRRPTGFSSGPIPSASVDPTAPTGLPPSSYNSVPPPMDEIQIAKQKAQEIAARLLNSADAKRPRVDNGASYDYGDNKGFSSYPSEGKQMSGTVPSSIPVSYGSFQGTTKKIDIPNMRVGVIIGKGGETIKYLQLQSGAKIQVTRDMDADPNCATRTVDLTGTPDQISKAEQLITDVLQEAEAGNTAGSGGGGGRRMGGQAGADQFVMKIPNNKVGLIIGKGGETIKSMQAKTGARIQVIPLHLPPGDPTPERTLQIDGITEQIEHAKQLVNEIISGENRMRNSAMGGGYPQQGGYQARPPSSWAPPGGPPAQPGYGGYMQPGAYPGPPQYGQSPYGSYPQQTSAGYYDQSSVPPSQQSAQGEYDYYGQQQSQQPSSGGSSAPPTDTTGYNYYQHASGYGQAGQGYQQDGYGAYNASQQSGYGQAAGYDQQGGYGSTTNPSQEEDASQAAPPSSAQSGQAGYGTTGQQPPAQGSTGQAGYGAPPTSQAGYSSQPAAAYNSGYGAPPPASKPPTYGQSQQSPGAPGSYGSQSGYAQPAASGYGQPPAYGYGQAPQGYGSYGGYTQPAAGGGYSSDGSAGATAGGGGGTPASQSAAPPAGPPKASPKS

SEQ ID NO: 943 - DNA, 1143 bp, Arabidopsis thaliana
atgacgttccgaagtttactccaggaaatgcggtctaggccacaccgtgtagttcacgccgccgcctcaaccgctaatagttcagaccctttcagctggtcggagctcccggaggagctgcttagagaaatcctgattagggttgagactgttgacggcggcgattggccgtcgcggcgaaacgtggtggcttgtgccggcgtttgtcgtagctggaggattctcaccaaggagattgtagctgttcctgaattctcctctaaattgactttccctatctccctcaagcagtctggtccaagagattctctagttcaatgctttataaaacgtaatcgaaatactcaatcgtatcatctctatctcggattaactacctctttgacggataacgggaagtttcttcttgctgcttctaagctgaagcgcgcaacttgcactgattacatcatctctttgcgttcagacgatatctcaaagagaagcaacgcgtatcttgggagaatgagatcgaacttccttggaacaaaattcacggtctttgatggtagtcagaccggagcagcgaagatgcagaagagccgctcttctaatttcatcaaagtttcacctagagttcctcagggaagttaccccatcgctcacatttcatacgagttaaacgtcttaggctctcggggaccgagaagaatgcgttgcatcatggatacaatacctatgagcatcgtggagtcgcgaggagtagtagcttcaacatccataagctctttttccagtcggtcatcaccagtctttaggtctcactcaaaaccattgcgcagtaatagtgcatcatgtagcgactcaggcaacaacctgggagatccaccattggtgctgagcaacaaagctccacggtggcatgagcagttacgttgctggtgcttaaatttccatggtcgagtcacagtggcttcggttaagaactttcagcttgtggcagttagtgactgtgaagcagggcagacatctgagaggatcatactccagtttgggaaagttgggaaggacatgtttaccatggattatggatatccgatttctgcgtttcaagcgtttgctatctgcctgagcagttttgaaaccagaattgcctgtgaataa

SEQ ID NO: 944 - protein, 380 aa, Arabidopsis thaliana
MTFRSLLQEMRSRPHRVVHAAASTANSSDPFSWSELPEELLREILIRVETVDGGDWPSRRNVVACAGVCRSWRILTKEIVAVPEFSSKLTFPISLKQSGPRDSLVQCFIKRNRNTQSYHLYLGLTTSLTDNGKFLLAASKLKRATCTDYIISLRSDDISKRSNAYLGRMRSNFLGTKFTVFDGSQTGAAKMQKSRSSNFIKVSPRVPQGSYPIAHISYELNVLGSRGPRRMRCIMDTIPMSIVESRGVVASTSISSFSSRSSPVFRSHSKPLRSNSASCSDSGNNLGDPPLVLSNKAPRWHEQLRCWCLNFHGRVTVASVKNFQLVAVSDCEAGQTSERIILQFGKVGKDMFTMDYGYPISAFQAFAICLSSFETRIACE

SEQ ID NO: 945 - DNA, 942 bp, Arabidopsis thaliana
atgaattcaaacattttcccaccatcgaaacaacaaaacgagcttaataatatacaacaatccttctcaaatctccaatctcaatgctccaatttactcctcaacgtttcacaaacccttaatcctctcttcaacgccaacacgaacaacaacaaacctaatatattctctgctctcaattcgtttcgtgatcaagctaagcaagctttagattctagaatctctcgattcaattctggtaaggcacctgtctgggcgagaatttctgacgacggtggtggtgcgagggctcaggtgacggttccgattcgcggaagcgggaaaggattatctgctgatgctattgaggagagattggcgggagttcctgtttacgcgttgagtaattcgaatgaggagtttgtgttggtttcagggacttcctctgggaaatctctgggtttgttgttttgtaaagaggaagatgcagagactcttcttaaagagatgaagagtatggatcctcgtatgaggaaagaaggttcaaaagttgttgctcttgctcttagcaaggtgttccagttaaaagttaatggtgtggcatttaggttgattcctgagtctactcaagtgaaaaatgccttgaaggaaaggaaaacagctggtatcgatgatgatgacttccatggtgttccggttttccagtcaaagagcttgattctacgaagtgaaaacatgagttatcgccctgttttctttagaaaggaggacttggaaaaatctctaatacgagcgtccagccaacagaaccgacttaaccctgctctgaaaccaggcgatattcaggttgcagttttcgaagatattgtcaagggaatgagggaaagcacgacgtcaaactgggacgacattgtgtttataccgcctggttttgaggtttcaactgagcaaacacaggagtaa

SEQ ID NO: 946 - protein, 313 aa, Arabidopsis thaliana
MNSNIFPPSKQQNELNNIQQSFSNLQSQCSNLLLNVSQTLNPLFNANTNNNKPNIFSALNSFRDQAKQALDSRISRFNSGKAPVWARISDDGGGARAQVTVPIRGSGKGLSADAIEERLAGVPVYALSNSNEEFVLVSGTSSGKSLGLLFCKEEDAETLLKEMKSMDPRMRKEGSKVVALALSKVFQLKVNGVAFRLIPESTQVKNALKERKTAGIDDDDFHGVPVFQSKSLILRSENMSYRPVFFRKEDLEKSLIRASSQQNRLNPALKPGDIQVAVFEDIVKGMRESTTSNWDDIVFIPPGFEVSTEQTQE

SEQ ID NO: 947 - DNA, 624 bp, Arabidopsis thaliana
atggtggagtctctgttcccgagcatcgaaaacacaggtgaatcgtctcgaagaaagaagccgaggatatcagagacggcggaggcggagatagaggcacgacgtgtcaacgaagaaagcttgaagagatggaaaacgaatcgtgtgcaacagatctacgcttgtaagctcgtcgaagctttacgccgagttcgtcagagatcttccaccaccagcaacaacgagaccgataaactcgtctccggcgcggcgagggagatacgtgatacggcggatcgagttctagctgcgtccgctcgtggtacgactcggtggagcagagcgattttagcgagtcgcgtccgagcgaagctgaagaaacatagaaaggcgaaaaagtcaacgggaaattgtaaatcgagaaaaggtctcacggagacgaatcggattaagttaccggcggttgagagaaaactgaagattcttggccgtttggttcctggttgccggaaagtctctgtaccgaatcttttagatgaagcgaccgattacatcgcagcgttagagatgcaggttcgagccatggaggctctcgccgaacttttaaccgcagccgcaccacggacgacgttgaccggaacttaa

SEQ ID NO: 948 - protein, 207 aa, Arabidopsis thaliana
MVESLFPSIENTGESSRRKKPRISETAEAEIEARRVNEESLKRWKTNRVQQIYACKLVEALRRVRQRSSTTSNNETDKLVSGAAREIRDTADRVLAASARGTTRWSRAILASRVRAKLKKHRKAKKSTGNCKSRKGLTETNRIKLPAVERKLKILGRLVPGCRKVSVPNLLDEATDYIAALEMQVRAMEALAELLTAAAPRTTLTGT

SEQ ID NO: 949 - DNA, 531 bp, Arabidopsis thaliana
atgtcttctcatactgcaactaagtatgatgttttcctaagtttcagagggcatgacactcgccacaacttcatcagttttctctacaaagaactggttcgaaggagcattcgaaccttcaaagacgacaaagagctggagaatggccagaggttttcgccggagctcaaaagccccatcgaggtgtcaagattcgccgtcgttgttgtctcagagaactatgctgcgtcttcttggtgtctcgatgagctcgtaacgatcatggatttcgaaaaaaagggttccatcaccgtgatgcccatcttctacggcgtggaaccgaatcatgtgaggtggcagaccggagtactcgctgaacagtttaagaaacatgcgagtagagaagatcctgagaaagttcttaaatggaggcaagcattgaccaattttgcgcaactctccggcgattgttcaggtgatgatgactcgaagctggtggacaaaattgctaacgagatatcaaacaagaagacgatttatgcaacaatatga

SEQ ID NO: 950 - protein, 176 aa, Arabidopsis thaliana
MSSHTATKYDVFLSFRGHDTRHNFISFLYKELVRRSIRTFKDDKELENGQRFSPELKSPIEVSRFAVVVVSENYAASSWCLDELVTIMDFEKKGSITVMPIFYGVEPNHVRWQTGVLAEQFKKHASREDPEKVLKWRQALTNFAQLSGDCSGDDDSKLVDKIANEISNKKTIYATI

SEQ ID NO: 951 - DNA, 1407 bp, Arabidopsis thaliana
atgttggtacagagaagagtaatgagttggagaagagtctggaagtcgtttcaagcggcttctgcgcattgtttactcttctccttcacgcttcttctcgctttgaagcttgatcatgttgtttctcattcatggtggtttgtatttgcacccttgtggttgtttcatgctgtgattgctcgtggtagattttcattgcctgctccatcaatgcctcatgatcgacattgggctccttttcactcggttatggcaacaccacttcttgttgcttttgagatccttctctgtgtacatcttgaagataaatatgttgttgacttaaagattgtctttctaccgttgcttgcatttgaggtagcaattttgatagataatgtcagaatgtgcaggacgctcatgcctggagatgaagaaactatgagtgatgaagccatatgggaaacacttcctcatttctgggtttccatatctatggttttcttcattgccgcaacaaccttcactcttcttaaattatgtggtgacgtagctgcgttgggatggtgggacttatttataaacttcggaatagcagagtgctttgcgtttcttgtctgtacaaagtggagcaatcagtcaattcataggtattcacatataccggaacctagctcatcttcaatggtagtaagatatctggattggaacagaggtctagtagtaaccgctgacgacgagcatcagcaaagcaacagaatatgtggtctccaagatattggtggacatgttatgaaaattccatttgtgacctttcaaatcatccttttcatgcgcttagagggaacgccagcttctgccaaaaacattccgattttagttctgtttgtacctctttttctgttacaaggagctggggtactttttgctatgtatagattggttgagaaatcagtcttattaataaatagtggtagtggttcttatggaagatattttaccgcaacatcatcagctcgtgaattcctgggattctttcaacatggtgcaagattacttggctggtggtctatcgatgaaggaagtcgggaagaacaagcaaggctctactctggagaagctactggatacaacaccttctcaccagaggttgtgaagaaaatgccaaagtctgatcttgttgaagagatatggagacttcaagctgcattgagtgagcaaacagatatcaccagttatagccagcaagagtacgaaaggcttcaaaacgagaagattctttgtagagtttgctttgaagatccgatcaacgtggttctactcccatgtagacatcacgtcctctgcagtacatgctgcgagaaatgcaagaaatgtccgatttgtcgtgtcctgatcgaggagcgtatgcctgtatacgatgtgtag

SEQ ID NO: 952 - protein, 468 aa, Arabidopsis thaliana
MLVQRRVMSWRRVWKSFQAASAHCLLFSFTLLLALKLDHVVSHSWWFVFAPLWLFHAVIARGRFSLPAPSMPHDRHWAPFHSVMATPLLVAFEILLCVHLEDKYVVDLKIVFLPLLAFEVAILIDNVRMCRTLMPGDEETMSDEAIWETLPHFWVSISMVFFIAATTFTLLKLCGDVAALGWWDLFINFGIAECFAFLVCTKWSNQSIHRYSHIPEPSSSSMVVRYLDWNRGLVVTADDEHQQSNRICGLQDIGGHVMKIPFVTFQIILFMRLEGTPASAKNIPILVLFVPLFLLQGAGVLFAMYRLVEKSVLLINSGSGSYGRYFTATSSAREFLGFFQHGARLLGWWSIDEGSREEQARLYSGEATGYNTFSPEVVKKMPKSDLVEEIWRLQAALSEQTDITSYSQQEYERLQNEKILCRVCFEDPINVVLLPCRHHVLCSTCCEKCKKCPICRVLIEERMPVYDV

SEQ ID NO: 953 - DNA, 504 bp, Arabidopsis thaliana
atggcagaagacaagatcttaaagaagactccggcggcgaagaagccgcgaaaaccgaaaaccaccactcatcctccatactttcagatgataaaagaggctttgatggtcctgaaagagaagaacggatcaagcccttatgctatagctaagaagatagaggagaaacacaagtctttacttccagagagtttccgtaaaacactttctctacagcttaaaaactctgttgctaaaggtaagctcgtgaagatcagagcctcttacaagctctcagataccaccaagatgataacgaggcagcaggacaagaagaataagaagaatatgaagcaagaagataaagagatcacaaagaggactaggtcttcttcgacaaggcctaagaagactgtgtctgtgaacaaacaagaaaagaagaggaaagtgaagaaggcgagacagcctaagtctatcaaatcttcagttggtaagaagaaggccatgaaagcttccgctgcttga

SEQ ID NO: 954 - protein, 167 aa, Arabidopsis thaliana
MAEDKILKKTPAAKKPRKPKTTTHPPYFQMIKEALMVLKEKNGSSPYAIAKKIEEKHKSLLPESFRKTLSLQLKNSVAKGKLVKIRASYKLSDTTKMITRQQDKKNKKNMKQEDKEITKRTRSSSTRPKKTVSVNKQEKKRKVKKARQPKSIKSSVGKKKAMKASAA

SEQ ID NO: 955 - DNA, 1077 bp, Arabidopsis thaliana
atggtgatgagaagtgtggatctacgatcagataccgttactagaccgacagatgcgatgcgagaagcaatgtgtaacgcagaggtggatgatgacgtcctcggatatgacccaacggctagacgtcttgaagaggagatggctaagatgatggggaaagaggctgctctgttcgtgccatccgggacaatggggaatctgatcagcgtgatggttcactgcgacgtgagaggcagcgaggtgattcttggcgacaattgtcacatccatgtttacgagaatggagggatatcgactatcgggggagtgcatcctaagacagtcaagaatgaagaagacgggaccatggacttggaggccattgaagcagctattagagatcctaaaggaagcacgttttatccatcaacaaggttgatttgcttggagaacacacatgccaactctggtgggagatgtttgagcgtggaatacactgagaaagttggagagattgcgaagagacatggcgtgaagctccatatcgacggagcccgtcttttcaatgcttccattgcacttggagttccagtccataagcttgttaaggctgcggactccgttcaggtgtgtctctctaaaggtcttggagctccggtaggatctgtaatcgttggttcgcaaagcttcatagagaaggcgaaaacggttaggaaaacattaggtggaggaatgagacaaataggtgttctgtgcgcagccgctttggtcgcactccaagaaaacctcccaaagctacaacatgaccacaagaaggctaagttgttagctgaagggttgaatcaaatgaaagggattagagtaaatgttgcagccgtggagaccaacatgattttcatggatatggaggatggttcaagacttacggctgagaaactgcggaagaatctagaggagaatggcattctccttatccggggaaactcatcccggatcagaatagttatacaccaccagataacaacaagtgatgtgcattacacattgtcttgctttcagcaagcaatgctaacgatgcaggaaccaagccgaacctaa

SEQ ID NO: 956 - protein, 358 aa, Arabidopsis thaliana
MVMRSVDLRSDTVTRPTDAMREAMCNAEVDDDVLGYDPTARRLEEEMAKMMGKEAALFVPSGTMGNLISVMVHCDVRGSEVILGDNCHIHVYENGGISTIGGVHPKTVKNEEDGTMDLEAIEAAIRDPKGSTFYPSTRLICLENTHANSGGRCLSVEYTEKVGEIAKRHGVKLHIDGARLFNASIALGVPVHKLVKAADSVQVCLSKGLGAPVGSVIVGSQSFIEKAKTVRKTLGGGMRQIGVLCAAALVALQENLPKLQHDHKKAKLLAEGLNQMKGIRVNVAAVETNMIFMDMEDGSRLTAEKLRKNLEENGILLIRGNSSRIRIVIHHQITTSDVHYTLSCFQQAMLTMQEPSRT

SEQ ID NO: 957 - DNA, 1233 bp, Arabidopsis thaliana
atgatttgcgctgcgattgcggcgttaaacgaaccggatggttcgagcaagatggcaatttcgagatacatcgagagatgttacaccggtttaacttctgctcatgctgctttgttgactcaccatctcaagactttgaagaccagtggtgttctttctatggttaagaaatcttacaaaattgctggttcttctactcctcctgctagtgtagctgttgctgctgctgccgccgctcaaggtctcgatgttcccagatctgagattctccattcaagtaacaacgatcccatggcttctggctctgcttctcagcctctgaaacgaggtcgtggtcgtcctcctaagcctaaacctgaatctcaaccacaaccactacagcaacttccaccgaccaatcaagtccaggctaacggacagccaatctgggaacagcagcaagttcaatcacctgttccggttccgactccggttacagagtcggcgaagagaggacctggtcgtccaaggaagaacggttctgctgctcctgctactgcaccaatcgttcaagcttcggttatggctggaattatgaaacgtagaggtagaccaccgggtcgtcgagctgctgggagacagaggaagcccaaatccgtttcttctactgcctctgtgtatccttatgttgctaatggtgctagacgcagaggaaggcctaggagagttgttgaccctagcagtattgttagtgttgctccagtaggtggtgaaaatgtggcagcggttgcgccagggatgaagcgtggacgtggacgaccacctaagattggtggtgttatcagtaggcttattatgaagcctaagagaggacgaggacgtcctgtaggtagacccagaaagattggaacatcagtcacgactgggacacaagattctggagaactcaagaagaagtttgatatttttcaagagaaagtgaaagaaattgtgaaggtgttgaaggatggagttacaagtgagaatcaagcagtggtgcaagccataaaagatctggaagcactaacagtgacggagaccgttgagccacaagttatggaagaagtgcagccagaggagactgcagcaccacagactgaagctcaacaaactgaagctgctgagacacaaggaggacaagaagaaggacaagaaagagaaggagaaacacagacccagacagaagcagaggcaatgcaagaagctctgttctga

SEQ ID NO: 958 - protein, 410 aa, Arabidopsis thaliana
MICAAIAALNEPDGSSKMAISRYIERCYTGLTSAHAALLTHHLKTLKTSGVLSMVKKSYKIAGSSTPPASVAVAAAAAAQGLDVPRSEILHSSNNDPMASGSASQPLKRGRGRPPKPKPESQPQPLQQLPPTNQVQANGQPIWEQQQVQSPVPVPTPVTESAKRGPGRPRKNGSAAPATAPIVQASVMAGIMKRRGRPPGRRAAGRQRKPKSVSSTASVYPYVANGARRRGRPRRVVDPSSIVSVAPVGGENVAAVAPGMKRGRGRPPKIGGVISRLIMKPKRGRGRPVGRPRKIGTSVTTGTQDSGELKKKFDIFQEKVKEIVKVLKDGVTSENQAVVQAIKDLEALTVTETVEPQVMEEVQPEETAAPQTEAQQTEAAETQGGQEEGQEREGETQTQTEAEAMQEALF

SEQ ID NO: 959 - DNA, 2373 bp, Arabidopsis thaliana
atgacggaatctatctggttaaacgatcaatcttctcctcggtcgatgataccttcagcaaaaccagtggctaatgtccatcgccagaggtgtaggagtgtcttcaagttactagtccagagggaaatttcaccaaacacaaagtttgttccaagaaaacggtggggtgaaagccgatgtgatgctgattcgtcgtgtggaaccactagcgaaccagtgagagagcagggacttaatcttatttcttgggttgaggcagagtcattgcagcatttatctgctaaatactgtcctcttgtacctcctccaaggtcaacgattgcagcagcttttagttcagatggaagaactcttgcttctacacatggtgaccacactgtaaaaattattgattgtgagacaggaaaatgcttaaaaatattgactggccatcgaaggacaccctgggtggtcagatttcacccgcgccactcagaaatagttgctagtggaagtttagatcatgaggtgcgcttatggaatgcaaaaactggggagtgtatcagaactcatgatttctatcgacctattgcttccattgctttccacgctggaggtgaattacttgctgttgcatctggtcataagttgcacatatggcattataataagggaggggatgactcggcaccagcaattgtgttgaagacaaggcggtccctgagagctgtacactttcatccacatggggttcctcttctcttgactgctgaggtgactgacattgattcatcagattccgcaatgacaagatcaacatctccaggttatttgcgatatccgccccctgctattttcttcaccaacacacaaagtggcagtcgtaccagtttggcagccgaactgccacttgtgccattaccgtatttgctcttgccttcatattctgcggatgatccaagaatactatattctagtggtactactggtccaaggaatgcacaaacaaggtttcagagtaatcaaagttctgtagaacatggcagcagaacaatttcgccttctcctcttcccatggctacgtctgctgatctttctggttcctatcatgtcccagacaactctgctagtaatacatttgctacccaagcaggagctagaaattctactactgcagttgatgccatggatgtagatgaagctcaacctgttggaagaaatagagttcccagtcaagtttcaagtcaaccagatttactggagtttggacaacttcagcagttatttcactttagagacagaggttcctgggagctaccttttctacaagggtggttgatggctcaaagccaagctggtgctaattcagtggctcttcctactggtagtagtggtcacgtcaactcaactccttatatgggttcttcttcagcatctcattcatccacagccagtctagaggctggagtagcgtcattagaaattcctggtggtgttaacttatatggggtttctgcaagaggtgactcccgggaccgaattctacagtcccgcttcgcaggatctggtttagcagaaggtcgttcctctcgtaacactcaacatgaaggagctgatgctcaacctgtggtaaacagaatcccttctgaactggctagttcaattgctgctgcagagttgccttgtactgtcaaactgagagtgtggtcacatgacatcaaagacccatgttcaatactgaagtctgacaaatgtcgattaacaatacatcatgctgttctttgcagtgagatgggagcccatttttctccatgtgggagatatttagcagcctgtgttgcatgcgttattcctcatgctgagacagatccaagtttgcagacactggtccaacaagactcagggcttgcaacttcccctactcgacatcctgtcacagcacatcaagtcatgtatgaacttcgtgtgtattctctggaaaaagaatcatttggttcggtacttgtgtcccgggcaattagggctgcacattgcttaacctctatccagttctcaccaacctccgagcacattctgcttgcatatggtcgtcgtcatggttctcttttgaagagcattgtgagtgatggagaaacaacatcacattttttcacagttttggagatttacagagtttcagatatggaactggtgagagtacttccaagctcagaggatgaagttaatgttgcttgctttcatccttctcctgggggaggtcttgtctatggaacaaaggagggaaaactaaggatcttccggtacaacacagctgctgcgtccaatctcactgcaccaaatagctctcccgatgagaacttggccgaggtgcagacctatgcgttagaatgctag

SEQ ID NO: 960 - protein, 790 aa, Arabidopsis thaliana
MTESIWLNDQSSPRSMIPSAKPVANVHRQRCRSVFKLLVQREISPNTKFVPRKRWGESRCDADSSCGTTSEPVREQGLNLISWVEAESLQHLSAKYCPLVPPPRSTIAAAFSSDGRTLASTHGDHTVKIIDCETGKCLKILTGHRRTPWVVRFHPRHSEIVASGSLDHEVRLWNAKTGECIRTHDFYRPIASIAFHAGGELLAVASGHKLHIWHYNKGGDDSAPAIVLKTRRSLRAVHFHPHGVPLLLTAEVTDIDSSDSAMTRSTSPGYLRYPPPAIFFTNTQSGSRTSLAAELPLVPLPYLLLPSYSADDPRILYSSGTTGPRNAQTRFQSNQSSVEHGSRTISPSPLPMATSADLSGSYHVPDNSASNTFATQAGARNSTTAVDAMDVDEAQPVGRNRVPSQVSSQPDLLEFGQLQQLFHFRDRGSWELPFLQGWLMAQSQAGANSVALPTGSSGHVNSTPYMGSSSASHSSTASLEAGVASLEIPGGVNLYGVSARGDSRDRILQSRFAGSGLAEGRSSRNTQHEGADAQPVVNRIPSELASSIAAAELPCTVKLRVWSHDIKDPCSILKSDKCRLTIHHAVLCSEMGAHFSPCGRYLAACVACVIPHAETDPSLQTLVQQDSGLATSPTRHPVTAHQVMYELRVYSLEKESFGSVLVSRAIRAAHCLTSIQFSPTSEHILLAYGRRHGSLLKSIVSDGETTSHFFTVLEIYRVSDMELVRVLPSSEDEVNVACFHPSPGGGLVYGTKEGKLRIFRYNTAAASNLTAPNSSPDENLAEVQTYALEC

SEQ ID NO: 961 - DNA, 630 bp, Arabidopsis thaliana
atggagaatgggaaaagagacagacaagacatggaagtgaataccacaccgaggaagcctcgtgtactactcgctgcaagtggaagcgtcgctgctatcaaattcggcaatctctgccattgcttcaccgaatgggcagaagtcagagccgtcgttacgaaatcatctctacatttcctcgataaactctctctcccacaagaagtgactctgtatactgatgaagatgaatggtctagctggaacaagatcggtgatcctgtccttcacatcgagcttagacgttgggctgatgttttagtcattgctcctttgtctgctaacaccttaggcaagattgctggtgggctttgtgataatcttctgacttgcattatacgagcttgggactataccaaaccactgtttgttgctccagctatgaatactttgatgtggaacaatcctttcactgaaaggcatcttttgtctcttgatgaactgggaatcacacttattcctcctatcaagaagagacttgcctgtggagactacggtaatggagctatggctgagccctctcttatctattccactgtcagactcttctgggagtctcaggctcatcagcaaaccggtggaactagttaa

SEQ ID NO: 962 - protein, 209 aa, Arabidopsis thaliana
MENGKRDRQDMEVNTTPRKPRVLLAASGSVAAIKFGNLCHCFTEWAEVRAVVTKSSLHFLDKLSLPQEVTLYTDEDEWSSWNKIGDPVLHIELRRWADVLVIAPLSANTLGKIAGGLCDNLLTCIIRAWDYTKPLFVAPAMNTLMWNNPFTERHLLSLDELGITLIPPIKKRLACGDYGNGAMAEPSLIYSTVRLFWESQAHQQTGGTS

SEQ ID NO: 963 - DNA, 918 bp, Arabidopsis thaliana
atggcttctaattaccgttttgccatcttcctcactctctttttcgccaccgctggtttctccgccgccgcgttggtcgaggagcagccgcttgttatgaaataccacaacggagttctgttgaaaggtaacatcacagtcaatctcgtatggtacgggaaattcacaccgatccaacggtccgtaatcgtcgatttcatccactcgctaaactccaaagacgttgcatcttccgccgcagttccttccgttgcttcgtggtggaagacgacggagaaatacaaaggtggctcttcaacactcgtcgtcgggaaacagcttctactcgagaactatcctctcggaaaatctctcaaaaatccttacctccgtgctttatccaccaaacttaacggcggtctccgttccataaccgtcgttctaacggcgaaagatgttaccgtcgaaagattctgtatgagccggtgcgggactcacggatcctccggttcgaatccccgtcgcgcagctaacggcgcggcttacgtatgggtcgggaactccgagacgcagtgccctggatattgcgcgtggccgtttcaccagccgatttacggaccacaaacgccgccgttagtagcgcctaacggtgacgttggagttgacggaatgattataaaccttgccacacttctagctaacaccgtgacgaatccgtttaataacggatattaccaaggcccaccaactgcaccgcttgaagctgtgtctgcttgtcctggtatattcgggtcaggttcttatccgggttacgcgggtcgggtacttgttgacaaaacaaccgggtctagttacaacgctcgtggactcgccggtaggaaatatctattgccggcgatgtgggatccgcagagttcgacgtgcaagactctggtttga

SEQ ID NO: 964 - protein, 305 aa, Arabidopsis thaliana
MASNYRFAIFLTLFFATAGFSAAALVEEQPLVMKYHNGVLLKGNITVNLVWYGKFTPIQRSVIVDFIHSLNSKDVASSAAVPSVASWWKTTEKYKGGSSTLVVGKQLLLENYPLGKSLKNPYLRALSTKLNGGLRSITVVLTAKDVTVERFCMSRCGTHGSSGSNPRRAANGAAYVWVGNSETQCPGYCAWPFHQPIYGPQTPPLVAPNGDVGVDGMIINLATLLANTVTNPFNNGYYQGPPTAPLEAVSACPGIFGSGSYPGYAGRVLVDKTTGSSYNARGLAGRKYLLPAMWDPQSSTCKTLV

SEQ ID NO: 965 - DNA, 3438 bp, Arabidopsis thaliana
atggcggcatcaacttcaacccgattccttgttctgctcaaagatttttctgccttcagaaagatatcatggacttgtgctgcaactaattttcaccgccaatctcgttttttatgccatgttgcgaaagaagacgggtctcttactcttgcaagccttgatttggggaacaaaccacggaaatttgggaagggtaaggcgatgaagcttgagggaagttttgttactgaaatgggtcaaggtaaggtaagagcggtaaagaacgataaaatgaaagttgtcaaggaaaaaaagccagctgagatagtgtctcctttgttttctgcaaaatcctttgaggagcttggcctcccggattccttgttagacagtttggaaagagaaggtttctctgtcccaacagatgtccaatcagcagctgtcccggcaataatcaaaggtcacgatgcagtgattcagtcttacacaggatctggcaaaacattagcttatctgcttccaatattgtccgaaattggtcctctagcagaaaaatctagaagttcgcacagtgaaaatgataagaggactgagattcaggcaatgatcgtggctccatcaagagaactcggtatgcagatagtaagagaggtagagaaactgctcggacctgttcaccgtagaatggttcagcagttggtaggaggtgcaaaccgaatgaggcaagaagaggcccttaagaaaaataaacctgcaattgttgttggcactcccgggagaattgcagagataagcaaaggtggaaaattgcacactcatgggtgtagattcttggtgctagacgaagtcgatgagcttttatcgtttaatttccgagaagatatccatcgaatactagaacatgtaggaaagagatctggggctggtcctaaaggagaagtcgatgaacgggctaaccggcagaccattctagtctctgcaactgtgccattctcggttatccgagcagctaaaagctggagtcacgagccggttcttgtccaagccaacaaagtcactcctcttgataccgttcaaccatctgcaccggtaatgagcttgactcccacaacttctgaagctgatggccagattcagactactattcagagcttacctccagctttaaaacactattactgcatctcaaagcatcaacacaaagtcgacacgttaaggagatgcgttcacgccctcgatgcccaatcggttatagctttcatgaaccactcaaggcagctcaaagatgtggtctacaaactcgaagctcgtggtatgaattcagctgagatgcacggagatctcgggaagctagggagatcaacagttctaaagaagttcaagaacggggaaatcaaggtacttgtgacaaacgagctctctgcccggggtctggatgttgcggaatgtgatctggtggtgaatcttgagcttccaactgatgcggttcactatgctcatcgagctgggagaacagggaggctgggaaggaaagggacggtggtaacagtgtgcgaggaatcacaagtgtttatagtgaagaagatggagaagcagcttggtttgcctttcttgtattgtgagtttgttgatggagagcttgttgtcactgaggaagataaagctattataagcgatagaaatctctcttatagagacaaattgagcagtgggcttgtcggtattaaggcagatgatgctgttgatctgttccgagacatgattcagtctcgtcctcttcccactgttatagatttcaatagattgtttagtgccattgccaaaacgaaacagtatgagctagtgttagctctctgcaagcaaatggaatcgaagggaattgcacatagcatctacactttgagtattatgatcaattgtttctgtcgctgtcgtaaactttcttacgctttttctactatggggaagatcatgaaacttgggtatgagcctgatacagtcatctttaacactctactcaatggcttatgtctcgagtgtagagtttctgaagctctggaattagttgatcgaatggtagaaatgggacataaacccactctcataacgcttaacactctggtcaatggcctttgtctcaacggtaaagtctctgatgctgtggttttgattgatcgaatggttgagactggctttcaacccaatgaagtaacttatggaccggttttaaatgtaatgtgtaagtccggccaaactgcccttgccatggagttgctcagaaagatggaagaaagaaatatcaagctcgatgcagtcaaatacagtatcatcattgatggtctttgcaaagatgggagcctcgacaatgcattcaaccttttcaatgaaatggaaatcaaagggttcaaagctgatattattacctacaacactctcattggaggcttttgtaatgctggtagatgggatgatggtgccaagttattgagggatatgatcaagaggaaaatcagccccaacgttgtcacattcagtgttttgattgatagttttgtgaaagagggaaaactacgagaggccgatcaactgctcaaggagatgatgcaacgaggtatagctcctaatactattacatataattccttgatagatgggttttgcaaggagaaccgcctagaggaggccatccagatggtggatctgatgattagcaagggatgcgatcctgatatcatgacgtttaatatcctcataaatggatattgtaaggctaatcggattgacgatggtttggaactcttccgcgaaatgtctctgagaggagtgattgctaatacagttacttataacactcttgtccaagggttttgtcaatcgggaaaacttgaggttgccaaaaaactcttccaagagatggtttctcggcgtgttcgtcctgatattgtgtcctacaaaatattgctggatgggttgtgtgacaatggagaactagagaaagcattggaaatatttggaaaaatagagaagagtaagatggagcttgatattggtatatatatgatcattatccatgggatgtgcaatgctagtaaggtggatgatgcttgggatttattctgtagcctccctctcaaaggagtgaagcttgatgctagggcatacaacataatgatttcagaattatgtaggaaagactcactgtctaaagcagacatactgttcagaaaaatgacagaggaaggacatgctccagatgagttgacatacaacatacttatcagggcacatcttggtgatgatgatgcaaccacagcagctgaacttattgaagaaatgaagagtagtgggttcccagcagatgtttccactgttaagatggttattaatatgctttctagtggtgaattggacaaaagctttctagatatgctttctacaactcgggcttcattgaaatga

SEQ ID NO: 966 - protein, 1145 aa, Arabidopsis thaliana
MAASTSTRFLVLLKDFSAFRKISWTCAATNFHRQSRFLCHVAKEDGSLTLASLDLGNKPRKFGKGKAMKLEGSFVTEMGQGKVRAVKNDKMKVVKEKKPAEIVSPLFSAKSFEELGLPDSLLDSLEREGFSVPTDVQSAAVPAIIKGHDAVIQSYTGSGKTLAYLLPILSEIGPLAEKSRSSHSENDKRTEIQAMIVAPSRELGMQIVREVEKLLGPVHRRMVQQLVGGANRMRQEEALKKNKPAIVVGTPGRIAEISKGGKLHTHGCRFLVLDEVDELLSFNFREDIHRILEHVGKRSGAGPKGEVDERANRQTILVSATVPFSVIRAAKSWSHEPVLVQANKVTPLDTVQPSAPVMSLTPTTSEADGQIQTTIQSLPPALKHYYCISKHQHKVDTLRRCVHALDAQSVIAFMNHSRQLKDVVYKLEARGMNSAEMHGDLGKLGRSTVLKKFKNGEIKVLVTNELSARGLDVAECDLVVNLELPTDAVHYAHRAGRTGRLGRKGTVVTVCEESQVFIVKKMEKQLGLPFLYCEFVDGELVVTEEDKAIISDRNLSYRDKLSSGLVGIKADDAVDLFRDMIQSRPLPTVIDFNRLFSAIAKTKQYELVLALCKQMESKGIAHSIYTLSIMINCFCRCRKLSYAFSTMGKIMKLGYEPDTVIFNTLLNGLCLECRVSEALELVDRMVEMGHKPTLITLNTLVNGLCLNGKVSDAVVLIDRMVETGFQPNEVTYGPVLNVMCKSGQTALAMELLRKMEERNIKLDAVKYSIIIDGLCKDGSLDNAFNLFNEMEIKGFKADIITYNTLIGGFCNAGRWDDGAKLLRDMIKRKISPNVVTFSVLIDSFVKEGKLREADQLLKEMMQRGIAPNTITYNSLIDGFCKENRLEEAIQMVDLMISKGCDPDIMTFNILINGYCKANRIDDGLELFREMSLRGVIANTVTYNTLVQGFCQSGKLEVAKKLFQEMVSRRVRPDIVSYKILLDGLCDNGELEKALEIFGKIEKSKMELDIGIYMIIIHGMCNASKVDDAWDLFCSLPLKGVKLDARAYNIMISELCRKDSLSKADILFRKMTEEGHAPDELTYNILIRAHLGDDDATTAAELIEEMKSSGFPADVSTVKMVINMLSSGELDKSFLDMLSTTRASLK

SEQ ID NO: 967 - DNA, 1041 bp, Arabidopsis thaliana
atgacggactcttacggcgccgtctccgtcgacgttggaacaatctatcttggtggcaaggagcatcgtgttaaaactgctagtggtgttgtgtctgtcattgtctatggagacagagaaaagccagcattgattacttatcctgatttagccctaaaccatatgtcatgcttccaagggttattcttctgtcctgaagcagcttcattgctgcttcataacttctgcatttaccatatcagtccacctgggcatgagttaggagctgctccaatttgtcctaatgattcagtcccttctgctgaaaacttggcagatcagatccttgaagttctcaactttttcggccttggtgttgtgatgtgtatgggagtgactgcaggtgcttatatcctcaccttattcgcgatgaaacatagagaacgggttcttggtttgattcttgtctcaccgttatgcaaggcgccgtcttggtctgaatggttttacaacaaggttatcacaaacttgttatattattacggaatgtgtggagtggtaaaggaatttttgcttcagagatattttagtaaggaagtccgtggtaacgttgagattccagagtcagatatagcacaagcttgcagaagactgcttgatgaaagacaaggcataaacgttttgcgatttcttgacgccattgaccggagacctgacatctcaagtggattgaagaaactaaaatgcaggacacttatcttcatcggagatcaatctcctttctactcagaagctgttcacatggcagcaactttggatagaggatactgtgctttggttgaggttcaggcttgtggttcaatggtaacagaggagcaaccacatgcaatgttgatcccaatggaatatttcttgatgggttacggattatacagaccatctcttttctccgagagccctagaagtccacttagcccttcttgtatttcacctgagcttctctctcctgaaagcatgggattaaagcttaagcctatcaaaaccagaatttcggcggcttaa

SEQ ID NO: 968 - protein, 346 aa, Arabidopsis thaliana
MTDSYGAVSVDVGTIYLGGKEHRVKTASGVVSVIVYGDREKPALITYPDLALNHMSCFQGLFFCPEAASLLLHNFCIYHISPPGHELGAAPICPNDSVPSAENLADQILEVLNFFGLGVVMCMGVTAGAYILTLFAMKHRERVLGLILVSPLCKAPSWSEWFYNKVITNLLYYYGMCGVVKEFLLQRYFSKEVRGNVEIPESDIAQACRRLLDERQGINVLRFLDAIDRRPDISSGLKKLKCRTLIFIGDQSPFYSEAVHMAATLDRGYCALVEVQACGSMVTEEQPHAMLIPMEYFLMGYGLYRPSLFSESPRSPLSPSCISPELLSPESMGLKLKPIKTRISAA

SEQ ID NO: 969 - DNA, 354 bp, Arabidopsis thaliana
atgatgatgaagtcgttgatctgtctctctctcatcctcctcccacttgtctccgtcgtggaaggtctcggtggtggtggtggtcttggtagccggaagccgatcaagaatgtatctgatccggatgttgttgcggtcgccaagtatgccatcgaggaacataacaaggagtcgaaggagaagttggttttcgtcaaggttgtggagggaacgacgcaagtggtctccggtacaaagtacgatctgaaaattgcggcgaaggatggtggtggtaagatcaagaactatgaggctgttgttgttgaaaagctttggcttcattctaagagccttgagtctttcaaggcgttatag

SEQ ID NO: 970 - protein, 117 aa, Arabidopsis thaliana
MMMKSLICLSLILLPLVSVVEGLGGGGGLGSRKPIKNVSDPDVVAVAKYAIEEHNKESKEKLVFVKVVEGTTQVVSGTKYDLKIAAKDGGGKIKNYEAVVVEKLWLHSKSLESFKAL

SEQ ID NO: 971 - DNA, 750 bp, Arabidopsis thaliana
atgagtagcattggaactgggtacgatctctccgtcaccactttctctcccgatggccgtgttttccagatcgagtacgccgctaaagctgtcgacaacagtgggactgttgttggaatcaagtgcaaagatgggattgttatgggagttgagaaacttattgcatcaaagatgatgctaccaggttccaacaggagaatccattctgttcatcgtcatgctggcatggctgttgctgggcttgcagctgatgggaggcaaattgttgcgcgtgctaagtctgaagcacgaagctatgagagtgtttatggcgatgctgtacctgtgaaggaactttctgagcgtgttgcaagttatgtacatctgtgtaccctgtattggtggctcaggccttttggctgtggggttattcttggaggttatgatagagatggacctcaattgtacatgattgaaccatcaggcatatcatatagatactttggtgcggccattggcaaaggaaagcaagctgccaaaacggaaattgagaaattaaatttatctgagatgacatgcaaagaaggcgttatcgaggtggcgaaaatcatctacaagctacacgatgaagccaaggacaaggcttttgaattggagatgagctggatatgcgaggagtcaaaacgagagcatcagaaggtccctgatgatcttctggaagaagcaaagacggcagctaaaactgcgctcgaggagatggatgctgactaa

SEQ ID NO: 972 - protein, 249 aa, Arabidopsis thaliana
MSSIGTGYDLSVTTFSPDGRVFQIEYAAKAVDNSGTVVGIKCKDGIVMGVEKLIASKMMLPGSNRRIHSVHRHAGMAVAGLAADGRQIVARAKSEARSYESVYGDAVPVKELSERVASYVHLCTLYWWLRPFGCGVILGGYDRDGPQLYMIEPSGISYRYFGAAIGKGKQAAKTEIEKLNLSEMTCKEGVIEVAKIIYKLHDEAKDKAFELEMSWICEESKREHQKVPDDLLEEAKTAAKTALEEMDAD

SEQ ID NO: 973 - DNA, 1170 bp, Arabidopsis thaliana
atggcggataacaccgataatcggagatccttatggggagttccggagaagcttcagcttcacatagcgatgctgacgttgcaattcggttacgccggattccacgtggtgtctcgagctgctcttaacatgggaatcagcaaactcgtcttccctgtttatcgtaacatcatcgccttgcttcttctccttcccttcgcttacttccttgaaaagaaggagagaccagcgattactctcaactttctcatccagttcttctttttggcactcataggaataacagcgaaccaaggattttacttgttgggactggacaacacttcaccaacatttgcttcctccatgcaaaactctgttcccgccattacctttctcatggctgctcttctcaggattgagaaagtaagaataaacagaagagacggtatctccaaaatcttaggaacagctctttgtgtcgccggagcttccgtcatcaccctctataaaggtccaaccatctacactccggctagccacctccacgctcatctactcaccacaaactccgccgtcttagcgccgctaggaaacgccgcgcctaaaaactggacccttggttgcatctacctaatcggtcactgtctctcgtggtcaggctggcttgttttccaagctccggttcttaagtcttatccagcgaggctctcggttacgtcttacacttgtttcttcggaatcattcagttcttgatcattgctgctttctgtgaaagagattctcaggcttgggtttttcactccggttgggagcttttcaccatcctctacgccggaatcgtagcgtctggaatcgcgtttgcggttcagatttggtgtattgacagagggggtccagtcttcgttgctgtttaccagcctgttcagactcttgtcgttgcgatcatggcttctattgcgttaggcgaagaattttatttgggcgggattattggagcggtcttgatcatagcgggactttacttcgtattgtacggtaagagcgaagagaggaaatttgcagcgcttgagaaggcagcgatccagtcctccgcggagcatggtattgaacgtgcacctgtttctcgcaactccatcaagtcgtccatcacaacaccactactccatcagtcaacggacaatgtttga

SEQ ID NO: 974 - protein, 389 aa, Arabidopsis thaliana
MADNTDNRRSLWGVPEKLQLHIAMLTLQFGYAGFHVVSRAALNMGISKLVFPVYRNIIALLLLLPFAYFLEKKERPAITLNFLIQFFFLALIGITANQGFYLLGLDNTSPTFASSMQNSVPAITFLMAALLRIEKVRINRRDGISKILGTALCVAGASVITLYKGPTIYTPASHLHAHLLTTNSAVLAPLGNAAPKNWTLGCIYLIGHCLSWSGWLVFQAPVLKSYPARLSVTSYTCFFGIIQFLIIAAFCERDSQAWVFHSGWELFTILYAGIVASGIAFAVQIWCIDRGGPVFVAVYQPVQTLVVAIMASIALGEEFYLGGIIGAVLIIAGLYFVLYGKSEERKFAALEKAAIQSSAEHGIERAPVSRNSIKSSITTPLLHQSTDNV

SEQ ID NO: 975 - DNA, 1092 bp, Arabidopsis thaliana
atgtcttctgctactgcgacttataactacgatgtttttctgagtttcagaggacccgacactcgccgcaagttcatcagctttctctacaaagaacttgttggaagggacattcgaacctttaaagacgacaaagagctagagaatggccagatgatttctccggagctcatactcgccatcgaggattcgagatttgccgtcgttgttgtctccgtgaactacgctgcgtcttcttggtgtctcgatgagctcgtaaagatcatggatatccagaagaacaagggttccatcaccgtgatgcctatcttctacggcgtgaatccgtgtcatttgaggaggcaaatcggagatgtcgctgaacagtttaagaagcacgaggcaagagaaaaagatcttgagaaagtgcttaaatggaggcaagcgttggccgctttggcagatatctccggcgattgttcaggggaagatgactcgaagctggtggacgtaatcgctgacaagatatcaaaagagctgatgatagttacaagaataagcaatgggaggaacctagttgggattgataaacacatgaacgaacttaaccgattgatggatttgaattccaacaaaggtaagagaatggttgggatttgggcaagaggaggaagttgtagatcggctctagctaaatatgtttatcagacatcctgtcaacactttgatagccattgttttcttggaaacgtgaaacggatttgtcagggtaactactttgaaagccatctacacaaagagtttctggataatattcaaggagaaaactctagcaaacaaagtctcaagaagcaaaaggttctgcttgtggcagacgacgtcgataagcttgaacagttagatgctcttgcaggggatttcagcggttttggtccggggagtgttgttatcatcactacaaaagataagcagttgttgatttcttatggtatacagcttgtctacgaagctgagtttttgacattccagaaattttgtcgtagcttccgatcattggcctttaaaaagagagacgacatttctgctgcgttcgagtgggctttgtatatataa

SEQ ID NO: 976 - protein, 363 aa, Arabidopsis thaliana
MSSATATYNYDVFLSFRGPDTRRKFISFLYKELVGRDIRTFKDDKELENGQMISPELILAIEDSRFAVVVVSVNYAASSWCLDELVKIMDIQKNKGSITVMPIFYGVNPCHLRRQIGDVAEQFKKHEAREKDLEKVLKWRQALAALADISGDCSGEDDSKLVDVIADKISKELMIVTRISNGRNLVGIDKHMNELNRLMDLNSNKGKRMVGIWARGGSCRSALAKYVYQTSCQHFDSHCFLGNVKRICQGNYFESHLHKEFLDNIQGENSSKQSLKKQKVLLVADDVDKLEQLDALAGDFSGFGPGSVVIITTKDKQLLISYGIQLVYEAEFLTFQKFCRSFRSLAFKKRDDISAAFEWALYI

SEQ ID NO: 977 - DNA, 1209 bp, Arabidopsis thaliana
atggataggcctagacaaaatgatcatttgggtgtgaataggattgggaaaaatatcagaaagagtcctcttcatcaatcgactttcgctgccagtactagcaacggtgccgctccaaggcttcaaacacagcctcaggtttataacataagcaagaacgactttagaagtattgttcagcagctaacgggttctccatcacgtgaaagccttcctcggcctcctcagaacaactcgctaaggcctcagaatacacggttgcagcggatcagaccatcccccttaacgcagttaaaccggcctgcggttcctctcccttccatggctccgccacagtctcatcctcagtttgctagacagcctccacaccagccacctttcccacaaaccacacaacaaccaatgatgggtcacagggaccagttttggtctaatacagctgagtctcccgtctcagagtatatgcgttatcttcaaagttcacttggagattcaggacccaatgctaaccaaatgcagccaggtcatgagcagcggccttatatcccaggtcatgagcaacggccatatgtgccaggtaatgagcagcagccatatatgccaggtaatgagcagcggccatatatcccaggtcatgagcagcggtcatatatgccagctcaatctcagtctcagtctcaacctcaacctcaacctcaacctcagcaacatatgatgcctggaccgcaacctcgaatgaacatgcagggccctcttcaacctaaccagtatctaccaccacccgggttagttcctagcccagtgcctcataatcttccttctcctcggttcaatgctcctgtacctgtgacgcctactcagccctctcccatgttcagtcagatgtatggtggatttccttctcctcgatataacggttttggaccactgcagtcacctacatcccaatttcttcaaccatctcctaccggttacccgaatatgttctctccgagatcgccttacccattgctgtcaccaggagttcagtatcctcaaccacttaccccaaacttctcattttcacaaattgctcaacaaggaagtcttggacccggtgcaggtccaagtcaaggtcctcctcagcctcctccttctccagggctcatgttcccgttatctccatccgggttcttccccatgccaagtccaagatggaatgattactag

SEQ ID NO: 978 - protein, 402 aa, Arabidopsis thaliana
MDRPRQNDHLGVNRIGKNIRKSPLHQSTFAASTSNGAAPRLQTQPQVYNISKNDFRSIVQQLTGSPSRESLPRPPQNNSLRPQNTRLQRIRPSPLTQLNRPAVPLPSMAPPQSHPQFARQPPHQPPFPQTTQQPMMGHRDQFWSNTAESPVSEYMRYLQSSLGDSGPNANQMQPGHEQRPYIPGHEQRPYVPGNEQQPYMPGNEQRPYIPGHEQRSYMPAQSQSQSQPQPQPQPQQHMMPGPQPRMNMQGPLQPNQYLPPPGLVPSPVPHNLPSPRFNAPVPVTPTQPSPMFSQMYGGFPSPRYNGFGPLQSPTSQFLQPSPTGYPNMFSPRSPYPLLSPGVQYPQPLTPNFSFSQIAQQGSLGPGAGPSQGPPQPPPSPGLMFPLSPSGFFPMPSPRWNDY

SEQ ID NO: 979 - DNA, 1983 bp, Arabidopsis thaliana
atggaggaagagaaagcttctgctgcacagagcttaatcgatgtagttaacgagattgctgcgatttctgattatcgtataacagtgaagaagctttgttataatctagcgaggagattaaagctgcttgttcctatgtttgaggaaattagagaaagtaacgaaccgatcagcgaagatacgttgaagactttgatgaatttgaaggaagctatgtgttcagcgaaggattatctcaaattttgtagccaagggagcaagatttatctggtgatggagagggaacaagtgacaagtaaattgatggaggtgtctgttaagttagaacaatctttaagccagattccatatgaagaactcgatatatcggatgaagttagagaacaggttgagctggttcttagtcagtttcggcgagctaaaggaagagtagatgtatcagatgatgagctatatgaagatcttcagtcgctttgcaacaaaagtagtgatgtagatgcttatcagcctgtgctagagcgggttgcgaagaagttacatttgatggagattcctgacctagctcaagaatcagtggctctgcatgaaatggttgcttcaagcggtggagatgttggtgaaaatattgaggagatggcaatggtattaaagatgattaaggattttgtgcagacggaggatgataatggcgaggagcagaaagtaggagttaactctagaagcaatggacagacttctacggcagcgagtcagaagatacctgtgattcctgatgattttcgctgtccgatttcgctggaaatgatgagagatccagttattgtttcatcagggcagacatacgaacgcacatgtattgagaaatggatagaaggtggacactcgacatgtccaaaaacacagcaggcgctaacaagcacaaccctcacaccaaactatgttctccgtagtctcatagctcagtggtgcgaggccaacgatattgagcctccaaagcctccgagcagtttaagacccagaaaagtatcgtccttctcatctcccgcagaagcgaacaagattgaagatcttatgtggagacttgcgtacggaaaccccgaggaccaacgatctgcagctggggaaatccgccttcttgcaaaacgaaatgcagacaaccgcgtggccatagccgaagctggagccatacctcttctcgtaggtctcctctcaactcctgattctcgtattcaagaacattcggtaacagctcttctaaacctctccatatgtgagaacaacaaaggagccattgtttcagctggagctattcctggtatagttcaagtgcttaagaaaggaagcatggaggccagagagaatgcggcggctacacttttcagtctatcagtgatcgatgaaaataaagtgactatcggtgccttaggagcaattccgccactcgttgtattacttaatgaaggtacacaaagaggcaagaaagatgctgctactgcactctttaacctctgtatataccaaggaaacaaaggaaaagctatacgtgcaggagtgattcccacgttgactagactcttgacagagcccggaagcggaatggtcgatgaggcactcgcgattttggcgattctctctagccaccccgaaggaaaagcaatcataggatcctctgatgcagtcccaagtttggttgagtttatcagaactggctcgcctagaaacagagaaaacgcagctgctgttctagtccacctctgttctggagacccacaacatcttgtcgaagcgcagaaactcggccttatgggtccattgatagatttagctggaaatgggacggatagagggaaacgaaaagcagcgcagttgcttgaacgcatcagccgtctcgctgaacagcagaaggaaacggctgtgtcacaaccggaagaagaagctgaaccaacacatccagaatccaccacagaagctgcagatacttaa

SEQ ID NO: 980 - protein, 660 aa, Arabidopsis thaliana
MEEEKASAAQSLIDVVNEIAAISDYRITVKKLCYNLARRLKLLVPMFEEIRESNEPISEDTLKTLMNLKEAMCSAKDYLKFCSQGSKIYLVMEREQVTSKLMEVSVKLEQSLSQIPYEELDISDEVREQVELVLSQFRRAKGRVDVSDDELYEDLQSLCNKSSDVDAYQPVLERVAKKLHLMEIPDLAQESVALHEMVASSGGDVGENIEEMAMVLKMIKDFVQTEDDNGEEQKVGVNSRSNGQTSTAASQKIPVIPDDFRCPISLEMMRDPVIVSSGQTYERTCIEKWIEGGHSTCPKTQQALTSTTLTPNYVLRSLIAQWCEANDIEPPKPPSSLRPRKVSSFSSPAEANKIEDLMWRLAYGNPEDQRSAAGEIRLLAKRNADNRVAIAEAGAIPLLVGLLSTPDSRIQEHSVTALLNLSICENNKGAIVSAGAIPGIVQVLKKGSMEARENAAATLFSLSVIDENKVTIGALGAIPPLVVLLNEGTQRGKKDAATALFNLCIYQGNKGKAIRAGVIPTLTRLLTEPGSGMVDEALAILAILSSHPEGKAIIGSSDAVPSLVEFIRTGSPRNRENAAAVLVHLCSGDPQHLVEAQKLGLMGPLIDLAGNGTDRGKRKAAQLLERISRLAEQQKETAVSQPEEEAEPTHPESTTEAADT

SEQ ID NO: 981 - DNA, 1119 bp, Arabidopsis thaliana
atggtgacaggttgtgttgatcttcatcaatctttcaaatctgcagattcatcttctgtgccaattcctcctcctcttccatcaaaatctgatggactcaagaaaaaacttgggcatagcagcgtttcgacagccacaagagatatgtgggatcgtcttttcaatgacggatacaaagctgatgtagtcatctatacagataatggcagtatcatctatgctcatgccaacatccttggaactgcttccactgtgatcaaaggcatgttgaagcaagccaagagacatggcaagtggcatacaatatcaatccgaggtgtccctcatgatgctgtgcgagtttttatccgtttcctctactcttcttgctatgagaaagaagaaatgaacgagtttatcatgcatttgctacttctgtcacacgcgtacgtggttcctcagctgaaacgggtctgtgaatggcatctagaacatggtttgcttaccactgagaatgtggttgatgtgttccagcttgcgctgctgtgtgatttccctcggcttagcctcatatctcaccgtatgatcatgaaacactttaacgaactctctgcgacagaagcatggacagctatgaagaaaagccatccctttcttgagaaagaagttagagactcagtaatcatcgaagcaaatacgcggaaagagaggatgagaaaacgcaatgatcagaggatatattcgcagctatacgaagcaatggaagcacttgttcatatatgcagagatggatgtaaaacaatagggccacacgataaagatttcaaaccgaaccatgcaacgtgtaactatgaagcttgcaagggattagaatcactgatccggcatttcgcaggctgtaagctaagagttccaggaggttgcgtgcattgcaagagaatgtggcaactccttgaactgcattcacgtgtttgcgcaggttctgatcaatgtcgagtccctctatgcagaaaccttaaggagaagatggagaaacagagcaagaaagatgagtcgagatggaaacttctggtgaagaatgtattggggagtaagaaaatcggaggctctcctttctttttaccggtgacaaactgttaa

SEQ ID NO: 982 - protein, 372 aa, Arabidopsis thaliana
MVTGCVDLHQSFKSADSSSVPIPPPLPSKSDGLKKKLGHSSVSTATRDMWDRLFNDGYKADVVIYTDNGSIIYAHANILGTASTVIKGMLKQAKRHGKWHTISIRGVPHDAVRVFIRFLYSSCYEKEEMNEFIMHLLLLSHAYVVPQLKRVCEWHLEHGLLTTENVVDVFQLALLCDFPRLSLISHRMIMKHFNELSATEAWTAMKKSHPFLEKEVRDSVIIEANTRKERMRKRNDQRIYSQLYEAMEALVHICRDGCKTIGPHDKDFKPNHATCNYEACKGLESLIRHFAGCKLRVPGGCVHCKRMWQLLELHSRVCAGSDQCRVPLCRNLKEKMEKQSKKDESRWKLLVKNVLGSKKIGGSPFFLPVTNC

SEQ ID NO: 983 - DNA, 3255 bp, Arabidopsis thaliana
atggcatcggaatcgaaaagctacgctaggagagatcgtcttcttgagattgaggccactgttcgaaagtggtgggaagacgaggatgtattcagagccgaatcttgtgagaatcttccaaaaccaggagaaaagtttttctcaaccttccctttcccgtatatgaatggttatctacacattgggcatgccttttcattgtccaaggttgattttgcttctgcttaccataggctaagaggagctaatgtgcttcttccatttggtttccattgtactggtatgccaattaaggcttctgcggataagcttcgtcgtgagattgaacagtttggtaaccctcctgtgtttactgctgaagacaccaccaaagttcctgaagttcaggaggagagcagtgatactatagctttaccgattccgggtcagttcaagggaaagaagtctaaggttgctgccaaagctggtggacaggtttatcagtgggagattatgcgcagttttggtcttactgacagtgagattgcaaatttccgagagccttctgaatggttgtattactttccccctttggctgttgaagatctaagggcatatggattgggttgtgattggagacgctcgtttgtgaccactgatgttaatccctttttcgatgcctttgtgaggtggcagatgaggaagttgaaatctatgggaaagattgttaaagaccgcaggtacactatattctcacctttagatggccagccttgtgctgatcacgaccgtgctactggggaaggtgttcagcctcaagagtatacactcataaagatggaagtagtcaagccattccctctgaaactgggtcctttggaaggcaagagagtgtttttggctgcagctactttgaggcctgagaccatgtatggacaaacaaacgcatgggtactacctgatgggaaatatggagcttatgaaatcagcgaaactgaggtcttcatccttactgagagagctgcgctcaaccttgcgtaccagaacttttcgaagaaccctcaggagccttcctgcttggttgagttgaccgggtatgatctgattggactccctttgaggtctcctctgtcagtcaacgagatcatctatgctctgcccatgttgaccattctgaccaacaaaggtactggcattgtcaccagtgtgcctagtgatgctcctgatgattacatggctttacaagatttaatcaaaaagcctgctcttcaagataagtatggtgtgaaaacggaatggttgcccactgaaatcataccgatcatcaacattccggaatttggggataaagctgctgaaaaggtctgcttggatctgaaaattaaaagccaaaacgataaggaaaagcttgcagaggctaagaggttgacttacctgaaaggatttaccgaaggaaccatgcttattggagagttttttggtaggaaagttcaagaaattaagcccattatcaagacaaagctcatagagactggcgaggcaatcatatacagtgaacccgagaagccggtgatgtcaagatcgggtgatgaatgtgttgtggctcttacagatcagtggtacataacatacggcgaatcagaatggcggaaaattgctgaggaatgcctatcaaagatgaatctctactctgatgaaacaaggcatggctttgagcacactttgagctggctcaatcagtgggcttgctcacgatcttttggtttaggaactcgtattccctgggatgaacagttcctagtggaatccttatctgattcatctctttatatggcctattacacagttgcccatatctttcacgatggagacatgtataaaggtagcaagtctctgatccgccctcagcagatgaatgatgaagtttgggagtatctcttctgtgatggcccgtaccctaaatcatctgatattccatcagctgtcttaagtgagatgaagcaggaatttgactactggtacccgctagatcttcgagtttcaggaaaggatcttattcagaatcatttgacatttttcatctacaaccacactgcactaatggcgaatcgtaactggccacgtgggatcagatgtaatggtcatatcatgctgaattctgaaaagatgtcaaagtctactggaaatttcagaaccctgcgccagtctattgaagaattctctgccactggtacaaggttttgtttggctgatgctggtgatggtgttgatgatgcaaattttgcatttgaaactgcaaatgctgcaattttgcggttgacaaaagagctcacatggatggaagaagttctggatgtcgaatcctctttaagaacgggacctccatctacatatgctgataaagtgtttgaaaatgacatgaacattgctctcagattgactgaaagagcgtacaaagattgtctgtttagggaggcacttaaaaatgggttttacgacttacaagctgctcgggatgagtatagactctcttgtggaactggaggcatgcaccatgacttgctactgaaatttatggatgtgcaaacacgcctcattgtaccaatctgtccccattttgcagattatgtttggaggaaagttttgaataaggaaggttgtgtgctcacagcaggctggccaccatcaaatgagccagatttggtgctcaagagtgcaaacaaatatttgcaagattctattgtgttaatgagaaagcttcttcaaaaacaactctcaggttccaagaagggtgctaagaaaggtgctcaagtaacagctgtgccagaggggaagctaaaaggcctagtatatgtgaatgagcaatttgatggatggagagctcactgcctgcggattctgcaaagtagatttgaccagcaaacctgtagtttccccccggatacagagatgcttgcagaactaagtgcaacattgttgcaggagggaaaaaacttgaaagccattcaaaaggtttgcatgcctttccttaaattcaagaaggacgaggcaatatctattggcactcaggctctgaacttgaggttaccttttggagagatcgaagtccttcagagtaacaaggacttgatcaggcggcaacttggtcttgaagaggttgaaatatattctgcaagtgaccctgatgatgtttcaatagctggtccacatgcttcgctgctgacgcagaatcctccatctccaggcagcccaactgccatctttgtgaccaggtaa

SEQ ID NO: 984 - protein, 1084 aa, Arabidopsis thaliana
MASESKSYARRDRLLEIEATVRKWWEDEDVFRAESCENLPKPGEKFFSTFPFPYMNGYLHIGHAFSLSKVDFASAYHRLRGANVLLPFGFHCTGMPIKASADKLRREIEQFGNPPVFTAEDTTKVPEVQEESSDTIALPIPGQFKGKKSKVAAKAGGQVYQWEIMRSFGLTDSEIANFREPSEWLYYFPPLAVEDLRAYGLGCDWRRSFVTTDVNPFFDAFVRWQMRKLKSMGKIVKDRRYTIFSPLDGQPCADHDRATGEGVQPQEYTLIKMEVVKPFPLKLGPLEGKRVFLAAATLRPETMYGQTNAWVLPDGKYGAYEISETEVFILTERAALNLAYQNFSKNPQEPSCLVELTGYDLIGLPLRSPLSVNEIIYALPMLTILTNKGTGIVTSVPSDAPDDYMALQDLIKKPALQDKYGVKTEWLPTEIIPIINIPEFGDKAAEKVCLDLKIKSQNDKEKLAEAKRLTYLKGFTEGTMLIGEFFGRKVQEIKPIIKTKLIETGEAIIYSEPEKPVMSRSGDECVVALTDQWYITYGESEWRKIAEECLSKMNLYSDETRHGFEHTLSWLNQWACSRSFGLGTRIPWDEQFLVESLSDSSLYMAYYTVAHIFHDGDMYKGSKSLIRPQQMNDEVWEYLFCDGPYPKSSDIPSAVLSEMKQEFDYWYPLDLRVSGKDLIQNHLTFFIYNHTALMANRNWPRGIRCNGHIMLNSEKMSKSTGNFRTLRQSIEEFSATGTRFCLADAGDGVDDANFAFETANAAILRLTKELTWMEEVLDVESSLRTGPPSTYADKVFENDMNIALRLTERAYKDCLFREALKNGFYDLQAARDEYRLSCGTGGMHHDLLLKFMDVQTRLIVPICPHFADYVWRKVLNKEGCVLTAGWPPSNEPDLVLKSANKYLQDSIVLMRKLLQKQLSGSKKGAKKGAQVTAVPEGKLKGLVYVNEQFDGWRAHCLRILQSRFDQQTCSFPPDTEMLAELSATLLQEGKNLKAIQKVCMPFLKFKKDEAISIGTQALNLRLPFGEIEVLQSNKDLIRRQLGLEEVEIYSASDPDDVSIAGPHASLLTQNPPSPGSPTAIFVTR

SEQ ID NO: 985 - DNA, 1470 bp, Arabidopsis thaliana
atgggatctcagatcattcataactcacaaaaaccacatgtagtttgtgttccatatccggctcaaggccacatcaaccctatgatgagagtggctaaactcctccacgccagaggcttctacgtcaccttcgtcaacaccgtctacaaccacaatcgtttccttcgttctcgtgggtccaatgccctagatggacttccttcgttccgatttgagtccattgctgacggtctaccagagacagacatggatgccacgcaggacatcacagctctttgcgagtccaccatgaagaactgtctcgctccgttcagagagcttctccagcggatcaacgctggagataatgttcctccggtaagctgtattgtatctgacggttgtatgagctttactcttgatgttgcggaggagcttggagtcccggaggttcttttttggacaaccagtggctgtgcgttcctggcttatctacacttttatctcttcatcgagaagggcttatgtccgctaaaagatgagagttacttgacgaaggagtacttagaagacacggttatagattttataccaaccatgaagaatgtgaaactaaaggatattcctagcttcatacgtaccactaatcctgatgatgttatgattagtttcgccctccgcgagaccgagcgagccaaacgtgcttctgctatcattctaaacacatttgatgaccttgagcatgatgttgttcatgctatgcaatctatcttacctccggtttattcagttggaccgcttcatctcttagcaaaccgggagattgaagaaggtagtgagattggaatgatgagttcgaatttatggaaagaggagatggagtgtttggattggcttgatactaagactcaaaatagtgtcatttatatcaactttgggagcataacggttttgagtgtgaagcagcttgtggagtttgcttggggtttggcgggaagtgggaaagagtttttatgggtgatccggccagatttagtagcgggagaggaggctatggttccgccggactttttaatggagactaaagaccgcagtatgctagcgagttggtgtcctcaagagaaagtactttctcatcctgctattggagggtttttgacgcattgcgggtggaactcgatattggaaagtctttcgtgtggagttccgatggtgtgttggccattttttgctgaccagcaaatgaattgtaagttttgttgtgacgagtgggatgttgggattgagataggtggagatgtgaagagagaggaagttgaggcggtggttagagagctcatggatggagagaagggaaagaaaatgagagaaaaggcggtagagtggcagcgcttagccgagaaagcgacggaacataaacttggttcttccgttatgaattttgagacggttgttagcaagtttcttttgggacaaaaatcacaggattaa

SEQ ID NO: 986 - protein, 489 aa, Arabidopsis thaliana
MGSQIIHNSQKPHVVCVPYPAQGHINPMMRVAKLLHARGFYVTFVNTVYNHNRFLRSRGSNALDGLPSFRFESIADGLPETDMDATQDITALCESTMKNCLAPFRELLQRINAGDNVPPVSCIVSDGCMSFTLDVAEELGVPEVLFWTTSGCAFLAYLHFYLFIEKGLCPLKDESYLTKEYLEDTVIDFIPTMKNVKLKDIPSFIRTTNPDDVMISFALRETERAKRASAIILNTFDDLEHDVVHAMQSILPPVYSVGPLHLLANREIEEGSEIGMMSSNLWKEEMECLDWLDTKTQNSVIYINFGSITVLSVKQLVEFAWGLAGSGKEFLWVIRPDLVAGEEAMVPPDFLMETKDRSMLASWCPQEKVLSHPAIGGFLTHCGWNSILESLSCGVPMVCWPFFADQQMNCKFCCDEWDVGIEIGGDVKREEVEAVVRELMDGEKGKKMREKAVEWQRLAEKATEHKLGSSVMNFETVVSKFLLGQKSQD

SEQ ID NO: 987 - DNA, 1020 bp, Arabidopsis thaliana
atgacagatggtgcaagtccaggggttcatatgatgatgcaacttctcataacttcagagaaagatggaatcctttgtcctattcctcagtatccattgtactcagcttcaattgcccttcacggtggaactttggttccatactaccttgatgaagcatcaggatggggtcttgaaatatctgagctgaagaaacaacttgaagatgctaggtcaaagggcatcactgtgagagctttggctgtcattaaccctggaaacccgacagggcaggttctttcggaagaaaaccagcgtgacgttgttaagttctgcaagcaagagggtttagttcttttagcagacgaggtttatcaagagaatgtctatgtccctgacaaaaagttccattccttcaagaaagtagcccgctctatgggctacggtgagaaggatcttgccttagtctctttccaatctgtctccaaagggtactatggagagtgtgggaaaagaggtggttacatggaggttactggattcacttctgatgtaagagagcagatatacaaaatggcttctgtgaatctttgttccaacatctctggtcaaattcttgctagcctcatcatgagcccacccaagcctggtgacgactcctatgaatcatacatagcagagaaggatggaattctctcatctttggcaagacgtgcaaagactcttgaagaggctctgaacaagctagagggagttacatgcaatagagcagaaggagctatgtatctattcccttgccttcaccttccacaaaaggcaattgcagctgctgaggcggaaaagacagcaccagacaatttctactgcaaacgccttctaaaagctactggaatagtcgttgtccctggttctggctttagacaggtacctggaacatggcatttcaggtgcactatacttccccaagaggataagattccagcgattgttgatcgtctaactgcgttccaccagagcttcatggacgagttccgcgactaa

SEQ ID NO: 988 - protein, 339 aa, Arabidopsis thaliana
MTDGASPGVHMMMQLLITSEKDGILCPIPQYPLYSASIALHGGTLVPYYLDEASGWGLEISELKKQLEDARSKGITVRALAVINPGNPTGQVLSEENQRDVVKFCKQEGLVLLADEVYQENVYVPDKKFHSFKKVARSMGYGEKDLALVSFQSVSKGYYGECGKRGGYMEVTGFTSDVREQIYKMASVNLCSNISGQILASLIMSPPKPGDDSYESYIAEKDGILSSLARRAKTLEEALNKLEGVTCNRAEGAMYLFPCLHLPQKAIAAAEAEKTAPDNFYCKRLLKATGIVVVPGSGFRQVPGTWHFRCTILPQEDKIPAIVDRLTAFHQSFMDEFRD

SEQ ID NO: 989 - DNA, 1260 bp, Arabidopsis thaliana
atggcggccgtaggagtagattcgaggcgtcctgagacagcgatggaggaaacctgtaacgtgaaaggagcggcggcgaaacaaggggaagggcttaagcagtactatctccagcacatccatgagctccagcgccagcttcgacagaagactaataacctcaatcgccttgaagctcaaaggaatgaactcaattctcgagtgagaatgctcagagaagagttacagctccttcaagaacctgggtcctatgtgggagaagtggtaaaagttatgggaaagaacaaggtcttggttaaggttcatccagaggggaagtatgttgttgatattgacaaaagtatagacattacgaaaatcactccatcaacgagagttgctcttcgtaatgatagctatgttctccacctggttctgccaagtaaagtagatcccttggttaaccttatgaaagttgagaaggttccagactccacctatgacatgattggtggtcttgaccagcagattaaggaaataaaggaggtcattgagctgccaatcaagcatcctgaattgtttgagtctcttggaattgcgcagccaaagggtgtgttgttatacggtccacctggaactgggaagacactattggctcgggctgttgcacatcacactgactgtactttcataagagtttctggttccgagcttgtccagaaatacattggagaaggttctagaatggtcagagaactttttgtgatggcaagggagcatgcaccatcaatcatcttcatggatgaaatcgatagtattgggtctgctcgtatggaatctggaagtggaaatggtgacagtgaggtgcaacggaccatgctcgagcttctcaatcaacttgacggttttgaagcgtcaaacaaaatcaaggttttgatggctacaaatcgtattgatattctggatcaagctcttctcaggcctggaagaattgataggaaaattgaatttcctaatcctaatgaagagtcacgttttgacatcttgaagattcactcgaggaaaatgaatttgatgcgtggaatcgatctgaaaaagattgcagagaagatgaatggcgcttcaggtgctgagctgaaggctgtgtgcacggaggcgggaatgtttgctctgcgtgagaggagagtacacgtgacacaagaagactttgagatggcggtggccaaggtaatgaagaaagacacggagaagaacatgtctctgcgtaagctgtggaagtag

SEQ ID NO: 990 - protein, 419 aa, Arabidopsis thaliana
MAAVGVDSRRPETAMEETCNVKGAAAKQGEGLKQYYLQHIHELQRQLRQKTNNLNRLEAQRNELNSRVRMLREELQLLQEPGSYVGEVVKVMGKNKVLVKVHPEGKYVVDIDKSIDITKITPSTRVALRNDSYVLHLVLPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNEESRFDILKIHSRKMNLMRGIDLKKIAEKMNGASGAELKAVCTEAGMFALRERRVHVTQEDFEMAVAKVMKKDTEKNMSLRKLWK

SEQ ID NO: 991 - DNA, 1377 bp, Arabidopsis thaliana
atggagaaagtaaagattgaagaaattcagtccaccgctaagaaacaacggattgctactcacacccatatcaaaggccttggcctcgagccaactggtatccctataaaattggcagctggatttgttggtcaacttgaggctagagaggcagctggtcttgtagttgacatgattaagcagaagaaaatggcgggcaaggctcttttgcttgctggacctcctggaactgggaaaacagctttggctcttggaatctctcaagagctgggaagcaaggttccattctgtccaatggttggatctgaggtttactcatcagaggttaagaaaacagaggttctcatggagaattttagacgtgccattggtctacgtatcaaggaaaccaaagaagtctatgaaggggaggtcaccgagctgtcaccagaagaaactgaaagcctcactggaggttatggtaaaagcatcagccatgttgtaattacactcaagacagtcaaaggaaccaaacatctgaaattggatcccactatctatgatgccttgattaaggaaaaggtagctgtaggagatgtaatctatatcgaagcaaacagtggagctgtcaaacgggtaggtagaagtgatgcttttgccactgaatttgatctggaagcagaagaatatgttccacttcccaaaggagaggtccacaaaaagaaagagatagtgcaggatgtcacactccaagatctggatgcagcaaatgctcgacctcaaggtggccaggatatactttctttgatgggccaaatgatgaaaccgcggaagactgagatcactgataagcttcggcaagaaattaacaaggttgtgaaccgatatatagatgaaggtgtggcagagcttgttccaggagttctatttattgatgaggttcatatgcttgatatggagtgcttctcatacttgaaccgtgctcttgagagctcattatctccgatagtgatatttgcaacaaatagaggtgtttgcaacgtaagagggactgatatgcccagcccccatggagtccctattgatctattagatcgattggttatcatccggactcaaatctatgatccctctgaaatgatccagattatagccattcgtgcgcaagttgaagaattaaccgtggatgaagaatgcttggttctacttggggagattgggcaaagaacttcactaaggcacgctgtgcagcttctgtctcctgccagcattgtagcgaaaatgaatggccgtgacaatatttgcaaggctgatatagaggaagtaacatcactctacttggatgctaaatcttcagcaaagcttttgcatgagcaacaagaaaaatacatctcatga

SEQ ID NO: 992 - protein, 458 aa, Arabidopsis thaliana
MEKVKIEEIQSTAKKQRIATHTHIKGLGLEPTGIPIKLAAGFVGQLEAREAAGLVVDMIKQKKMAGKALLLAGPPGTGKTALALGISQELGSKVPFCPMVGSEVYSSEVKKTEVLMENFRRAIGLRIKETKEVYEGEVTELSPEETESLTGGYGKSISHVVITLKTVKGTKHLKLDPTIYDALIKEKVAVGDVIYIEANSGAVKRVGRSDAFATEFDLEAEEYVPLPKGEVHKKKEIVQDVTLQDLDAANARPQGGQDILSLMGQMMKPRKTEITDKLRQEINKVVNRYIDEGVAELVPGVLFIDEVHMLDMECFSYLNRALESSLSPIVIFATNRGVCNVRGTDMPSPHGVPIDLLDRLVIIRTQIYDPSEMIQIIAIRAQVEELTVDEECLVLLGEIGQRTSLRHAVQLLSPASIVAKMNGRDNICKADIEEVTSLYLDAKSSAKLLHEQQEKYIS

SEQ ID NO: 993 - DNA, 297 bp, Arabidopsis thaliana
atggcggcaactactggacttgagactctcgtcgatcagattatttcggtgattacaaatgacggacgcaacattgtgggagttcttaaaggttttgaccaggctacaaatataatccttgatgaatctcatgaacgtgtgttttccacaaaggaaggagtacaacaacatgtgttgggtttgtacatcatcagaggggacaacataggtgttatcggggagctggacgaggagcttgatgctagtctggatttttcgaagctgagagcccatccgttgaaacccgtagtgcattga

SEQ ID NO: 994 - protein, 98 aa, Arabidopsis thaliana
MAATTGLETLVDQIISVITNDGRNIVGVLKGFDQATNIILDESHERVFSTKEGVQQHVLGLYIIRGDNIGVIGELDEELDASLDFSKLRAHPLKPVVH

SEQ ID NO: 995 - DNA, 624 bp, Arabidopsis thaliana
atgcttgccgttcaccgtccttcttccgccgtatcagacggagattccgttcagattccgatgatgatcgcgtcgtttcaaaaacgttttccttctctctcacgcgactccacggccgctcgttttcacacacacgaggttggtcctaatcagtgttgctccgccgttattcaagagatctccgctccaatctccaccgtttggtccgtcgtacgccgctttgataacccacaagcttacaaacactttctcaaaagctgtagcgtcatcggcggagacggcgataacgttggtagcctccgtcaagtccacgtcgtctctggtctccccgccgctagctccaccgagagactcgatatcctcgacgacgaacgccacgtcatcagcttcagcgttgttggtggtgaccaccggctctctaactaccgatccgtaacgacccttcacccttctccgatctccgggaccgtcgttgtcgagtcttacgtcgttgatgttcctccaggcaacacaaaggaagagacttgtgacttcgttgacgttatcgtacgatgcaatcttcaatctcttgcgaaaatagccgagaatactgcggctgagagcaagaagaagatgtctctgtga

SEQ ID NO: 996 - protein, 207 aa, Arabidopsis thaliana; identical to SEQ ID NO: 14

SEQ ID NO: 997 - DNA, 969 bp, Arabidopsis thaliana
atggatgagactttacttgacgatataatacgacggcttttggcgacgaataatggaaggacggtgaagcaagcacagattactgagacggagatacgtcagctatgtttagcttcaaaagaggtttttctcagtcagcctaatctcctcgagctcgaggctcctatcaagatttgcggagatgttcatggtcagtttccagacctcttgcggttgtttgagtatggtggttatccaccagctgcgaactacttgtttcttggggattatgttgatcgtggtaagcagagcatagagacgatatgccttcttcttgcctataaggtcaaatacaagttcaacttctttcttctcagaggcaatcacgaatgtgcttcaatcaaccgtgtatatggattctacgatgaatgcaaaagaagatataatgttcgcttatggaaaacattcaccgagtgcttcaactgtctgcctgtttctgctctcattgatgataagatcctctgcatgcatggtggactatcgcctgatattaagagcttagatgacatcaggagaattcctcgtcctattgacgttcctgatcagggcattctttgtgatttgttgtgggctgatcctgacagagagattcaaggctggggggagaatgacagaggtgtctcttatacatttggggctgacaaagtagctgagttccttcaaactcatgaccttgatcttatatgccgagctcatcaggttgtagaagatggatacgagttctttgcaaagagacaactagtgacaatattctctgcacccaattactgtggcgagtttgacaatgctggtgcattgatgagtgttgatgatagcttaacatgttcattccaaatccttaaggcatctgagaagaaaggaagatttggattcaacaacaatgttcctagaccaggaaccccacctcataagggtggaaaaggtcgttaa

SEQ ID NO: 998 - protein, 322 aa, Arabidopsis thaliana
MDETLLDDIIRRLLATNNGRTVKQAQITETEIRQLCLASKEVFLSQPNLLELEAPIKICGDVHGQFPDLLRLFEYGGYPPAANYLFLGDYVDRGKQSIETICLLLAYKVKYKFNFFLLRGNHECASINRVYGFYDECKRRYNVRLWKTFTECFNCLPVSALIDDKILCMHGGLSPDIKSLDDIRRIPRPIDVPDQGILCDLLWADPDREIQGWGENDRGVSYTFGADKVAEFLQTHDLDLICRAHQVVEDGYEFFAKRQLVTIFSAPNYCGEFDNAGALMSVDDSLTCSFQILKASEKKGRFGFNNNVPRPGTPPHKGGKGR

SEQ ID NO: 999 - DNA, 3171 bp, Arabidopsis thaliana
atggcgttatctatgaagccattcagagccgatgattccggtttccagtcaaacaatctttgggtcggtagcctaacgccggagacgacagagtcagatctgaccgagttgtttggaagatacggcgatattgatagaatcacggtgtattcttcacgaggctttgcgtttatatactacagacatgtggaggaagcagtcgcagccaaagaggctcttcaaggagcaaatttgaatggaacgaatgagctctgcaaaagaatacatcaaacacatgtttactctcgtttatgcgaagaaggtttaatccgattgtcgtttatctgcaaacttgtatccgcgtttagcagtctgatttcaggttcgcttcagatgttaaatctcacaagcttgagtatgaatgtattgcgtactccactcgaaattcgcaatgataagaaattttggagtttaaaagttcagtttcctgcaaaaatcaaaccgcgtggagaaatttgtctatggcggtacgtagatatcaataactgcatctgcgaaacagaaaattctggcaaccgtatcgtcctaactcctagtatcgctggcacatatccatatcagtgtgagggagttttgggcttgttttggctcgatgcttcaggaagacaaattacgtggttgttaaggcggctaactctaccaatcagaaacgctttattcgaagaaccatgtttgttcctcaattcccatccctacgcaaaaccttgtaagagtctatgggtgggtggaatcggccctaatgtctccaaggatgacctggaggaagagttcagcaagtttgggaaaatcgaggattttaggtttctcagagaacgcaagacagctttcattgattattatgagatggatgatgctttacaggctaagagcatgaatggaaagcctatgggtggtagctttttgcgtgttgattttctccggtcacaagcgccaaaaaaagaacaatgggctggctcttacgataacagaaatggcaatatgaatcataaaccgcagtatcctcactcatatgaagactttaaaggagatgtccagccaagtaaggttctgtggattgggttccctcctactgctacacaatgcaatgatgagcaaattctgcacaatgcgatgatactctttggtgagatcgagagggtaaaaagttacccatcaaggaattttgcacttgtggagtttaggagcgcggaggaagctcgccaatgcaaggaaggcctacaggggaggttattcaataatcctagaatcaaaattatgtactcaaacgatgagttgcctcctgagcaagacgatactagtttttactctggtatgaaacggtcaaggacagatatgttcaataatgatccttcatttgtatcttctcctcattctactggaattcctgggtctatgaggcccctcagaggtacaaatgagcgttcatataatggtgcagaatacaatgacgttgttggtaaggagccaaactggaggaggccatctgcaaatggaactggaatactcccatctccaacaggacctggaatcctcccatctcctgcacaaggtacgaggcgccctatgaggtcaaaccccgattcttgggaaggatatgatcctgctcagttggtcagagaaagtaaacgaaccagaagagatggatcagtggacggttttactccaatgggtgtcgatgagaggtcatttggtcgaggttcagttgctgctagacctatccgtggcccccctgattctgatcacatatggagaggaatgattgccaagggtggaactcccgtctgttgtgctcgttgtgtacctatgggaaaggggattgaaactaaactgcctgaggtcgtcaattgttcagcaagaactgatttgaatatgctcgctaaacattacgccgttgccattggatgtgagatcgtttttttcgtaccagacagggaagaagattttgcgtcttacactgaatttctccggtaccttagctcaaaagatcgggcgggtgttgccaaattagatgatggtacaactttattcttggtgcctccatcagatttcttaactgatgtactccaagtgacccgtcaagaacggctatatggtgttgttctcaagttacccccgccagccgttcctgttacagcatcatacagacaagaatctcagtccaatcctctgcattatatggatcaagcccgggattcacctgccaatgctagtcacagtttatatcctcctagggaaaattacattaggggtgcaccagaacatttgacagctgcttcaaaaccatctgttagcgagcctctcagaatacctaataatgcagcgcctcaagctggggttagtttaactccggagcttttagccactctggcatctattctccctgcaacttctcaacctgctgcccctgagagtcaccaacctatgtcaggaccttcaacagttgtttccacagcacatcagtccaatggactgtacaatggagaagcaccgtctcaagcttggaaaagaggtccacaaacagttcatgatgcgtcaaatcagtcattccaacaatacggaaatcagtacactccagctgggcaactacctcctcctccttcgcgttaccctccagcttcaaacaaccccaactacactagtggaatggtccatggcaacatgcaataccagagccaatctgttaacatgcctcagctgtctccgttaccaaatatgcctcataataattattccatgtacactcagggttcgtcaaatcatcctgtttctcagcccatggtccagcaataccaaccagaagcgtccatgccaaaccaaaactatggtccaattccaagttatcagcaagctaattttcatggcgtaacaacaaatcaggcacagaacttaaacccttcccaatttcaagctgccatgcaaccaccagcagataaggcaaatttagagccacaaaaccaagcactacgattgcagcctatgatctctggggatggtcagggtacaacagatggggaggtcgataagaatcagagataccagtcaacactacaatttgcagcaaaccttcttctccagatacagcagaaacagcagcaacagtcttcaggtactccggctggacaggggccttga

SEQ ID NO: 1000 - protein, 1056 aa, Arabidopsis thaliana
MALSMKPFRADDSGFQSNNLWVGSLTPETTESDLTELFGRYGDIDRITVYSSRGFAFIYYRHVEEAVAAKEALQGANLNGTNELCKRIHQTHVYSRLCEEGLIRLSFICKLVSAFSSLISGSLQMLNLTSLSMNVLRTPLEIRNDKKFWSLKVQFPAKIKPRGEICLWRYVDINNCICETENSGNRIVLTPSIAGTYPYQCEGVLGLFWLDASGRQITWLLRRLTLPIRNALFEEPCLFLNSHPYAKPCKSLWVGGIGPNVSKDDLEEEFSKFGKIEDFRFLRERKTAFIDYYEMDDALQAKSMNGKPMGGSFLRVDFLRSQAPKKEQWAGSYDNRNGNMNHKPQYPHSYEDFKGDVQPSKVLWIGFPPTATQCNDEQILHNAMILFGEIERVKSYPSRNFALVEFRSAEEARQCKEGLQGRLFNNPRIKIMYSNDELPPEQDDTSFYSGMKRSRTDMFNNDPSFVSSPHSTGIPGSMRPLRGTNERSYNGAEYNDVVGKEPNWRRPSANGTGILPSPTGPGILPSPAQGTRRPMRSNPDSWEGYDPAQLVRESKRTRRDGSVDGFTPMGVDERSFGRGSVAARPIRGPPDSDHIWRGMIAKGGTPVCCARCVPMGKGIETKLPEVVNCSARTDLNMLAKHYAVAIGCEIVFFVPDREEDFASYTEFLRYLSSKDRAGVAKLDDGTTLFLVPPSDFLTDVLQVTRQERLYGVVLKLPPPAVPVTASYRQESQSNPLHYMDQARDSPANASHSLYPPRENYIRGAPEHLTAASKPSVSEPLRIPNNAAPQAGVSLTPELLATLASILPATSQPAAPESHQPMSGPSTVVSTAHQSNGLYNGEAPSQAWKRGPQTVHDASNQSFQQYGNQYTPAGQLPPPPSRYPPASNNPNYTSGMVHGNMQYQSQSVNMPQLSPLPNMPHNNYSMYTQGSSNHPVSQPMVQQYQPEASMPNQNYGPIPSYQQANFHGVTTNQAQNLNPSQFQAAMQPPADKANLEPQNQALRLQPMISGDGQGTTDGEVDKNQRYQSTLQFAANLLLQIQQKQQQQSSGTPAGQGP

SEQ ID NO: 1001 - DNA, 1209 bp, Arabidopsis thaliana
atgggttctcttcttcctcttcttggcatctcagtagtctccgccattttctttctggttcttcaacaaccagaacaatcttcttcagccattatactgagcttgaagaaacgccatggaagctcctctggtagtagtggtaaccagtacagttcaagcagaccatcagctggtttccaagggaacaggagcacgtgctctctcttcctcggcacgtgggttcgtgataactcttatcctctctataaaccggcggattgtcccggcgtcgttgagcctgagttcgattgtcagatgtacggtcgtcctgactctgactacctcaagtatcgatggcaacctcagaattgcaatttacccacgttcaatggtgctcagtttctgttgaaaatgaagggcaaaaccataatgtttgcgggtgattcattggggaagaatcaatgggagtctttgatctgccttattgtttcatctgcaccgtccactcggacagaaatgaccagaggcttgcctctctccaccttcagattcttggattatgggataacaatgtcattttacaaagctccgttcttggtggacatagatgctgttcaaggcaagcgtgtgttgaagctggatgagatctctggtaatgccaatgcttggcatgacgctgatctcctcatcttcaacactggtcactggtggagccacaccggatctatgcaaggatgggacttgattcaatcaggcaattcttattaccaagacatggaccgttttgtggcaatggagaaagcacttcgtacttgggcgtattgggtcgaaactcacgttgatagatcccgaacacaagtcttgttcctctccatttctccaacacacgacaacccgagtgactgggcggcatcatcgtcttcaggatccaagaactgctacggagaaacagaaccgatcacaggaacagcttatccagtgagctcctacacagatcagctaagatcagtgattgttgaagtgcttcacgggatgcacaatccggcgtttcttctcgacataacactcctctcttccctaagaaaagacggtcatccgtcagtatacagcggcctcattagcggttcacaaaggtctagaccagaccagtctgcagattgtagccattggtgtttgcctggtttacctgatacatggaaccagttgttgtatacgcttctcatctattag

SEQ ID NO: 1002 - protein, 402 aa, Arabidopsis thaliana
MGSLLPLLGISVVSAIFFLVLQQPEQSSSAIILSLKKRHGSSSGSSGNQYSSSRPSAGFQGNRSTCSLFLGTWVRDNSYPLYKPADCPGVVEPEFDCQMYGRPDSDYLKYRWQPQNCNLPTFNGAQFLLKMKGKTIMFAGDSLGKNQWESLICLIVSSAPSTRTEMTRGLPLSTFRFLDYGITMSFYKAPFLVDIDAVQGKRVLKLDEISGNANAWHDADLLIFNTGHWWSHTGSMQGWDLIQSGNSYYQDMDRFVAMEKALRTWAYWVETHVDRSRTQVLFLSISPTHDNPSDWAASSSSGSKNCYGETEPITGTAYPVSSYTDQLRSVIVEVLHGMHNPAFLLDITLLSSLRKDGHPSVYSGLISGSQRSRPDQSADCSHWCLPGLPDTWNQLLYTLLIY

SEQ ID NO: 1003 - DNA, 1686 bp, Arabidopsis thaliana
atgacgaagctggcggaaaaatcgggaagcagaccaccgtgggtgggattagcggcagccgcatgggttcaggtctcggcgggaagtggttcgacgttcccgctttactcctccgctctcaaatcggttttgggttttagccagcagcaggtcacgatccttggcgttgcttgtgatttgggtgaaaacatgggtcttcttcctggatacgccagtaacaagcttcctccatggtcgatgcttctcatcggagcttcctcttgtttcctcggcttcggcgttctttggctctccgtcagccaaatcgttcttggcttgcctttttggctgctttttgtagctctagctttagctaccaatagcaactcgtggttcggtacagcatctcttgtcaccaatatgaggaattttcctatgagccgaggccctgtggctggacttctcaaaggttatattgggatcagtggtgcagcattcactgtcttgttcagcatggtgcttcaccattcagctatggatctgcttctgtttcttacggttggtattccggttatatgcttaactgtgatgtatttcatccgcccctgtattccggctactggtgaagacccttctgagcccatgtatttcgcttttctgcttgtcactagtatactgtttgctgcttatcttgttgtgacgactgttttgagtgaggtgtttatactgcccagcatactcaaatatgttcttgtggctatcatggtgttacttttgttgtcgcctcttgcggttcccatcaagatgacacttttccgttcaaatgccaagagctctccactggggtcttcagacaatctagccaaagaggaaggtactcatgaagaaccgttgctgacaccttctacctcagcttcaaaccttgggcctatctttgagggagatgatgagtcggatatggaaatacttcttgctgaagcagaaggtgccgtgaagaagaagagaaaacccaggagaggtgaggatttcaagtttggccaagtttttgtcaaggcagatttctggctcctttggtttgtctacttcctcggcatgggttcaggtgttacagtctcgaacaacttggcacagatcggatttgcttttggtattaaggacacaacaatactcctgtgtcttttcagtttcttcaacttcataggccgtcttgcttcaggtgccatttctgagcactttgtgaggtcaagaacgcttccaagaacactatggatgggagccgcgcagctagttatggtgttcacattcctcctcttcgccatggctatcgaccacaccatttacgttgcgactgctctaatcggaatatgcatggggtttcagttcttatctatcgcaaccatctccgagctatttggtcttagacattttggaatcaacttcaacttcatactgctgggaaacccgcttggtgccaccattttctcggccattctcgcaggatacatctatgacaaggaggctgataagcaagggaagatgacctgcattggtccagattgcttccgagtaacattcttggttctagccggtgtttgtgggcttggaaccctgctgagcattattttgacagtgagaattcgcccggtttatcaagctctatatgcgtctggctcattccggttgcagccgcaatcaacgggtcattga

SEQ ID NO: 1004 - protein, 561 aa, Arabidopsis thaliana
MTKLAEKSGSRPPWVGLAAAAWVQVSAGSGSTFPLYSSALKSVLGFSQQQVTILGVACDLGENMGLLPGYASNKLPPWSMLLIGASSCFLGFGVLWLSVSQIVLGLPFWLLFVALALATNSNSWFGTASLVTNMRNFPMSRGPVAGLLKGYIGISGAAFTVLFSMVLHHSAMDLLLFLTVGIPVICLTVMYFIRPCIPATGEDPSEPMYFAFLLVTSILFAAYLVVTTVLSEVFILPSILKYVLVAIMVLLLLSPLAVPIKMTLFRSNAKSSPLGSSDNLAKEEGTHEEPLLTPSTSASNLGPIFEGDDESDMEILLAEAEGAVKKKRKPRRGEDFKFGQVFVKADFWLLWFVYFLGMGSGVTVSNNLAQIGFAFGIKDTTILLCLFSFFNFIGRLASGAISEHFVRSRTLPRTLWMGAAQLVMVFTFLLFAMAIDHTIYVATALIGICMGFQFLSIATISELFGLRHFGINFNFILLGNPLGATIFSAILAGYIYDKEADKQGKMTCIGPDCFRVTFLVLAGVCGLGTLLSIILTVRIRPVYQALYASGSFRLQPQSTGH

SEQ ID NO: 1005 - DNA, 507 bp, Arabidopsis thaliana
atggagctcctctctagagctcttttcttctttcttctactctcagttctttcttctttctcttcttcaagtttcatttcagatggggtcttcgaatctcagagtttggttcttggcagaaacttgcttcagaccaagaaaacatgtcctgtgaactttgagtttatgaactacacgatcataaccagcaaatgcaaaggtcccaaatacccaccaaaagaatgttgtggcgccttcaaggactttgcgtgtccttacactgaccagctcaacgacctgagctcggattgtgcaaccactatgttcagttacatcaatctctatggaaaatacccgcctggacttttcgctaaccagtgcaaagaaggtaaagaaggtctcgaatgccctgccggatcccagttgcctccagagacatcagcagaggtaaacgcagcaactacctcgtcgtcccgtctttggctgaccgtttccgcggctcttttggtttttgttaagttgttctga

SEQ ID NO: 1006 - protein, 168 aa, Arabidopsis thaliana
MELLSRALFFFLLLSVLSSFSSSSFISDGVFESQSLVLGRNLLQTKKTCPVNFEFMNYTIITSKCKGPKYPPKECCGAFKDFACPYTDQLNDLSSDCATTMFSYINLYGKYPPGLFANQCKEGKEGLECPAGSQLPPETSAEVNAATTSSSRLWLTVSAALLVFVKLF

SEQ ID NO: 1007 - DNA, 1788 bp, Arabidopsis thaliana
atggatttcgcagccaagaaattcatcaacaaccccaacgatgttgtaactgagttcatagagggtctggtagaaacttatcctggactccagtatttggatggttttcctgaggttaaggtggtgctacgagctgatgtctcggctgcaaaatatgacaaggttgccgttatctcaggtggaggcagtgggcatgagccagcacatgctggatacgttggagaaggaatgctaacagctgctatttgtggagatgtctttgcctccccaccagttgattctatccttgctggaattcgagctgtaactggtactgagggatgtctattgattgtcaagaattatacgggtgatcgcttgaactttggtttggctgctgaacaagcaaaatctgaaggttacaaagttgagactgtaattgttggagaggattgcgctttacccccgccacgtggcatcgctggacgcagagggttagcaggaacagttcttgtccataaggttgcgggggcagcagcagctgctggtctttctctagaaaaagttgctgctgaggcaaaatgtgcgtcagagatggttggtaccatgggtgttgcattatccgtctgtacacttcctggacaggttacatcagatcgtcttggcgcacagaagatggaactcgggcttggaattcatggagaacctggtgctgctgtggttgacgttgaacctgtggatgtggtggtgtcccatgttcttcagcaaatacttagtcctgagaccaattatgttccaattactcgtggtaacagagtggttctcatggtcaatggtttgggaggcacacctttaatggaacttatgattgctgctggaaaagcagtccctaaactgcagttggaatttggacttgccgttgatagggtgtatacaggcttttttatgacttctcttgatatggcaggattctcgatttcaatcatgaaggctgaccattcgattttagaccgattggatgctccaaccaaggctccaaattggccagttggcactgatggcaaccggccaccagcgaagattcctgttcctgttcctccttctcgatcaataaaaagcatggagtctcaaagccgacctctagagctgagtaaagaaggtcaagttcttgaggcagctattcaagcagcagcaactgtgatcatcagccttaaggatagtttgaatgaatgggatggaaaagtaggcgatggtgattgtgggtcaacaatgtacagaggtgcaacagctattctggaggacatgaaaaactattatccactcaatgatgctgcggaaacagtgaatgagattggtctatcaatcaaaagagccatggggggcacaagcggaataatttaccatctcctctgcaaggcagcatacgcggagctaaaagctaacgctcagtcagaagtcactcccaaaaattggtctgaagcactcaagtcatcaatcgcttcagtcagcaaatatggtggagcaactgcgggctacagaacgatgctagatgcgctcatcccagcttcacaagttcttgaggagaaactgagcgctggagaggatccaatatctgctttcattctatcaggcgaagcggcaactgccggagcggaatcaaccatacagatgcaagcacaggctgggagatcaagctatgtatctgcagagaatcttgcaacggttccagatccaggtgcaatggcagcagcgggatggtacaatgcggcagcaagagccgtaaaggagcagtatgagggctcgtcatga

SEQ ID NO: 1008 - protein, 595 aa, Arabidopsis thaliana
MDFAAKKFINNPNDVVTEFIEGLVETYPGLQYLDGFPEVKVVLRADVSAAKYDKVAVISGGGSGHEPAHAGYVGEGMLTAAICGDVFASPPVDSILAGIRAVTGTEGCLLIVKNYTGDRLNFGLAAEQAKSEGYKVETVIVGEDCALPPPRGIAGRRGLAGTVLVHKVAGAAAAAGLSLEKVAAEAKCASEMVGTMGVALSVCTLPGQVTSDRLGAQKMELGLGIHGEPGAAVVDVEPVDVVVSHVLQQILSPETNYVPITRGNRVVLMVNGLGGTPLMELMIAAGKAVPKLQLEFGLAVDRVYTGFFMTSLDMAGFSISIMKADHSILDRLDAPTKAPNWPVGTDGNRPPAKIPVPVPPSRSIKSMESQSRPLELSKEGQVLEAAIQAAATVIISLKDSLNEWDGKVGDGDCGSTMYRGATAILEDMKNYYPLNDAAETVNEIGLSIKRAMGGTSGIIYHLLCKAAYAELKANAQSEVTPKNWSEALKSSIASVSKYGGATAGYRTMLDALIPASQVLEEKLSAGEDPISAFILSGEAATAGAESTIQMQAQAGRSSYVSAENLATVPDPGAMAAAGWYNAAARAVKEQYEGSS

SEQ ID NO: 1009 - DNA, 483 bp, Arabidopsis thaliana
atgacgaagttcaggaagcttggtcggccggcgggtcaccgtatgtccatgcttaggactatggtttctcagttggtgaagcacgagcgtattgagaccactgtcactaaggctaaagaggttcgtcgtcttgctgataatatgattcaactcggcaaagaggggtcactctctgctgcaaggcgagcagctggttttgtgagaggagatgatgtccttcacaagattttcacagaactggcacatagatacaaagatagagctggtggatacacaagactgctacgtactcgcatacgagttggtgatgctgctcctatggcctatatcgagtttattgacagagagaacgagcttaggcaatcaaaaccagcaacacctcaaccaccgcaacgagtgccattggacccatgggaaagatctcggctcaccaggcagttcgctccgcctaaggaggagaaaatccctgattctgagctgtaa

SEQ ID NO: 1010 - protein, 160 aa, Arabidopsis thaliana
MTKFRKLGRPAGHRMSMLRTMVSQLVKHERIETTVTKAKEVRRLADNMIQLGKEGSLSAARRAAGFVRGDDVLHKIFTELAHRYKDRAGGYTRLLRTRIRVGDAAPMAYIEFIDRENELRQSKPATPQPPQRVPLDPWERSRLTRQFAPPKEEKIPDSEL

SEQ ID NO: 1011 - DNA, 2973 bp, Arabidopsis thaliana
atgagagctggtttaagtacgattcaacagactctgacgccggaggctgccaccgttttaaaccaatcaatcgccgaagccgcgcgtcgtaatcacggccaaaccactcctctccacgttgcagccactcttctagcttctcctgctgggtttctccgacgagcttgtatccgatctcaccccaattcttctcatcctttacagtgtcgagccctcgagctctgcttcagcgtcgccttagagcgtctcccaacagctacaaccactccggggaatgatccaccgatctcaaacgcgcttatggcggcgcttaaacgagctcaagctcatcaacgccgtggttgtccggagcaacaacagcaaccgttgttggccgttaaagttgagcttgaacagctcattatctcgattttggatgatccgagtgttagtcgggttatgagagaagctagcttttcaagtcccgccgttaaagctacaattgaacagtcgttgaataattcggttactccgacgccgattcctagtgtttcttcagtcgggttgaattttagacccggtggtggaggtccgatgacccggaattcgtatcttaatccacggttacaacagaacgcttcgtcggtacaatcaggggtgagtaagaacgatgatgtggagcgggttatggatatattgggtcgggcgaagaagaaaaacccggttttggttggtgattcggagccgggtcgggttattcgtgagatccttaagaaaattgaagtcggtgaagttgggaatttagcggtgaagaactcaaaggtggtttctttagaggagattagttccgataaggctttaagaattaaggaattagatgggttgcttcagacccgattaaagaattcggatcctattggtggcggcggagtgatacttgatcttggtgacttgaaatggctagtggagcaaccgagttcaacgcaaccgccggctacggttgcggtggagattgggaggacggcggtggtggagttacggaggcttttggagaagtttgaaggaagactctggtttatagggacggcgacgtgtgagacttatttaagatgtcaagtttatcatccatcagtggagactgattgggatcttcaagctgtgtcggtggcagctaaagctccagcgtctggcgttttcccgaggcttgcgaacaatttggaatcattcacgccattgaagagctttgtgcctgcgaataggacattgaaatgttgtccacagtgtttacagagttacgagcgagaacttgctgagattgattcagtgtcttctccagaggttaaatctgaagtagctcagcctaaacagttgccacagtggctgttgaaagctaaaccggttgatcgtttaccgcaagcaaagattgaagaagtgcagaagaaatggaatgatgcatgcgtgcgtcttcatcctagctttcataacaagaacgagaggattgttccgatcccggttcctataacgttgacaacgagcccttacagtcctaacatgcttcttcgtcagccgttgcagcctaagttacagcctaatagagagttgcgtgagagggtacacttgaagcctatgagtcctttggtggctgagcaggccaagaagaagagtcctcccgggagcccggttcagaccgatcttgttcttggacgagcagaggattcggagaaagcaggagatgtgcaagtaagagactttctcggctgcatatcgtctgaatcagtgcagaacaataataacatcagtgttttgcaaaaggagaatcttgggaattcgttagacattgatttgtttaagaagctgttgaagggaatgaccgagaaagtttggtggcagaatgatgcagccgctgcggtggctgcaactgttagtcagtgcaagctcgggaatgggaaacgacgcggtgttttatcaaagggagatgtctggttacttttttcaggaccggatagagtggggaagagaaaaatggtgtcagctctgtcttctcttgtgtatgggacgaatccaataatgattcagctcgggtcgagacaagatgctggagatggaaattctagtttccgtggtaaaaccgcgttggataagattgcggaaactgttaagaggagtccgttctctgttatcttgcttgaagatattgacgaagctgatatgttggtgcgtggaagcataaaacaggcaatggatagaggcagaatccgtgactcgcatggccgtgagatcagtttaggtaacgtgatctttgttatgacagcgagctggcatttcgcagggacgaaaacatcgttcctagacaatgaagcaaaactacgagatttggctagcgaaagctggcgtttgaggttgtgcatgcgggagaaatttgggaaacgacgagcaagttggctgtgtagcgacgaggagaggctgacgaaaccgaagaaagaacatggatcgggtttatctttcgatctgaaccaagccgctgatacggatgatggttctcataatacgagcgatctaacaacagataatgatcaagacgagcaaggttttagtggaaagctgtcactacaatgcgttccatttgcattccacgatatggttagccgtgtagatgatgcggtagcgtttcgagcagttgatttcgcagctgtgagacggagaatcacagaaacattatctgagagattcgaaacgatcataggcgaatcactatcagtagaagtcgaggaagaggcacttcagagaatcttgagtggagtgtggttaggccaaacagagttagaggaatggattgagaaagcgattgttccggtgttgagccaacttaaggctcgagtttcgtcttctggtacttacggtgactgtacggttgctcggctcgagctagatgaagattccggtgaacgaaacgccggtgatttactgccgacaactattactttggcagtatga

SEQ ID NO: 1012 - protein, 990 aa, Arabidopsis thaliana
MRAGLSTIQQTLTPEAATVLNQSIAEAARRNHGQTTPLHVAATLLASPAGFLRRACIRSHPNSSHPLQCRALELCFSVALERLPTATTTPGNDPPISNALMAALKRAQAHQRRGCPEQQQQPLLAVKVELEQLIISILDDPSVSRVMREASFSSPAVKATIEQSLNNSVTPTPIPSVSSVGLNFRPGGGGPMTRNSYLNPRLQQNASSVQSGVSKNDDVERVMDILGRAKKKNPVLVGDSEPGRVIREILKKIEVGEVGNLAVKNSKVVSLEEISSDKALRIKELDGLLQTRLKNSDPIGGGGVILDLGDLKWLVEQPSSTQPPATVAVEIGRTAVVELRRLLEKFEGRLWFIGTATCETYLRCQVYHPSVETDWDLQAVSVAAKAPASGVFPRLANNLESFTPLKSFVPANRTLKCCPQCLQSYERELAEIDSVSSPEVKSEVAQPKQLPQWLLKAKPVDRLPQAKIEEVQKKWNDACVRLHPSFHNKNERIVPIPVPITLTTSPYSPNMLLRQPLQPKLQPNRELRERVHLKPMSPLVAEQAKKKSPPGSPVQTDLVLGRAEDSEKAGDVQVRDFLGCISSESVQNNNNISVLQKENLGNSLDIDLFKKLLKGMTEKVWWQNDAAAAVAATVSQCKLGNGKRRGVLSKGDVWLLFSGPDRVGKRKMVSALSSLVYGTNPIMIQLGSRQDAGDGNSSFRGKTALDKIAETVKRSPFSVILLEDIDEADMLVRGSIKQAMDRGRIRDSHGREISLGNVIFVMTASWHFAGTKTSFLDNEAKLRDLASESWRLRLCMREKFGKRRASWLCSDEERLTKPKKEHGSGLSFDLNQAADTDDGSHNTSDLTTDNDQDEQGFSGKLSLQCVPFAFHDMVSRVDDAVAFRAVDFAAVRRRITETLSERFETIIGESLSVEVEEEALQRILSGVWLGQTELEEWIEKAIVPVLSQLKARVSSSGTYGDCTVARLELDEDSGERNAGDLLPTTITLAV

SEQ ID NO: 1013 - DNA, 2181 bp, Arabidopsis thaliana
atggaaggtgctgctgtggcggaagggctgtggggattagcggatcaccaccagaagcttggtgagatcggaaaaaccataaagtgcttggaagccatctgccagagtcaaatctctttccttcctcttgttgaagtcaagtctcgcctccgtttggctgctcttttactccgttactctcacaatgtcaaccatgccaagtcccatctcgagcgctctcttcttctccttaagtctattccttcctcctacgatctcaaatttcagaattatagcttgctcagccactgttatcacctccttgcttcattccctcctcaacgcaaccttcttgtcaaggctctcgaactcgcatcttctgtccctcaggatatttctgcgtacctctggtcttgcaatttcaactctcaactcgctaacacgttcattatccaagccgattttccttcttctctctccgctctcgagtctggttttctctctgcttcacacatatgttttcctgagctccagatgttcttcacagcttcaatgcttcacgttcatatcatgcaatggactgatgattattcagtggaaaaagctgtccagcgatgcgatgagatctggcagaccatttcttcagacaagactgatcgctgccccggtttgttcttctacaatgagatgttgcatgttttctatcgcctcaggctctgcgattataagaacgctcagcatcatgtcgaccgcttggaccaggcaatgaatgctcattcgcataaaatgcaggagattcagcaacttctggatgagctcagttcgttaaatcttagtctctcccgttacgaccttccctccagagaaagatcggccctctcagcaagacaatctcagcttcaagatcgtgtaaacgcattatctccatcttctagcactgttaactctctggagcccgcatactttggcaacatagatcgtggatggacagagaagctactgctttcaccatctccaattgatggagaatggctaccaaaaagtgccatcgatgctttggtccatcttatggttgtcatatcgggacgtccaaagggactctttaaagagtgttcaaaacgtatcgagtctggactgcagatcattcaagatgaactgatcaagcttggaattactgacgaagttagagaggctgatttgcggcacacagctatctggatgtctagggtttttcttatgctacagatgcagtttcttgagaatagagtggctttggaacttacaaggtctgattatgtcgaagctgaagaggctttggttgatatgaaaaattggtttacacgatttccaacgattttacaagcttctgagtgtatgattgagatgctcagggggcaatattctcattctgttggttgctacagcgaagctgctttccattgtattgaagcgaccaagttgacagagagtatttcaatgcaagcttcgtgtcaagcttttgcagctgtttcttaccttactattggagatgctgaatcatcatctaaggcacttgatttaattggaccactcaatggaatgacgaattcactatctggtgttcgagaggaagctagtattctctttgcttacggtcttctcttgatgaagcaacgagatctacaggaagcaagaaaccgtcttgccaagggtttgcagatcgctcataatcatatgggtaacctgcagctagttgcacagtatttgacactcctgggaaatttagctctttccttgcacgacaccgtacaagccagggagatcctgcgttcctctcttacacttgcaaagaaactttatgatatcccaactcagctatgggttctatccatcttcacagctctgtatcagcagttgggtgagaaaggcaacgagatggagaacgaagaattccggaagaagaaatgggatgagttgcagagtagacttgctgaagcgcgaggatcaattcatcacattgaactggttgcgaaagctaggatagaattgtatcagatcgacaacaatccacaagaacagtcactagtagcatctgcgcaatcaatgcaagggaatctggatattccagagtctgttggtatagaaggtccatcacctgctccatcatcttcaaggctcgttggtttagacaccggaaaaagatggggaaaacgaaggatgtaa

SEQ ID NO: 1014 - protein, 726 aa, Arabidopsis thaliana
MEGAAVAEGLWGLADHHQKLGEIGKTIKCLEAICQSQISFLPLVEVKSRLRLAALLLRYSHNVNHAKSHLERSLLLLKSIPSSYDLKFQNYSLLSHCYHLLASFPPQRNLLVKALELASSVPQDISAYLWSCNFNSQLANTFIIQADFPSSLSALESGFLSASHICFPELQMFFTASMLHVHIMQWTDDYSVEKAVQRCDEIWQTISSDKTDRCPGLFFYNEMLHVFYRLRLCDYKNAQHHVDRLDQAMNAHSHKMQEIQQLLDELSSLNLSLSRYDLPSRERSALSARQSQLQDRVNALSPSSSTVNSLEPAYFGNIDRGWTEKLLLSPSPIDGEWLPKSAIDALVHLMVVISGRPKGLFKECSKRIESGLQIIQDELIKLGITDEVREADLRHTAIWMSRVFLMLQMQFLENRVALELTRSDYVEAEEALVDMKNWFTRFPTILQASECMIEMLRGQYSHSVGCYSEAAFHCIEATKLTESISMQASCQAFAAVSYLTIGDAESSSKALDLIGPLNGMTNSLSGVREEASILFAYGLLLMKQRDLQEARNRLAKGLQIAHNHMGNLQLVAQYLTLLGNLALSLHDTVQAREILRSSLTLAKKLYDIPTQLWVLSIFTALYQQLGEKGNEMENEEFRKKKWDELQSRLAEARGSIHHIELVAKARIELYQIDNNPQEQSLVASAQSMQGNLDIPESVGIEGPSPAPSSSRLVGLDTGKRWGKRRM

SEQ ID NO: 1015 - DNA, 261 bp, Arabidopsis thaliana
atggcaaagaccctcaattccatctgcttcaccactcttctgctcgttctcttgttcatctcggctgagatcccgacggctgaggctaattgtgatacgtatttaggcgaagtcacagtgtattacccatgtagggaaagagactgtgaagcccaatgctatgagcattacccacactcatgtaaaggagagtgtgagcatcatgaccacgtagtgcatcatgacaacgaagaagagcattgccactgctacggtcgttga

SEQ ID NO: 1016 - protein, 86 aa, Arabidopsis thaliana
MAKTLNSICFTTLLLVLLFISAEIPTAEANCDTYLGEVTVYYPCRERDCEAQCYEHYPHSCKGECEHHDHVVHHDNEEEHCHCYGR

SEQ ID NO: 1017 - DNA, 1836 bp, Arabidopsis thaliana
atggatgcttcggtggtgagattttcccaatcgccggcaagagtgccaccggaatttgaaccagatatggagaagattaaacggaggctgctcaagtacggtgttgatccaacccccaaaatcctgaacaatctccgaaagaaagaaattcaaaaacacaaccgtagaaccaagcgcgaaaccgagtccgaggcggaggtgtatacggaggcgcagaaacaatcaatggaggaagaagctcgttttcaaacccttagacgggaatacaagcaattcacgaggtcaatttctggaaaaaggggcggcgatgttggtttgatggttgggaatccatgggaaggaatcgagagagtgaagctgaaggagctcgttagtggcgttcggagagaagaggttagtgctggtgaattgaagaaagagaatctaaaagagttgaagaagatacttgagaaggatcttcgttgggttctagacgacgacgttgatgtggaagaatttgatttggacaaagaatttgatcctgcgaaacggtggcgtaacgaaggagaagcagtcagagttctcgttgacagattgagtggtagagaaatcaatgagaagcattggaagtttgtgagaatgatgaatcaatcagggcttcagttcactgaagatcagatgcttaagatcgttgatcgattgggacgtaaacagagctggaaacaagcttcagctgttgttcattgggtgtattctgataaaaagcgtaaacatcttaggagcagatttgtttacaccaagcttttgtccgttcttgggtttgcgaggaggccacaggaagctcttcagatattcaatcagatgcttggtgatcgccagttatatcctgatatggcggcgtaccactgtattgctgtaacacttgggcaagcgggtttattgaaggagttgcttaaagtaatcgagcgtatgaggcagaaaccgactaaactaactaagaatttgcggcaaaagaactgggatcctgtgcttgaacctgacttggttgtatacaacgctattcttaacgcttgtgttccaacactccaatggaaggctgtttcatgggtatttgtagagttaagaaaaaatggtttgaggcctaatggagctacatatgggcttgcgatggaggttatgctggagtcagggaagtttgatcgtgttcacgatttttttaggaagatgaaaagcagtggcgaagctccaaaagcaatcacatacaaggttcttgtccgagctctctggagagaaggcaagatcgaagaagctgttgaagcagtcagagatatggaacaaaagggagttataggaacgggttcagtttactatgaattggcatgctgtctgtgcaacaacgggcgttggtgcgatgcaatgctcgaagtggggaggatgaaaagacttgaaaattgcaggccgctcgagattaccttcacaggactcatagccgcttcattgaacggtggtcatgttgatgattgcatggctatattccaatatatgaaagataaatgtgatccgaatataggaactgcgaacatgatgcttaaagtttacggaaggaatgatatgttttcagaagctaaagaattgtttgaagagattgtcagcagaaaagagactcatttagttccaaacgagtatacatacagcttcatgcttgaagcttcagctagatcactgcaatgggaatactttgaacatgtgtatcaaacgatggttctttctggttaccaaatggatcaaacaaaacatgcatcaatgctgatagaagcatcaagagccgggaaggtaacaaatctttgtctagtttaa

SEQ ID NO: 1018 - protein, 611 aa, Arabidopsis thaliana
MDASVVRFSQSPARVPPEFEPDMEKIKRRLLKYGVDPTPKILNNLRKKEIQKHNRRTKRETESEAEVYTEAQKQSMEEEARFQTLRREYKQFTRSISGKRGGDVGLMVGNPWEGIERVKLKELVSGVRREEVSAGELKKENLKELKKILEKDLRWVLDDDVDVEEFDLDKEFDPAKRWRNEGEAVRVLVDRLSGREINEKHWKFVRMMNQSGLQFTEDQMLKIVDRLGRKQSWKQASAVVHWVYSDKKRKHLRSRFVYTKLLSVLGFARRPQEALQIFNQMLGDRQLYPDMAAYHCIAVTLGQAGLLKELLKVIERMRQKPTKLTKNLRQKNWDPVLEPDLVVYNAILNACVPTLQWKAVSWVFVELRKNGLRPNGATYGLAMEVMLESGKFDRVHDFFRKMKSSGEAPKAITYKVLVRALWREGKIEEAVEAVRDMEQKGVIGTGSVYYELACCLCNNGRWCDAMLEVGRMKRLENCRPLEITFTGLIAASLNGGHVDDCMAIFQYMKDKCDPNIGTANMMLKVYGRNDMFSEAKELFEEIVSRKETHLVPNEYTYSFMLEASARSLQWEYFEHVYQTMVLSGYQMDQTKHASMLIEASRAGKVTNLCLV

SEQ ID NO: 1019 - DNA, 1758 bp, Arabidopsis thaliana
atgtatcggcttgtctccaacgttgcttccaaagctaggattgccagaaagtgtacaagccagattggaagcaggctcaattctactaggaattatgcagcaaaagacataaggttcggtgttgaagctcgggctttaatgcttaggggtgttgaggatcttgctgatgcagttaaagtcactatgggacccaagggtcgtaatgtcatcatcgaacaaagctggggtgcaccaaaggtgacaaaggatggtgtgactgttgccaagagcattgagttcaaggatagaattaagaacgttggtgccagtcttgtgaaacaggttgctaacgccacaaatgacgtagctggtgatggaacaacgtgtgccacagtccttactagagctatcttcacggaaggttgtaaatcagttgccgctggaatgaatgcaatggacctaagacgtggtatcaaattggcagttgatactgttgtgacgaacttgcagagccgagcacgcatgattagcacctctgaagaaatcgcccaagttggaacaatatcagctaatggagatagggaaattggtgaactgattgcaaaggctatggaaactgtcggcaaagagggagtgatcacaattcaagatggcaagaccttgtttaatgagctggaagttgttgagggtatgaagattgacaggggatacatctccccgtacttcataactaacccgaaaacacaaaaatgtgaactagaagatcctctcattcttatccacgagaagaaaatttccaatataaacgcaatggtgaaagtattagaactggccctcaagaagcaaaggccgctgctgatcgttgctgaggatgtggagagcgatgctcttgccaccctaattctgaacaaacttcgtgctaatatcaaggtctgtgctgtgaaggcccctggttttggagagaaccgaaaggccaatttacatgatctagctgccctcactggagcccaggtaataacagaagagttgggtatgaatctagacaacattgacctcagtatgtttggaaactgcaagaaggtaacggtatccaaagatgatactgttgttctcgatggggctggtgacaagcaagcaattggggaacgatgtgaacagatacgatccatggttgaagcaagcacttctgattatgacaaggagaagttgcaagaaaggttggctaagctttcgggtggtgttgctgtactaaagattggaggagcaagtgagacagaagttagtgaaaagaaagatagagtaacggatgctctaaatgccactaaagcagccgtagaggagggtattgttccaggtggtggtgttgctcttttgtatgcttcgaaagaacttgagaagctttccacagctaactttgatcagaaaattggtgttcaaatcattcaaaacgcactcaagacacctgtttacacgattgcttccaatgctggagtcgagggtgcagttgtcgtaggcaagcttttggaacaagataatcctgaccttggttatgatgctgctaaaggagaatatgtggacatgataaaggctggtattatcgatcctttgaaagtgatcagaaccgcattagttgatgctgcaagtgtttcgtctttgttgacaacgacggaagcagttgtgactgagattccaacgaaagaggtagcatctccgggtatgggcggtggtggcatgggcggcatgggtggcatgggcggtatgggaggaatgggtttctga

SEQ ID NO: 1020 - protein, 585 aa, Arabidopsis thaliana
MYRLVSNVASKARIARKCTSQIGSRLNSTRNYAAKDIRFGVEARALMLRGVEDLADAVKVTMGPKGRNVIIEQSWGAPKVTKDGVTVAKSIEFKDRIKNVGASLVKQVANATNDVAGDGTTCATVLTRAIFTEGCKSVAAGMNAMDLRRGIKLAVDTVVTNLQSRARMISTSEEIAQVGTISANGDREIGELIAKAMETVGKEGVITIQDGKTLFNELEVVEGMKIDRGYISPYFITNPKTQKCELEDPLILIHEKKISNINAMVKVLELALKKQRPLLIVAEDVESDALATLILNKLRANIKVCAVKAPGFGENRKANLHDLAALTGAQVITEELGMNLDNIDLSMFGNCKKVTVSKDDTVVLDGAGDKQAIGERCEQIRSMVEASTSDYDKEKLQERLAKLSGGVAVLKIGGASETEVSEKKDRVTDALNATKAAVEEGIVPGGGVALLYASKELEKLSTANFDQKIGVQIIQNALKTPVYTIASNAGVEGAVVVGKLLEQDNPDLGYDAAKGEYVDMIKAGIIDPLKVIRTALVDAASVSSLLTTTEAVVTEIPTKEVASPGMGGGGMGGMGGMGGMGGMGF

SEQ ID NO: 1021 - DNA, 1191 bp, Arabidopsis thaliana
atggctccggtgaagcagaagaagaagaataagaagaagcctctggataaggcgaagaagttggcgaagaataaagagaagaagagagtcaacgcagtgccattggatccggaggctatcgactgcgactggtgggatactttctggctccgaaactcttctccctcagtcccctcagacgaagactatgcgttcaagcacttctttagggcttctaagacaacttttagctacatttgctcgctcgtcagggaggaccttatctctagacctccctctggtctcatcaacatcgagggaaggcttcttagtgttgagaaacaagtcgccattgctcttcgaaggttagcttccggtgattctcaggtctccgttggtgctgcctttggtgttggccagtccactgtttctcaggttacatggagattcatcgaggcactcgaagaacgtgccaagcatcatcttagatggccagattctgaccgaattgaagagatcaagtcaaagttcgaggagatgtacggtctccccaattgctgcggagccattgacactacgcacatcatcatgactctcccggctgtgcaagcatcagatgactggtgtgaccaggagaagaactacagcatgttcttacaaggagtctttgatcacgagatgagatttctcaacatggttaccggctggcctggcggcatgaccgtctccaagcttctcaagttctctggcttcttcaaactctgtgaaaacgctcagattttagacggcaatcctaaaactctatcccaaggagcccagattagagaatacgttgttggagggatcagttacccgcttcttccctggcttataactcctcacgacagcgatcatccctctgattccatggtggcgttcaacgaaaggcatgagaaggtgaggtcagtcgcagctactgcctttcaacagcttaaaggaagctggaggattctgagcaaagttatgtggagaccagacaggaggaagctacctagtataatactggtgtgttgtttgttgcataacatcattatcgactgtggggattatcttcaagaagatgttcctttgtctggtcatcacgactccggttatgcagaccggtactgcaagcagaccgagccgcttggtagtgagctcagaggatgtctgactgagcatttgcttaggtga

SEQ ID NO: 1022 - protein, 396 aa, Arabidopsis thaliana
MAPVKQKKKNKKKPLDKAKKLAKNKEKKRVNAVPLDPEAIDCDWWDTFWLRNSSPSVPSDEDYAFKHFFRASKTTFSYICSLVREDLISRPPSGLINIEGRLLSVEKQVAIALRRLASGDSQVSVGAAFGVGQSTVSQVTWRFIEALEERAKHHLRWPDSDRIEEIKSKFEEMYGLPNCCGAIDTTHIIMTLPAVQASDDWCDQEKNYSMFLQGVFDHEMRFLNMVTGWPGGMTVSKLLKFSGFFKLCENAQILDGNPKTLSQGAQIREYVVGGISYPLLPWLITPHDSDHPSDSMVAFNERHEKVRSVAATAFQQLKGSWRILSKVMWRPDRRKLPSIILVCCLLHNIIIDCGDYLQEDVPLSGHHDSGYADRYCKQTEPLGSELRGCLTEHLLR

SEQ ID NO: 1023 - DNA, 849 bp, Arabidopsis thaliana
atgggtactagagctcagcagattcctttacttgaaggtgagactgataattacgatggtgttactgtaaccatggtggaacctatggattctgaggtttttactgaaagtcttagggcttctctttcgcattggagagaagaggggaagaagggaatttggataaagctgcctcttggattggctaatcttgtggaggctgcagttagtgaaggatttagatatcaccacgcggagcctgagtacttgatgcttgtatcttggatctctgaaactcctgatacaatcccagccaatgcttctcatgttgtaggtgctggtgctttggtcatcaacaaaaatactaaagaggtcctcgttgtccaggagaggagtgggtttttcaaagataaaaatgtgtggaagctgcctactggtgttatcaacgagggcgaggatatatggactggagtagctagggaagtggaagaagaaactggaattattgcagattttgtcgaagtactggctttcaggcaaagccacaaagccatcttaaaaaagaaaacagatatgtttttcctgtgtgtcttaagtccgcgctcttacgatattactgaacaaaaatctgagatcttgcaagctaagtggatgccgatccaagagtatgtagaccaaccatggaacaagaagaacgagatgttcaagttcatggctaacatttgccaaaagaagtgtgaggaagaatacttgggattcgccattgtgccaactaccacatcatctggtaaagagagctttatctactgcaatgcggatcatgccaagcgccttaaagtatcgcgtgaccaagcctctgcttctctctga

SEQ ID NO: 1024 - protein, 282 aa, Arabidopsis thaliana
MGTRAQQIPLLEGETDNYDGVTVTMVEPMDSEVFTESLRASLSHWREEGKKGIWIKLPLGLANLVEAAVSEGFRYHHAEPEYLMLVSWISETPDTIPANASHVVGAGALVINKNTKEVLVVQERSGFFKDKNVWKLPTGVINEGEDIWTGVAREVEEETGIIADFVEVLAFRQSHKAILKKKTDMFFLCVLSPRSYDITEQKSEILQAKWMPIQEYVDQPWNKKNEMFKFMANICQKKCEEEYLGFAIVPTTTSSGKESFIYCNADHAKRLKVSRDQASASL

SEQ ID NO: 1025 - DNA, 1227 bp, Arabidopsis thaliana
atggcgacagcgaatcctggccgtggaggtggtagaagaggcggtggagctatggatgacgataagttggtcttcgagactaccgatggaattgagcccatcacgagcttcaatgatatgggcattaaggaagatgtgcttcgcggtgtctacgaatatggattcgagaagccttccgcgattcagcagagggctgttatgccgattcttcaaggacgtgatgttattgctcaagctcagtccggtaccgggaagacatctatgattgctctctccgtttgtcaagtcgttgatacttcttctagagaggttcaggccttgatattatccccaacaagagagctggctacacaaacagagaagacgatacaagctattggattacatgccaatattcaggcacatgcttgcatcggtgggaatagtgttggagaagacatcaggaagctggagcatggtgttcatgttgtgtctgggacacctggtcgtgtctgtgacatgataaagaggagaagtcttcgtaccagagctattaaacttctgattcttgatgaatcagatgaaatgctgagcagagggttcaaggaccagatctatgatgtttacagatatcttccaccagatcttcaggtttgcttggtttctgcaactcttcctcacgagattttggagatgacatccaagtttatgacagaaccagtgaagatacttgtgaagcgtgatgagttgactcttgaaggaatcaaacaattttttgttgctgttgagaaggaagagtggaaatttgatacactctgtgatctttatgacacgcttactatcactcaagctgttatcttctgcaatactaaacgaaaggtggattatcttagtgagaaaatgagaagtcacaacttcactgtctcatcaatgcatggagacatgcctcagaaggagagagacgccatcatgaatgagtttcggtcaggtgatagtcgtgttttgataacaacagatgtatgggcacgtgggattgatgtgcaacaagtttctcttgttatcaattatgatctccccaacaaccgtgagctctacatccatcgtattgggcggtctggtcgattcgggcgtaagggtgttgcaatcaactttgttaaaagcgacgacatcaagattctcagagacattgagcagtactacagtacccagattgatgagatgccaatgaatgtagctgatcttatctaa

SEQ ID NO: 1026 - protein, 408 aa, Arabidopsis thaliana
MATANPGRGGGRRGGGAMDDDKLVFETTDGIEPITSFNDMGIKEDVLRGVYEYGFEKPSAIQQRAVMPILQGRDVIAQAQSGTGKTSMIALSVCQVVDTSSREVQALILSPTRELATQTEKTIQAIGLHANIQAHACIGGNSVGEDIRKLEHGVHVVSGTPGRVCDMIKRRSLRTRAIKLLILDESDEMLSRGFKDQIYDVYRYLPPDLQVCLVSATLPHEILEMTSKFMTEPVKILVKRDELTLEGIKQFFVAVEKEEWKFDTLCDLYDTLTITQAVIFCNTKRKVDYLSEKMRSHNFTVSSMHGDMPQKERDAIMNEFRSGDSRVLITTDVWARGIDVQQVSLVINYDLPNNRELYIHRIGRSGRFGRKGVAINFVKSDDIKILRDIEQYYSTQIDEMPMNVADLI

SEQ ID NO: 1027 - DNA, 1842 bp, Arabidopsis thaliana
atgggagcagtagagcttatgagtgatccatcgagcttatgcacagtcgagaactatgtggacaacgttgatttatctgatacgcaattggtgcagaccgtgagaaaggctcttacatctgtcaaaactggggactcagacctttatagtgagatggttggagttatggcacgggacatcaaagaatttaaggatcctgatgtagtggcgcagcttgagacagtcttgaaagctctatcaggcgctgtggcttgcatagatgtccttcaccatcaaaagcttctttctgcgctttttcgaatgaaattgtgggaccacagacctgatgtcatggatgcattggtgaaccttgtcatatcactggctgtcactagtggaaagtatttagactcttgtctgaatatgctcgtaagcaacttcgttccacctccttgggtagtgaataacctttcgcactcccgtatactaaacaagaagatagacgttctttctcgggtgcatgcagcgcttctgaaaatctctattttggttcctcttactccctcaagattagtgccaatgctcttccagcaaatgcccaagatgcacaaaaaggaccattcgatagtgatatatgtggagagcttattaaaattggagaatagctcaatagggcaagttggtggcagcatgattcttggtatggtgatggagaggctgcgagatttggatttagagattgaatgggatgatattccacaagatgactctagtagaggaatgtttgatatggaacttgaagatgcagctgaaggcactatgaatgatggagacgagcttccagtgggacctctaaagcaggatacatcagatggaagtatagtctctaagttgttggacaaattgatggtcgtagcttttgagcatcttgaatcctgtcaaaatgatggtcgtttggatcaggtgtttgaaagcctcttcaagtcatttgaaaacttcattctgaacacatacaaatcaaaattcacccagtttctgatattctatgcctgctcactggatcctgaaaattgtggtgtgaaatttgctagtaagctagtggagatttttctctccagcaacaagcatgtagctactagaatgagtgcggtggcttatcttgctagcttcttggctcgtggaaagtttttgcctgtttcctttgtggctagcatgttgaaaaggttgatagatgagtgtgtgggttactgcagaacttgcaatgatgatactaggcctgaagcacatcagattttcttctccggatgtcaggcaatcatgtatgtgctctgcttcaggatgagatccatcttggatgttcctcgctttcggtcccagcttacaccattggagtcaatattaatgcacaaactaaacccattgatggtatgccttccatcggtagttgcggagttccttagacaagctaaagaaggtggtctgttcatcgtctcagactcgttcattttcgatgacctacttgagtctgagctttcccgtgcttttggcgggtttgagaggctggatacattcttcccatttgacccttgcttgctaaaatcctcaaacagctttatctccccaaatttcatctactggtcaatggtcaaagcgacctatgacgaagatgatgatgataatgatgctgaggtgatcgtgaatggagatgaggacagtgacgaagatgacgaggctgatcttgattacgccctgaacaagatgtccataacgcctaagcactctttcaagaacaagatggaaagagacagacttttaagaatgccttccaggatcagaccgtcaacgagtcctgaatccttgtga

SEQ ID NO: 1028 - protein, 613 aa, Arabidopsis thaliana
MGAVELMSDPSSLCTVENYVDNVDLSDTQLVQTVRKALTSVKTGDSDLYSEMVGVMARDIKEFKDPDVVAQLETVLKALSGAVACIDVLHHQKLLSALFRMKLWDHRPDVMDALVNLVISLAVTSGKYLDSCLNMLVSNFVPPPWVVNNLSHSRILNKKIDVLSRVHAALLKISILVPLTPSRLVPMLFQQMPKMHKKDHSIVIYVESLLKLENSSIGQVGGSMILGMVMERLRDLDLEIEWDDIPQDDSSRGMFDMELEDAAEGTMNDGDELPVGPLKQDTSDGSIVSKLLDKLMVVAFEHLESCQNDGRLDQVFESLFKSFENFILNTYKSKFTQFLIFYACSLDPENCGVKFASKLVEIFLSSNKHVATRMSAVAYLASFLARGKFLPVSFVASMLKRLIDECVGYCRTCNDDTRPEAHQIFFSGCQAIMYVLCFRMRSILDVPRFRSQLTPLESILMHKLNPLMVCLPSVVAEFLRQAKEGGLFIVSDSFIFDDLLESELSRAFGGFERLDTFFPFDPCLLKSSNSFISPNFIYWSMVKATYDEDDDDNDAEVIVNGDEDSDEDDEADLDYALNKMSITPKHSFKNKMERDRLLRMPSRIRPSTSPESL

SEQ ID NO: 1029 - DNA, 1014 bp, Arabidopsis thaliana
atgtcgaattggagacataaactatggagaaaattgagctcatttcagagagctagttactcaactacatcttcaagaaacaacaaattaaagcttgatgaccttagaaaactccggccaatgattctaaagagaatcgaaaatcgagctaaagattacccggttaaagagattgttcctgtagctgaagaaatccttatagctagaaagaatctaatcagtaacatcgccgctcttcttaaggtgtttcctgtcttgacatgcaaattctgttcagaagtgtttgttggcaaagaaggacatttgattgagacatgtcgtagttatatacggcgtggtaacaataggctacacgaatgggttccaggttccataaacgatatacttgtgccagttgaatcctatcacttacacaacatctctcaaggtgttatcagacaccaagagaggtttgattatgatcgtgttcccgcaatcttggaactatgttgtcaagcaggagccatccatcctgaagaaatccttcaatattcggaaattcacgataacccgcaaatctctgaggaagatatcaggagtttacccgctggagatctcaaatatgttggggcaaacgctcttatggcgtgggagaaagtgagagctggtgtgaagaaactattgcttgtttatccttcaaaagtttgcaaacgatgtaaggaggttcatgtgggtccgagtggtcataaagctcggttatgtggtgtgttcaaatatgagagctggcgcggcactcattactgggaaaaagccggtgtgaatgatttggtacccgagaaaatggtgtggcaccggaggcctcaggacccagtggttcttgttgacgaagggcggagttattatgggcatgcccctgctattgtgagcctttgtagccataccggtgccattgttcctgtaaaatacgcttgcaagatgaagccccaaggtttatctttttctttcactaatccagttccaaatctcgaaacgtag

SEQ ID NO: 1030 - protein, 337 aa, Arabidopsis thaliana
MSNWRHKLWRKLSSFQRASYSTTSSRNNKLKLDDLRKLRPMILKRIENRAKDYPVKEIVPVAEEILIARKNLISNIAALLKVFPVLTCKFCSEVFVGKEGHLIETCRSYIRRGNNRLHEWVPGSINDILVPVESYHLHNISQGVIRHQERFDYDRVPAILELCCQAGAIHPEEILQYSEIHDNPQISEEDIRSLPAGDLKYVGANALMAWEKVRAGVKKLLLVYPSKVCKRCKEVHVGPSGHKARLCGVFKYESWRGTHYWEKAGVNDLVPEKMVWHRRPQDPVVLVDEGRSYYGHAPAIVSLCSHTGAIVPVKYACKMKPQGLSFSFTNPVPNLET

SEQ ID NO: 1031 - DNA, 1296 bp, Arabidopsis thaliana
atgaatgtggtgcggagattaacgagtattgcctctggacgtaatttcgtttcttctgataacgtaggagaaactgagacgccgagatcaaagcctaaccagaatcgtgaagaaacagagtctacggaaactacgtcgtacgagaaagattctgtctcttcctcagagaactctgatcatttaccaaaggaaatccgtgaggatatggactgtggaatcatcaagggaaatggaacagaatctggacggattattaccaccaaaaagaagggtttgaatgatcaaaaagacaagacaatctcttacagagctgaacatgtaattggcactggctcattcggtgttgtctttcaggctaagtgcttagagacggaagaaaaagtagcaataaagaaagtgttacaggacaagagatacaaaaacagagaacttcagatcatgcgaatgcttgatcatcctaatgtcgttgagctcaagcattctttcttttccacgactgagaaagacgagctttatcttaaccttgttcttgagtatgtacccgagactatttaccgcgcttccagatcttacaccaagatgaatcagcatatgcctttgatttatattcagctctacacctatcagatttgccgtgctatgaattatctgcatcaagtggttggagtgtgtcaccgtgacattaagccgcagaatctgttggtcaataatgttacgcatgaagtaaagatatgcgattttgggagcgccaaaatgctgattccaggagaaccaaatatatcttacatatgctcaaggtattacagagctcctgaactcatatttggagcaaccgaatacacaagtgcgatcgatatgtggtctgtaggttgtgtcatggctgagctttttcttggacatcctctattccctggagaaaccagtgttgatcaattggtggagatcattaagattttagggacaccagcaagagaagagataaagaacatgaatcctcgttacaatgattttaagttccctcagatcaaagctcagccgtggcacaagattttccggagacaggtatctccagaagcaatggatcttgcctctagattgctccagtattcaccaaacctgagatgcacagcgcttgaagcatgtgcacacccattcttcgatgatctgagagacccgagagcatccttgcctaatggaagagcacttcctccattgtttgatttcacagctcaagaacttgctggggcatctgttgaactgcgtcatcgcttaatacctgagcatgcaaggaaatga

SEQ ID NO: 1032 - protein, 431 aa, Arabidopsis thaliana
MNVVRRLTSIASGRNFVSSDNVGETETPRSKPNQNREETESTETTSYEKDSVSSSENSDHLPKEIREDMDCGIIKGNGTESGRIITTKKKGLNDQKDKTISYRAEHVIGTGSFGVVFQAKCLETEEKVAIKKVLQDKRYKNRELQIMRMLDHPNVVELKHSFFSTTEKDELYLNLVLEYVPETIYRASRSYTKMNQHMPLIYIQLYTYQICRAMNYLHQVVGVCHRDIKPQNLLVNNVTHEVKICDFGSAKMLIPGEPNISYICSRYYRAPELIFGATEYTSAIDMWSVGCVMAELFLGHPLFPGETSVDQLVEIIKILGTPAREEIKNMNPRYNDFKFPQIKAQPWHKIFRRQVSPEAMDLASRLLQYSPNLRCTALEACAHPFFDDLRDPRASLPNGRALPPLFDFTAQELAGASVELRHRLIPEHARK

SEQ ID NO: 1033 - DNA, 858 bp, Arabidopsis thaliana
atgtcacgatatttcacatccccaccgcctgtgtatgcgaggaactgggcgaacggtcaaaacttggtcgaatggactaagatcgaaagaccaatagttgattctaaaaagctgcatcggaaagagaagaaggagaaaaagaaagaaaagaaattaaagaaagagaagaaatcccttgaacagaagtattccacaaccaagacagtctcatatgaatccgaacagcttgagaaatcttgtttaacagaagaatttgagcaacctcaggttggatatttgtctgatggtagccagaacagtaagaagagaagaagggaaacttctcctgctgttgttgagagtcaaatcaaagctacacctgtagctggtaaaccactacggattcgtattgttttcaagaaaccgaaagaagctgaagctgtacctcaagaggatcctgtttgttccacttcagggactcagagacctagcgaattaccaagttctgtctctcttccaagtatctgtgatcatgatgtggctgtaccctcaacttctcttgagagtggcaaggtagcaattatttccgaatcaaagaagagaaagaaacataagcctagcaaagaatcccggtacaattcattgtttgatgaattagttcctccctgtatttccttggaggaagatgatagcagcagcgatgactggctttttggaacaagtcggaaagaaaatgtttcttctgccaagtcttcttataagactgatgaagacacgatcatgagcttgcagacgtcaagagattgttcctctttgcctagagctatgttattgtctgaagttggaattttttcattaccatatactgtcccgttttag

SEQ ID NO: 1034 - protein, 285 aa, Arabidopsis thaliana
MSRYFTSPPPVYARNWANGQNLVEWTKIERPIVDSKKLHRKEKKEKKKEKKLKKEKKSLEQKYSTTKTVSYESEQLEKSCLTEEFEQPQVGYLSDGSQNSKKRRRETSPAVVESQIKATPVAGKPLRIRIVFKKPKEAEAVPQEDPVCSTSGTQRPSELPSSVSLPSICDHDVAVPSTSLESGKVAIISESKKRKKHKPSKESRYNSLFDELVPPCISLEEDDSSSDDWLFGTSRKENVSSAKSSYKTDEDTIMSLQTSRDCSSLPRAMLLSEVGIFSLPYTVPF

SEQ ID NO: 1035 - DNA, 1011 bp, Arabidopsis thaliana
atggatctcgcgtcgaatcttggtgggaagatcgataaatccgatgttctcaccgccgtcgaaaagtatgagcaatatcatgtcttccatggaggaaacgaggaagagagaaaagccaattatactgacatggttaataagtactatgaccttgctactagcttttatgagtacggatggggagaatccttccattttgcacaaagatggaaaggagaatcgcttcgagagagtattaagcgacacgagcactttcttgctcttcagcttggcatccaaccaggacaaaaggtactggatgtaggatgtggaattggtggaccgttgagggaaattgcaagattcagcaattcagttgttaccgggctcaacaataacgaataccagatcaccagaggcaaggaactaaaccgacttgcaggtgtcgacaagacatgtaactttgtcaaggctgacttcatgaagatgccattcccggaaaacagtttcgatgcagtttatgcaatagaagcaacttgccatgcacctgatgcgtatggatgctacaaagagatctacagagtgctaaagcctgggcaatgttttgctgcctatgagtggtgtatgactgatgcatttgaccctgataacgccgaacatcagaaaataaagggagagatagagattggagatggtcttcctgacattaggctgactacaaaatgcctcgaagctctgaagcaggccggttttgaagtgatatgggaaaaggatctggccaaggactcgccggtcccatggtacttacctcttgacaaaaatcatttctcactcagtagcttccgccttacagctgttggacgattcataaccaaaaacatggtcaagatccttgaatacataagacttgcacctcaaggaagccaaagggtctcaaatttcctggagcaggctgcggaaggattagtcgacggtggaaggagagagattttcacgccaatgtatttcttcttggcccggaagccagagtaa

SEQ ID NO: 1036 - protein, 336 aa, Arabidopsis thaliana
MDLASNLGGKIDKSDVLTAVEKYEQYHVFHGGNEEERKANYTDMVNKYYDLATSFYEYGWGESFHFAQRWKGESLRESIKRHEHFLALQLGIQPGQKVLDVGCGIGGPLREIARFSNSVVTGLNNNEYQITRGKELNRLAGVDKTCNFVKADFMKMPFPENSFDAVYAIEATCHAPDAYGCYKEIYRVLKPGQCFAAYEWCMTDAFDPDNAEHQKIKGEIEIGDGLPDIRLTTKCLEALKQAGFEVIWEKDLAKDSPVPWYLPLDKNHFSLSSFRLTAVGRFITKNMVKILEYIRLAPQGSQRVSNFLEQAAEGLVDGGRREIFTPMYFFLARKPE

SEQ ID NO: 1037 - DNA, 1275 bp, Arabidopsis thaliana
atggcggcagaagagggtaaagatgaggcgggattggatcaggtggaagaagagttctctatttggaaaaggaacacaccttttctctacgatcttatgatctctcacccactagaatggccttctcttactctccactgggttccttcgacgccgattccgtactcgaaagatccttactttgccgtccataagcttatccttgggactcatacctccggtggtgcccaagattttctaatggtcgccgatgtcgttattccgacacccgacgctgaaccaggattaggtggaagagatcaggaacctatcgtccctaaggtggagattaagcagaagatacgtgttgatggagaagtgaacagagcgaggtgtatgccacaaaagccaactcttgtgggtgctaaaacaagtggctctgaggtgtttctgtttgattacgccagactctctggaaagccccaaacaagtgagtgtgatcctgatctgaggctaatgggacatgaacaagaaggttatggattggcttggagttcctttaaggagggttatcttttgagtggctcacaagatcagagaatctgcctttgggatgtctcagcgactgccactgataaagttttgaacccaatgcatgtgtatgagggacatcaaagtatcatcgaagatgtagcatggcacatgaagaatgaaaacatattcgggtctgcgggtgatgattgtcaattggtgatatgggacttacggactaaccaaatgcaacaccaagtcaaagttcacgagagagagataaactatctttctttcaatcccttcaatgaatgggtactagccacagcttcctcagactcaactgtcgccttgtttgaccttcgtaagctgactgcgccattacatgtcctgagcaaacacgagggagaagttttccaagtggagtgggatcccaaccatgaaacagtgcttgcatcttctggcgaggacagaagactcatggtctgggatatcaacagggttggggatgagcagcttgaaatagagttggatgcagaagatggtccacctgagctgctcttctctcatggaggccacaaggccaagatatcagactttgcctggaacaaggacgagccttgggtcatctcaagtgtagctgaagacaacagtcttcaagtctggcaaatggcggaaagcatctaccgcgaagatgacgaggatgaggatgatgatgatgaaggcaaccaaaatgcacaacattccaatgaaaaccagaaatga

SEQ ID NO: 1038 - protein, 424 aa, Arabidopsis thaliana
MAAEEGKDEAGLDQVEEEFSIWKRNTPFLYDLMISHPLEWPSLTLHWVPSTPIPYSKDPYFAVHKLILGTHTSGGAQDFLMVADVVIPTPDAEPGLGGRDQEPIVPKVEIKQKIRVDGEVNRARCMPQKPTLVGAKTSGSEVFLFDYARLSGKPQTSECDPDLRLMGHEQEGYGLAWSSFKEGYLLSGSQDQRICLWDVSATATDKVLNPMHVYEGHQSIIEDVAWHMKNENIFGSAGDDCQLVIWDLRTNQMQHQVKVHEREINYLSFNPFNEWVLATASSDSTVALFDLRKLTAPLHVLSKHEGEVFQVEWDPNHETVLASSGEDRRLMVWDINRVGDEQLEIELDAEDGPPELLFSHGGHKAKISDFAWNKDEPWVISSVAEDNSLQVWQMAESIYREDDEDEDDDDEGNQNAQHSNENQK

SEQ ID NO: 1039 - DNA, 15468 bp, Arabidopsis thaliana
atggctattgatgggagtttcaaccttaaacttgccttggagacgttctctgtacgttgtccaaaggtcgcagcttttccatgtttcacttcgattctcagcaagggaggagaagttgtggataacgaagaggtgattcatgctttaggggatgcgtttcttcacccggagtttacagttccgttggttcattgcttccttccaataataagaaatgttgtagatagagtggtgggtcttcttcgtctagtggatgatcttaagtcaagtattgactactcagacgatgtgtcatcagttttggataatgctatgacggaaggtattagtgtgattgatttttatgtccggcgtggacaaaggttggagcttcatgagtgtgcttgcttggccttcagtcgtgcgcttcatttcaatacgtctttgttagggtctattctaaattattttgagaaagctccaccaccatacgagcgaattcttgtgaaagatatagtttctgagtcgcgcatggaggctacagatgcgtacttgctttgtcttcgagtatcatatcgttttcttgtcattagacctgaagttttctctaagttgtgggattggtcttgttacttggactccatgaaaaggctctcagaatgtcctagacaacaaaggcatttcttggaaaagtatcgagatgctgtgtgggatgtcaattctttctctgaaccatttgaaatccactctagggtgaagaaatcttttgaaatggtctcattggctgttagtcaaaagcgacctgttcttctgtatggtccctcggggtctggaaagtctgccctcattaggaagttggctgatgaaagtggtaaccatgttgtatttatccacatggatgatcaacttgatgggaaaacattggttggcacttatgtgtgtactgatcaacctggcgaattcagatggcagcctggctcacttacccaggcgattatgaatgggttctgggtggttcttgaggacatagacaaagctccatcagatgttcccctcgtcttgtcatctttgctgggagggtcttgctcattcttgaccagtcaaggagaggagatacggatagcagaaactttccaactgttttcaactatatcgacacctgaatgcagtgtgtcacacatcagagacgctggaaattcgttgagtcctctatggaggagaattgttgtatatccaccagatcgtgagagcttgcaaagtatcctgggtgctaggtatcctaacctaggtcctgttgcagagaagcttattgaaacatttgaaaccatcaactctgctcttcgtccccaattttctagttcaacaactgaaaactcagctactttcagttctccaagtagattttcactgagagatctgctcaagtggtgtgaacgagttcatggcctgccctcctatgatggccatgcagtttatcaggaggcagcagatatattctctgcgtctaatatgtcagttaaaaaccgagtggcagtaagtgagattgtggctagtatttggaatgtcgctgttccagaatctcaggataagcccccaattcagtcacatgatcggtctaggtttgttgaaacacgcacatctacacggttacttgagaaaatagctcgctctgtcgagtacaatgagccagttctcttagtaggagaaacagggactgggaaaacgacactagttcaaaatcttgcacactggatcggacagaaactcactgttttgaatttgagccagcaaagtgatatagttgatctattgggtggttttaagcctattgatccaaagcttatgtgcacaatggtgtacaatgaattcaatgaattggcaagagatttgaagattaaggatgattcaaaaattatgaaatggctgcaagataattttagagccaagaagtggcatacatttttgactgggttattggacattattaaaggcattgaaggtagaattactgaacgcatggaaggtaaaattggggaagcaaggtctagatctggtagaaagaggaagaaaccagaagaagagctcaaaaactgtgcgtgtctgaggacgaaagtgaataagatacgacaacagatccattcaggtggaatggtttttacctttgttgaaggtgcgtttgtgactgccctcagggaggggcattgggttttactagatgaagtgaacttagccccaccagagatattgggcaggctgattggtgttcttgaaggagtgagaggatcactttgtttagctgagagaggggatgtaatgggcattcccagacatttgaatttccgtttgtttgcttgtatgaatccagccacagatgctggtaagcgagacttgccattctcattccgaagcagatttacagagtatgctgtggatgatgacatatgtgatgatgacctggagatattcgtgagacgatttttaggtggacgtggatctgacagtaagttagtagccaacattgtttggttttacaaagaagctaaaaggttatctgaagaaagcttgcaggatggtgctaatcagaagccacagtacagcttaaggtctctataccgtgcgctagaatatgcgataaaagcagaagctattggtggttttcagaaagcattatatgatggattttccatgtttttcctctccttattggatgcttccagtgctaagatcgtggaaccgataataaagcgtatctccggggaaaatatccgaagccaaccacttcaaagatacttgggagaattaaaaggcagttctgataaatttgttggcagttatgttaagacgaagagtgtaattgatcatcttaatcatttggcgcatgccatttttattaaaagatatcctgtgctcttacaaggaccaacatccagtggaaaaacaagccttgtcaaatatcttgcagcaataagtggaaacaaatttgtaagaatcaataatcatgagcagactgatatccaagagtatttaggttcctatatgactgattcttcagggaagcttgtatttcacgaaggagcgttggtgaaggctgtcaggggtgggcattggattgtcttagatgaacttaatttggctccatctgatgtcttagaggcactaaacaggctgcttgatgacaatagggagctttttgtgcctgagctgagtgaaacaatctcagcgcatcctaattttatgctcttcgctacacagaaccctcctactttatatggtggacgcaaaatactgtctcgagcttttcgcaatcggtttgtggagattcatgttgatgaaattccagaagatgaactgagtgaaattcttactacgaagtgtagtattgctaacagtcatgcttcaaaaatggttgaagtgatgaaagacctgcaacgcaataggcagagtagcaaagcttttgctggaaaacatggttatataactccaagagatttattccggtgggcctatcgtttcaggacttatgacggtacatctcatgaagaactcgccagagaagggtattacatccttgcagaaaggctgcgtgatgacactgagaaggtagttgttcaagaggtgctggagagacatttccgtgtcagtcttgccaaagatgatttgtacaatatgggattctttcctgtgagagacagatcaaaattgatcacagaatacgagaatcaagtcaaacagttggagctctctcaggcattgacgccttttggccaagatattgttatttgtggagatattagtagagctgaagtgtcgatcaaatcagtagaggtagctttggagaagtacaaaaatggttcagttataggagtggccgccacgccacaggatgttgattttcttgagaaaataaggaacaatatggtgatgctgtatcaaaaatggcgtgcaatatttgtttggcaagatgggccccttgtggaagctatgagagctggaaatatcgttcttgtggatgagatatctttggctgatgacagtgtattagaaagaatgaatagtgtgttggagacagacaggaaattgtccttagctgagaaaggtggtcccgtcttggaggaagttgtagctcatgaagacttttttgttctagccaccatgaacccgggtggtgattatggaaagaaggaattgtcacctgcgcttcgtaatcgttttactgagatatgggtccctcctattacagatactgaggagctcagaagtattgccttttctggcctgtccagtttgaaggaatctaatgttgtagatcccatcatcaacttctgggagtggttcaacaggttgcatactgggagaacgcttactgtcagagatctcctctcctgggttgcatttgtcaacatggcaactgagagtttaggaccagcatatgctattcttcatggagcatttctcgtgttacttgacggtttaagtctcggaactggtttctctggaagggatggtcaagatctgagagaaaaatgcttcgctttcctgttacaacaacttgagctttttgctagcgatacactacctttggagctttcaagaatggagctgtatggctggggtgattccaaagcaatttgtgaaaaaagtaagagtgttcgacatgagggcatgtttggcatcgatccattttttataagcaaaggtgatgaaaatcctgagattggtggattcgagtttttagcaccaactacccacaggaatgtcttgagagtattgcgtgcaatgcagctttcaaaaccaattttattagaaggtagccctggtgttggaaaaactagtctgatattggcgttgggaaaatattctggccacaaggttgtgcgcataaatctatcggagcagactgacatgatggatttgctgggatcagatttaccagttgaaagtgatgaggacatgaagtttgcttggtctgatggaattctcttgcagggtttgaatgcgattttggatcatcgtgctcaagtcttcatcccagaactgggctgtacctttgaatgccctccaacatttagagtttttgcatgtcagaatccttccactcaaggtggtggcaggaaaggtcttcccaagtctttccttaaccgattcacgaaagtttatgtggacgagttagtggaagatgattacctcttcatctgtcgctcactttacccatctgttcctagtccattgctttcaaagcttattgctctcaacagacagttacacgatggtactatgttatatcgaaagtttggtcacgatggctcaccatgggaattcaatctacgggatgtgataagatcatgccagtttatgcaagaggcgatacatgacttagaagttgaaagctttctcaatgttctgtacattcaaagaatgcgtactgcaactgaccgtaaagaagttctgcgtatctataaggctatttttgataaaaccccgtcgataaatccgtatcctcgggttcagctaaatcctgcgtacttagttgttggaactgctgccattaaacgaaatttaaatcagtctaatattgccagtgagcagttgaaacttttgcctgaaatccgtcaaaatctggaagctgttgcacattgtgtgcagaataaatggttgtgcatcctagtcggaccatcgtcatctggaaagacttcggtgatcagaatattggctcagttaacaggatatcctcttaatgaattaaatctttcgtctgcgactgacagctctgatctactcggatgctttgagcagtacaatgccttccgtaatttcagattggtgatgactcgagttgagcaccttgtcgatgagtataacagtctgctattacagtcttcccaggaggcccttttcagcaataggagtggcttagtttccagatggctttcctatttaaataagattgattcctctctcgtggagaacccattattcttcttgaacgactctgaaacactgtctacattagaagaggttgtagaagacctggaacaggtcttgaaagaaggtgttttacccgttagttggtcaaaaaagtatctggaacaaatctcgaagactatattgcagttacaaactcatgagaaaaagcagtctacaaagtttgaatgggtgacaggaatgctgataaaggcaatagaaaagggagagtgggttgtcctcaaaaatgctaatctctgtaatcccacggtacttgatagaattaactcattggtggaaccgtgtggatcaatcactataaatgaatgcgggatcgttaatggtgaacctgtcactgtggttccgcacccaaactttcgtttgttcctgtctgtaaatccaaaatttggggaagtatcaagagcaatgaggaatagaggcgttgaggtatttatgatggggccacattggcagctcaatgaggatggctcaaactgtgaagagcttgtgctgagaggtgtggaaaggtttcttgctctgtcaggtattccaggttataagctggttacttccatggccaaagcacatgttcatgcatggctaaacggtcaaagctttggtgtacggatcacgtatcttgagctcgaacagtgggttcacctcttccaattgctgctcatgaatggtaatcaacttttgtggagcttacagctaagttgggagcacatctatctctcttcgcttggggtaactgatggaaaagaagttgttgattttgtgcgtgagacatatttatcagatgttgaactttctgagcttgattcatttatgggtggggatctgtacctgcctggaggatggccaaagcctttcaacttgagagacttgacatggtactcaagagaaacaacagtaagacagaattgcatgtatctggagttcctaggagctcagtatgcctcacatcagcctaaaataagcgacaatgtcaaatcaagagatagggagttggctgctggggaaccaagaattatttattctattgattcttggacgcttaaaaaagtcttgtttcctaaagccttaattgggtcaagctgtgcaccagatgcagcaaattttgaaaatgatttggcttcaaaaatgctattgtttgctgccaactggacaatagaacaggcaaccgaagaggatattcaactctatcttgcgtggtttagttggtttggttctagactgcaacaacactgtccgtttctgctttgttttctcaatacgttgaaggttgagtttgagcatccaatttggaatcatatatctagatgtcggaaaaatctgaaattcctctgcagattggatccagatgctgttccaattcctatgctgtcctccaaattgattgatgtagccgcatcaaatgaccagtccaaaccttacagtaaatccctctttgagtctctcaactctgttggcgttcttcgtcgttcgtatcagcagtggcttgtagagagcaacgacaaccacacagatgtatccacttttactcggtttttggattcgcttcgcgtattggagaagaaaattctttgcgaaattgttggagcaccatctttcagtgtgttgattcagttgtacaccgaagttattgacaaccattcattcttttggtctggtttggtctcttcttcagatgagtatctattgttttccttttggtcactgataaaatctatcaaaaagatgcacagttttttccctggagaagttcaggtggttctggaggaaagcaaaaatattaacaacatagttttgcatggtcaccctgaaaagtctatgctgtgggcttatgggggacatccttccttgccggtatctgcagagctgttccacaagcagcaagagtttctacagctgtgcagcacagtttggccattgaaatcagaatcagatgaacacggaaatgatcatcttaccaaagccattccattttctggccctgaattatgtttgcttgccttggaaggtctttgcatttcatcatacattgctgacgaagacgatgtagattatgtagctgctgttcagctggatgagatctaccagacttttttggagaggctgaaactagagaagaagagactggaggataaaatgggtttcagtgagattgacaatactgaaaatataactgcttcctgctgcgtgttctgtccagagattgtgactacagggtctggatttagcagttgggtgaagacatgttttattgctagcagtgaaagttgttctctagacgtagagttacttgctgcacttcagcacctcttggttgctcgacctactgaacatcaggatcttgtggacattcgaaaactgctcaaaccggctctagaatattctttatcctcaaccaggcctccacagactcttgtagctcatcaaaaactcctgtgggcaattgatgcacatgcctctgaactaggagtggacaccaaaattgctggttttgctctcgagatttggtactggtggcattctgtattgtggaaaaatagtcaaattggtctcatgattgcgcatttagtaacatctttctttcatctcatgttcacggggcctacagaatatctcagacactggcaactgtcagattctgtcaccttctatgctgattcagcctgtgaaaacagctaccgttgctcagattctataatatatacgcaccaaaagtcatttgagtcagaaacgtttgtggcaattaagtctgtatttcatgcaattgagaaaaagcagaacaagatggatggaatacagaatcttatctcactgattggctcatcaagccataataaattgaaatccgttactcactcatttgtcggaccattagcaaaacgtctttattccgatagctcatcaaatgaattctactgcaatcttggcttggcgtggctttatcttggaggactacgcttccatcttttgaatagcttagatgttatagatccagccatgaagatcacttgcaagctgttaaagctagaagagaaaatctcatcacttgagctaaacatcaaggtccggggagaatgtgggtatctgtctggattgctttactctggaaacaatgacgaaagcagtgaacatacattatctaagctcaaaactgagcataaaagattgcaaagaaaggttatttttagatctgatccaaaaaagtaccaggatttacgaagggcgctggatgaatttgctggatttctcacacgtcccataagtctggtcaacgatattgaagtgcttgattggaatcaggttgttgagcaggttttcaactggcaggagacagcaatatcttttattgatcggatgtcaagtgactattctgaatatgtcgatataactcagccaattcaagtttcagtgtacgagatgaaattgggtttatcactctttgtatctggtgctctcttgggaaaacttctcaacagatttgacatagacatggttgactcagtcatggaaacaatttatgccttaatgagatttccaagggactcgtcgatagcttcaactacctacaccgaatgtttgccacctttgcacctttcccatggtgcaaattctcgtgctaagtccttaggtttggatgttggcttgttgcacaaacttatctctgtttcaagtgcagaagattcgagaaaagcctcagagttgcaactcaaagttgctctttataaaaatctccatgctcgtgttttacaatttgtcgcaaatactgggctactggatgaagcttcttttgagttattggacaagatatatgttgaattggcgagaatttggatggagatgaagtttcaagccaaaacaaaggctgacaatcttcctgggctgtacaaatttcgttcccgggacttcaaaattgatagtgtcatggaagtagatatatctgcccttggcaagtatttcccaaacgaaagtttctctgagtggcaagagtatctggctgatgatgatacgaagaatgtgaaagatatgacacatattgaccaggatgaggaaaatttggaggatgattgggacttgatacaggagcatctggatagtatatatagcacacataatgagttatttggtttctgtgacctctctgaaaagacaatttattctattcagtctggaagattctgtattactgacagtagaagactggattcgttcactgattcctatgaacttggagtcagtatgatcaaagggctaaggggtttatttacatcgagcttggatgcaaaacttgttccagaacacctacttcgtctttgcctggaaaacaaaaaaaacttcacttcaaactatcagtcagccagtaaatataacttttacaaggatttggatggtcctgagctggggaaaatggtcaagtttctcactcctcttcaacaaagaattaattctctattgcaagaacgggaggaccatcctggtcttcagaaactttctggtgtacttcagatgctcttggctattccctccagtactcctctcgcaaaggctctctcaggattgcaatttctgctctgcaaggttcacaagttacaggaagagggatgtaaattgcccatctctgatcttttggagccaattatttccctagcaagctcttggcagaaggtggaatttgagcgctggcctactttgcttgatgaggttcaggatcagtatgaactaaacgctaggaagttctgtttcagaaggatgctgtggaaatttcagaacatgaaaacgagtccatttcacaaagtatcattcttgaaggatttaaagggccttcagcattatatacttaagtcttcacagttgattgctcctccgctgtttttacagttgacttctaacttgactgtctttgactcccgcttttactttgacagtgattcacacaagaggagggtggaaatgtgctacaatatttttggattctatattcaatttctaccggttgtaatggagcagttagatttgaatagaaaaaatgttgaaactgagttaaaggaggttcttaaactttgtcggtgggagaggccagataattatttgtacaatgagaccactaaaaggaccaggcaaaaggtcaagaaactgatacagaagtttacggacatgctacgcctccctgtaatgcttgttaagccagacctgacgaaggaacgagctcaatttctccctctactagatccagatcttatggatggagcatccgacatgaggatcgaggtcctagttagtgctttagatgcagagcaattgagggacaggtcttcatggtatgttgtctggtggaataaattaaaggaatcggtaggacgctttcaccaagaaatgcactataaaacattgctgatgggtgcagagcatcagtattcgtcccctgtctatcagggtgattggaaaaatttgtggagtacggttgctaggattggtgaaaccatagctggctgttcagatctatggagaaacagtgatagagatgttgcaaagaagagggccctgtttgaacttctcaagttattagaaagtagtggtttgcagaaacacaagtttgaaaatatagagatgtcaaatcactttaaagggttgctttatcagccagcatacgatccaaagcatctgttactgctaacacataccaaaagtaacatacatccttccatgggtgtagaagatcaaaacaaggaaaattcactagttgagtggagagtggcaaatgagttttactttaagagcttggcttcagtgcaactcatgttaaatattgaccgaaaacactccgatgtaacagctgagcaggttaaacgggcaatctcatttctcaatcatcttgtggaaatacaacggcaacaaaggaaatctgcgtatgcctttgccgaacttttcaaccgctttcgccaatgtgttttatctctagcgagattactgggtgattcagttggtgcggatagaaaggatgattctgtgttcagtttcccccaaaatcaacatgctgtcttcaattgcttgtggctacagaagcaactctttgataacattactgcaatgcttcttgaggagtcggccttactgagaacagttggaagtacacacttggattcctgtcaagctgtgaaaacctcatcacggagtttgctcagctttattgaaatactaattcccatcgctcaaaattccaaggcttcgctggataggcttctacttgattgcaacggttttatcatcacaccaagtagcagtcttaagcagtttgtcactcagcatatggttcaggtgctacgccagaactttgatcaacttacggaccttgagaaccaaatttcaagtttctgtgaaaacaatgagaaaagctattgcagagacgttcttctcagtcaattttcccctgtgtttaaagaggggaaattgttggctgaaaatctgaactgcttacttaacgtgagagaccagtcaactggaatggaacccaaggaacgactatttcttgaagaaaatcttgcaagtatatttgcaaatgttaaggatgtgattggaaagctttgctcttataaagatggaagtctttctcaagaagaggaaatgaatattactacatgggatggtctgtttaagaaggcagaaaatgacttgaaccttgataacctgtgtaaactcctgtccgaatcatttggttccattgaacaactgttgaactcatcaggcgtcctttcagctggtgttggagaccagttgaagcaacttcaagcatttttggatcttttattgagctttggggattgttaccttaaagagtttttggcgataagcaaaacggtttcactgataacccatgtccttgcaagtgttcttgccgatctatttacaaaaggatttggcatctccaaaaatgaagaagatgatgactctaaagttgacaaatcggaagctgcagaaggtactggtatgggagatggtgtgggggcaaaagatgtaagtgaccaaatagaagatgaagaccaactgcatggcacagataagaaggaagaggaagagaaagagcaagatgatgtgctgggtaaaaacaaaggcattgagatgagtgacgaatttgatggcaaagaatacagcgttagtgaggatgaagaagaagacaaggaagacgaaggaagtgaggatgagccgttggataatggaataggagatgtgggatctgatgccgaaaaagccgatgaaaagccatggaacaaggatgaagaagatgaggaagaaaatatgaatgagaagaatgaatctggaccatctatagtcgacaaggacacaagatcaagggagctaagagccaaggatgatggtgttgaaactgctgatgagcctgaggagtccaatacttctgacaaaccggaagaaggaaacgatgagaatgtggagcaggatgattttgatgatacagataatttagaagaaaaaatccagaccaaggaagaagcacttggtggactaactcctgatgtcgataatgaacaaattgatgatgacatggagatggacaaaacagaggaggtcgaaaaggaagatgcaaatcagcaggaagaaccttgttcagaagatcaaaagcatcctgaagaaggtgaaaatgatcaagaagaaactcaagagccatctgaggaaaatatggaggctgaggctgaagataggtgtggatcaccccaaaaagaagaacctggaaatgatcttgaacaggaaccagaaacggaaccaatagaaggaaaagaagttatgtcagaagacatgatgaaaccgaacttccgtaatgataatatttctggcgtagagtctggttcacaaaatccccatgggtctaatgtgctgggtgcaggaagtacagcaccacaagaaaatttgtctgctactgatgttacggatgaactcactgattcaatggatctgccttcgagtagtaacacggaaatgaacctcatgatgaccaacatggccaacggtgagacattgacagacaacttaccaaagatggaatttcctcaaaaccagtcatctactgctcaacaaaccaaggtcaatccttataggaacgttggtgatgccttgaaggagtggaaagaaagagttagaatctcctctgaccttggagaaaagcaagaggctgaaaatgagatggaagaccctgatgctagtgaatatggatttgcttctcagtttgatgcaggaacttcccaagctctaggacctgcgttgcctgagcaagtgaacacagatatgagagaaggggaatccgaagaagaaaaacttgcaggtaatcaggatgatgtctctccaatggatattgatgacttgaacccagaaaacaaacctgctgtccaatccaaaccatcgatcagtaatagcatcgcggaacaggtccaagaaccagatacagataggacccaccaagagaactctcctattcataattttggtgatggtaacagtaggatggactctatggtctctgtcgacaatactttcttgggggaagaggcatgtaatctggaccggatgcaagtgactgataatgactcggaaagcaatcaggataatcaggaagatccagatgccagaagcaatgctgttgttctttggaggagatgtgaattgcttactgcaaaaccgtctcaggagctggctgagcaactacgtcttatcttagaacccacgcttgctagcaagctcagtggtgactacagaacgggtaaaaggatcaacatgaagaaggttattccatacatagcaagtcactatcggaaagataaaatttggttgaggaggacaaaaccaaacaagcgtgattaccaagttgttatcgctgtggatgactcgcgtagcatgtcagaaagtggatgtggtgattttgcaattagagctttggcaacggtatgccgagctatgtcacagcttgagctgggaagtttggctgtggcaagtttcgggaagcaagggagcataaagatgttacatgattttggtcagtctttcaccacagaatccggcattaagatgatctcaaatttgacatttaaacaagaaaatctcattgaagatcaaccagtcgtcaatctgctgagaaacatgaatgaaatgctagagaatttggccagcacaagacgacagtcttacgggagcaacccgcttcaacaacttgtactaatcatcggcgatgggaagttccatgagcgagagaagttgaaacgaactgttagaagctttctccagcaaaaacgtatggtggtatatctgcttctcgatgacgcagagcaatctgtttttgatttagcggactatgtatatgatggtgaaaggagaccttataagaaaatgaattacttggattccttccccttcccatactacattgtgctaagagacatcgaagccttacccagaacacttggtgatgtgttgagacagtggttcgagctgatgcaaagctcgcgggactga

SEQ ID NO: 1040 - protein, 5155 aa, Arabidopsis thaliana
MAIDGSFNLKLALETFSVRCPKVAAFPCFTSILSKGGEVVDNEEVIHALGDAFLHPEFTVPLVHCFLPIIRNVVDRVVGLLRLVDDLKSSIDYSDDVSSVLDNAMTEGISVIDFYVRRGQRLELHECACLAFSRALHFNTSLLGSILNYFEKAPPPYERILVKDIVSESRMEATDAYLLCLRVSYRFLVIRPEVFSKLWDWSCYLDSMKRLSECPRQQRHFLEKYRDAVWDVNSFSEPFEIHSRVKKSFEMVSLAVSQKRPVLLYGPSGSGKSALIRKLADESGNHVVFIHMDDQLDGKTLVGTYVCTDQPGEFRWQPGSLTQAIMNGFWVVLEDIDKAPSDVPLVLSSLLGGSCSFLTSQGEEIRIAETFQLFSTISTPECSVSHIRDAGNSLSPLWRRIVVYPPDRESLQSILGARYPNLGPVAEKLIETFETINSALRPQFSSSTTENSATFSSPSRFSLRDLLKWCERVHGLPSYDGHAVYQEAADIFSASNMSVKNRVAVSEIVASIWNVAVPESQDKPPIQSHDRSRFVETRTSTRLLEKIARSVEYNEPVLLVGETGTGKTTLVQNLAHWIGQKLTVLNLSQQSDIVDLLGGFKPIDPKLMCTMVYNEFNELARDLKIKDDSKIMKWLQDNFRAKKWHTFLTGLLDIIKGIEGRITERMEGKIGEARSRSGRKRKKPEEELKNCACLRTKVNKIRQQIHSGGMVFTFVEGAFVTALREGHWVLLDEVNLAPPEILGRLIGVLEGVRGSLCLAERGDVMGIPRHLNFRLFACMNPATDAGKRDLPFSFRSRFTEYAVDDDICDDDLEIFVRRFLGGRGSDSKLVANIVWFYKEAKRLSEESLQDGANQKPQYSLRSLYRALEYAIKAEAIGGFQKALYDGFSMFFLSLLDASSAKIVEPIIKRISGENIRSQPLQRYLGELKGSSDKFVGSYVKTKSVIDHLNHLAHAIFIKRYPVLLQGPTSSGKTSLVKYLAAISGNKFVRINNHEQTDIQEYLGSYMTDSSGKLVFHEGALVKAVRGGHWIVLDELNLAPSDVLEALNRLLDDNRELFVPELSETISAHPNFMLFATQNPPTLYGGRKILSRAFRNRFVEIHVDEIPEDELSEILTTKCSIANSHASKMVEVMKDLQRNRQSSKAFAGKHGYITPRDLFRWAYRFRTYDGTSHEELAREGYYILAERLRDDTEKVVVQEVLERHFRVSLAKDDLYNMGFFPVRDRSKLITEYENQVKQLELSQALTPFGQDIVICGDISRAEVSIKSVEVALEKYKNGSVIGVAATPQDVDFLEKIRNNMVMLYQKWRAIFVWQDGPLVEAMRAGNIVLVDEISLADDSVLERMNSVLETDRKLSLAEKGGPVLEEVVAHEDFFVLATMNPGGDYGKKELSPALRNRFTEIWVPPITDTEELRSIAFSGLSSLKESNVVDPIINFWEWFNRLHTGRTLTVRDLLSWVAFVNMATESLGPAYAILHGAFLVLLDGLSLGTGFSGRDGQDLREKCFAFLLQQLELFASDTLPLELSRMELYGWGDSKAICEKSKSVRHEGMFGIDPFFISKGDENPEIGGFEFLAPTTHRNVLRVLRAMQLSKPILLEGSPGVGKTSLILALGKYSGHKVVRINLSEQTDMMDLLGSDLPVESDEDMKFAWSDGILLQGLNAILDHRAQVFIPELGCTFECPPTFRVFACQNPSTQGGGRKGLPKSFLNRFTKVYVDELVEDDYLFICRSLYPSVPSPLLSKLIALNRQLHDGTMLYRKFGHDGSPWEFNLRDVIRSCQFMQEAIHDLEVESFLNVLYIQRMRTATDRKEVLRIYKAIFDKTPSINPYPRVQLNPAYLVVGTAAIKRNLNQSNIASEQLKLLPEIRQNLEAVAHCVQNKWLCILVGPSSSGKTSVIRILAQLTGYPLNELNLSSATDSSDLLGCFEQYNAFRNFRLVMTRVEHLVDEYNSLLLQSSQEALFSNRSGLVSRWLSYLNKIDSSLVENPLFFLNDSETLSTLEEVVEDLEQVLKEGVLPVSWSKKYLEQISKTILQLQTHEKKQSTKFEWVTGMLIKAIEKGEWVVLKNANLCNPTVLDRINSLVEPCGSITINECGIVNGEPVTVVPHPNFRLFLSVNPKFGEVSRAMRNRGVEVFMMGPHWQLNEDGSNCEELVLRGVERFLALSGIPGYKLVTSMAKAHVHAWLNGQSFGVRITYLELEQWVHLFQLLLMNGNQLLWSLQLSWEHIYLSSLGVTDGKEVVDFVRETYLSDVELSELDSFMGGDLYLPGGWPKPFNLRDLTWYSRETTVRQNCMYLEFLGAQYASHQPKISDNVKSRDRELAAGEPRIIYSIDSWTLKKVLFPKALIGSSCAPDAANFENDLASKMLLFAANWTIEQATEEDIQLYLAWFSWFGSRLQQHCPFLLCFLNTLKVEFEHPIWNHISRCRKNLKFLCRLDPDAVPIPMLSSKLIDVAASNDQSKPYSKSLFESLNSVGVLRRSYQQWLVESNDNHTDVSTFTRFLDSLRVLEKKILCEIVGAPSFSVLIQLYTEVIDNHSFFWSGLVSSSDEYLLFSFWSLIKSIKKMHSFFPGEVQVVLEESKNINNIVLHGHPEKSMLWAYGGHPSLPVSAELFHKQQEFLQLCSTVWPLKSESDEHGNDHLTKAIPFSGPELCLLALEGLCISSYIADEDDVDYVAAVQLDEIYQTFLERLKLEKKRLEDKMGFSEIDNTENITASCCVFCPEIVTTGSGFSSWVKTCFIASSESCSLDVELLAALQHLLVARPTEHQDLVDIRKLLKPALEYSLSSTRPPQTLVAHQKLLWAIDAHASELGVDTKIAGFALEIWYWWHSVLWKNSQIGLMIAHLVTSFFHLMFTGPTEYLRHWQLSDSVTFYADSACENSYRCSDSIIYTHQKSFESETFVAIKSVFHAIEKKQNKMDGIQNLISLIGSSSHNKLKSVTHSFVGPLAKRLYSDSSSNEFYCNLGLAWLYLGGLRFHLLNSLDVIDPAMKITCKLLKLEEKISSLELNIKVRGECGYLSGLLYSGNNDESSEHTLSKLKTEHKRLQRKVIFRSDPKKYQDLRRALDEFAGFLTRPISLVNDIEVLDWNQVVEQVFNWQETAISFIDRMSSDYSEYVDITQPIQVSVYEMKLGLSLFVSGALLGKLLNRFDIDMVDSVMETIYALMRFPRDSSIASTTYTECLPPLHLSHGANSRAKSLGLDVGLLHKLISVSSAEDSRKASELQLKVALYKNLHARVLQFVANTGLLDEASFELLDKIYVELARIWMEMKFQAKTKADNLPGLYKFRSRDFKIDSVMEVDISALGKYFPNESFSEWQEYLADDDTKNVKDMTHIDQDEENLEDDWDLIQEHLDSIYSTHNELFGFCDLSEKTIYSIQSGRFCITDSRRLDSFTDSYELGVSMIKGLRGLFTSSLDAKLVPEHLLRLCLENKKNFTSNYQSASKYNFYKDLDGPELGKMVKFLTPLQQRINSLLQEREDHPGLQKLSGVLQMLLAIPSSTPLAKALSGLQFLLCKVHKLQEEGCKLPISDLLEPIISLASSWQKVEFERWPTLLDEVQDQYELNARKFCFRRMLWKFQNMKTSPFHKVSFLKDLKGLQHYILKSSQLIAPPLFLQLTSNLTVFDSRFYFDSDSHKRRVEMCYNIFGFYIQFLPVVMEQLDLNRKNVETELKEVLKLCRWERPDNYLYNETTKRTRQKVKKLIQKFTDMLRLPVMLVKPDLTKERAQFLPLLDPDLMDGASDMRIEVLVSALDAEQLRDRSSWYVVWWNKLKESVGRFHQEMHYKTLLMGAEHQYSSPVYQGDWKNLWSTVARIGETIAGCSDLWRNSDRDVAKKRALFELLKLLESSGLQKHKFENIEMSNHFKGLLYQPAYDPKHLLLLTHTKSNIHPSMGVEDQNKENSLVEWRVANEFYFKSLASVQLMLNIDRKHSDVTAEQVKRAISFLNHLVEIQRQQRKSAYAFAELFNRFRQCVLSLARLLGDSVGADRKDDSVFSFPQNQHAVFNCLWLQKQLFDNITAMLLEESALLRTVGSTHLDSCQAVKTSSRSLLSFIEILIPIAQNSKASLDRLLLDCNGFIITPSSSLKQFVTQHMVQVLRQNFDQLTDLENQISSFCENNEKSYCRDVLLSQFSPVFKEGKLLAENLNCLLNVRDQSTGMEPKERLFLEENLASIFANVKDVIGKLCSYKDGSLSQEEEMNITTWDGLFKKAENDLNLDNLCKLLSESFGSIEQLLNSSGVLSAGVGDQLKQLQAFLDLLLSFGDCYLKEFLAISKTVSLITHVLASVLADLFTKGFGISKNEEDDDSKVDKSEAAEGTGMGDGVGAKDVSDQIEDEDQLHGTDKKEEEEKEQDDVLGKNKGIEMSDEFDGKEYSVSEDEEEDKEDEGSEDEPLDNGIGDVGSDAEKADEKPWNKDEEDEEENMNEKNESGPSIVDKDTRSRELRAKDDGVETADEPEESNTSDKPEEGNDENVEQDDFDDTDNLEEKIQTKEEALGGLTPDVDNEQIDDDMEMDKTEEVEKEDANQQEEPCSEDQKHPEEGENDQEETQEPSEENMEAEAEDRCGSPQKEEPGNDLEQEPETEPIEGKEVMSEDMMKPNFRNDNISGVESGSQNPHGSNVLGAGSTAPQENLSATDVTDELTDSMDLPSSSNTEMNLMMTNMANGETLTDNLPKMEFPQNQSSTAQQTKVNPYRNVGDALKEWKERVRISSDLGEKQEAENEMEDPDASEYGFASQFDAGTSQALGPALPEQVNTDMREGESEEEKLAGNQDDVSPMDIDDLNPENKPAVQSKPSISNSIAEQVQEPDTDRTHQENSPIHNFGDGNSRMDSMVSVDNTFLGEEACNLDRMQVTDNDSESNQDNQEDPDARSNAVVLWRRCELLTAKPSQELAEQLRLILEPTLASKLSGDYRTGKRINMKKVIPYIASHYRKDKIWLRRTKPNKRDYQVVIAVDDSRSMSESGCGDFAIRALATVCRAMSQLELGSLAVASFGKQGSIKMLHDFGQSFTTESGIKMISNLTFKQENLIEDQPVVNLLRNMNEMLENLASTRRQSYGSNPLQQLVLIIGDGKFHEREKLKRTVRSFLQQKRMVVYLLLDDAEQSVFDLADYVYDGERRPYKKMNYLDSFPFPYYIVLRDIEALPRTLGDVLRQWFELMQSSRD

SEQ ID NO: 1041 - DNA, 396 bp, Arabidopsis thaliana
atggagtcttcttcttcactaaaaggttctgcacttgggaagcttgtggtgacctctggtctcttacatagctcatggagtaagatcttggagatacataacccaccttattcgaatcatgatccaggtctacaagtttcaaaaaaaaaaaaagattcaggtctagaatttcagattcaccgagaagagaaattcacacttgtggtttttagcgcaccaccgatctgcagaagtagtagctctgattctactcttcttcatgtgaaagataaagaaaatcctttcccattcctctgctccgagaacaacccatcattctctcttcacacacctgcttttaacctttttacctctgcttctactagtctcacttacctcaaatcagaggtaatttaa

SEQ ID NO: 1042 - protein, 131 aa, Arabidopsis thaliana
MESSSSLKGSALGKLVVTSGLLHSSWSKILEIHNPPYSNHDPGLQVSKKKKDSGLEFQIHREEKFTLVVFSAPPICRSSSSDSTLLHVKDKENPFPFLCSENNPSFSLHTPAFNLFTSASTSLTYLKSEVI

SEQ ID NO: 1043 - DNA, 1503 bp, Arabidopsis thaliana
atggtgatcttatctctcgtctcttgttccttctccgttttctcaccgccgattagtctccggcttcatctcccgccggtaacttctctctgctcccatggaaccttccctgcttcttctacatttcggtctcagctacaaccattgcttatcagctgcttaaatcatcgagaacctgctttaactttccgatgtagctgccttagctctccgattgaatccggaagtcaaattgaatctctgttttcgttattccgagatattgggtttatagaagaagaaactgagatgattttagcgaagaacccagatataaagtcgacatctttggataaaatcggtgctcgtgttgcttctcttcagtctctgaaaatcaatggcttcccgcttcagggtttgatagctaagtgccctaatttattgacttcagaagaatttgatctcgttattagtttcttagttgatgaacttgaaggaaggcttgatcctgaattagttgagcgcttactctctgtggtagacacatctatcttgcttagttttaatcagaaggtgagattgcttctcctccatgggatacctaaagaaaagatctctcatgtattgaacaaagtgtacctaaataaattgctgtatcagaaatcagttgaagatattgagagattgattagtttcttggaaccttttggtggaattggtataattgctaggcggccagtgattctcaatagtgacttggatagtcagttgattcctagggttgatttcattaggaatctaagcggggaagacgatttcgctactggaacggtgctacgtagacttcctgccatattgagttatagtgttgagcatatgaacggccaagtagagtttctcaagtcttttgctggcttgacgagtgagcaagtgtttaagattgttcatgtgttccctaatgttatcagcactagtaaagagaggaaactgcgcccgaggatagagtttctgaaggaatgcggctttgattcccccggcatgttcaaattcttgagtaaagcaccattgattttagctctatccgaaaataatctctcgcacaaactcggttttctggtgaagattggatataagcatagaacaaaggaactggcctttgcgatgggagctgtgaccagaacaagctctgacaatatgcagagggttattggactgtacttgagttatggtctttcattcgaagacattctagcaatgagcacaaaacatcctcaagtcctgcagtataattatacttctttagaggaaaaactggagtatttgatcgagtacatgggtcgtgaagtcgaagaacttcttgcattccctgcatttcttggatacaagcttgatagcaggatcaagcatcggtatgaagaaaagttgaagagcagaggtgagaacatgtctcttaacaagcttttgacagtatcagctgaaagattctctaaggcggctgataatatcgaaatgatttgtttatga

SEQ ID NO: 1044 - protein, 500 aa, Arabidopsis thaliana
MVILSLVSCSFSVFSPPISLRLHLPPVTSLCSHGTFPASSTFRSQLQPLLISCLNHREPALTFRCSCLSSPIESGSQIESLFSLFRDIGFIEEETEMILAKNPDIKSTSLDKIGARVASLQSLKINGFPLQGLIAKCPNLLTSEEFDLVISFLVDELEGRLDPELVERLLSVVDTSILLSFNQKVRLLLLHGIPKEKISHVLNKVYLNKLLYQKSVEDIERLISFLEPFGGIGIIARRPVILNSDLDSQLIPRVDFIRNLSGEDDFATGTVLRRLPAILSYSVEHMNGQVEFLKSFAGLTSEQVFKIVHVFPNVISTSKERKLRPRIEFLKECGFDSPGMFKFLSKAPLILALSENNLSHKLGFLVKIGYKHRTKELAFAMGAVTRTSSDNMQRVIGLYLSYGLSFEDILAMSTKHPQVLQYNYTSLEEKLEYLIEYMGREVEELLAFPAFLGYKLDSRIKHRYEEKLKSRGENMSLNKLLTVSAERFSKAADNIEMICL

SEQ ID NO: 1045 - DNA, 2931 bp, Arabidopsis thaliana
atgtctgagtcgttgcttcgtattgatcacgccggcttagacaccctaattccgggaatgatgtgcagtcacagagtttggacacactcagaactagctcctccttcagtgagcgtgaatgaatcccatctggtgaaaggtctcttacaagctttgcaaggtttctctagtcccttcattttctgggaccgaaaggaacaaactttccgcgctaaaagtgagatacgagtttctcatttgtctcagtcaagccttcatgtccttctcgctggatttttgtatgctgctacatgtttgaagcttgtggagtctattgttagtggaattaatgcctctcttaaatctcctcctactttaatggcattttcgaactctgcctctggttggcttgaggcaaatattgctttgaatgaggaagtgaagatcaacgattctaatgttgctgttactccaactcttttgggattaactagttctttatctagtctgtgttcagatgctgaataccttttccaagttgtacgaggtgcgatccctcatgcgtattttgagtcgagttcggctatttcaacagctgaaattgctgtgcacgttcttgattacctttacaagaggctagatgaagtatgtcttgtacaaggtggtgagcttgtggccgtggaaggatttcacatgttattgcaaatctttgctggaagtttattgccatatgtagagagtttggattcatggttgtttgagggaactcttgatgatccttttgaagagttgttctttacagccaaccaatcggtctcggttagcgatgcagagttttgggagaaaagctatctgttgacgagggtgctgggtccaaaatcaaatgtaacttcgctaaatcaaaagaaagggatgagtggaaatgactccaattcagtttctgacaaagacaaagagcagaacaatcgggtgttatgcccactgttcataaaagacatatgtaagtcgattgtttctgctggaaagtcactgcagctgatgcagcatattccttctacgtcttcagaaaattgtgaaaagattcagtaccatgggcgaaatggttttgggaattctggctgtggcatactcctggctggaaagaatagctttagaagcattgcagacttatccttgtctgaaatattctgtctatcacttgctggcctcataggccatggtgatcatgtatctagatatctgtggaaagatgagacagatgagtgggagatttctcctactttagcatcatatataagtggtaagctagtgaatggcacaggtgatcttctcacatactcagagcgaatgtggtataagttgttggttggtgctgtgcaagagaaaaaatctatagaagccaaatcagaactccagagtccatgttgtgttacttgtgttaaagaagaaaaaaatgttctcgctgccgaaaaggtgttgcaggggttgttttgtcatgaaaaccttgttgtttcagcatctaaaatggatcttgagaggaataaaaatgcctggcatgtcttgaacttatcagagaactattgtctaccctctctaaatgataagagtttgttgagtgctgtttttgagggatctggcgttgcaccaaaatttgtcggaacaaactacaaatatggattccaattcggtagatctgaatatctttcttctcaagatgacaccaaaattctagaaacgttatttccttttcctacattgctgccgtcattccagtcgaagctccatatgtcagaattcctaccttaccaaaagaatagtacacttccttcaagagttctcagctggatacttaggacagagccaaggaatactctacttcctgttgtaataatgcaagaatgcttcacaatcaacatcaggaggcaggtggacaacattagcaaagtgattttttcaaaactaatgaatgaatggaaattgatgcacgaacttgcggtgttgcgtgccatttatttgttaggttcaggggaccttctgcagcattttttgactgtcatatttgataggctgggcaagggagagtcatcaaatgatgattttgagttgaacataatcattcaggaatcaattagaaattcagctgataccatgttgttaagcagtcctgatgcattggtggtatctatttccagtgaagggtgtttggacagagacaaagatgacaagggcgacgtaaaatccctttcttcacctcgtgaaagcagcgttaacaattatgcgatagattgccttgaatctctcaaattcacatacaaggtgccgtggccgcttgagcttattgcgaacagcgaggccattaagaagtataaccaggtcaagcgagcaaaatatgtgcttgataaggcacgaaggttgatgtggaagggtaaaggctctgcaacaaaaatccgcaagcaccactgtttactggaacaaaagctcctcaattttgtggatgcttttcatcaatacgtaatggatagggtatatcacactgcttggcgtgagctgtgcgaagctatggtaaaagcagggtctctagatgaggtcatagatgtacacgagacgtacttgttatcgattcagaggcaatgttttgtggttcaagaaaagctgtgggcaatcatcgcaagtcggatcaacatgattctcggtttagctctagaattctactcaatacaacagacgctgagcagcggtggagcagtttcagctatcaaggctagatgggagatggagatagaccgcatcgagaaacaattcgaggactgtattgctttcctccttagagtattgacttcgaagaagaatgtgggacacttccctcatctggctgatttggtgaccagaatcaattacaattatcactacatgtctgacactggaagctcgatgactgcttctggatcatag

SEQ ID NO: 1046 - protein, 976 aa, Arabidopsis thaliana
MSESLLRIDHAGLDTLIPGMMCSHRVWTHSELAPPSVSVNESHLVKGLLQALQGFSSPFIFWDRKEQTFRAKSEIRVSHLSQSSLHVLLAGFLYAATCLKLVESIVSGINASLKSPPTLMAFSNSASGWLEANIALNEEVKINDSNVAVTPTLLGLTSSLSSLCSDAEYLFQVVRGAIPHAYFESSSAISTAEIAVHVLDYLYKRLDEVCLVQGGELVAVEGFHMLLQIFAGSLLPYVESLDSWLFEGTLDDPFEELFFTANQSVSVSDAEFWEKSYLLTRVLGPKSNVTSLNQKKGMSGNDSNSVSDKDKEQNNRVLCPLFIKDICKSIVSAGKSLQLMQHIPSTSSENCEKIQYHGRNGFGNSGCGILLAGKNSFRSIADLSLSEIFCLSLAGLIGHGDHVSRYLWKDETDEWEISPTLASYISGKLVNGTGDLLTYSERMWYKLLVGAVQEKKSIEAKSELQSPCCVTCVKEEKNVLAAEKVLQGLFCHENLVVSASKMDLERNKNAWHVLNLSENYCLPSLNDKSLLSAVFEGSGVAPKFVGTNYKYGFQFGRSEYLSSQDDTKILETLFPFPTLLPSFQSKLHMSEFLPYQKNSTLPSRVLSWILRTEPRNTLLPVVIMQECFTINIRRQVDNISKVIFSKLMNEWKLMHELAVLRAIYLLGSGDLLQHFLTVIFDRLGKGESSNDDFELNIIIQESIRNSADTMLLSSPDALVVSISSEGCLDRDKDDKGDVKSLSSPRESSVNNYAIDCLESLKFTYKVPWPLELIANSEAIKKYNQVKRAKYVLDKARRLMWKGKGSATKIRKHHCLLEQKLLNFVDAFHQYVMDRVYHTAWRELCEAMVKAGSLDEVIDVHETYLLSIQRQCFVVQEKLWAIIASRINMILGLALEFYSIQQTLSSGGAVSAIKARWEMEIDRIEKQFEDCIAFLLRVLTSKKNVGHFPHLADLVTRINYNYHYMSDTGSSMTASGS

SEQ ID NO: 1047 - DNA, 1572 bp, Arabidopsis thaliana
atgggtgtctgtttctccgccattagagtcactggtgctagcagcagtagacgaagcagtcagaccaaatccaaggctgctcctactcccatcgataccaaggcctctaccaaacgccgaaccggctccatcccctgcggcaagcgtaccgattttggctactccaaagacttccacgatcactacaccatcggcaagttgctcggccatggtcaattcggctacacctacgtcgccatccacagacccaatggagatcgcgtcgccgtcaaaagactcgataagtctaagatggttcttcctattgctgttgaggatgtcaagcgtgaggttcagattcttattgctctctctggccacgagaatgttgttcagtttcacaatgcctttgaggatgacgattacgtctatattgttatggagttgtgcgaaggaggcgaattgctggataggatattatccaagaaaggtaatcggtactccgagaaagatgcagccgttgtcgttaggcagatgctcaaagttgcaggagaatgtcatctacacggtcttgtacatagagatatgaaaccagagaactttttgttcaaatcagctcaactagattcgcctctaaaggctacggattttggtttatcggattttatcaaaccagggaaaaggttccatgacattgttggtagcgcctattatgtggctcctgaggtattaaagcgcagatcagggcctgaatcagatgtatggagcattggtgtgattacgtatatattactttgtgggaggcggcctttttgggatagaactgaagatggtatatttaaagaggttttaagaaataaacctgacttcagccgtaaaccttgggcaactataagtgacagcgccaaagattttgtgaaaaagttacttgtaaaagacccacgagcacggctaactgctgcacaagcactatcacatgcgtgggttagagaaggcgggaatgctactgatatccctgtcgacatttcagttctgaacaacttaagacaatttgtgagatacagccgtctaaagcaatttgctttaagggcgcttgctagcacacttgacgaggcagagatctctgacctcagagatcaatttgatgcgattgatgtggataaaaatggcgtcattagtcttgaagagatgagacaggcacttgccaaagatcttccttggaaactgaaagactcacgagttgctgagatccttgaagcgattgatagcaacactgatgggttagtggacttcacagagtttgtagcagcagctctacatgttcatcaactagaagaacatgattcagagaaatggcagctaaggtcaagagcagcttttgagaaattcgacctagacaaagacgggtacataacgcctgaggaacttcgaatgcacacggggttaagaggatcaatagatccactgctggatgaagcagacatagacagagatgggaaaataagcctgcatgagttcaggagacttctaagaacagcgagcataagttcacagagagcaccaagccctgcaggtcacaggaatcttcgatag

SEQ ID NO: 1048 - protein, 523 aa, Arabidopsis thaliana
MGVCFSAIRVTGASSSRRSSQTKSKAAPTPIDTKASTKRRTGSIPCGKRTDFGYSKDFHDHYTIGKLLGHGQFGYTYVAIHRPNGDRVAVKRLDKSKMVLPIAVEDVKREVQILIALSGHENVVQFHNAFEDDDYVYIVMELCEGGELLDRILSKKGNRYSEKDAAVVVRQMLKVAGECHLHGLVHRDMKPENFLFKSAQLDSPLKATDFGLSDFIKPGKRFHDIVGSAYYVAPEVLKRRSGPESDVWSIGVITYILLCGRRPFWDRTEDGIFKEVLRNKPDFSRKPWATISDSAKDFVKKLLVKDPRARLTAAQALSHAWVREGGNATDIPVDISVLNNLRQFVRYSRLKQFALRALASTLDEAEISDLRDQFDAIDVDKNGVISLEEMRQALAKDLPWKLKDSRVAEILEAIDSNTDGLVDFTEFVAAALHVHQLEEHDSEKWQLRSRAAFEKFDLDKDGYITPEELRMHTGLRGSIDPLLDEADIDRDGKISLHEFRRLLRTASISSQRAPSPAGHRNLR

SEQ ID NO: 1049 - DNA, 1020 bp, Arabidopsis thaliana; identical to SEQ ID NO: 607

SEQ ID NO: 1050 - protein, 339 aa, Arabidopsis thaliana; identical to SEQ ID NO: 608

SEQ ID NO: 1051 - DNA, 2394 bp, Arabidopsis thaliana
atggaagacgacggcaagagcagccccaagttaccgatccctggaaagagaaatatactaatcaccagtgctttgccttacgtcaacaacgttcctcatctcggaaacatcatcggatgtgttctgagcgctgatgtgtatgctagatactgtcgtctccgtggctataatgcgatttacatatgtggaaccgatgaatatgggactgcaactgagaccaaagctttggaggagaattgcacccccaaggaaatctgtgacaagtaccatgccattcataaagaagtttatgactggtttggtataagttttgacaagtttgggcgaacttcaactccagaacagactgaggtgtgccaagcaattttcaacaagttgtgggacaacaagtggctttcagagaacaccatgcagcagctttactgcgatacatgcaagaagttcttagctgaccggcttgttgagggttcttgtccgttcgaaggatgtaattatgattctgctcgtggagatcagtgcgaaaaatgtggaaagctcctgaatcctactgaacttaaagatccgaagtgcaaggtctgtcaaaacacaccccgaattcgcgacacagaccacctgtttattgagcttccgttactgaaagataggttggaagcgtatattaaaaagacctctgttactggatcttggagtcaaaatgctattcaaacgacaaatgcatggcttagggatgggcttagacagagatgcattacgagggatcttaagtggggagtgcctgtcccacatgagaaatacaaggacaaagtcttctatgtttggtttgatgctcctattggatacgtctcaataacgtcttgctacacatctgaatgggagaagtggtggaagaatcctgagaatgtggagctttatcagtttatggggaaagacaatgtgccatttcacactgtgatgtttccctctacccagcttggaactgaggaaaattggacactcatgaagacaatcagtgtgactgaatatttaaactatgaagacggaaagttctccaagagtaaaggtgttggagtgtttggtaatgatgtaaaagatacaaatatacctgtcgaagtgtggagatactacttgctgaccaacaggcctgaggtgtctgacacatcgttttcatggactgatttgcaagcaaaactgaatggcgagttgctgagcaacctaggcaactttgttaatcgagttctgagttttatagcaaagcctgataatgcaggttacgggtctgtcattcctgatgctcatgatgctgaatctcattctttaacaaaatcactggcggaaaaggttgaaaagtttgtggcagagtatgttgaagccatggaaaaggttaagctcaagcagggactgaaaactgctatgctgatttcaagcgaagggaactattacttgcaggcaagccaattttggaaactttacaaggaagataaacctttgtgtgcagttgttataagaactgctgctggtttagtacaccttcttgctcaattgttagaacctttcatgccatccttttcttgtgaggtatttaaacagctaaatttgcctccacaattttctctctccgacgagaggggagaggtattactagcaagtagaccatgggatattctgcctcctagccacaggataggcacccctcaacctttgttcaaggagttggaaaacgacgaagtggcacggtacagagaaaagtttgctggaagtcagtctgatagacgtgctagggatgaagcagcaaatttggcggatcaacttaataaaacaaaactttcagatgccaagaaacaaaaggcatcatcaaaaggcggaggaaaacccaaacctcaaccagctgctgatcgtgaaataactatggcaagacttgatatccgagttggtaaaattgtgaaggctgagaaacatcccaaggcagatgcattgtatgtagaagaaattgatgttgggggtggtgaaattcgcactgttgtcagtggactggtcaaatatatacctcttgaggaaatgcagaatcgtatggtttgtgttctttgcaacttgaaaccggcgaaaatgagggatattgtgtcacaagcaatggttcttgcagcttccagtagtgatggaagcaaggtggagttagttgagccccctaaaactgctaatattggagagcgagttacatttcccgggtttgaaggcgagccagacgatgtcttaaacccaaagaagaaagtatgggagacgcttttggttgatctaaacacaaaagagaatctagttgcttgctacaaagatgtgcccttcactacatctgcaggtgtatgcaaagtttcatccatcagcaatggcacgatccggtaa

SEQ ID NO: 1052 - protein, 797 aa, Arabidopsis thaliana
MEDDGKSSPKLPIPGKRNILITSALPYVNNVPHLGNIIGCVLSADVYARYCRLRGYNAIYICGTDEYGTATETKALEENCTPKEICDKYHAIHKEVYDWFGISFDKFGRTSTPEQTEVCQAIFNKLWDNKWLSENTMQQLYCDTCKKFLADRLVEGSCPFEGCNYDSARGDQCEKCGKLLNPTELKDPKCKVCQNTPRIRDTDHLFIELPLLKDRLEAYIKKTSVTGSWSQNAIQTTNAWLRDGLRQRCITRDLKWGVPVPHEKYKDKVFYVWFDAPIGYVSITSCYTSEWEKWWKNPENVELYQFMGKDNVPFHTVMFPSTQLGTEENWTLMKTISVTEYLNYEDGKFSKSKGVGVFGNDVKDTNIPVEVWRYYLLTNRPEVSDTSFSWTDLQAKLNGELLSNLGNFVNRVLSFIAKPDNAGYGSVIPDAHDAESHSLTKSLAEKVEKFVAEYVEAMEKVKLKQGLKTAMLISSEGNYYLQASQFWKLYKEDKPLCAVVIRTAAGLVHLLAQLLEPFMPSFSCEVFKQLNLPPQFSLSDERGEVLLASRPWDILPPSHRIGTPQPLFKELENDEVARYREKFAGSQSDRRARDEAANLADQLNKTKLSDAKKQKASSKGGGKPKPQPAADREITMARLDIRVGKIVKAEKHPKADALYVEEIDVGGGEIRTVVSGLVKYIPLEEMQNRMVCVLCNLKPAKMRDIVSQAMVLAASSSDGSKVELVEPPKTANIGERVTFPGFEGEPDDVLNPKKKVWETLLVDLNTKENLVACYKDVPFTTSAGVCKVSSISNGTIR

SEQ ID NO: 1053 - DNA, 1095 bp, Arabidopsis thaliana
atggaggttttcttagagatgcttctcacggcggttgttgctctcttgttttctttccttttggccaagctcgtttctgttgctacggtggagaacgatttgagttctgatcagccgctcaagcccgagatcggtgtcggtgttacagaggatgttcgttttggtatgaagatggatgctcgtgttctcgaaagccagaggaatttccaagttgttgatgagaatgtggaacttgtcgatcggtttcttagcgaagaagctgatcgagtttatgaagtcgatgaagctgttactggaaacgctaaaatctgtggtgaccgtgaagctgagtcctcggctgcagcctcgtcggaaaattatgtgatcgccgaggaggtgatcttagttcgaggacaggacgaacagagcgactcggctgaagctgagtccatttcttctgtctcgccggaaaacgtggtagcggaggagattaagagtcaaggacaagaggaagtaacagaattaggaagaagtggttgcgtagaaaacgaagaaagtggtggagatgtcttagtcgctgaatctgaggaggttagagttgaaaagagtagtaatatggtggaggagagtgatgctgaagcagagaatgaagagaaaacagagttgactattgaagaagatgatgattgggaaggaattgagaggagtgaacttgagaaagcctttgcggctgctgtaaatcttttggaagaatccgggaaagctgaagaaattggtgctgaagctaagatggagttgtttggccttcacaagatcgccactgaagggtcatgtagagaggcacaacctatggccgtcatgatctctgctcgtgccaaatggaatgcgtggcaaaaacttggaaacatgagtcaagaagaggcaatggagcagtatcttgcacttgtctcaaaggaaatccctggtttgacgaaagctggtcatactgtagggaagatgtcagaaatggaaacctctgttggcttgcctccgaattcaggatcattagaagatccgaccaacttagtcacaactggtgttgatgaatccagcaaaaatgtttcaggggagaggtga

SEQ ID NO: 1054 - protein, 364 aa, Arabidopsis thaliana
MEVFLEMLLTAVVALLFSFLLAKLVSVATVENDLSSDQPLKPEIGVGVTEDVRFGMKMDARVLESQRNFQVVDENVELVDRFLSEEADRVYEVDEAVTGNAKICGDREAESSAAASSENYVIAEEVILVRGQDEQSDSAEAESISSVSPENVVAEEIKSQGQEEVTELGRSGCVENEESGGDVLVAESEEVRVEKSSNMVEESDAEAENEEKTELTIEEDDDWEGIERSELEKAFAAAVNLLEESGKAEEIGAEAKMELFGLHKIATEGSCREAQPMAVMISARAKWNAWQKLGNMSQEEAMEQYLALVSKEIPGLTKAGHTVGKMSEMETSVGLPPNSGSLEDPTNLVTTGVDESSKNVSGER

SEQ ID NO: 1055 - DNA, 2133 bp, Arabidopsis thaliana
atggaccaacaaccggagaggcgagaaggccggagttttccggagcgtaaaggacagaagcggaagctagaggaaggagccgccgccgtagaagatcgagagatctctgccgtcagcaccgacggaggccaagcgcttcttagcgaggttgctgctcaagtctcggtactaaactctgccttctcttggcaagagtccgatcgcgctgctgccaagcgagccactcaagttctggctgagctagccaaaaacgaggatttagtgaacgtgattgtcgacggaggtgctgttccagctcttatgacgcatctacaggcgccaccatacaacgacggggacttggctgagaagccgtacgaacacgaagttgagaagggaagcgcttttgcgcttggtcttcttgctattaagccagagtatcagaaactgatagtagacaaaggtgccttacctcatttagtgaatttgttgaagagaaacaaagatggttctagctctcgagctgtgaatagtgttatcagaagagcggctgatgccatcaccaatcttgctcatgagaacagcagtatcaagacccgtgttagggtagaaggcggtattccacctctcgtggagttgcttgaattttctgattcaaaggtccagagagcagcagcaggggcattgagaacccttgcatttaaaaatgatgataacaagaatcagatagttgaatgcaatgctcttcccacacttattctaatgctaggatcagaggatgctgctatacattatgaagcggttggagttataggcaatctagtacactcgtctccacacattaaaaaagaggttcttactgccggggcgttgcaacctgtcattggtcttcttagctcctgttgccctgagagtcaaagagaggcggctttattacttgggcagtttgcctcaactgattctgattgtaaggtgcacattgtgcaaaggggtgctgtccgtcctttaattgagatgcttcagtccccggatgtccagttgaaggaaatgtcggcctttgcactgggtagattggcacaggatgcccacaatcaagctggtattgcccatagtggtggtttaggacctttattgaagcttctcgattcaagaaatggatcattgcaacacaatgctgcatttgctctttatggccttgccgataatgaggataatgtgtcagattttatcagggtgggaggtatccaaaagctacaggatggagagtttattgttcaagcaactaaagattgtgtttccaaaacactaaagagattggaggagaagattcatggaagagttctgagacatctgttgtacctaatgcgcatttcagagaagtctatccaaagacgagttgctcttgcccttgctcatctctgttcacccgaggatcaacgaaccatattcatagatgacaacgggttggagttgctactcggtcttcttggttctttaaacactaagcagcaacttgacggtgcagcagcgttgtacaaattagcaaataaatctatggcactttctccagttgatgctgctcctccttctccaacacaaagggtttatctcggagagcaatatgtaaataatgctacgctgtctgatgtaacctttctagtcgaaggaaggacattctatgcacacagaatttgtctgctggcatcctcagatgcatttcgtgcaatgtttgatggtggttacagagaaaaagacgctagagatattgagattccaaatatcaaatgggaggtgtttgagttaatgatgaggtttatatacactggatctgtcgacataacaaatgagatatcaaaagatcttctaagagcagcggatcagtatctcttggagggcctgaaacgactctgtgaatacacaattgctcaggatattacgttggaaagtataggagacatgtacgagctatcagaagcattccatgcgatgtcgctgaggcaagcttgtatcatgttcatcctggagcatttcgataaactgagttcaatgccttggcagaacgagctggtgcagagaacaataccagagataagagagtacttttgtagagccctaacaaagtctactacaaacctgcaaagcttgaggttgtag

SEQ ID NO: 1056 - protein, 710 aa, Arabidopsis thaliana
MDQQPERREGRSFPERKGQKRKLEEGAAAVEDREISAVSTDGGQALLSEVAAQVSVLNSAFSWQESDRAAAKRATQVLAELAKNEDLVNVIVDGGAVPALMTHLQAPPYNDGDLAEKPYEHEVEKGSAFALGLLAIKPEYQKLIVDKGALPHLVNLLKRNKDGSSSRAVNSVIRRAADAITNLAHENSSIKTRVRVEGGIPPLVELLEFSDSKVQRAAAGALRTLAFKNDDNKNQIVECNALPTLILMLGSEDAAIHYEAVGVIGNLVHSSPHIKKEVLTAGALQPVIGLLSSCCPESQREAALLLGQFASTDSDCKVHIVQRGAVRPLIEMLQSPDVQLKEMSAFALGRLAQDAHNQAGIAHSGGLGPLLKLLDSRNGSLQHNAAFALYGLADNEDNVSDFIRVGGIQKLQDGEFIVQATKDCVSKTLKRLEEKIHGRVLRHLLYLMRISEKSIQRRVALALAHLCSPEDQRTIFIDDNGLELLLGLLGSLNTKQQLDGAAALYKLANKSMALSPVDAAPPSPTQRVYLGEQYVNNATLSDVTFLVEGRTFYAHRICLLASSDAFRAMFDGGYREKDARDIEIPNIKWEVFELMMRFIYTGSVDITNEISKDLLRAADQYLLEGLKRLCEYTIAQDITLESIGDMYELSEAFHAMSLRQACIMFILEHFDKLSSMPWQNELVQRTIPEIREYFCRALTKSTTNLQSLRL

SEQ ID NO: 1057 - DNA, 780 bp, Arabidopsis thaliana
atggcgacgacaacaacagaagcaacgaagacatcatcgaccaatggagaagatcagaagcagtctcagaatcttcgacatcaagaagttggtcacaagagtctcttacagagcgatgatctctaccagtatatactggagacaagtgtgtatcctagagaaccagaatcaatgaaggaactcagggaagtgacagcaaaacatccatggaacataatgaccacatcagctgatgaaggacagttcttaaacatgcttatcaagctcgttaacgccaagaacacaatggagatcggagtttacactggctactctcttctcgccaccgctcttgctctccctgaagacggcaaaattctggctatggatgtcaacagagagaattacgaattgggtttaccgatcattgagaaagccggcgttgctcacaagatcgacttcagggaaggccctgctcttcccgttcttgatgaaatcgttgctgacgagaagaaccatggaacatatgactttatattcgttgatgctgacaaagacaactacatcaactaccacaagcgtttgatcgatcttgtgaaaattggaggagtgattggctacgacaacactctgtggaatggttctgtcgtggctcctcctgatgcaccaatgaggaagtacgttcgttactacagagactttgttcttgagcttaacaaggctcttgctgctgaccctcggatcgagatctgtatgctccctgttggtgatggaatcactatctgccgtcggatcagttga

SEQ ID NO: 1058 - protein, 259 aa, Arabidopsis thaliana
MATTTTEATKTSSTNGEDQKQSQNLRHQEVGHKSLLQSDDLYQYILETSVYPREPESMKELREVTAKHPWNIMTTSADEGQFLNMLIKLVNAKNTMEIGVYTGYSLLATALALPEDGKILAMDVNRENYELGLPIIEKAGVAHKIDFREGPALPVLDEIVADEKNHGTYDFIFVDADKDNYINYHKRLIDLVKIGGVIGYDNTLWNGSVVAPPDAPMRKYVRYYRDFVLELNKALAADPRIEICMLPVGDGITICRRIS

SEQ ID NO: 1059 - DNA, 1248 bp, Arabidopsis thaliana
atgatgcagcagccacctccagcttccaacggtgctgcaacagggccagggcagattccttccgaccaacaagcttacctccagcagcagcagtcgtggatgatgcagcaccagcagcaacaacaaggtcagccgcctgcaggatggaatcagcagtctgcaccgtcttctggtcaaccacagcagcagcagtatggtggtggtggatctcagaatccaggatcagctggtgagatccggtccctgtggatcggtgacttgcagccatggatggatgagaactatctcatgaacgtctttggtcttactggcgaggctacagcagctaaagttattcgcaataaacagaacggatattcagaaggttatggctttattgagtttgtgaaccatgctacagctgagaggaatttacagacttacaatggtgctccgatgccgagcagtgagcaggccttcaggttgaactgggctcagcttggagctggagagagacgccaggctgaagggcctgagcacacagtttttgttggagacttggcacctgatgttaccgaccacatgcttactgaaacgtttaaagctgtgtattcctctgtcaagggagctaaagttgtgaatgataggactactggacggtccaagggttatggatttgtcaggtttgcggatgaaagtgagcagattcgtgccatgactgaaatgaatggtcaatactgctcatcaaggcctatgcgtactggtcctgctgccaacaagaagcctcttacaatgcaaccagcttcatatcagaacactcaaggaaattcaggagaaagtgatccaactaacacaacaatttttgttggagctgtggatcaaagtgtaacagaagatgatttgaagtcagtttttggtcaatttggtgaactagttcatgtgaaaatacccgcaggaaaacgttgcggatttgttcaatacgccaatagggcatgtgctgagcaagcactttctgtgttgaacggaacacaacttgggggacaaagcattcgtctttcatggggtcgcagtccttccaacaaacagactcaacctgatcaagcccagtatggtggtggtggaggatactatgggtatcctcctcaaggatatgaagcatacggatatgcacctcctcctcaggaccctaacgcctactacggtggttatgctgggggcggctatggaaactaccagcagcctggtggataccagcagcaacagcagtga

SEQ ID NO: 1060 - protein, 415 aa, Arabidopsis thaliana
MMQQPPPASNGAATGPGQIPSDQQAYLQQQQSWMMQHQQQQQGQPPAGWNQQSAPSSGQPQQQQYGGGGSQNPGSAGEIRSLWIGDLQPWMDENYLMNVFGLTGEATAAKVIRNKQNGYSEGYGFIEFVNHATAERNLQTYNGAPMPSSEQAFRLNWAQLGAGERRQAEGPEHTVFVGDLAPDVTDHMLTETFKAVYSSVKGAKVVNDRTTGRSKGYGFVRFADESEQIRAMTEMNGQYCSSRPMRTGPAANKKPLTMQPASYQNTQGNSGESDPTNTTIFVGAVDQSVTEDDLKSVFGQFGELVHVKIPAGKRCGFVQYANRACAEQALSVLNGTQLGGQSIRLSWGRSPSNKQTQPDQAQYGGGGGYYGYPPQGYEAYGYAPPPQDPNAYYGGYAGGGYGNYQQPGGYQQQQQ

SEQ ID NO: 1061 - DNA, 1305 bp, Arabidopsis thaliana
atggatctatcttctcaacgacaatccccaaatggttctaggggttttcgtcttcaagctccattggtggattctgtatcttgttattgtagagtagattccggtcttaagactgttgtagaagcaaggaagtttgttcctggttcaaagctttgtattcaacctgatatcaatcccaatgctcatagacgtaagaattctaagagggagaggactagaattcaacctccgcttctccctggcctccctgacgatctagctgtcgcttgccttatccgtgttcctcgtgcagaacatagaaaactcaggctcgtgtgtaagagatggtataggcttgcttctgggaacttcttttactctcaaaggaagttacttgggatgtctgaagaatgggtttatgtttttaaaagagatcgtgatgggaagatctcgtggaatacgtttgatcctatctctcagctttggcagccgcttccacctgttccaagggaatattcagaggctgttgggtttggttgcgctgttttaagcggttgtcatctttatttgtttggaggtaaggatcctttaagagggtcaatgaggagggtcattttctataatgcaaggacgaataagtggcacagagcaccggatatgcttaggaagcggcatttttttggttgttgtgttataaacaattgtttatatgtagcgggtggggagtgtgaaggaattcaaaggacacttcgctcagctgaggtttatgatccaaacaagaacaggtggagttttattgctgatatgagtacagcaatggtgcctctgatcggtgtggtttatgacaaaaagtggtttctcaagggtcttgggtctcaccaactagtaatgagtgaagcttatgacccagaagttaattcatggagcccggttagtgacgggatggttgctggttggcgtaatccgtgtacttctctaaacggtcgtctttacggattggattgtagggacggatgcaaactcagggtatttgatgaatccacggattcatggaacaaattcatggacagtaaagctcatttgggaaactcgaagtcgcttgaagctgcagctcttgttcctctacacaataagctttgtataatccggaacaacatgagcatgagtctggttgatgtctcgaatcctgacaaaaacaaccctcgactgtgggaaaacattgccgtaaaaggacagtccaagagcattctcagtaatatatggtcgagtattgcagggagagctttgaagagccatatagtgcattgtcaagtgcttcaagcgtga

SEQ ID NO: 1062 - protein, 434 aa, Arabidopsis thaliana
MDLSSQRQSPNGSRGFRLQAPLVDSVSCYCRVDSGLKTVVEARKFVPGSKLCIQPDINPNAHRRKNSKRERTRIQPPLLPGLPDDLAVACLIRVPRAEHRKLRLVCKRWYRLASGNFFYSQRKLLGMSEEWVYVFKRDRDGKISWNTFDPISQLWQPLPPVPREYSEAVGFGCAVLSGCHLYLFGGKDPLRGSMRRVIFYNARTNKWHRAPDMLRKRHFFGCCVINNCLYVAGGECEGIQRTLRSAEVYDPNKNRWSFIADMSTAMVPLIGVVYDKKWFLKGLGSHQLVMSEAYDPEVNSWSPVSDGMVAGWRNPCTSLNGRLYGLDCRDGCKLRVFDESTDSWNKFMDSKAHLGNSKSLEAAALVPLHNKLCIIRNNMSMSLVDVSNPDKNNPRLWENIAVKGQSKSILSNIWSSIAGRALKSHIVHCQVLQA

SEQ ID NO: 1063 - DNA, 3564 bp, Arabidopsis thaliana
atgagaaaccattgcttagaactctcttccaattgttcctccattttcgcttcttccaaatccaatcctcgtttctctccttccaagctctcctattccactttcttctctcgctctgccatctattacagatcaaaaccaaaacaagcctcgtcttcttcttccttctccactttccccccatgtctcaatcggaaaagctccctcacgcatgttctcaaacccgtctcagagctcgccgacaccactaccaagcctttttctccggagatcgtcggcaagagaaccgatctgaagaagattatgattctcggcgctggtccgattgtcattggacaagcttgtgagtttgattactctggtactcaagcttgtaaagccttaagagaagagggctatgaggttatcctgatcaattcgaatcctgccactatcatgactgatccggaaactgctaatcggacttatatcgctccgatgactcctgagcttgtcgagcaggttattgagaaagagaggcctgacgctttgttaccaaccatgggtggtcaaaccgcattgaacctcgcggttgctcttgctgagagtggtgctttggagaaatacggtgttgaattgataggagctaagcttggtgcgattaagaaagctgaagatcgtgagttgttcaaggatgcgatgaagaacattgggctaaagactccaccttcagggattgggaccactcttgatgagtgttttgacattgctgagaaaattggtgagttccctttgattatccgtcctgcgtttactttaggtggtactggtggtggaattgcgtataacaaagaggagtttgagtctatatgtaaatcgggtttggctgcgagtgcgacaagtcaagttcttgtggagaaatccttgttgggttggaaagaatatgagcttgaggtgatgagagacttagctgacaatgttgtcattatctgttccattgagaatattgatcctatgggtgtgcacactggtgattccatcactgtggcacctgcacagactctaacggatagagagtaccagcggcttagggattattccattgcgattatacgggagattggtgttgagtgtggtggatctaatgtgcagtttgctgtcaacccggttgatggtgaagttatgatcatagagatgaaccctagggtctcaagatcttctgctcttgcttccaaggctacagggtttcccattgctaaaatggctgccaagttgtctgttggctataccttggatcagattcctaatgatatcacgaggaaaacaccggctagcttcgagccctccatcgattatgtggtgactaagattcctcgatttgcatttgaaaagtttccaggatctcagccattgctaacgacccagatgaaatctgttggggaatctatggctctcggccgtacattccaagaatctttccagaaagctctgaggtctctggagtgtggattctcgggttggggttgtgcaaaaattaaagagctagattgggactgggatcagctgaaatacagcctaagagtcccaaatcctgacaggatccatgcgatatatgctgccatgaaaaagggtatgaaaattgatgaaatctacgagttgagcatggtggacaagtggttcctaacccagcttaaagagctcgtggacgtcgaacagtatcttatgtccggaaccttgtcagagattacaaaagaagacctttacgaagtcaaaaagcggggatttagtgacaagcaaatcgcttttgctacaaagacaaccgaggaagaagtccgtaccaagcggatttctctaggagttgttccatcttacaagagagtggatacatgtgctgcagagttcgaagcgcatacaccatacatgtactcttcatatgatgttgaatgtgaatcagctccaaacaacaagaagaaggttttgattttgggtggagggccaaaccgcattggtcaagggattgaatttgattactgttgttgccacacatctttcgccttacaggatgctggatatgagaccataatgttgaactcaaatcctgaaacagtatccacagattatgatacaagcgataggctctattttgaacctctcacaatcgaggatgttctcaatgttatcgaccttgagaaacctgatggcataatagtgcaatttggtggtcaaactcctctgaaacttgctctgccgatcaaacattatttggataagcacatgcccatgagcttgagcggagcgggacctgttcgcatctggggtacatcacctgactccattgacgctgctgaagacagagagaggttcaatgcaattctcgacgagctgaagattgagcagcccaagggaggcattgcaaagagcgaagctgatgcattagccatagcaaaggaggtagggtacccagttgtggtaagaccttcttatgttctaggtggacgagcaatggagatcgtttatgatgacagtagactaataacctatttggaaaatgcggtacaagttgacccagagagacctgttttggtagataaatatctttctgatgccattgagatcgacgttgatacccttactgattcctatggaaatgtggtgattggtggaataatggagcatatcgaacaagctggtgtgcattctggtgactcagcttgtatgcttccaacacaaaccatcccagcttcttgtttgcaaactattcgaacatggaccactaagctggcgaagaagctaaatgtatgtgggctgatgaactgtcagtacgcaatcacaacatctggggatgtttttttgctggaagccaatccccgagcttcccgtactgtcccttttgtgtcaaaagccattggacaccctcttgccaagtatgcagcgctggtcatgtcgggcaaatctctcaaagatcttaactttgaaaaagaagttatccctaaacatgtctctgtgaaagaagctgttttcccgtttgagaagttccaaggatgcgatgtgatactcgggccagagatgagaagcacaggagaagtgatgagcatcagttctgaattctcaagtgcgtttgcaatggctcagatcgctgcaggtcaaaagctacctctatcaggcacagtcttcctcagcttaaacgatatgaccaaaccgcacctggagaaaatcgcggtgtccttcctcgagcttgggttcaaaatagttgccacctcgggaacagctcatttcctggaactgaaaggcattccagtggagagagtgttgaagttgcatgaaggaagaccacatgctgctgatatggtggcgaatggtcagatccatttgatgttgatcacaagctcgggtgatgctcttgatcagaaagatgggagacagctcagacaaatggctctagcatacaaggtacctgttataaccactgttgctggtgcattggccactgctgagggaatcaagagcttgaagtcaagtgccattaaaatgaccgctcttcaggacttctttgaggtaaagaatgtatcttctttgctcgtctga

SEQ ID NO: 1064 - protein, 1187 aa, Arabidopsis thaliana
MRNHCLELSSNCSSIFASSKSNPRFSPSKLSYSTFFSRSAIYYRSKPKQASSSSSFSTFPPCLNRKSSLTHVLKPVSELADTTTKPFSPEIVGKRTDLKKIMILGAGPIVIGQACEFDYSGTQACKALREEGYEVILINSNPATIMTDPETANRTYIAPMTPELVEQVIEKERPDALLPTMGGQTALNLAVALAESGALEKYGVELIGAKLGAIKKAEDRELFKDAMKNIGLKTPPSGIGTTLDECFDIAEKIGEFPLIIRPAFTLGGTGGGIAYNKEEFESICKSGLAASATSQVLVEKSLLGWKEYELEVMRDLADNVVIICSIENIDPMGVHTGDSITVAPAQTLTDREYQRLRDYSIAIIREIGVECGGSNVQFAVNPVDGEVMIIEMNPRVSRSSALASKATGFPIAKMAAKLSVGYTLDQIPNDITRKTPASFEPSIDYVVTKIPRFAFEKFPGSQPLLTTQMKSVGESMALGRTFQESFQKALRSLECGFSGWGCAKIKELDWDWDQLKYSLRVPNPDRIHAIYAAMKKGMKIDEIYELSMVDKWFLTQLKELVDVEQYLMSGTLSEITKEDLYEVKKRGFSDKQIAFATKTTEEEVRTKRISLGVVPSYKRVDTCAAEFEAHTPYMYSSYDVECESAPNNKKKVLILGGGPNRIGQGIEFDYCCCHTSFALQDAGYETIMLNSNPETVSTDYDTSDRLYFEPLTIEDVLNVIDLEKPDGIIVQFGGQTPLKLALPIKHYLDKHMPMSLSGAGPVRIWGTSPDSIDAAEDRERFNAILDELKIEQPKGGIAKSEADALAIAKEVGYPVVVRPSYVLGGRAMEIVYDDSRLITYLENAVQVDPERPVLVDKYLSDAIEIDVDTLTDSYGNVVIGGIMEHIEQAGVHSGDSACMLPTQTIPASCLQTIRTWTTKLAKKLNVCGLMNCQYAITTSGDVFLLEANPRASRTVPFVSKAIGHPLAKYAALVMSGKSLKDLNFEKEVIPKHVSVKEAVFPFEKFQGCDVILGPEMRSTGEVMSISSEFSSAFAMAQIAAGQKLPLSGTVFLSLNDMTKPHLEKIAVSFLELGFKIVATSGTAHFLELKGIPVERVLKLHEGRPHAADMVANGQIHLMLITSSGDALDQKDGRQLRQMALAYKVPVITTVAGALATAEGIKSLKSSAIKMTALQDFFEVKNVSSLLV

SEQ ID NO: 1065 - DNA, 2667 bp, Arabidopsis thaliana; identical to SEQ ID NO: 805

SEQ ID NO: 1066 - protein, 888 aa, Arabidopsis thaliana; identical to SEQ ID NO: 806

SEQ ID NO: 1067 - DNA, 1833 bp, Arabidopsis thaliana
atgattagcacagtacttcgccgatctatccttggtacgtcaaggcgtactctcgccgcttcggtgacctccattaacgcagctctatttcataaccttgctccagccgccgccacagtctccgatctagcaaatggagctactaatgtcaagtctctcccttcgaattcgagcccttttggtgttaaagtgagagactttcatgttaaatctgtaccgtcggagtttagatcgtcgattgtttcttctgcgggattcgcggctcaagagtatgctccttcttatgagaacgatggagggattggagattcggagagtgttggtagcagcggtggtggtgatgggcttgcgatagctgatcttggtatatctccggagattgttaaagctttgaagggtaggggtattgagaaactctttcctattcagaaagctgtgttggagccagcgatggagggtcgtgatatgattggccgtgcaaggactggaacgggaaagacacttgcttttgggattcctattattgacaaaatcatcaaattcaacgctaaacatggtcgtgggaagaatcctcagtgcttggttttggcaccgacgagggagcttgctcgtcaggttgagaaagagttcagggaatctgctccaagtttggatactatttgtctctatggaggtacaccaatcgggcaacaaatgagggagctgaactatggtattgatgtggcggttggaactcctggtcgtatcattgatctgatgaaaaggggagctttgaatctatcagaggttcagtttgtggttcttgatgaagctgatcagatgcttcaagttggatttgcggaagatgttgaaataatattgcagaagttgccagcgaagcgtcagagtatgatgttttctgcaacaatgccaagttggatcagatctctcaccaagaagtacctgaacaatcctttgacaattgatcttgttggagattcagatcagaaacttgcagatgggattactatgtattctatcgctgcagattcttatggaagagcatccatcattggtcctcttgtaaaggaacatggcaaaggaggaaaatgcattgtctttacccaaacaaaacgtgatgcagatcgccttgcatttggattggcaaaaagctataaatgtgaagctttacacggtgacatatctcaagctcagagagaaagaacacttgctggtttcagggatgggaatttcagtattcttgttgcaactgatgttgctgcccgtggacttgatgtacctaatgtcgatttagtaattcattatgagcttcctaataacacggagacgtttgttcaccgaacggggcgaactggtcgtgctggaaagaaaggaagcgcgattctcatccacggtcaagatcaaaccagggctgttaaaatgattgagaaagaagtcggaagcagattcaatgagctgcctagcattgctgtggaaagaggaagcgcaagcatgtttgaaggagtaggtgctagatctggtgggtcgttcggaggaggtcgatcaggcggtggtgggtatggtagttacggtagcagcagtggccgttcaggtggtggtagttatggaggttatggtggcagcagtggccgttcaggtggtggtggtggtagttatggaggttcagggggatcaagcagccgttactctggtggttcagaccgctcatctggtttcggaagctttggttcaggcggttcttcaggaggatttggttcagaccgttcttctcagtcaagtggaaggagcagctttggtgggtttggatcaaacgatggtaaaagatcttactga

SEQ ID NO: 1068 - protein, 610 aa, Arabidopsis thaliana
MISTVLRRSILGTSRRTLAASVTSINAALFHNLAPAAATVSDLANGATNVKSLPSNSSPFGVKVRDFHVKSVPSEFRSSIVSSAGFAAQEYAPSYENDGGIGDSESVGSSGGGDGLAIADLGISPEIVKALKGRGIEKLFPIQKAVLEPAMEGRDMIGRARTGTGKTLAFGIPIIDKIIKFNAKHGRGKNPQCLVLAPTRELARQVEKEFRESAPSLDTICLYGGTPIGQQMRELNYGIDVAVGTPGRIIDLMKRGALNLSEVQFVVLDEADQMLQVGFAEDVEIILQKLPAKRQSMMFSATMPSWIRSLTKKYLNNPLTIDLVGDSDQKLADGITMYSIAADSYGRASIIGPLVKEHGKGGKCIVFTQTKRDADRLAFGLAKSYKCEALHGDISQAQRERTLAGFRDGNFSILVATDVAARGLDVPNVDLVIHYELPNNTETFVHRTGRTGRAGKKGSAILIHGQDQTRAVKMIEKEVGSRFNELPSIAVERGSASMFEGVGARSGGSFGGGRSGGGGYGSYGSSSGRSGGGSYGGYGGSSGRSGGGGGSYGGSGGSSSRYSGGSDRSSGFGSFGSGGSSGGFGSDRSSQSSGRSSFGGFGSNDGKRSY

SEQ ID NO: 1069 - DNA, 1395 bp, Arabidopsis thaliana
atgatgtccaacggtggtgattcgtcggaaattgtccgggaactggaagagttaaagctcaagaaggcagaaatagagcaccgtatttcgaccctcgaagctaagctccaggatacggcggcagttgaactgtacgacgccgtatccaacggtgactcttatctgacggcaccggagcttgaacatgggttatctccagatcagatttaccgttatagtcgtcaactgttacttccttcgtttgctgttgaagggcagtcaaatcttttgaagtcttcggtattagttattggagcaggaggactaggttcacctgccttattgtatcttgcagcatgtggtgttggtcagttgggtattatcgatcatgatgttgtagagctcaacaatatgcataggcagattatacacacagaagcatttattggacatcccaaagtgaaatctgctgctgctgcttgtcgctcgataaattcaacgatcaaagttgatgaatatgtggaagctcttcgcacttccaatgctttggaaatcctcagccaatatgatatcatagtcgatgcgactgataatcctccaagccgttacatgatcagtgattgttgtgtcttgttaggaaagcctttggtgtcgggtgctgcgcttggtatggaagggcagcttacggtttataatcataacggaggcccgtgttaccggtgtctttttcccactcctccacctacctcagcgtgccaaagatgttctgatagtggagttcttggagtagtgccaggtgttattggttgtctacaagcgctagagacaattaaactcgcaagcctggtgggagaaccactctctgaacggatgcttctttttgatgctttatcagcaaggatgcgcattgtcaagatcagaggcaggtcatcacagtgcaccgtgtgtggagacaattcatctttcaataagcaaacttttaaagattttgactatgaggacttcactcaatttcctttatttgcgggcccattgaacctgcttcctgcagaatcaagaattagcagcaaggagttcaaagaaattcttcaaaagaaggaacaacatgttctgctcgatgttcgaccttcacatcactataagattgtctctctcccggattcactcaacatccctcttgcaaacttagagactcggttaaacgagcttacttcagctcttaaagaaaagggaaatggccatgcgaacactgaatcttgcacaaatcctagtgtcttcgttgtatgcagacgcgggaatgattcacaaagagctgttcaatatcttcgtgagtcgggttttgattcggctaaggatataattggaggactggaagcttgggcagccaatgtcaaccccaacttccccacctactag

SEQ ID NO: 1070 - protein, 464 aa, Arabidopsis thaliana
MMSNGGDSSEIVRELEELKLKKAEIEHRISTLEAKLQDTAAVELYDAVSNGDSYLTAPELEHGLSPDQIYRYSRQLLLPSFAVEGQSNLLKSSVLVIGAGGLGSPALLYLAACGVGQLGIIDHDVVELNNMHRQIIHTEAFIGHPKVKSAAAACRSINSTIKVDEYVEALRTSNALEILSQYDIIVDATDNPPSRYMISDCCVLLGKPLVSGAALGMEGQLTVYNHNGGPCYRCLFPTPPPTSACQRCSDSGVLGVVPGVIGCLQALETIKLASLVGEPLSERMLLFDALSARMRIVKIRGRSSQCTVCGDNSSFNKQTFKDFDYEDFTQFPLFAGPLNLLPAESRISSKEFKEILQKKEQHVLLDVRPSHHYKIVSLPDSLNIPLANLETRLNELTSALKEKGNGHANTESCTNPSVFVVCRRGNDSQRAVQYLRESGFDSAKDIIGGLEAWAANVNPNFPTY

SEQ ID NO: 1071 - DNA, 564 bp, Arabidopsis thaliana
atggcgatcaatcgtagctccgatcatgaatccgacgaaaacacccgtctttaccatccttaccagaactaccaggtcccgatcaaatctcagtatctatacaagcttccgacttctccggaatttctattcacggaagagtctctcaagcagcgtcgatcatggggagaaaatctcactttctacacagggacgggttatctagccggctctgtagccggtgcttcagctgggatcttctctggtatcaagagtttcgaaaatggagacacgacgaagctgaaaatcaacaggattttgaattcgtctggtcaggcaggtcgtacttggggtaatagggttgggattgttgggttgatctacgcagggattgagagtggtgtggtggcggtaactgataaggacgatgtttggaccagtgttgtcgctggtctgggaactggagcggtctttagggcagcacgaggagtgagatctgcggctgtggctggtgcttttggcggaattgcggctggtgcagttgtggcggggaagcaggttttcaagcggtatgctcacatatga

SEQ ID NO: 1072 - protein, 187 aa, Arabidopsis thaliana
MAINRSSDHESDENTRLYHPYQNYQVPIKSQYLYKLPTSPEFLFTEESLKQRRSWGENLTFYTGTGYLAGSVAGASAGIFSGIKSFENGDTTKLKINRILNSSGQAGRTWGNRVGIVGLIYAGIESGVVAVTDKDDVWTSVVAGLGTGAVFRAARGVRSAAVAGAFGGIAAGAVVAGKQVFKRYAHI

SEQ ID NO: 1073 - DNA, 1674 bp, Arabidopsis thaliana
atggttttggggtgtttccctttgaaaagcaagaagaaacgtggctctgtttctatgaagcggttggatcttgaagaaagcaagccaactgctttacctgagccaccaaagattccaagtcgtaatttacaatcagctcctccgagtttcagaactcgtgtgaagccaattcaatctaacaacggtggaaccggagagatgagtagccgagcaagagtcatgtctgctccgtcaagcatccacggtgcagcggaacgggatttgcttgctggtgtttaccacgacgagcaagatgaacaaccaagagatccacgtacttctactaaagaatctagccctcaaccacttccgttaccgtcaccaagaactggttcttcattgaagaattggggaagctttaagtcgtttaacggaagcagcggtcggttatcatcatccgcagctgtatctggacctttacctttgccacctagcgggtcagttaggagcttttcatatgatgaagtaatggctgcgtgtaacgctttttcttcagaccgatgtgtcatggaaggtctttcatctgttatgtacatggcttcctttggtgatgaggcttcgacctcaggtttaaagaaggttgacgcaactgttgtacgacttcacgtaattactcagagtattagggagttcattaatgaagtcaacacattggcgtcgctgcaacaccagaacctttgtaagctggtaggctatcatgctcgtgacggttctgacacaagaatgttggtgtacgagaggcttgctctgggcagcttggaccgtttactgcatgggagatcagatgggcctcctcttgattggaacactagaatgaagattgcactatgcgcagctcagggtctaaccttcttgcacgaagaaggcccttttcaggcaatgtacaatgaattttcgacggcaaatatccaagtcgataaagatttcagcgccaagctatcaggatacggttgtgcaggccatgcgcctgagacagagacatctaatagttcggcacttgctaatctctctgtcgagactctagagagagggcttttgaccccgaagagcaatgtgtggagctatggaatagttcttcttgagatgttaacgggtcggaaaaatatggacgggtcttacccgaaagaagagaggaacttagtgaaatggagcagagcttttctagcagatgattgcaggctctcgcttataatggatcctcagcttaaaggtcggtttccggcaaaagcggctaggagcatagcagatatagcacagaaatgtctgcaggtggagccttcagagcgtccaaccatgagaaacatcgtggatcaactcaagatcatacaggacatgaagtactcgtgtaggttcccattgagagaacccgcaccggtcgtggcaaggaaacatatgggaagatcaagcagtctcaacacgattatttggaccccggcatcagtgccaccaaggtcgagtttttcaccgtcacctccaccacgacgaccgtctgtctcacccacaaggggacggacgctcgtgtttcccccagtgtttccgccgcgagcgtgttcatctttggaggaaatggctcgggaagaggttcgaagatcgtcttcagccagtggtaggagaactagcctcgaagggttttga

SEQ ID NO: 1074 - protein, 557 aa, Arabidopsis thaliana
MVLGCFPLKSKKKRGSVSMKRLDLEESKPTALPEPPKIPSRNLQSAPPSFRTRVKPIQSNNGGTGEMSSRARVMSAPSSIHGAAERDLLAGVYHDEQDEQPRDPRTSTKESSPQPLPLPSPRTGSSLKNWGSFKSFNGSSGRLSSSAAVSGPLPLPPSGSVRSFSYDEVMAACNAFSSDRCVMEGLSSVMYMASFGDEASTSGLKKVDATVVRLHVITQSIREFINEVNTLASLQHQNLCKLVGYHARDGSDTRMLVYERLALGSLDRLLHGRSDGPPLDWNTRMKIALCAAQGLTFLHEEGPFQAMYNEFSTANIQVDKDFSAKLSGYGCAGHAPETETSNSSALANLSVETLERGLLTPKSNVWSYGIVLLEMLTGRKNMDGSYPKEERNLVKWSRAFLADDCRLSLIMDPQLKGRFPAKAARSIADIAQKCLQVEPSERPTMRNIVDQLKIIQDMKYSCRFPLREPAPVVARKHMGRSSSLNTIIWTPASVPPRSSFSPSPPPRRPSVSPTRGRTLVFPPVFPPRACSSLEEMAREEVRRSSSASGRRTSLEGF

SEQ ID NO: 1075 - DNA, 1074 bp, Arabidopsis thaliana
atggaaggttcctcgtcagccatcgcgaggaagacatgggagctagagaacaacattctcccagtggaaccaaccgattcagcctccgacagtatattccactacgacgacgcttcacaagccaaaatccagcaggagaagccatgggcctccgatcctaactacttcaagcgcgttcacatctcagcccttgctcttctcaagatggtggttcacgctcgctccggtggcacaatcgagatcatgggtcttatgcagggtaaaaccgagggtgatacaatcatcgttatggatgcttttgctttgcctgttgaaggtactgagactagggttaatgctcagtctgatgcctatgagtatatggttgaatactctcagaccagcaagctggctgggaggttggagaacgttgttggatggtatcactctcaccctgggtatggatgttggctctcgggtattgatgtttcgacacagatgcttaaccaacagtatcaggagccattcttagctgttgttattgatccaacaaggactgtttcggctggtaaggttgagattggggcattcagaacatatccagagggacataagatctcggatgatcatgtttctgagtatcagactatccctcttaacaagattgaggactttggtgtacattgcaaacagtactactcattggacatcacttatttcaagtcatctctcgatagtcaccttctggatctcctttggaacaagtactgggtgaacactctttcttcttccccactgttgggcaatggagactatgttgccgggcaaatatcagacttggctgagaagctcgagcaagcggagagtcagctcgctaactcccggtatggaggaattgcgccagccggtcaccaaaggaggaaagaggatgagcctcaactcgcgaagataactcgggatagtgcaaagataactgtcgagcaggtccatggactaatgtcacaggttatcaaagacatcttgttcaattccgctcgtcagtccaagaagtctgctgacgactcatcagatccagagcccatgattacatcgtga

SEQ ID NO: 1076 - protein, 357 aa, Arabidopsis thaliana
MEGSSSAIARKTWELENNILPVEPTDSASDSIFHYDDASQAKIQQEKPWASDPNYFKRVHISALALLKMVVHARSGGTIEIMGLMQGKTEGDTIIVMDAFALPVEGTETRVNAQSDAYEYMVEYSQTSKLAGRLENVVGWYHSHPGYGCWLSGIDVSTQMLNQQYQEPFLAVVIDPTRTVSAGKVEIGAFRTYPEGHKISDDHVSEYQTIPLNKIEDFGVHCKQYYSLDITYFKSSLDSHLLDLLWNKYWVNTLSSSPLLGNGDYVAGQISDLAEKLEQAESQLANSRYGGIAPAGHQRRKEDEPQLAKITRDSAKITVEQVHGLMSQVIKDILFNSARQSKKSADDSSDPEPMITS

SEQ ID NO: 1077 - DNA, 993 bp, Arabidopsis thaliana
atggctcttccgttgccattgatcttccttatcttctctcatttgttcgtttctggagttagatcaacgagcttcattatggtgaacaaatgcgaatacacagtctggcctggacttttatcaaacgccggagttccaccacttccgacgaccggattcgttctccaaaaaggcgaagaacgaacaatcagcgctccaacttcatggggaggaagattctgggggagaactcaatgttccaccgacaccgacggaaaattcacttgtctcaccggagattgcggatctggtaccctcgaatgctccggatccggagcaacaccaccagcaacactagcggaattcacactagacggatctaacggactcgatttctacgacgttagtctcgtcgacggttacaacgtcccgatgctagtggctccacaaggaggctcgggtttaaactgtagcagcaccggatgcgttgtagatctgaacggttcgtgtccgtcggagcttaaagtgacgagtttagacggcagaggtaaacaatccatgggatgtaaaagcgcgtgtgaagcttttcgtacgccggagtattgttgcagcggcgcccacggtacacctgacacgtgtaaaccgtcgtcgtactcgttgatgtttaaaactgcgtgtccacgtgcttacagctacgcttacgatgatcagagtagtaccttcacatgtgctgaatctcctaattacgttatcacgttttgccctactcctaacaccagtcaaaaatcatctcaagatcagagcccagatcccaaaccgacgacaccaaccgggacgtcgtcgacaactcctgccggagatagtagtacgacgtggtcaccggtagatacatcaatgatatacgaaggagctttggatcaaaacaaaggatcaccgtccacgtgtcatctttcgttatgtggaatcacagtcacacttgcgctggccttttgtcggatgtggcggctcttttga

SEQ ID NO: 1078 - protein, 330 aa, Arabidopsis thaliana
MALPLPLIFLIFSHLFVSGVRSTSFIMVNKCEYTVWPGLLSNAGVPPLPTTGFVLQKGEERTISAPTSWGGRFWGRTQCSTDTDGKFTCLTGDCGSGTLECSGSGATPPATLAEFTLDGSNGLDFYDVSLVDGYNVPMLVAPQGGSGLNCSSTGCVVDLNGSCPSELKVTSLDGRGKQSMGCKSACEAFRTPEYCCSGAHGTPDTCKPSSYSLMFKTACPRAYSYAYDDQSSTFTCAESPNYVITFCPTPNTSQKSSQDQSPDPKPTTPTGTSSTTPAGDSSTTWSPVDTSMIYEGALDQNKGSPSTCHLSLCGITVTLALAFCRMWRLF

SEQ ID NO: 1079 - DNA, 1140 bp, Arabidopsis thaliana
atgtgtggaggagctataatctccgatttcatacctccgccgaggtccctccgcgtcactaacgagtttatctggccggatctgaaaaacaaagtgaaagcttcaaagaagagatcgaataagcgatccgatttcttcgatcttgacgatgatttcgaagctgatttccaagggtttaaggatgactcggcttttgactgcgaagacgatgatgatgtcttcgtcaatgttaagcctttcgtcttcaccgcaactactaagcccgtagcttccgctttcgtctccactggtatatatttggtaggttcagcatatgccaagaaaactgtagagtccgctgagcaagctgagaaatcttctaagaggaagaggaagaatcaataccgagggattaggcagcgtccttggggaaaatgggctgcggagatccgtgatccgagaaaaggctcccgagaatggcttggaacattcgacactgctgaggaagcagcaagagcttatgatgctgcagcacgcagaatccgtggcacgaaagctaaggtgaattttcccgaggagaagaaccctagcgtcgtatcccagaaacgtcctagtgctaagactaataatcttcagaaatcagtggctaaaccaaacaaaagcgtaactttggttcagcagccaacacatctgagtcagcagtactgcaacaactcctttgacaactcttttggtgatatgagtttcatggaagagaagcctcagatgtacaacaatcagtttgggttaacaaactcgttcgatgctggaggtaacaatggataccagtatttcagttccgatcagggcagtaactccttcgactgttctgagttcgggtggagtgatcacggccctaaaacacccgagatctcttcaatgcttgtcaataacaacgaagcatcatttgttgaagaaaccaatgcagccaagaagctcaaaccaaactctgatgagtcagacgatctgatggcataccttgacaacgccttgtgggacaccccactagaagtggaagccatgcttggcgcagatgctggtgctgtgactcaggaagaggaaaacccagtggagctatggagcttagatgagatcaatttcatgctggaaggagacttttga

SEQ ID NO: 1080 - protein, 379 aa, Arabidopsis thaliana
MCGGAIISDFIPPPRSLRVTNEFIWPDLKNKVKASKKRSNKRSDFFDLDDDFEADFQGFKDDSAFDCEDDDDVFVNVKPFVFTATTKPVASAFVSTGIYLVGSAYAKKTVESAEQAEKSSKRKRKNQYRGIRQRPWGKWAAEIRDPRKGSREWLGTFDTAEEAARAYDAAARRIRGTKAKVNFPEEKNPSVVSQKRPSAKTNNLQKSVAKPNKSVTLVQQPTHLSQQYCNNSFDNSFGDMSFMEEKPQMYNNQFGLTNSFDAGGNNGYQYFSSDQGSNSFDCSEFGWSDHGPKTPEISSMLVNNNEASFVEETNAAKKLKPNSDESDDLMAYLDNALWDTPLEVEAMLGADAGAVTQEEENPVELWSLDEINFMLEGDF

SEQ ID NO: 1081 - DNA, 936 bp, Arabidopsis thaliana
atgggagacaacaaccctaaccgatcagaagcagaacgtcttctcggaatcgcggagaagcttctcgagtcacgagatctaaacggttcaaaagagtttgcaatcttagctcaagagacagagccactcctcgaaggcaccgatcaaatcctcgccgtcgtcgatgtcttactctcatcagcaccagagaatcgtatcaaaaaccaaccaaactggtacaaaatccttcagatcgaagatctaactgaatcatcaacagacaacgatctaatcaagaaacaataccgtcgtcttgctcttcttctccaccctgacaaaaaccgtttccctttcgccgatcaagctttcagattcgtgcttgatgcatgggaagttctatcaacacctacgaagaaatctcaattcgatggagatttgaatctcatcttcactaaagtaaatctcaacactcagaaatcgaagaagaaaacaacaacgaatgagaagatgtctacgttttggacggcgtgtccgtactgttacagtcttcatgagtatcctagggtttatcaagagtattgtattagatgtcaaaactgtcaaagagcgtttcacgctgcgagtattcctcagttgcctccgttgatacctggtaaagatgagtattattgttgttggggtttttttccgatggggtttgttggtggtaaaggaggagaagctgccattgctaatggagtagatgcagctaagttccctaattggatgcctccggttttctcatccggcggcgttgcagctcctccaagtggtaatggtgttagttttgatggatggtcaggtggtgcggcgaagagagataatgaggctgtgaggagtaataatggtgttggagttaattcagatggaacaccgaagaagagaggaagaggaaggccgaagaagaatccggtttag

SEQ ID NO: 1082 - protein, 311 aa, Arabidopsis thaliana
MGDNNPNRSEAERLLGIAEKLLESRDLNGSKEFAILAQETEPLLEGTDQILAVVDVLLSSAPENRIKNQPNWYKILQIEDLTESSTDNDLIKKQYRRLALLLHPDKNRFPFADQAFRFVLDAWEVLSTPTKKSQFDGDLNLIFTKVNLNTQKSKKKTTTNEKMSTFWTACPYCYSLHEYPRVYQEYCIRCQNCQRAFHAASIPQLPPLIPGKDEYYCCWGFFPMGFVGGKGGEAAIANGVDAAKFPNWMPPVFSSGGVAAPPSGNGVSFDGWSGGAAKRDNEAVRSNNGVGVNSDGTPKKRGRGRPKKNPV

SEQ ID NO: 1083 - DNA, 648 bp, Arabidopsis thaliana
atggtgagaatattccttctctacaatatactaaattcgtttcttctctctttagtaccaaagaagctacgaactcttttccctctttcttggttcgacaaaactctccacaagaactcaccaccgtctccgtcaacgatgttaccttctccatcatcttcttcagcgccgacgaaaagaatagatccgtccgagctcaaacgcgttttccagatgttcgacaagaacggtgacggtcgaatcacaaaggaagagctcaacgactcgcttgagaatcttggaatctacataccagacaaagatctgactcaaatgatccacaagatcgatgctaacggtgatggatgcgtcgacatagacgagtttgagtcgctgtacagctcgattgtggatgagcatcacaacgatggcgaaacagaggaagaggatatgaaagatgcgtttaacgtgtttgaccaagacggagatgggtttatcactgtggaggagttgaaatctgtgatggcttccttgggactcaagcaagggaagaccctagatggttgtaagaagatgattatgcaagttgatgcagatggtgatggtagagtcaattacaaagagtttcttcagatgatgaaaggtggtggctttagcagcagtaattga

SEQ ID NO: 1084 - protein, 215 aa, Arabidopsis thaliana
MVRIFLLYNILNSFLLSLVPKKLRTLFPLSWFDKTLHKNSPPSPSTMLPSPSSSSAPTKRIDPSELKRVFQMFDKNGDGRITKEELNDSLENLGIYIPDKDLTQMIHKIDANGDGCVDIDEFESLYSSIVDEHHNDGETEEEDMKDAFNVFDQDGDGFITVEELKSVMASLGLKQGKTLDGCKKMIMQVDADGDGRVNYKEFLQMMKGGGFSSSN

SEQ ID NO: 1085 - DNA, 483 bp, Arabidopsis thaliana
atggagagtgaaggaaagattgtgttcacagaagagcaagaggctcttgtagtgaagtcttggagtgtcatgaagaaaaactcagctgaattaggtctcaaactcttcatcaagatctttgagattgcaccaacaacgaagaagatgttctctttcttgagagactcaccaattcctgctgagcaaaatccaaagctcaagcctcacgcaatgtctgtttttgtcatgtgttgtgaatcagcagtacaactgaggaaaacagggaaagttacggtgagggagactactttgaagagacttggagccagccattctaaatacggtgtcgttgacgaacactttgaggtggccaagtatgcattgttggagacgataaaggaggcagtgccggagatgtggtcaccggagatgaaggtggcttggggtcaggcttatgatcaccttgttgctgccattaaagctgaaatgaatctttccaactaa

SEQ ID NO: 1086 - protein, 160 aa, Arabidopsis thaliana
MESEGKIVFTEEQEALVVKSWSVMKKNSAELGLKLFIKIFEIAPTTKKMFSFLRDSPIPAEQNPKLKPHAMSVFVMCCESAVQLRKTGKVTVRETTLKRLGASHSKYGVVDEHFEVAKYALLETIKEAVPEMWSPEMKVAWGQAYDHLVAAIKAEMNLSN

SEQ ID NO: 1087 - DNA, 411 bp, Arabidopsis thaliana
atggctttctgcaacaaacttagcggtatcttgagacaaggggtttctcagagctcaaatggtccagttacatctatgcttggctctcttcgttacatgtcctctaagctttttgttggtggtctctcttggggaactgatgacagctccttaaagcaagctttcactagctttggtgaagtcacagaagcaacggtgattgcagacagagagacagggaggtcgaggggattcggatttgttagcttcagctgtgaggattctgctaacaatgccataaaagaaatggatggaaaggagctgaatggtaggcaaatccgtgtgaatcttgcaaccgaaagatcgagtgccccgagatcatcatttggtggtggtggcggttacggtggtggcggtggtggtggctactaa

SEQ ID NO: 1088 - protein, 136 aa, Arabidopsis thaliana
MAFCNKLSGILRQGVSQSSNGPVTSMLGSLRYMSSKLFVGGLSWGTDDSSLKQAFTSFGEVTEATVIADRETGRSRGFGFVSFSCEDSANNAIKEMDGKELNGRQIRVNLATERSSAPRSSFGGGGGYGGGGGGGY

SEQ ID NO: 1089 - DNA, 2163 bp, Arabidopsis thaliana
atggaaccaccgccttcttctctgtcctccaccgcggtggcttccacctccatctccgccgccactgctcctgttcctcctcctctacctcctcacgtgacttcttcttaccccgaatctctcgactcctcccctcgttctcgcaccaccgatggctgggatgaccttcctgctccttctggcggcggcggtggcggtggtggtagcgccgtctcttctaaacttcgttttatgtgtagctacggcggtcatatccttcctcgccctcacgataagtctctctgctacatgggcggtgacactcgcatcgttgtcgtcgaccgtaactcctctctcccttctctcatcgctcgtctctccaacacgcttctcgacggtcgttccttcaccctcaagtaccagttacctagcgaagaccttgactctctcatctccgtcactaccgacgaagatctcgacaacatgatcgaagagtatgaccgtaccatttccgcttccaattccaccaaaccttcgcgtctccggttgtttctattcacctccaagcctgaggctactcaatctatgggtcagatccttgagagctctgccaagagcgacgattggttcctcaacgcactcaatagcgccggtcttctcaatcgaggattctcagattctgatactaacgtcaatcgtttacttggtttggatgatgctcttgctctccgttctaattccggtgacaacaacaatcgagatggtgatgatggctctgttaaaagcgccaagcaacagcaacctccaccgccgcagcagcaagaacaacagcaaggaggccaagatgtgaactgcttaccggattctccgatgttagatacatcctcttctttcggctccacttcttcgtctccctcgctcgccaatttgcctccgatccgtgtccatgtagaggaaccaggcggagtaaggactttgccagatcagagaaatctgggaattgaagaacagttcgcacgattcaacgtcgggaacaagcatcagctacatgacgacggatttgctgcgatctcttcaccaccgccgatgcctgtcacaatcgcccttcctgctgcgcctgtgactgcagccaccgtctctaatgagttccaggccagggtttactcagatgacgagagatccgatcacggcgtgcaggctggatacaggaagcctccgactccgcgatcgcagccgcagaatctaccgcctcagcaggctcatcagctgaaatcaaatagcggtggtggacacgagctgccatcacccaattccgtttccagtgatagcagtatgagcaacccaatgtttcaccaaagaccatctgtctatcaagaaccaattgctcagataccttctggctctaccgttgttactggtatgatcaatccctcagatccaagcacacttttgtcacagcatcagaatcaggacccagcctatatccttcacccccagtttgagcaacaatctgcacaatctcagccacagcagcagttcatacacactgctgctcctcctcaatacattcatcaccatccgtctagcggccttcctgtcccgacttacatccaggtttacccttcgcaacagcctcaacagtccttccatcaacacgcaggtcgactggatcagcagccttatcctgtttattatgtcactgctcctgtcccacctaggccctacagtatgcctgtgccacaatctccaagtgtgagcgatgctgcagggtctatcccctctaaccatcccaactctaccatgatgcctccacctcctaacaaccacatgagaagtgttagcagtggcaaacctgagatgggacaggctggggtttacacaacagccccaggtgtgggcggtgctcagatggttcaccagattcccacaaaccagcagcaattcatggggtattcgcagatccgtcaccctcctcagtctggttcagctgggaatccaaactatggatatgaatatgtcgacaatgctcatacacagatatactacactcaacctatgggacatgcacagtaccagacaatgactgggcctccacctgccatggtgatgcctgatggttctgctgctgctaagcttccagctgagaacatgactcaacagatccggagttcacagccattgtga

SEQ ID NO: 1090 - protein, 720 aa, Arabidopsis thaliana
MEPPPSSLSSTAVASTSISAATAPVPPPLPPHVTSSYPESLDSSPRSRTTDGWDDLPAPSGGGGGGGGSAVSSKLRFMCSYGGHILPRPHDKSLCYMGGDTRIVVVDRNSSLPSLIARLSNTLLDGRSFTLKYQLPSEDLDSLISVTTDEDLDNMIEEYDRTISASNSTKPSRLRLFLFTSKPEATQSMGQILESSAKSDDWFLNALNSAGLLNRGFSDSDTNVNRLLGLDDALALRSNSGDNNNRDGDDGSVKSAKQQQPPPPQQQEQQQGGQDVNCLPDSPMLDTSSSFGSTSSSPSLANLPPIRVHVEEPGGVRTLPDQRNLGIEEQFARFNVGNKHQLHDDGFAAISSPPPMPVTIALPAAPVTAATVSNEFQARVYSDDERSDHGVQAGYRKPPTPRSQPQNLPPQQAHQLKSNSGGGHELPSPNSVSSDSSMSNPMFHQRPSVYQEPIAQIPSGSTVVTGMINPSDPSTLLSQHQNQDPAYILHPQFEQQSAQSQPQQQFIHTAAPPQYIHHHPSSGLPVPTYIQVYPSQQPQQSFHQHAGRLDQQPYPVYYVTAPVPPRPYSMPVPQSPSVSDAAGSIPSNHPNSTMMPPPPNNHMRSVSSGKPEMGQAGVYTTAPGVGGAQMVHQIPTNQQQFMGYSQIRHPPQSGSAGNPNYGYEYVDNAHTQIYYTQPMGHAQYQTMTGPPPAMVMPDGSAAAKLPAENMTQQIRSSQPL

SEQ ID NO: 1091 - DNA, 831 bp, Arabidopsis thaliana
atggaatcaaaatcagaacaaaacgagtggagctccggcgtgtgggctcacttaaccgccgtacggcaacaatcgccgcttgttcagtgcatcaccaacttcgtctcgatggatctcgttgccaacacgcttttatccgccggtgcatctccagcgatggtccattccgtcgttgagattcctgatttcactcctcatattcacgcgctctgcgtcaacgtcggaacacttacacctgactggcttccgtcaatgaaagctgccgctgaactcgcttctcagctccgaaagccttgggttcttgatcccgccgccgtgagttgctccggattccgattaaaagcgtgtttggagctcatcgagctaaaacctactgtaatcaaaggaaacggttctgagattattgctctctcctctgcttcacgtggacaaactaagggtgctgatagctcacatgaatcaacagacgctatagaagctgcaaagtcattagcgatgtcaagtggtgctgttgttgcagtgtcaggagctgttgatattgttactgatgggaaacaggttattggtgttcacaacgggacgaagatgatgcaacagattactgcaactggttgttctctagctggtttgattgtagcgtttcttgctattgattcatcacgggtactggaagctacggtttccgctatggctgtctttggcattgcaggtgagttgggtgaagcgatggcgaatggtccagcgtcattgagaatgcatttgatagattgtctttatgggttggatgaaaccacagtgcttaaacgtgtgaatgtgaccaggttgggttga

SEQ ID NO: 1092 - protein, 276 aa, Arabidopsis thaliana
MESKSEQNEWSSGVWAHLTAVRQQSPLVQCITNFVSMDLVANTLLSAGASPAMVHSVVEIPDFTPHIHALCVNVGTLTPDWLPSMKAAAELASQLRKPWVLDPAAVSCSGFRLKACLELIELKPTVIKGNGSEIIALSSASRGQTKGADSSHESTDAIEAAKSLAMSSGAVVAVSGAVDIVTDGKQVIGVHNGTKMMQQITATGCSLAGLIVAFLAIDSSRVLEATVSAMAVFGIAGELGEAMANGPASLRMHLIDCLYGLDETTVLKRVNVTRLG

SEQ ID NO: 1093 - DNA, 732 bp, Arabidopsis thaliana
atgggaacaccagagacatctcgggagccttgccctgatcgtatactcgatgatatcggtggtgcttttggtatgggagctgttggaggatctgcctttcatttcattaaagggacttacaattctcctaaaggtagtcgctttgttggaggaacacaatcggtgagcatgaacgcacctcgtactggaggcagttttgctgtttggggaggtttattctcgacatttgactgtaccatggtgtacctaaggcaaaaggaggatccttggaactctatcattgctggtgctgcaactggagggtttctgtctatgcggcaaggggctggtgctgcttcgagatcagctatttttggaggggttttgcttgctttgattgaaggagctgggatcatgttgaacaaggtactggctcagcctcagaatatgatgatggaggaccctggaatgcaaggaatgcctgggatgcagggaatgcagggaatgcctgggatgcccggaatgcaaggaatgcctgggatgcaaggaatgcagatggggcagatgcagagtcaagcacagataaggtcagagagtcaaaaccagaatacagcttcatcatcatcatcatcatcatggtttggagggctttttgataagaaaaaggaggaggtgcaaccaggcagtgaaagtaaaacagaggtgttggagagttttgatgctcctccggtgccatcatttgagttcaagtaa

SEQ ID NO: 1094 - protein, 243 aa, Arabidopsis thaliana
MGTPETSREPCPDRILDDIGGAFGMGAVGGSAFHFIKGTYNSPKGSRFVGGTQSVSMNAPRTGGSFAVWGGLFSTFDCTMVYLRQKEDPWNSIIAGAATGGFLSMRQGAGAASRSAIFGGVLLALIEGAGIMLNKVLAQPQNMMMEDPGMQGMPGMQGMQGMPGMPGMQGMPGMQGMQMGQMQSQAQIRSESQNQNTASSSSSSSWFGGLFDKKKEEVQPGSESKTEVLESFDAPPVPSFEFK

SEQ ID NO: 1095 - DNA, 2391 bp, Arabidopsis thaliana
atgggagacggagctttaatcgtagcggtggctatcaaagggaacaatagcaaaaccaaaggcgttgttcgatgggcacttcaagaatttgcttctcaagaacatgtcgtcttcaagctcttacatgtccaaccaagagattcgaattcggtttcaactacaagaaaagatttgaccacaagtgtttacaaaaaagatgttgatagaaaaaccagagagatgcttcttccaagcagagacatgtttgttcatagagaggttcaattggatataatggtgcttgaatcagacgatatagctgatgcaatctctaaagcagttcaagatcatggaattagtgagctagtcattggagcttcctcttcaatcatcttctcatggaagttgaagagaagcaacttgtcttcaagaattgcagatgctacaccaagattttgctcagttcatgttatctctaaaggaaagcttctcaatgttcgtaaatccgatatggacaccgaaacgagcattgcagacgatagaagcgaaagccggttctcttcagatagccattcaggaacagtaagttcgacatcgagtcatcaattctcatcaacacctttactcttccaacgaatccaagccctaacaaccgtgaaccagaaggttggaacaaacattggaaaacagaacaatgaaccgcatcatcatcatcataacagagctgggtctctagacgtggatgaatcaaagttactgaaccagaagggcttttatcgaacaagcagctccggaatcgggtatggaggaagtgatatcagtagctggagaagctctcagatggaagaggcttcaagctcaagtacctacagtgaccctacttcatctagtagccagatacataaagactttgagttagagaagctgaagattgaactccgtcacattaaaggaatgtatgcagttgctcaaagcgaagtcatcgatgcttctaaaaagatgcaagatctgaaccagcggcgatcagaggaagctacaaggctcaagaacttaacgataagagaagaagaagcggatgaagtggtggaaatggagagggagagacaagaggatgcggaaaacgaagctgagctcgtgagagaatgcattgagagagaaaccgaagagagacttgaggcggaagcaagagcggaagaggttagaaaagagaagcagaggttagaggatgcacttgaaggtggaccgcttcaacgccaacaatacatgaaatttgagtgggaagagatcgtcgaggcgacgtcatctttctcggatgaacttaagatcggagtcggtggttacggaagcgtatataggtgtaacttgcatcacacgacagtagctgtcaaggttcttcattcagacaaaagtagtttaaccaaacagtttcaccaagagcttgagattcttagcaagattcgtcatccacacttgcttctcctcctaggcgcgtgtcctgaacgcggaagcttagtttacgagtatatgcacaacggaagccttgaggaaagactcatgaaacgccgaccaaacgttgacacaccgcaaccgccgccattacggtggttcgagcggttccgaatcgcttgggagatcgcttcagcactctactttctccacacaaacgaaccaagaccaatcgttcaccgcgatcttaaaccagccaatatcctcctagaccggaacaatgtgagcaaaatcggagacgtaggcctttccaaaatggttaatcttgatccttctcatgcctcaacggttttcaacgaaaccggtccagttggaacattcttctacatagatcctgaataccaaagaaccggagtggtaactcccgaatctgatatctacgcgtttggaatcatacttcttcagctagtcacagctagatccgcgatgggtttggctcattcgatagagaaagcgttgagagatcaaaccgggaaatttacagagatcttggataaaactgctggagattggccggttaaggaagctaaagagatggttatgatagggcttagatgtgcagagatgagaaagcgtgatcgtcctgatttagggaaagagattttgccggttcttgaacggttaaaggaagttgcgtctatcgcaaggaacatgtttgctgataacctaattgatcatcaccataacgctccgacccatttctactgtccaataacaaaggatgtgatggagaatccatgtgttgcttcggatggatatacgtatgagaagagagcgattaaggaatggcttcagaagaatcataaatctccaatgacggatttgccctttcctagtgattctcttcttcctaatcattctcttctttctgcaatcaaggagtggagatcacaactaattaaataa

SEQ ID NO: 1096 - protein, 796 aa, Arabidopsis thaliana
MGDGALIVAVAIKGNNSKTKGVVRWALQEFASQEHVVFKLLHVQPRDSNSVSTTRKDLTTSVYKKDVDRKTREMLLPSRDMFVHREVQLDIMVLESDDIADAISKAVQDHGISELVIGASSSIIFSWKLKRSNLSSRIADATPRFCSVHVISKGKLLNVRKSDMDTETSIADDRSESRFSSDSHSGTVSSTSSHQFSSTPLLFQRIQALTTVNQKVGTNIGKQNNEPHHHHHNRAGSLDVDESKLLNQKGFYRTSSSGIGYGGSDISSWRSSQMEEASSSSTYSDPTSSSSQIHKDFELEKLKIELRHIKGMYAVAQSEVIDASKKMQDLNQRRSEEATRLKNLTIREEEADEVVEMERERQEDAENEAELVRECIERETEERLEAEARAEEVRKEKQRLEDALEGGPLQRQQYMKFEWEEIVEATSSFSDELKIGVGGYGSVYRCNLHHTTVAVKVLHSDKSSLTKQFHQELEILSKIRHPHLLLLLGACPERGSLVYEYMHNGSLEERLMKRRPNVDTPQPPPLRWFERFRIAWEIASALYFLHTNEPRPIVHRDLKPANILLDRNNVSKIGDVGLSKMVNLDPSHASTVFNETGPVGTFFYIDPEYQRTGVVTPESDIYAFGIILLQLVTARSAMGLAHSIEKALRDQTGKFTEILDKTAGDWPVKEAKEMVMIGLRCAEMRKRDRPDLGKEILPVLERLKEVASIARNMFADNLIDHHHNAPTHFYCPITKDVMENPCVASDGYTYEKRAIKEWLQKNHKSPMTDLPFPSDSLLPNHSLLSAIKEWRSQLIK

SEQ ID NO: 1097 - DNA, 1515 bp, Arabidopsis thaliana
atgcctaacgccggtcgtggaggatctcgaaagagtaagaccacaccaaacgtgactcaaagagccggaggttcaacgcctgctggaagaccctcttcgctaccgcagcagtacgatttcaccccggcggcggcgacggttcaagtttctgcatcgattccgcctcaaggagccggcgccggcgcctcatcctctgccccccactaccgtaactacccaccaccgcagcaactcttccaacactccaccaatcaaccacagcgtgtagatccgttgccaccacaagagactgctcagcaagaccctcctctttcgccggatccagaaactgcatctcacagtcatccctcgtctcaaggcaacaacttccaagagggcattcctgcagtgttgccggagctccaagaagactccgtggttgctctgaatgacattctctctgtgcctggcagagaagcgtggtgttgtgtgttgtctcccattccccggccaaaaaccgaatggtttactcgagacagaggatctcgcttggttaggaagatcactagaattttcttacaaaaattcgatgctcccttctataactggtcatgtgtgccagttgataaaagagaaagattatttttagagtttgcgaaaactcaccactgggatcccttaataacagggacagtccaatattacttcaatgagatcgtcaagaggcgcttgaaggacatggttagcaccgcaaggacaactcgagagcagcctccatggattggagaaacgctgtggggaacaatgtgtgcttactgggacacagaagcagcacaaaaaaggagtcggacctattccaaagctcgtctctctgaccgtaacggtatcggtcctcacgtccactactctgggccaaaatcttttcaagaaatccaagatgaattggaagagaagttgggaagaccggtccatcttggtgaggtgttcattgaaacacacactaagtcggatggctcatttgttgatcagaagtcggagaagattgctcaagcttatcagcagaatgtgagagataggctgtcagcactagaggcgtctgcttctgctgtctctgatggctcttcacgacctccggagctcacactagatgattatacagccatctttctcgagtccacagaaaaggattcaagaggcaatccttatggactaggatgtctaaaagacactctaggcagcgccaaccgcaatcactccggttcctcatcatcctttcaagccctagaagaacggctgcaggaagctcaaaggaaaatagaagagcaggctgcatataatgagaagagagatgctgagattgctgcccgagaagctgagtcatcccgagtcacagctgagcaaaaggacaagctcgagcaattgtctttagtcgagaagtatctacgccaaaccgatccgcagttcttggacttcatggcaagtcactctaccacaaccacagaacgtataccaagtcctccacctaatgatccttag

SEQ ID NO: 1098 - protein, 504 aa, Arabidopsis thaliana
MPNAGRGGSRKSKTTPNVTQRAGGSTPAGRPSSLPQQYDFTPAAATVQVSASIPPQGAGAGASSSAPHYRNYPPPQQLFQHSTNQPQRVDPLPPQETAQQDPPLSPDPETASHSHPSSQGNNFQEGIPAVLPELQEDSVVALNDILSVPGREAWCCVLSPIPRPKTEWFTRDRGSRLVRKITRIFLQKFDAPFYNWSCVPVDKRERLFLEFAKTHHWDPLITGTVQYYFNEIVKRRLKDMVSTARTTREQPPWIGETLWGTMCAYWDTEAAQKRSRTYSKARLSDRNGIGPHVHYSGPKSFQEIQDELEEKLGRPVHLGEVFIETHTKSDGSFVDQKSEKIAQAYQQNVRDRLSALEASASAVSDGSSRPPELTLDDYTAIFLESTEKDSRGNPYGLGCLKDTLGSANRNHSGSSSSFQALEERLQEAQRKIEEQAAYNEKRDAEIAAREAESSRVTAEQKDKLEQLSLVEKYLRQTDPQFLDFMASHSTTTTERIPSPPPNDP

SEQ ID NO: 1099 - DNA, 1887 bp, Arabidopsis thaliana
atgatgtttaatgagatgggaatgtgtggaaacatggatttcttctcttctggatcacttggtgaagttgatttctgtcctgttccacaagctgagcctgattccattgttgaagatgactatactgatgatgagattgatgttgatgaattggagaggaggatgtggagagacaaaatgcggcttaaacgtctcaaggagcaggataagggtaaagaaggtgttgatgctgctaaacagaggcagtctcaagagcaagctaggaggaagaaaatgtctagagctcaagatgggatcttgaagtatatgttgaagatgatggaagtttgtaaagctcaaggctttgtttatgggattattccggagaatgggaagcctgtgactggtgcttctgataatttaagggagtggtggaaagataaggttaggtttgatcgtaatggtcctgcggctattaccaagtatcaagcggagaataatatcccggggattcatgaaggtaataacccgattggaccgactcctcataccttgcaagagcttcaagacacgactcttggatcgcttttgtctgcgttgatgcaacactgtgatcctcctcagagacgttttcctttggagaaaggagttcctcctccgtggtggcctaatgggaaagaggattggtggcctcaacttggtttgcctaaagatcaaggtcctgcaccttacaagaagcctcatgatttgaagaaggcgtggaaagtcggcgttttgactgcggttatcaagcatatgtttcctgatattgctaagatccgtaagctcgtgaggcaatctaaatgtttgcaggataagatgactgctaaagagagtgctacctggcttgctattattaaccaagaagagtccttggctagagagctttatcccgagtcatgtccacctctttctctgtctggtggaagttgctcgcttctgatgaatgattgcagtcaatacgatgttgaaggtttcgagaaggagtctcactatgaagtggaagagctcaagccagaaaaagttatgaattcttcaaactttgggatggttgctaaaatgcatgactttcctgtcaaagaagaagtcccagcaggaaactcggaattcatgagaaagagaaagccaaacagagatctgaacactattatggacagaaccgttttcacctgcgagaatcttgggtgtgcgcacagcgaaatcagccggggatttctggataggaattcgagagacaaccatcaactggcatgtccacatcgagacagtcgcttaccgtatggagcagcaccatccaggtttcatgtcaatgaagttaagcctgtagttggatttcctcagccaaggccagtgaactcagtagcccaaccaattgacttaacgggtatagttcctgaagatggacagaagatgatctcagagctcatgtccatgtacgacagaaatgtccagagcaaccaaacctctatggtcatggaaaatcaaagcgtgtcactgcttcaacccacagtccataaccatcaagaacatctccagttcccaggaaacatggtggaaggaagtttctttgaagacttgaacatcccaaacagagcaaacaacaacaacagcagcaacaatcaaacgttttttcaagggaacaacaacaacaacaatgtgtttaagttcgacactgcagatcacaacaactttgaagctgcacataacaacaacaataacagtagcggcaacaggttccagcttgtgtttgattccacaccgttcgacatggcgtcattcgattacagagatgatatgtcgatgccaggagtagtaggaacgatggatggaatgcagcagaagcagcaagatgtatccatatggttctaa

SEQ ID NO: 1100 - protein, 628 aa, Arabidopsis thaliana
MMFNEMGMCGNMDFFSSGSLGEVDFCPVPQAEPDSIVEDDYTDDEIDVDELERRMWRDKMRLKRLKEQDKGKEGVDAAKQRQSQEQARRKKMSRAQDGILKYMLKMMEVCKAQGFVYGIIPENGKPVTGASDNLREWWKDKVRFDRNGPAAITKYQAENNIPGIHEGNNPIGPTPHTLQELQDTTLGSLLSALMQHCDPPQRRFPLEKGVPPPWWPNGKEDWWPQLGLPKDQGPAPYKKPHDLKKAWKVGVLTAVIKHMFPDIAKIRKLVRQSKCLQDKMTAKESATWLAIINQEESLARELYPESCPPLSLSGGSCSLLMNDCSQYDVEGFEKESHYEVEELKPEKVMNSSNFGMVAKMHDFPVKEEVPAGNSEFMRKRKPNRDLNTIMDRTVFTCENLGCAHSEISRGFLDRNSRDNHQLACPHRDSRLPYGAAPSRFHVNEVKPVVGFPQPRPVNSVAQPIDLTGIVPEDGQKMISELMSMYDRNVQSNQTSMVMENQSVSLLQPTVHNHQEHLQFPGNMVEGSFFEDLNIPNRANNNNSSNNQTFFQGNNNNNNVFKFDTADHNNFEAAHNNNNNSSGNRFQLVFDSTPFDMASFDYRDDMSMPGVVGTMDGMQQKQQDVSIWF

SEQ ID NO: 1101 - DNA, 2691 bp, Arabidopsis thaliana
atgtattgtagagagtccttgtcgagtctccagactttgaacgtagcaaagagtctcagctctttgttccctaaacaatcagctctcatcaacccgatctccgctggacgtcgaaacaacctgcctcgtccaaacctcagaagacgatgtaaggtcaccgcttcacgggctaatattgaacaagaaggtaacacagtgaaagaacccattcagaatattaaagtaaagggatacataacggcccaagaagagtttctggagggcataacttggtcgagaggtctcgatgacattgctgatatccgcggcagatcattgctcgtcgagcttattagcgccaagactgaccagcggattacggtagaagactacgcacaacgtgtatgggccgaagcccctgatgagaagtacgagtgcgagtttgagatgcctgaagactttggaccagtgggagccatcaagattcagaaccaataccatcgacagttgttcctcaagggggtagagcttaaattacccggcgggtcgataacgtttacatgtgagtcatgggtggcccccaagtccgttgacccaaccaagcggatattcttctccgacaagtcctacttgccttcccaaacaccagagcctcttaaaaagtatcgaaaagaggagctcgagaccttacaaggcaagaaccgcgaggaagttggtgaatttaccaagtttgagcgcatttacgactatgatgtgtacaacgatgttggtgaccctgacaatgatcctgaacttgctcgtccggtaattggaggcctcacacatccatatccaaggcgttgcaagaccggtcgaaaaccttgtgagactgacccctcttcagagcaacgctacgggggagagttctatgtaccaagagacgaggagttctctacagccaagggcacttcattcacaggcaaggccgtactggcagctcttccctccatcttccctcagatcgagtctgttctattgagtccccaagaaccttttccacacttcaaggccatacaaaatctctttgaagaaggcattcagcttcccaaggatgctggcctcttacctctgctccccagaatcatcaaagctcttggcgaagctcaagatgatattctccagtttgatgccccagttctcattaacagggatagattttcatggttacgagacgacgagtttgctcgccagacacttgccggccttaatccttatagcattcagctagttgaagagtggccgttaataagcaaactagacccggccgtttatggtgatcccacctcactcattacttgggaaattgtggaaagagaagttaaaggaaacatgacagttgatgaggctctaaagaataagagattgttcgtgttggattatcatgatttgcttctaccatatgtgaacaaagtgagagagttaaacaataccacattatatgcttctagaacactattcttcctcagcgatgatagcacattgaggcctgttgccattgagttgacttgtccaccaaatatcaacaagccccaatggaaacaagtcttcacgccaggctatgatgctacgtcatgctggctatggaatcttgctaagactcatgctatctctcatgacgccggttatcatcagcttatttcccattggttgaggactcatgcctgtacggagccatacataatagcggcaaatagacaactaagtgccatgcatcccatttataggcttttgcatcctcatttccgctacaccatggaaatcaacgctcgtgcacgccaaagtcttgtcaacggaggtggaatcattgagacttgtttctggcccgggaagtatgcattagagctaagttcagccgtctatggtaaactatggaggtttgaccaggaaggcttacccgcggatctcatcaaaagggggttggctgaggaagataagaccgcagaacatggagtacgtctgacgataccagactatccatttgcaaatgatggtctaatattgtgggatgcaattaaagaatgggtgacagactatgtgaaacattactatcctgatgaagaactgatcacatcggacgaggaactccaaggatggtggagtgaagtgcggaacataggccacggagacaagaaagacgaaccttggtggcctgtcctcaaaacacaagatgacttgattggtgtggtaactacgattgcatgggtcacctcaggtcaccatgcagctgtaaactttggacagtacggatatggaggatactttcccaaccgaccaacgacaacaaggataagaatgccaacggaagatccgacagatgaagccttaaaagagttctatgagtcgccagaaaaagtgttgcttaagacatacccatcgcagaaacaggcgaccctagtgatggtcacgttggatcttttatcaacacattcacctgacgaagagtacattggagaacaacaagaagcatcttgggccaatgagcctgttatcaatgctgcatttgaaagattcaaaggcaagctccaatatctagaaggagtgatagatgagagaaacgtgaacattactctaaagaatagagctggagctggtgttgttaagtatgagcttttgaagcctacctctgagcatggtgttaccggaatgggtgttccttatagtatttctatttga

SEQ ID NO: 1102 - protein, 896 aa, Arabidopsis thaliana
MYCRESLSSLQTLNVAKSLSSLFPKQSALINPISAGRRNNLPRPNLRRRCKVTASRANIEQEGNTVKEPIQNIKVKGYITAQEEFLEGITWSRGLDDIADIRGRSLLVELISAKTDQRITVEDYAQRVWAEAPDEKYECEFEMPEDFGPVGAIKIQNQYHRQLFLKGVELKLPGGSITFTCESWVAPKSVDPTKRIFFSDKSYLPSQTPEPLKKYRKEELETLQGKNREEVGEFTKFERIYDYDVYNDVGDPDNDPELARPVIGGLTHPYPRRCKTGRKPCETDPSSEQRYGGEFYVPRDEEFSTAKGTSFTGKAVLAALPSIFPQIESVLLSPQEPFPHFKAIQNLFEEGIQLPKDAGLLPLLPRIIKALGEAQDDILQFDAPVLINRDRFSWLRDDEFARQTLAGLNPYSIQLVEEWPLISKLDPAVYGDPTSLITWEIVEREVKGNMTVDEALKNKRLFVLDYHDLLLPYVNKVRELNNTTLYASRTLFFLSDDSTLRPVAIELTCPPNINKPQWKQVFTPGYDATSCWLWNLAKTHAISHDAGYHQLISHWLRTHACTEPYIIAANRQLSAMHPIYRLLHPHFRYTMEINARARQSLVNGGGIIETCFWPGKYALELSSAVYGKLWRFDQEGLPADLIKRGLAEEDKTAEHGVRLTIPDYPFANDGLILWDAIKEWVTDYVKHYYPDEELITSDEELQGWWSEVRNIGHGDKKDEPWWPVLKTQDDLIGVVTTIAWVTSGHHAAVNFGQYGYGGYFPNRPTTTRIRMPTEDPTDEALKEFYESPEKVLLKTYPSQKQATLVMVTLDLLSTHSPDEEYIGEQQEASWANEPVINAAFERFKGKLQYLEGVIDERNVNITLKNRAGAGVVKYELLKPTSEHGVTGMGVPYSISI

SEQ ID NO: 1103 - DNA, 984 bp, Arabidopsis thaliana
atgacaatagggtcgtttttctcttctctcttattctggcgcaattctcaggaccaggaggcgcagagagggaggatgcaggagatagatcttagtgttcacactataaagtcccatggaggaagagtcgcttctaaacacaagcacgattggatcatactcgtcatcttgattgccatcgagataggcttgaacctcatctctcctttctaccgctacgtgggaaaagacatgatgactgacctcaagtaccctttcaaggacaacaccgtacctatctggtctgtccctgtgtacgctgtgcttcttcccatcatagtgttcgtctgcttctacctgaagaggacatgtgtgtacgatctgcaccacagcatcctcgggctgctcttcgccgtcttgataactggtgtcatcactgactccatcaaggtagccaccggacgccctcgtcctaacttctactggcgctgcttccccgacggcaaagagctgtatgatgcgttgggaggtgtggtatgccacggcaaggcagctgaggtcaaggaaggccacaagagcttcccgagcggacacacttcctggtcctttgcggggcttacattcctttccctttacctctctggcaaaatcaaggccttcaacaatgaaggacatgtggcgaaactctgcctcgtgatcttccctctgcttgccgcttgtcttgtggggatatctcgtgtggatgactactggcaccactggcaagatgtcttcgcaggagctctcattggcacccttgtagccgccttctgctaccgtcagttctaccccaacccttaccacgaagaaggatggggtccctacgcctatttcaaggcagctcaagaacgaggagtccctgtgacctcctcccaaaacggagatgccttgagggctatgtctctgcagatggattcaacatctctcgaaaacatggaatctggcacttccaccgctcccagatga

SEQ ID NO: 1104 - protein, 327 aa, Arabidopsis thaliana
MTIGSFFSSLLFWRNSQDQEAQRGRMQEIDLSVHTIKSHGGRVASKHKHDWIILVILIAIEIGLNLISPFYRYVGKDMMTDLKYPFKDNTVPIWSVPVYAVLLPIIVFVCFYLKRTCVYDLHHSILGLLFAVLITGVITDSIKVATGRPRPNFYWRCFPDGKELYDALGGVVCHGKAAEVKEGHKSFPSGHTSWSFAGLTFLSLYLSGKIKAFNNEGHVAKLCLVIFPLLAACLVGISRVDDYWHHWQDVFAGALIGTLVAAFCYRQFYPNPYHEEGWGPYAYFKAAQERGVPVTSSQNGDALRAMSLQMDSTSLENMESGTSTAPR

SEQ ID NO: 1105 - DNA, 378 bp, Arabidopsis thaliana
atggcacgtgtttctcacgtgctcaaggctgctcaactcctttctctcttctccgttgcttctctctcctggccgcctccgctctacttctggcctctcatggcctttggccagtttctcaacttcagggtataccaattgttaggtgaagctgggacttattacggtgttcgattcgggaagaacataccatgggttacagagttcccatttggagtcattagagatccacagtatgttgggagtatcatgtctctattggcatgcctctcttgggttccatttcaatacattctcctctggtctctcggttatgttttcatgatgtttctcgagtcaaaggaggatccaaatgctcgtgccaaatccatctcatga

SEQ ID NO: 1106 - protein, 125 aa, Arabidopsis thaliana
MARVSHVLKAAQLLSLFSVASLSWPPPLYFWPLMAFGQFLNFRVYQLLGEAGTYYGVRFGKNIPWVTEFPFGVIRDPQYVGSIMSLLACLSWVPFQYILLWSLGYVFMMFLESKEDPNARAKSIS

SEQ ID NO: 1107 - DNA, 2022 bp, Arabidopsis thaliana
atggctccaaattcagtagcagtgacaatggagaagccagacaacttctctttactagagatcaacggctcagatccatcctcattccccgacaaacgtaaatccatcagtccaaaacaattctcatggttccttcttctcaaagctcatagactcatctcgtgtctctcgtggctagtctcttcggttaaaaagcgaatcgcgttctccgcgaagaacattaacgaagaagaagatcctaaaagcagaggaaaacaaatgtacagattcatcaaagcttgtcttgtcatctccattattgccttgtccatagaaatcgttgcacatttcaagaaatggaatcttgatctcattaaccgaccgtcttgggaggtttacgggcttgtcgaatggtcgtacatggcttggctctcgtttcgatccgattacatcgctcctcttgtcatcagtctctccagattctgcactgtactctttttgattcagtctcttgatcggttagtcctctgtctcggttgcttttggatcaaatttaaaaagatcgaacctaagctcaccgaagaatctatcgatttagaagacccctccagtttcccaatggtccttattcagatcccaatgtgcaacgaacgagaggtgtatgaacaatcaataggagcagcttcacaacttgattggccaaaagataggatcttaattcaagtattagatgattcagacgatccaaatttacagcttttgatcaaagaagaagtatcggtttgggccgaaaaaggcgtaaacataatttacaggcataggttgatcagaactggttacaaagctggcaatttgaaatcagccatgacttgtgattacgttaaagattacgagtttgtgactatcttcgacgcagatttcacaccaaatcctgatttcctcaagaagactgttcctcatttcaagggtaatccagagctagggttggtccaagcaaggtggtcatttgtgaacaaagatgagaatctcctcacgaggctacaaaacataaacttatgtttccacttcgaagtagaacaacaagtgaacggtgtgtttctcaatttcttcggattcaatggaaccgctggagtatggaggatcaaggcattggaagaatccggcggatggctcgagagaaccaccgtggaagatatggatatcgcggttagagcgcatctcaacggctggaagtttatttaccttaatgatgttgaagtcacttgcgagttgccagagtcttatgaagcttacaagaagcaacaacatcgttggcattccggtcctatgcagctgttccggttatgccttccttcaattatcaaatcaaagatatcggtttggaagaaggcgaatttgatcttccttttctttcttctaaggaagcttattctaccattttactcattcacactcttttgcattatacttccattgacaatgttcatacccgaagccgagcttccgttgtggatcatctgctatgttcctatcttcatttcgcttctcaacattctcccgtcacctaaatctttccctttcttagtcccttaccttcttttcgaaaacacaatgtcaataaccaagttcaacgccatgatctccgggctgtttcagtttggatcggcttacgagtgggttgtgacgaagaaaaccgggagatcatcggagtccgatttgctagcgtttgctgaaaaggaagagaagttgcataggagaaactcggagtcaggtttggagcttctgagcaaacttaaggagcaagagacaaatcttgtagggcaagaaaccgtgaagaagagccttggagggctaatgaggccgaagaacaagaagaagacgaacatggtgttcaagaaagagctcgggcttgcgttcttgctgctaaccgcagctgcaaggagctttctatcggcgcacggtcttcacttctactttttgttgtttcagggactgtctttcttggttgtagggttggatttgatcggagaacagatcagctag

SEQ ID NO: 1108 - protein, 673 aa, Arabidopsis thaliana
MAPNSVAVTMEKPDNFSLLEINGSDPSSFPDKRKSISPKQFSWFLLLKAHRLISCLSWLVSSVKKRIAFSAKNINEEEDPKSRGKQMYRFIKACLVISIIALSIEIVAHFKKWNLDLINRPSWEVYGLVEWSYMAWLSFRSDYIAPLVISLSRFCTVLFLIQSLDRLVLCLGCFWIKFKKIEPKLTEESIDLEDPSSFPMVLIQIPMCNEREVYEQSIGAASQLDWPKDRILIQVLDDSDDPNLQLLIKEEVSVWAEKGVNIIYRHRLIRTGYKAGNLKSAMTCDYVKDYEFVTIFDADFTPNPDFLKKTVPHFKGNPELGLVQARWSFVNKDENLLTRLQNINLCFHFEVEQQVNGVFLNFFGFNGTAGVWRIKALEESGGWLERTTVEDMDIAVRAHLNGWKFIYLNDVEVTCELPESYEAYKKQQHRWHSGPMQLFRLCLPSIIKSKISVWKKANLIFLFFLLRKLILPFYSFTLFCIILPLTMFIPEAELPLWIICYVPIFISLLNILPSPKSFPFLVPYLLFENTMSITKFNAMISGLFQFGSAYEWVVTKKTGRSSESDLLAFAEKEEKLHRRNSESGLELLSKLKEQETNLVGQETVKKSLGGLMRPKNKKKTNMVFKKELGLAFLLLTAAARSFLSAHGLHFYFLLFQGLSFLVVGLDLIGEQIS

SEQ ID NO: 1109 - DNA, 792 bp, Arabidopsis thaliana
atgcggatgagctgtaatggatgcagagttcttcggaaagggtgtagtgaggattgtagtataaggccgtgtttggcttggatcaaatcgcctgaagcgcaagctaacgcaactgtctttctcgccaagttctatggccgtgctggactcatgaacctcatcaacgccggtcccaatcaccttcgtcctgggattttccgatcgttgttgcacgaagcttgtgggaggattgtgaatccgatctatggttcggtgggtttgttgtggtcggggaattggcagctttgtcaagacgccgtggaggctgtgatgaaaggagaaccggtcaaagagatcgccacagacgctgcgacgatcggccaaggtccgcctcttaagatctacgacatccgacatatctccaaggatgataactctgccgccgcggctactggctcaaccgatttgaaacttgcgaaaactcgccgtgctaagcgggtctccaccgtcgcgatacaggcggaatcggagggaaagtctgacgaggctagtcacgattcgtcgttgagtcatcagtctgaaatagtggctgctcatgaaggagagagcaaggaatccgagagcaatgtctctgaggttttggcattctcgcctccggctgtgaagggctccggcgagataaagcttgacctaactttaaggctcgaaccggtgtcacgtgcgtatcatgtggtacctgttaagaagagaaggatcggcgtgtttggcacgtgtcagaaggagagcacgtgtaagactgagcttatgctctaa

SEQ ID NO: 1110 - protein, 263 aa, Arabidopsis thaliana
MRMSCNGCRVLRKGCSEDCSIRPCLAWIKSPEAQANATVFLAKFYGRAGLMNLINAGPNHLRPGIFRSLLHEACGRIVNPIYGSVGLLWSGNWQLCQDAVEAVMKGEPVKEIATDAATIGQGPPLKIYDIRHISKDDNSAAAATGSTDLKLAKTRRAKRVSTVAIQAESEGKSDEASHDSSLSHQSEIVAAHEGESKESESNVSEVLAFSPPAVKGSGEIKLDLTLRLEPVSRAYHVVPVKKRRIGVFGTCQKESTCKTELML

SEQ ID NO: 1111 - DNA, 2019 bp, Arabidopsis thaliana
atggcgaatctgattcgaacagaccatcagcaacatattccaaagaagaggaagagaggggaaagtagagtttttaggctgaagacgttcggagagtctggacatccagctgagatgaacgagttgtcttttcgagataacctcgctaaactacttgagtttggtcactttgagagctccggtctaatgggaagttggtcttttcagctcgagattcaacgaaatccaaatcctctctatgttcttctctttgtcgtagaagagcccatcgaagcctctctcaatctccgttgcaaccattgccaatatgttggttggggaaatcaaatgatatgcaacaagaagtaccatttcgtgatcccctcaaaggaaacaatggcggcttttttaaaactggaaggtggaggctacgcttttcccgaaaaggaaagtttctcccatcttgtggagcttcaaggccatgtccttcacggcttctttcactccaacggatttggtcacttgctctctctcaacggcattgaaaccggctccgacttaaccggtcatcaggtcatggatttgtgggaccggctctgcaccggtttaaaggccaggaaaatagggttgaatgacgcgtcgcacaaaaaaggaatggagttgaggctgctgcatggggtagcaaaaggagagccatggttcggtcgttggggctaccggttcgggtcagggacatacggagtgactcaaaagatttacgagaaggcacttgagtcggtccgtaacatacccttgtgcttgcttaaccatcacctaaccagccttaaccgagaaactccaatcctcttgtcaaagtaccaaagtttatccaccgagccattgatcactctcagtgacctcttcaggttcatgcttcatctccattcacgtcttccaagagataactacatgagtaactcccgaaaccaaatcatctccattgatagtaccaactgcagatggtctcaaaaacggatccaaatggctatcaaagtggtcatagagtcactgaaaagagtcgaataccgatggatatcgagacaagaagtgagggatgcagctagaaattacattggggacactggtttgcttgattttgtgttgaagtcgcttgggaaccaggtggttggaaactatttggtccgacgtagtctaaatccggtgaagaaagtgctagagtattccttggaggatatatcaaatttgttaccaagtagtaacaatgaactcataacccttcaaaaccaaaactcaatggggaagatggcgacaaacggtcacaataagatcacaagaggtcaagttatgaaagacatgttttatttttacaaacacattctcatggactacaagggagtgttaggccccataggaggtatattgaaccaaatcggaatggcttcaagagcaatcctcgacgctaagtacttcatcaaagagtatcactacattagagatacatcggcgaaaacgttacacttagatcgaggggaagaattaggaatattctgcacgatcgcgtggaaatgtcatcatcataacaacgagataaaagttcctccacaagaatgcattgtagtgaagaaagatgcaacattgagtgaagtgtacggagaggcagaaagagtgtttagagatatctattgggaactaagagacgtcgtggtggagtcagtggtgggtggtcaaatagagatcacaagggtcgatgaaatggccttgaatgggaataagggattggtgttagaagggaacgtaggaatgatgatgaacattgaagtgacgaaatgttatgaagatgatgataaaaagaaggataagagaatagagtgtgagtgtggagcaacggaagaagatggagagagaatggtgtgttgtgatatttgtgaagtatggcaacacacaaggtgtgttggtgttcaacacaatgaggaagtgcctcgcatttttctttgtcaaagttgtgatcaacatcttattcctctctcttttttaccctaa

SEQ ID NO: 1112 - protein, 672 aa, Arabidopsis thaliana
MANLIRTDHQQHIPKKRKRGESRVFRLKTFGESGHPAEMNELSFRDNLAKLLEFGHFESSGLMGSWSFQLEIQRNPNPLYVLLFVVEEPIEASLNLRCNHCQYVGWGNQMICNKKYHFVIPSKETMAAFLKLEGGGYAFPEKESFSHLVELQGHVLHGFFHSNGFGHLLSLNGIETGSDLTGHQVMDLWDRLCTGLKARKIGLNDASHKKGMELRLLHGVAKGEPWFGRWGYRFGSGTYGVTQKIYEKALESVRNIPLCLLNHHLTSLNRETPILLSKYQSLSTEPLITLSDLFRFMLHLHSRLPRDNYMSNSRNQIISIDSTNCRWSQKRIQMAIKVVIESLKRVEYRWISRQEVRDAARNYIGDTGLLDFVLKSLGNQVVGNYLVRRSLNPVKKVLEYSLEDISNLLPSSNNELITLQNQNSMGKMATNGHNKITRGQVMKDMFYFYKHILMDYKGVLGPIGGILNQIGMASRAILDAKYFIKEYHYIRDTSAKTLHLDRGEELGIFCTIAWKCHHHNNEIKVPPQECIVVKKDATLSEVYGEAERVFRDIYWELRDVVVESVVGGQIEITRVDEMALNGNKGLVLEGNVGMMMNIEVTKCYEDDDKKKDKRIECECGATEEDGERMVCCDICEVWQHTRCVGVQHNEEVPRIFLCQSCDQHLIPLSFLP

SEQ ID NO: 1113 - DNA, 1092 bp, Arabidopsis thaliana
atggaagcactagttgttgatgctggctctaagttcctgaaagcaggagcagcaattcctgaccagtctcctgcaatgataattccctctcaaatgaaacgaatggttgatgatgggtcttcttcagctgataaccccaccactgtctttgaggatgtcactcttgatcctattgaaaggggtttgattagagattgggatgctatggaagatctgttgcgttatgttgtctacactgggcttggatgggaagagggaaacgaaggcaatatactttttacagatccactttgtactcctaaggctattagggagcaattggtgcagttgatgtttgaaacattcaatgtctctggattttatgcatctgagcaagcagtgttgtccctttatgctgttggacgcatctccggttgcactgttgatattggtcatgggaagatagatattgccccagttcttgaaggtgcagtacaacacattgcctcgaaacggtttgagctaggtggaaccgagctaactaaattatttgcccaagagcttggaaaaaccaacccgtcgatgaatctcagcatgtctgatgttgaaaaactcaaggagcagtatgcaaactgtgccgaggacgaaattgcttacaaaaaaacccaaaactgtgaaatcgagcagcatactcttcctgatggacaggtgataagcatcgggcgagagagatactcggttggagaagctctgtttcagccatcaatactgggactggaggagcatggaatcgttgagcagcttgtccggattatctccacagtgtcatctgagaaccataggcagctcttggagaacactgtactttgtggtggtacaacctccatgacaggattcgaaagtagattccagaaagaagcaaacttgtgctcatctgccattaggccaacactggtgaaaccgccagaatatatgccggagaatttggggatgtattcggcttgggttggaggagccatactagctaaagtggtgtttccgcagaatcagcacgttactaaagcagattatgacgagactggaccatcagtggttcacaggaaatgtttctga

SEQ ID NO: 1114 - protein, 363 aa, Arabidopsis thaliana
MEALVVDAGSKFLKAGAAIPDQSPAMIIPSQMKRMVDDGSSSADNPTTVFEDVTLDPIERGLIRDWDAMEDLLRYVVYTGLGWEEGNEGNILFTDPLCTPKAIREQLVQLMFETFNVSGFYASEQAVLSLYAVGRISGCTVDIGHGKIDIAPVLEGAVQHIASKRFELGGTELTKLFAQELGKTNPSMNLSMSDVEKLKEQYANCAEDEIAYKKTQNCEIEQHTLPDGQVISIGRERYSVGEALFQPSILGLEEHGIVEQLVRIISTVSSENHRQLLENTVLCGGTTSMTGFESRFQKEANLCSSAIRPTLVKPPEYMPENLGMYSAWVGGAILAKVVFPQNQHVTKADYDETGPSVVHRKCF

SEQ ID NO: 1115 - DNA, 1776 bp, Arabidopsis thaliana
atggaatccatcatggaagaagctgatagttacattgagtatgtatcagtggcggagcggagagcgattgcagcgcagaagatacttcagcggaagggaaaagcttcggaattggaagaagaagctgacaaggaaaagctcgctgaagctaaacctagtttacttgttcaagcaactcagctcaagcgagatgtacccgaagttagtgctactgagcaaatcatcttacaagagaaagagatgatggagcatttatctgataagaagacgcttatgtctgttcgtgaacttgccaaaggtatcacttatacagagcctctcttaactgggtggaaacctcctttgcatattaggaagatgtctagtaagcagagagatttgattaggaagcaatggcatattattgttaatggtgatgatattcctcctcctattaagaactttaaggatatgaagtttcctagacctgttctcgatactctcaaggagaaaggtattgtgcagcctactcctattcaagttcagggtcttcctgtgattttggctgggagagatatgattgggattgctttcactggttccggaaagactttggttttcgtgcttcccatgatcatgattgctctccaagaagagatgatgatgcctattgctgctggtgaaggtcccattgggcttattgtttgcccttctagagagcttgctaggcagacttatgaagtggttgagcagtttgtggctcctttggttgaggctgggtacccgccattgaggtcgttgctatgtattggaggtattgatatgagatcccagttggaggttgtcaagagaggtgtccatattgttgttgcaacccctgggaggttaaaggatatgctcgccaagaaaaagatgagcttagatgcttgcaggtacctgacactagatgaggcagataggttggttgatttgggtttcgaagatgacataagggaagtctttgaccactttaagtctcaacgtcaaacactattgttctctgccacaatgcccacaaagattcaaatctttgccagaagtgctctggtgaaacctgtgacagttaatgtaggaagagctggagctgcgaatctggatgtgatccaggaggtagaatacgtcaaacaagaagcaaagattgtttacctcctcgagtgtctacagaaaacctctccgccggttttgatattctgtgagaacaaagctgatgttgatgatattcacgagtacttgttactgaaaggagtggaagcagtggccatccatggaggaaaagatcaagaagacagagagtacgcaatctcttcgtttaaagctgggaaaaaagatgtgttggttgcgactgatgttgcttcaaagggtctagatttccctgatatacaacacgtaatcaactacgacatgccagcagagattgagaactatgtgcataggataggacgaacaggtcggtgtggtaaaactgggatagcaacgacgtttataaacaagaatcaaagcgaaaccactctgctggatttgaaacacttgttgcaagaagctaaacagaggattccacctgtccttgctgagctgaatgatccaatggaagaagcagagaccattgctaatgcaagtggtgtcaagggttgtgcctattgtggtggtcttggacatcgtatccgagactgtccaaaacttgagcaccagaagagtgtcgccatttctaactcaagaaaagattattttggctcgggtggctacagaggagaaatataa

SEQ ID NO: 1116 - protein, 591 aa, Arabidopsis thaliana
MESIMEEADSYIEYVSVAERRAIAAQKILQRKGKASELEEEADKEKLAEAKPSLLVQATQLKRDVPEVSATEQIILQEKEMMEHLSDKKTLMSVRELAKGITYTEPLLTGWKPPLHIRKMSSKQRDLIRKQWHIIVNGDDIPPPIKNFKDMKFPRPVLDTLKEKGIVQPTPIQVQGLPVILAGRDMIGIAFTGSGKTLVFVLPMIMIALQEEMMMPIAAGEGPIGLIVCPSRELARQTYEVVEQFVAPLVEAGYPPLRSLLCIGGIDMRSQLEVVKRGVHIVVATPGRLKDMLAKKKMSLDACRYLTLDEADRLVDLGFEDDIREVFDHFKSQRQTLLFSATMPTKIQIFARSALVKPVTVNVGRAGAANLDVIQEVEYVKQEAKIVYLLECLQKTSPPVLIFCENKADVDDIHEYLLLKGVEAVAIHGGKDQEDREYAISSFKAGKKDVLVATDVASKGLDFPDIQHVINYDMPAEIENYVHRIGRTGRCGKTGIATTFINKNQSETTLLDLKHLLQEAKQRIPPVLAELNDPMEEAETIANASGVKGCAYCGGLGHRIRDCPKLEHQKSVAISNSRKDYFGSGGYRGEI

SEQ ID NO: 1117 - DNA, 6465 bp, Arabidopsis thaliana
atgagcggaaggagatgtgatcggaggttgaatgtgcagaaagtttcagcggcagatgaactcgaaactaaacttggatttgggcttttctcccaaggggaaacgcggctcgggtggctactcacgtttgcatcatcatcttgggaagatgccgatactgggaaaacctttagttgtgtggaccttttctttgtcactcaggacggctcttcttttaagactaagtacaagttccgcccttacttgtatgccgccaccaaagacaatatggaactggaagttgaagcctacttgagacgccgatatgaaagacaagttgctgatattcagattgttcacaaagaagatctttatcttaaaaatcatctatctggcctgcaaaaaaaatatctcaaagtatcatttgacactgtgcaacaattggtggaagtaaagagggatctgttgcatattgtcgaacgaaacctcgcaaaatttaatgcacttgaagcttacgaatccatcttgtctggaaaacgagaacaacgtcctcaagactgcttagactctgtggtggacctccgcgagtacgatgttccttatcatgtccgatttgcaattgataatgatgtgcgtagtgggcaatggtacaatgtcagtatttccagcactgatgtcatactagagaagaggacggatcttctccaacgcgcagaagttcgcgtttgtgcattcgatatagagacagtaaagcttccattgaagttcccggatgctgaatatgatcaaattatgatgatatcctacatggttgatgggcaaggttttctaattactaacagagagtgtgttggcaaagacatagaagatctggaatatacacccaaaccagagtttgaagggtatttcaaagtcacgaatgttaccaacgaggttgaactcctccgaaaatggttttctcatatgcaagagttgaaacctggtatttatgttacatacaacggtgacttttttgactggccatttatagaacggagagcatctcatcatgggatcaaaatgaacgaggagttgggattccgttgtgatcaaaatcaaggtgaatgtcgagctaagtttgtgtgccatttggattgtttttcttgggtgaaacgtgatagctatcttcctcagggaagccagggtctgaaggctgttacaaaggtaaaactgggttacgatccactggaagtgaatcctgaggacatggttcggtttgcaatggaaaagccacagacaatggcctcctactctgtctctgatgctgttgcaacttactacctatacatgacatatgtccatccgttcgttttttctctcgcaactatcattccaatggtccctgatgaggttttacgcaaagggagtggcaccctttgtgaaatgcttttgatggttgaggcttacaaggcaaatgttgtatgtcccaacaaaaatcaagctgaccctgagaagttctaccaaggtaaacttcttgaaagtgagacatatattggtggccatgtagagtgcctccaaagtggtgttttcagatctgacattccaaccagttttaagctcgacgcatccgcataccagcaactgatcgataaccttggtcgggatctggaatatgctatcactgttgaaggaaaaatgagaatggattcagtttccaattttgatgaagtaaaggaagtaatcagggaaaagctcgagaagttacgggatgatcctatacgtgaagaggggcctcttatttatcaccttgatgtcgcggcgatgtatccaaatattatcttaacaaacaggcttcagccaccatcaatagttacggatgaggtttgcacagcatgtgatttcaacggcccggaaaagacctgtcttagaaaacttgaatgggtttggcgtggggtgacgttcaagggaaataaaagtgaatattaccatctgaagaagcagattgagtctgaatctgttgatgctggagcaaatatgcagtcttcaaaaccttttcttgatctgccaaaggtggaacaacaatccaaattaaaagaacgactgaaaaaatactgtcaaaaggcatatagccgagtacttgacaagccaatcactgaagttcgcgaggctgggatatgcatgagagaaaacccgttctatgtggacactgtgcgcagctttcgagataggaggtatgaatacaaaacacttaacaaggtctggaagggaaagttgtcagaggccaaggcaagtggcaatttaatcaagatccaggaagcacatgacatggtagtggtttacgattccttgcagctagctcataagtgtatacttaattccttttatggatatgtcatgcgaaagggcgcaagatggtactccatggaaatggctggggtagttacttatactggagccaaaatcatccagaatgctcgtttgcttattgaacgaattgggaaaccacttgagctggatacagatggtatatggtgtgctctacctggatcttttcctgagaactttacctttaaaaccatagatatgaagaaattcaccatctcgtatccgtgtgtaatacttaatgttgatgtggcgaagaataattcaaatgaccaatatcagactctagtagatcctgtacgaaagacatataattcacgtagcgaatgctcaattgaatttgaagtggatggaccgtacaaggcaatgattattcctgcatccaaggaagagggaatcttaattaagaagcggtatgctgttttcaatcatgacggaaccatagcagaactcaaggggtttgagatgaagcgtagaggagagctgaaactcattaaagttttccaggccgagctatttgacaaatttctgcatggatcaacccttgaagagtgttattctgctgttgcagctgttgcaaatcgttggcttgacctactcgagggtcaaggaaaagatattgccgatagtgaattgctagattatatatcagaatcaagcactatgagcaaatcgttagcagattatggtcaacaaaagtcatgtgcagtgaccacagcaaaacgcctggctgattttcttggtgatacaatggtcaaagataaaggactgcgctgccaatacatcgttgctcgtgaaccagaggggacacctgtaagtgaacgtgctgtccctgttgccatatttcaaacagatgatcctgaaaaaaagttttatctgcaaaaatggtgcaagatatcatcatatactggaatccgttcaattattgactggatgtattacaagcagcgtcttcattcagctattcaaaaagttattaccattcctgctgcaatgcagaaggtggcaaatcctgtacttagggtgcgtcatccttattggctcgagaaaaaggtctgtgacaaatttcgtcagggaaaaatagttgatatgtttagctcagcaaacaaagatcattcgacaactcaagataatgtagtggcggatattgaagagttttgcaaagaaaacagaccttccgtaaaagggccaaagccagttgcgcgttcatttgaagtcgatagaaatcactctgagggtaagcagcaagagagttgggatccagagttccatgatatctcattacagaacgttgacaagaatgtagattaccaaggatggcttgaactggaaaaaagaaaatggaaaatgactctaacgaataagaaaaaaagaaggtttgatgatctaaagccttgtaatcagattgatgcacacaagataaataaaaaagtctgtaagggaagagtaggtgtaggctcatactttaggaggcctgaagaagctttgactagttcctatttgcagataatacagttggtccaaagtccacagagcgggcaattttttgcttgggttgttgtggaaggattgatgcttaagatcccattgacgatcccaagggtgttttacattaattccaaagcttctatagctggaaacttcacgggaaagtgtatcaacaagattcttcctcacggaaagccttgttacaatttgatggaggcacgtcatttacacaatacacatatcttgcttcttgtcaatattcaggaagatcaatttataaaagaaagcaaaaagcttgccgctctacttgcagaccccgaaattgagggcatatatgaaactaagatgcctctggagtttagtgctatatgtcagattggatgtgtatgcaaaattgaagacacggccaaacaccgtaacacccaagatggatggaaacttggtgaacttcacaggataactacaactgagtgtcgctacttggagaattctattccacttgtttatttgtatcacagcacctcaacaggtcgtgctgtttatgttttatattgtcatgcttcgaagcttatgtctgttgtggtagtcaatccttacggtgacaaggaattattatcatctgccctagagagacagtttagagatagatgccaagaactgtcacctgagccattttcttgggatggtatccttttccaggtcgagtatgttgaccatccagaagctgccacgaaatttttacaaaaagcgctctgtgaatacagagaagaaaattgtggagcaactgtggcagtcattgaatgccctgactttaacaccacgaaggaaggtgtaaaggccctggaagatttcccatgtgtgaggattcccttcaacgacgatgacaatagttatcagcctgtctcctggcaacgtccagcagcaaaaatagcagtgctccgttgtgcttcagcaattcagtggttggaccggaggattgcccagtcaagatacgcccatgtgcctctggggaattttggacgtgattggttaacgttcacagtagatatcttcctgtccagggcactccgtgaccagcaacaggttctttgggtctcagataatggtgttccagaccttggagatataaacaatgaagagacatttctagctgatgagttacaagagacaagtttgctattccctggagcgtacagaaaagtgtctgtggagttaaaggtccatagattagctgttaatgcccttctgaaaagtgacctggtgagtgaaatggaaggaggcggctttttgggtgtgaattctagaggaagtagcttaaacgataatggcagttttgatgagaataatggatgcgcgcaagcatttcgtgtcctgaaacaattgatcaagcgcttgttgcatgatgcgtgtaattctggcaatatatatgctgattccattttgcaacatctgtcttggtggctccgcagcccttcctcaaagcttcacgatccagctctccatctcatgcttcacaaggtcatgcaaaaggtgtttgcgctgcttttgactgatttgcggaggttaggtgctataataatatacgcagacttctcaaaggtcattatcgacacagggaaatttgatctatctgctgcaaagacttattgtgaaagcttgctcacagtgatggggagtagagatatctttaagttgatcttgcttgagccggttcactactggcactcgttacttttcatggaccagcataactacgctggtatccgagctaccggagatgaaatttcaggtaacgaagttactattgaaccaaagtggagcgttgcacggcatttacccgagtatattcagaaggattttatcataattgttgccacgtttatatttggcccctggaaatttgcattagagaaaaaaaggggcagtgcagagagtttagaggcagagatggtagaatatctcaaggaacagataggaacccggttcataagcatgattgttgagaagattggtaatatcaggtcacacatcaaggatataaacgtgtcagatgcatcttgggcttctggtcaagctcccaaaggagattacacgttcgaatttatacaaattattactgctgttctggctcttgatcaaaacgttcagcaagatgttctggtaatgagaaagattctgttgaagtacattaaagtaaaagaatgtgctgctgaagccgaatttattgatcctgggccatccttcatcttacccaacgtggcttgcagcaactgcggtgcctacagagacctagatttctgcagagactcagctctcttaacagaaaaagaatggtcatgtgcggatccgcaatgtgtgaagatatatgacaaagagcagatagagagtagcattatccagatggtgagacagagggaaagaatgtaccagttgcaggatctagtgtgcaataggtgcaatcaggtgaaagccgctcatttgacagagcagtgtgagtgttctggatcctttagatgcaaggagagtggttcagatttccacaagaggattgagattttcttggatatagcaaagcgccagaagtttagactgctagaagaatgcatctcctggattttatttgccaccagctgttga

SEQ ID NO: 1118 - protein, 2154 aa, Arabidopsis thaliana
MSGRRCDRRLNVQKVSAADELETKLGFGLFSQGETRLGWLLTFASSSWEDADTGKTFSCVDLFFVTQDGSSFKTKYKFRPYLYAATKDNMELEVEAYLRRRYERQVADIQIVHKEDLYLKNHLSGLQKKYLKVSFDTVQQLVEVKRDLLHIVERNLAKFNALEAYESILSGKREQRPQDCLDSVVDLREYDVPYHVRFAIDNDVRSGQWYNVSISSTDVILEKRTDLLQRAEVRVCAFDIETVKLPLKFPDAEYDQIMMISYMVDGQGFLITNRECVGKDIEDLEYTPKPEFEGYFKVTNVTNEVELLRKWFSHMQELKPGIYVTYNGDFFDWPFIERRASHHGIKMNEELGFRCDQNQGECRAKFVCHLDCFSWVKRDSYLPQGSQGLKAVTKVKLGYDPLEVNPEDMVRFAMEKPQTMASYSVSDAVATYYLYMTYVHPFVFSLATIIPMVPDEVLRKGSGTLCEMLLMVEAYKANVVCPNKNQADPEKFYQGKLLESETYIGGHVECLQSGVFRSDIPTSFKLDASAYQQLIDNLGRDLEYAITVEGKMRMDSVSNFDEVKEVIREKLEKLRDDPIREEGPLIYHLDVAAMYPNIILTNRLQPPSIVTDEVCTACDFNGPEKTCLRKLEWVWRGVTFKGNKSEYYHLKKQIESESVDAGANMQSSKPFLDLPKVEQQSKLKERLKKYCQKAYSRVLDKPITEVREAGICMRENPFYVDTVRSFRDRRYEYKTLNKVWKGKLSEAKASGNLIKIQEAHDMVVVYDSLQLAHKCILNSFYGYVMRKGARWYSMEMAGVVTYTGAKIIQNARLLIERIGKPLELDTDGIWCALPGSFPENFTFKTIDMKKFTISYPCVILNVDVAKNNSNDQYQTLVDPVRKTYNSRSECSIEFEVDGPYKAMIIPASKEEGILIKKRYAVFNHDGTIAELKGFEMKRRGELKLIKVFQAELFDKFLHGSTLEECYSAVAAVANRWLDLLEGQGKDIADSELLDYISESSTMSKSLADYGQQKSCAVTTAKRLADFLGDTMVKDKGLRCQYIVAREPEGTPVSERAVPVAIFQTDDPEKKFYLQKWCKISSYTGIRSIIDWMYYKQRLHSAIQKVITIPAAMQKVANPVLRVRHPYWLEKKVCDKFRQGKIVDMFSSANKDHSTTQDNVVADIEEFCKENRPSVKGPKPVARSFEVDRNHSEGKQQESWDPEFHDISLQNVDKNVDYQGWLELEKRKWKMTLTNKKKRRFDDLKPCNQIDAHKINKKVCKGRVGVGSYFRRPEEALTSSYLQIIQLVQSPQSGQFFAWVVVEGLMLKIPLTIPRVFYINSKASIAGNFTGKCINKILPHGKPCYNLMEARHLHNTHILLLVNIQEDQFIKESKKLAALLADPEIEGIYETKMPLEFSAICQIGCVCKIEDTAKHRNTQDGWKLGELHRITTTECRYLENSIPLVYLYHSTSTGRAVYVLYCHASKLMSVVVVNPYGDKELLSSALERQFRDRCQELSPEPFSWDGILFQVEYVDHPEAATKFLQKALCEYREENCGATVAVIECPDFNTTKEGVKALEDFPCVRIPFNDDDNSYQPVSWQRPAAKIAVLRCASAIQWLDRRIAQSRYAHVPLGNFGRDWLTFTVDIFLSRALRDQQQVLWVSDNGVPDLGDINNEETFLADELQETSLLFPGAYRKVSVELKVHRLAVNALLKSDLVSEMEGGGFLGVNSRGSSLNDNGSFDENNGCAQAFRVLKQLIKRLLHDACNSGNIYADSILQHLSWWLRSPSSKLHDPALHLMLHKVMQKVFALLLTDLRRLGAIIIYADFSKVIIDTGKFDLSAAKTYCESLLTVMGSRDIFKLILLEPVHYWHSLLFMDQHNYAGIRATGDEISGNEVTIEPKWSVARHLPEYIQKDFIIIVATFIFGPWKFALEKKRGSAESLEAEMVEYLKEQIGTRFISMIVEKIGNIRSHIKDINVSDASWASGQAPKGDYTFEFIQIITAVLALDQNVQQDVLVMRKILLKYIKVKECAAEAEFIDPGPSFILPNVACSNCGAYRDLDFCRDSALLTEKEWSCADPQCVKIYDKEQIESSIIQMVRQRERMYQLQDLVCNRCNQVKAAHLTEQCECSGSFRCKESGSDFHKRIEIFLDIAKRQKFRLLEECISWILFATSC

SEQ ID NO: 1119 - DNA, 1068 bp, Arabidopsis thaliana
atggagttacccgtcgtagatctgtctagttacctcgacttctccggtgatgaattaggatccgatctactcgaatcatgccgacaagtgagtcggatcctaaaagaaaccggagctctcattgttaaagatcctcgatgttgcgctcaagacaacgatcgattcattgatatgatggaaaattatttcgaaaaacctgatgatttcaaacgattgcaacaaagacctaatcttcactatcaggttggtgcgacgccggagggagttgaagtgccgaggagtttggttgatgaagagatgcaagaaaagttcaatacaatgcctaatgaatacaaaccacatattccgaaaggaccagatcataagtggagatatatgtggagagttggtcctaggccatctaacacacggtttaaggagcttaattctgagcctgttgtaccggaaggttttccggggtgggaagaagtaatggactcatggggttacaagatgatatccgcggttgaggttgttgctgaaatggcagcaattgggtttggtttgcctaaggatgcatttacatcactcatgaagcagggtcctcatcttcttgctccaacgggaagtgatcttaactgttacaacgaggaagggacgatatttgcaggatatcactatgatcttaattttctaacgattcatggaagaagtagattccctggtctatatatttggttaaggaatggagagaaggttgcggttaaagttccggtaggctgtctcttgattcaagctggaaagcagatagaatggttaactgctggagaatgcattgctggaatgcatgaagtggttgttacgagcaagacgaaggatgccatcacattagcaaaggaacaaaaccgaagcctatggagagtttcctcgactttgtttgcccacattgcctctgatgcggagctgaaacctttgggacatttcgcagaatcatctttggcaagtaaatatccggcgatacccgcaggagagtatgttgaacaagaactctcggtcatcaatctcaaaggaaataagggatcttcatag

SEQ ID NO: 1120 - protein, 355 aa, Arabidopsis thaliana
MELPVVDLSSYLDFSGDELGSDLLESCRQVSRILKETGALIVKDPRCCAQDNDRFIDMMENYFEKPDDFKRLQQRPNLHYQVGATPEGVEVPRSLVDEEMQEKFNTMPNEYKPHIPKGPDHKWRYMWRVGPRPSNTRFKELNSEPVVPEGFPGWEEVMDSWGYKMISAVEVVAEMAAIGFGLPKDAFTSLMKQGPHLLAPTGSDLNCYNEEGTIFAGYHYDLNFLTIHGRSRFPGLYIWLRNGEKVAVKVPVGCLLIQAGKQIEWLTAGECIAGMHEVVVTSKTKDAITLAKEQNRSLWRVSSTLFAHIASDAELKPLGHFAESSLASKYPAIPAGEYVEQELSVINLKGNKGSS

SEQ ID NO: 1121 - DNA, 444 bp, Arabidopsis thaliana
atgagccaccgtgtttcgattctatcatctcatttctcacctgcctccgccgtcatggcttccgagaaagaagctgctctcgccgccactccttccgattctcccaccatatttgacaagatcatcagcaaagagattccatccaccgtggtttttgaggatgacaaggtcttagcttttagggacataacgccccagggtcctgttcacatcctccttattccaaaagtgagggatggcctaactggcctctctaaggctgaggaaaggcacatcgacatcttgggccgccttctctacactgccaagcttgtagcaaaacaagaaggcctagcagagggtttcagaattgttatcaatgatggtcctcaaggctgtcaatcggtgtatcacattcatgttcatctcattggaggacgccaaatgaactggcctcctggttaa

SEQ ID NO: 1122 - protein, 147 aa, Arabidopsis thaliana
MSHRVSILSSHFSPASAVMASEKEAALAATPSDSPTIFDKIISKEIPSTVVFEDDKVLAFRDITPQGPVHILLIPKVRDGLTGLSKAEERHIDILGRLLYTAKLVAKQEGLAEGFRIVINDGPQGCQSVYHIHVHLIGGRQMNWPPG

SEQ ID NO: 1123 - DNA, 1698 bp, Arabidopsis thaliana
atgaactgtgcaatttcaggagaagttcccgtggagccagtggtttcgacgaagtcaggattactcttcgagagacgactaatcgaaagacatatatcggattatgggaagtgcccggttactggcgaaccacttaccattgatgacattgttcccatcaaaactggggagatcataaagccgaaaacattgcatacagctagtatccctggattgctcggaacgttccagaatgaatgggacggtttgatgctatcaaattttgcactggagcaacaactacatactgcaaggcaagagctaagtcatgccttgtatcagcatgattctgcttgtcgtgtgattgctagacttaaaaaagaaagagacgaagcacgccaattactggccgaggttgagagacatatacctgcggcccctgaagctgtgacagctaatgctgctctgagtaatggtaaacgagctgccgttgacgaggaactgggtcctgatgcaaagaaattgtgtcctggaatttcagctgaaattattacggaattgactgattgtaatgctgctctttcccagaagcgaaaaaagcgacagattcctcaaacattggcgtcaatagatactttggagaggttcactcagctatcaagccacccacttcacaagaccaacaaaccaggcatttgttcgatggacattctacattctaaggatgtcattgctactggaggagttgatgcaactgctgttctctttgatcgcccttctggacaaatcttgtcaacactgactggtcactcgaagaaggttacaagcgtaaaatttgtaggcgactctgatcttgttttgactgcttctgctgacaagacagtccgtatctggcggaatcctggggatgggaattatgcttgtgggtatacattgaatgatcattctgcggaggtgcgagctgtaactgtgcatcccacaaataaatactttgtctcggcatctcttgatggtacatggtgcttctacgatctgtcctctggctcatgccttgcacaggtatcagatgattcaaagaatgtagattacacggctgctgcttttcatcccgatggtctcattctcggaaccggtacttctcaatctgttgttaagatttgggacgttaaaagtcaggcaaatgtggctaagtttgatggacacactggggaagttacagctatatctttctctgaaaatggttacttcctcgcgacagctgcagaggatggtgttaggttgtgggatctgcgcaagttaaggaacttcaaatcatttttatctgcagatgcgaactctgtggagtttgatcctagcggatcttatctcggtattgctgcatcagatatcaaagtataccagacggcaagtgtgaaagctgaatggaaccttatcaagacactcccagatctctccggcactggtaaagctacgtgtgtgaagtttggttcagatgcacagtacgttgcagtcggttcgatggaccgtaactacggatatttggtcttcctggtgatgaaaaagccaacgtcgatgatgactctgcgcaagactcgtgaacaatccgtaaaaaactcagacagaacattccaaatgtccatctccagtgttatctcgctcaaatttctcaagttctgttgtatcttacagtatttgcagcaatgggggagaatttcatag

SEQ ID NO: 1124 - protein, 565 aa, Arabidopsis thaliana
MNCAISGEVPVEPVVSTKSGLLFERRLIERHISDYGKCPVTGEPLTIDDIVPIKTGEIIKPKTLHTASIPGLLGTFQNEWDGLMLSNFALEQQLHTARQELSHALYQHDSACRVIARLKKERDEARQLLAEVERHIPAAPEAVTANAALSNGKRAAVDEELGPDAKKLCPGISAEIITELTDCNAALSQKRKKRQIPQTLASIDTLERFTQLSSHPLHKTNKPGICSMDILHSKDVIATGGVDATAVLFDRPSGQILSTLTGHSKKVTSVKFVGDSDLVLTASADKTVRIWRNPGDGNYACGYTLNDHSAEVRAVTVHPTNKYFVSASLDGTWCFYDLSSGSCLAQVSDDSKNVDYTAAAFHPDGLILGTGTSQSVVKIWDVKSQANVAKFDGHTGEVTAISFSENGYFLATAAEDGVRLWDLRKLRNFKSFLSADANSVEFDPSGSYLGIAASDIKVYQTASVKAEWNLIKTLPDLSGTGKATCVKFGSDAQYVAVGSMDRNYGYLVFLVMKKPTSMMTLRKTREQSVKNSDRTFQMSISSVISLKFLKFCCILQYLQQWGRIS

SEQ ID NO: 1125 - DNA, 627 bp, Arabidopsis thaliana
atgttgcgtactatcttcctcttatctcttctctttgctctatccaatgcctctgttcaagatttctgtgtcgcaaacctgaaacgcgctgaaacccctgcgggttacccttgcattcgtcccattcatgtcaaagctacagactttgtcttctctggcttaggcactcctggaaacactacaaacatcatcaacgccgctgtcacacccgctttcgcagctcagttcccgggtctgaacggtctaggcctctctacagctagacttgacttagctcctaaaggtgtgatcccaatgcacactcaccctggtgcctctgaggttctctttgtccttactggctccattaccgctgggtttgtctcctcggcaaacgctgtctacgtgcagacactcaaaccaggacaggtcatggttttcccacagggcttgcttcatttccagatcaacgcgggaaaatcctctgcttcagccgttgtcactttcaacagcgctaatccgggtctgcagattctcgacttcgcactctttgctaacagtcttcccactgaactcgtcgtgggtactactttccttgacgccactacagtcaagaagctaaagggtgttcttggaggaactggctaa

SEQ ID NO: 1126 - protein, 208 aa, Arabidopsis thaliana
MLRTIFLLSLLFALSNASVQDFCVANLKRAETPAGYPCIRPIHVKATDFVFSGLGTPGNTTNIINAAVTPAFAAQFPGLNGLGLSTARLDLAPKGVIPMHTHPGASEVLFVLTGSITAGFVSSANAVYVQTLKPGQVMVFPQGLLHFQINAGKSSASAVVTFNSANPGLQILDFALFANSLPTELVVGTTFLDATTVKKLKGVLGGTG

SEQ ID NO: 1127 - DNA, 840 bp, Arabidopsis thaliana
atggagagtggcgatgagagtccggtggttctaattacgggatgttctcagggaggaattggtcacgcgctggcccgtgagttcactgagaagggatgtcgagtggtggcgacgagtcgatcacggagtacgatgacggatctggagcaagattcgaggttattcgtgaaggagcttgatgtgcaatcggaccagaatgtgagtaaggttttgtcggaggttattgataagttcggtaagatcgacgttcttgttaataacgccggagttcagtgcgttggacctctggcggagactccaatttccgccatggaaaacacattcaacaccaatgtttttggttccatgaggatgactcaagctgttgtaccacacatggtgtctaagaaaaagggaaagattgtcaacgttggaagtatcactgttatggcacctggtccatgggctggtgtctatacagctaccaaagctgctattcatgctcttaccgatactctgaggttggagcttcgtccgtttgggattgatgtcatcaatgttgtcccgggaggaataagaacaaacatagcaaactcagctgtggcaactttcaacaaaatgcctgagctgaaactatacaagccttatgaagaagctatcagagaaagggcgtttatatcacagaggatgaatccaactcctgcagaaacatttgccagagacactgtagccgcagtgctgaagaagaatccacccgcttggttctcgtcaggcaggtattcaaccctcatggcagtcatgtatcatatgcccttatggctcaaagattttttccagaagcaggttttaatgaagaagtga

SEQ ID NO: 1128 - protein, 279 aa, Arabidopsis thaliana
MESGDESPVVLITGCSQGGIGHALAREFTEKGCRVVATSRSRSTMTDLEQDSRLFVKELDVQSDQNVSKVLSEVIDKFGKIDVLVNNAGVQCVGPLAETPISAMENTFNTNVFGSMRMTQAVVPHMVSKKKGKIVNVGSITVMAPGPWAGVYTATKAAIHALTDTLRLELRPFGIDVINVVPGGIRTNIANSAVATFNKMPELKLYKPYEEAIRERAFISQRMNPTPAETFARDTVAAVLKKNPPAWFSSGRYSTLMAVMYHMPLWLKDFFQKQVLMKK

SEQ ID NO: 1129 - DNA, 1704 bp, Arabidopsis thaliana
atgggttttggtacatcttcttcttcatcttcttcctcagctctgaaatggctaggtttcgttactgccgtttgggtccaatccatctccggcaacaattacaccttctcaaattactccggcgcactcaaatccttaatgaacctcactcagttagaactcaacagtctctccgtcgctaaagacgtcggaaaagcattcggaatcctcgccggacttgcttccgaccgtctttcaactccggtgatcctcctcatcggttctttcgaaggtcttcttggttatggtgtacaatggcttgtcgttagccgcacgattcaacctataccttattggcagatgtgtgtgtttctctgtatgggaggaaacagtacgacgtggatgaacacggcggttctggttacttgtataagaaacttccggcgaaatcgtggtcctgtttcagggattcttaaaggatacgttggtttaagtactgcgattttcacggatctatgtaatgctctgttttcctctgacccagcttcgtttcttgtcctcctctccgtcgtgccttttgccgtttgtctcacggcggttttcttcctccgtgaaatccctccgtctactaccttcgccgaggataacgaagagtctaaatactttgctgtgtttaacatcgttgcggttgttgttgctgtgtaccttcagtcttacgacatcatcggaatcaaaacaggagctttctcaatcgcattcgcttccatacttctcatactcttagcctctcctgtcgctgtacctttccacgcttttatccgtagcaaagttcatgatgagcaagacgtagaaggacgaatagatgaacctttactaagatcaggatctgagattgaagtggaggaaacaatcgtaggtgctgcagcggcggcggataacgaattgccaccgtctcttaagccgttaagtaacgaggaggaagagaatcacggaactatagtgacgacggagaagaaaagaccggttcttggagaagaacacaccataatggaagctatgttgaccgttgacttttgggtgttgttcgtgtcgttcttgtgtggagtaggaactggtttagcagttatgaacaatatgggtcagatcgggcttgcgcttggttacactgatgtctccatttttgtctccatgactagcatttggggattctttggtcggattctctccggtactatctccgagcacttcatcaagaaagctggaacaccaagaccattatggaatgcagcagctcaaatcattatggccgtgggatatctactgatggctttagccttgcccggttcactctatattggttcaatggtggttggggtatgctatggagttcggttagcgataaccgtaccaacagcatcagaactcttcggtctcaaatactatggactcatctacaacatccttatacttaatatgcctctaggatcgttcctcttctcgggtctactcgcgggtttactctacgatgctgaagccacacctactcctggtggaggcaatacgtgtgtaggagctcattgtttccgtatcgtcttcattgtaatggcgtttgcttctatcattggggtcggtcttgaccttttgcttgcgtatagaaccaaggggatctatgcgaagattcatgcgagcaagaagactaagaaatctggtggtaatcttcgatga

SEQ ID NO: 1130 - protein, 567 aa, Arabidopsis thaliana
MGFGTSSSSSSSSALKWLGFVTAVWVQSISGNNYTFSNYSGALKSLMNLTQLELNSLSVAKDVGKAFGILAGLASDRLSTPVILLIGSFEGLLGYGVQWLVVSRTIQPIPYWQMCVFLCMGGNSTTWMNTAVLVTCIRNFRRNRGPVSGILKGYVGLSTAIFTDLCNALFSSDPASFLVLLSVVPFAVCLTAVFFLREIPPSTTFAEDNEESKYFAVFNIVAVVVAVYLQSYDIIGIKTGAFSIAFASILLILLASPVAVPFHAFIRSKVHDEQDVEGRIDEPLLRSGSEIEVEETIVGAAAAADNELPPSLKPLSNEEEENHGTIVTTEKKRPVLGEEHTIMEAMLTVDFWVLFVSFLCGVGTGLAVMNNMGQIGLALGYTDVSIFVSMTSIWGFFGRILSGTISEHFIKKAGTPRPLWNAAAQIIMAVGYLLMALALPGSLYIGSMVVGVCYGVRLAITVPTASELFGLKYYGLIYNILILNMPLGSFLFSGLLAGLLYDAEATPTPGGGNTCVGAHCFRIVFIVMAFASIIGVGLDLLLAYRTKGIYAKIHASKKTKKSGGNLR

SEQ ID NO: 1131 - DNA, 1503 bp, Arabidopsis thaliana
atgccggttgatttagataattcctctacagtttccggcgatgcaagcgtctcatcgaccggaaaccaaaatctaactcctaaatccgtcgggaagaagaaacggaatcttcctggaatgcctgatccagacgctgaagtgatagctttgtcacctaaaacacttatggcaacgaatcgattcgtttgcgaaatctgtaacaaaggttttcaacgtgaccagaatcttcagcttcatcgtcgtggtcacaatcttccatggaaacttcgacagagatcgactaaagaagtgaggaagaaggtttatgtttgtcctgtttctggctgtgttcatcatgacccttcacgtgctcttggagatcttactggaatcaagaaacacttttgtcggaaacacggcgagaagaaatggaagtgtgagaaatgttctaagaagtatgctgttcaatcagattggaaagctcattcgaagatttgtggcaccaaggagtataaatgcgattgtggaactctgttttctaggagagatagctttataacgcatagagccttttgtgatgccttggctgaagagagtgcgaagaatcatactcaaagcaagaaactttatccagaaactgtcactaggaagaatcctgaaattgagcaaaaatctccagcagctgttgagtcttctccgtcattaccgccttcttctccgccatcggttgctatagctccggcaccggctatttcggttgagactgagtctgtcaaaatcatatcttcctctgttttgccgattcagaattctccagaatctcaagaaaacaacaatcatcctgaagtcattattgaggaagcttcaagaacgatcgggttcaatgttagctcatcggatctaagcaatgatcacagtaacaacaatggtggatacgcaggtttgtttgtatcatcaacagcttcgcctagtttatatgcttcctcaaccgcttctccaagtctattcgcaccatcgtcctccatggaacccatctctctctgtctctcgacgaacccttctttgttcggaccaacaatacgagatccgccacatttcctaactcctctccctcctcaaccggcaatgtcagctactgcattgctccaaaaagctgcacaaatgggttccacgggatcaggaggttcgttgcttcgcgggttaggcatagtttcaactacttcttcatctatggaactcagcaatcatgatgcattgtcattagctcctggtcttggacttggactaccttgtagcagcggtggtagcggatcgggtctaaaagagctcatgatggggaattcatcggtgtttggtccgaaacagacgacactagactttcttggattaggaagagctgttggtaatggtggtaataccggaggtggattgtctgctctgttaacttctataggtggtggaggtggaatcgatctgtttggatcaggggagttttcaggcaaagacattggaagaagttcgtaa

SEQ ID NO: 1132 - protein, 500 aa, Arabidopsis thaliana
MPVDLDNSSTVSGDASVSSTGNQNLTPKSVGKKKRNLPGMPDPDAEVIALSPKTLMATNRFVCEICNKGFQRDQNLQLHRRGHNLPWKLRQRSTKEVRKKVYVCPVSGCVHHDPSRALGDLTGIKKHFCRKHGEKKWKCEKCSKKYAVQSDWKAHSKICGTKEYKCDCGTLFSRRDSFITHRAFCDALAEESAKNHTQSKKLYPETVTRKNPEIEQKSPAAVESSPSLPPSSPPSVAIAPAPAISVETESVKIISSSVLPIQNSPESQENNNHPEVIIEEASRTIGFNVSSSDLSNDHSNNNGGYAGLFVSSTASPSLYASSTASPSLFAPSSSMEPISLCLSTNPSLFGPTIRDPPHFLTPLPPQPAMSATALLQKAAQMGSTGSGGSLLRGLGIVSTTSSSMELSNHDALSLAPGLGLGLPCSSGGSGSGLKELMMGNSSVFGPKQTTLDFLGLGRAVGNGGNTGGGLSALLTSIGGGGGIDLFGSGEFSGKDIGRSS

SEQ ID NO: 1133 - DNA, 1668 bp, Arabidopsis thaliana
atgcacgcaccggtactcgttctgagcgattcgttgaagcgtgaatctggaagtaaggttcatcatggtaatatccaagcttccaaggctgttgctgatatcattcgtacaacattgggtcctcgttctatgttgaagatgcttcttgatgctggtggagggattgttgttactaatgatgggaatgctattcttcgtgagctagatgtcgctcatcctgcagctaagtcaatgattgagttgagccgtacgcaagatgaagaagttggtgatgggacaacgtctgttattgttctagctggtgaaatgcttcacgttgcagaagcgtttcttgagaagaattaccatcccacagtcatatgccgagcttacatcaaggctctcgaagattctattgctgttcttgacaaaattgctatgtcaattgatatcaatgaccgttcacaagtgctaggattagtcaagagctgcatagggacaaagttcactagccaatttggagatcttattgcggatttggctattgatgccactactactgttggtgttgatcttggacaaggtttgagggaggtagacattaaaaagtacatcaaggttgagaaagttcctggtggtcagttcgaggactctgaggttcttaaaggagttatgtttaacaaagatgttgttgctcctggtaaaatgaaaagaaagattgtcaacccacggattattcttcttgactgtcctcttgagtacaagaaaggtgaaaatcaaaccaatgctgagttggttagagaagaggactgggaagtgttgttgaagttggaagaggaatatatcgagaacatttgcgttcaaatactaaagttcaagcctgatttggttatcacagagaagggtcttagtgacttggcctgtcactatttcagtaaagctggggtaagtgcaatccgaaggttgagaaaaactgacaacaacagaatcgccaaggcttgtggagcagtaattgtgaacaggcccgacgaactgcaggagtctgatatcggtactggggctggcttgtttgaggtcaagaaaattggagatgatttcttttctttcattgttgattgcaaagaacccaaagcctgtactgtactcttaaggggaccaagtaaagatttcatcaatgaagtggaaagaaatttacaggatgccatgtctgttgcaagaaacattatcaaaaacccaaagctagttcctggtggaggagccacagagctaaccgtttctgccacattaaaacagaagagtgcaacaattgaaggcatagaaaagtggccttatgaagcagctgccattgctttcgaggctattccacgtaccctggctcaaaactgtggggttaacgtgatccgtactatgactgcattgcaagggaagcatgcaaatggtgaaaacgcatggactggtattgacgggaacactggtgcaatagctgatatgaaagagagcaagatatgggattcgtacaatgtgaaggcgcaaactttcaagacggctatagaagcagcgtgtatgcttctaaggatcgatgatatagtgagtggaatcaagaagaagcaagctcctggatctggaccttcaaagcctaccattgagacagaaggagatgcagacaacgaacaaattcttcccgactaa

SEQ ID NO: 1134 - protein, 555 aa, Arabidopsis thaliana
MHAPVLVLSDSLKRESGSKVHHGNIQASKAVADIIRTTLGPRSMLKMLLDAGGGIVVTNDGNAILRELDVAHPAAKSMIELSRTQDEEVGDGTTSVIVLAGEMLHVAEAFLEKNYHPTVICRAYIKALEDSIAVLDKIAMSIDINDRSQVLGLVKSCIGTKFTSQFGDLIADLAIDATTTVGVDLGQGLREVDIKKYIKVEKVPGGQFEDSEVLKGVMFNKDVVAPGKMKRKIVNPRIILLDCPLEYKKGENQTNAELVREEDWEVLLKLEEEYIENICVQILKFKPDLVITEKGLSDLACHYFSKAGVSAIRRLRKTDNNRIAKACGAVIVNRPDELQESDIGTGAGLFEVKKIGDDFFSFIVDCKEPKACTVLLRGPSKDFINEVERNLQDAMSVARNIIKNPKLVPGGGATELTVSATLKQKSATIEGIEKWPYEAAAIAFEAIPRTLAQNCGVNVIRTMTALQGKHANGENAWTGIDGNTGAIADMKESKIWDSYNVKAQTFKTAIEAACMLLRIDDIVSGIKKKQAPGSGPSKPTIETEGDADNEQILPD

SEQ ID NO: 1135 - DNA, 2448 bp, Arabidopsis thaliana
atgctcgagtaccgttgcagctccgttgactggaaaccatcaccggtggtagccctagctaacagctccgacgactctcaagtcgccgccgctcgcgaggacggttctcttgaaatctggctcgtctcccccggcgccgtcggatggcactgtcaactcactatccatggcgatccaaattcgagaatctcgtctcttgcgtggtgctgttctccttctatagggcttccttctggtcggttattctcctctagcatcgatggctctatttctgaatgggatcttttcgatttgaagcagaagattgtgcttgagtctattggaatctcgatatggcaaatggcattggctccgattagcggattctcgagtgatgtagaaggtattaagaatggatacttgagtgagaaatcgaatgatgaggaagagattgggagtgaagaagatggttctgattccgatgagtttcatgagaagtcagaggaggagatagataggattcttgcagctgcttgtgatgatggttgtgtgagactgtaccgtatctctaatttagaaaagttaacttactatagatcattgcctagggtcagtggacgtgctttaagtgtaacatggagtccagatgcaaaaaggatcttttcggggagcagtgatgggctgataagatgctgggacgctacctcgtgtcatgaggtatacagaattacagctggtcttggtggactaggaagtagttctgagatctgtgtttggtcacttctttcgttgaggtgttcagttcttgtgagtggagatagtacaggaactgtccagttttgggatagtgagcatggaacccttttggaagcacactctaatcacaaaggtgatgtcaatactcttgcagcagcccccagccataatcgagtcttttctgctggtgcggatggacaggttatcctttataagctctctggtagtactaacggttctcaagatttgaagccttcttcctctcagaaatgggactatattggttatgtcaaggctcatacacatgacatcagagctcttacagttgctgtaccaattagtcgagaagatccttttccggatgatatactgccagataaagcgagtcgtaaacatcgcaaaaaggggaagccggttgacttcacttatcataaatgggctcatttgggtgttccgatgcttatttctgctggtgatgatgcaaagctttttgcatattcaattcaggaatttactaagttctccccacatgatatatgtcctgcgcctcagagaatacccatgcaaatggtacataattcgatgttcaataagacttctcttctactggttcagggtattagtactttagatattcttcgacttaatataagcagtgattctagtggtcgtgcctcaacaaagtcattggttcgtgttaaaagtagagatgcccgaaagatcatatgcagtgcaatttctaacaccggatcacattttgcttactctgaccaaattggccccagtctgttcgagttgaagaaaaatgaatttacaaagtgtccatggagtgttagtagaaggcgacttcctgaacttccatttgcacattccatgattttcagttcggactgctctcgtctaataatagcagggcatgatagaaggatatatactattgacataagtagtttggaactagtatatgcatttacaccatctagggaggagcatgaaggtgaagctccaacacctaaggagcctccaataacaaaattgtttactagctcagatggtcagtggctagctgctatcaattgctttggggacatctatgtattcaacctcgaaacacaaaggcagcactggttcatttcaagactcgatggtgcatctgttaccgctgctggatttcatccctggaataacaatgcacttgtgatctcaacctcctcgaatcaggtctttgcttttgatgtagaagctagacagttaggcaagtggtcgttgctaaacacttatgttctgccaaagaggtatcaagagtttcctggggaggtccttggactctcattctccccgtcaccaaattcatcatctgtgatagtttacagttccagagcgaaatgtttgatcgacttcgggaagcctgtggaagaagatgaagagtatgatttaccaaacggcaatttgtctaaaacgctagaaggtaaacttgtcaacttgggcttgaaaaagggaaagggtacaaaccgaaaacgtcggttagatgagtatcagttagagggtaagagtaatgaacgaaagaacttcgaaatcttaccttcaaaccaccctgttttattcgtgggtcacctttctaaaaactcaatcctggtgatagagaaaccatggatggatgttgtcaagagtttggataatcaaccagtagacagacatatttttggaacttga

SEQ ID NO: 1136 - protein, 815 aa, Arabidopsis thaliana
MLEYRCSSVDWKPSPVVALANSSDDSQVAAAREDGSLEIWLVSPGAVGWHCQLTIHGDPNSRISSLAWCCSPSIGLPSGRLFSSSIDGSISEWDLFDLKQKIVLESIGISIWQMALAPISGFSSDVEGIKNGYLSEKSNDEEEIGSEEDGSDSDEFHEKSEEEIDRILAAACDDGCVRLYRISNLEKLTYYRSLPRVSGRALSVTWSPDAKRIFSGSSDGLIRCWDATSCHEVYRITAGLGGLGSSSEICVWSLLSLRCSVLVSGDSTGTVQFWDSEHGTLLEAHSNHKGDVNTLAAAPSHNRVFSAGADGQVILYKLSGSTNGSQDLKPSSSQKWDYIGYVKAHTHDIRALTVAVPISREDPFPDDILPDKASRKHRKKGKPVDFTYHKWAHLGVPMLISAGDDAKLFAYSIQEFTKFSPHDICPAPQRIPMQMVHNSMFNKTSLLLVQGISTLDILRLNISSDSSGRASTKSLVRVKSRDARKIICSAISNTGSHFAYSDQIGPSLFELKKNEFTKCPWSVSRRRLPELPFAHSMIFSSDCSRLIIAGHDRRIYTIDISSLELVYAFTPSREEHEGEAPTPKEPPITKLFTSSDGQWLAAINCFGDIYVFNLETQRQHWFISRLDGASVTAAGFHPWNNNALVISTSSNQVFAFDVEARQLGKWSLLNTYVLPKRYQEFPGEVLGLSFSPSPNSSSVIVYSSRAKCLIDFGKPVEEDEEYDLPNGNLSKTLEGKLVNLGLKKGKGTNRKRRLDEYQLEGKSNERKNFEILPSNHPVLFVGHLSKNSILVIEKPWMDVVKSLDNQPVDRHIFGT

SEQ ID NO: 1137 - DNA, 1071 bp, Arabidopsis thaliana
atggtcttaaatatggagtctaccggagaagctgttagatcaaccaccggtaacgacggtggtattacggtggttagatccgacgcgccgtcagatttccacgtagctcaaagatcagaaagctcaaaccaatctcccacctctgtcactcctcctccaccacagccatcgtctcatcacacagctcctccgccgctgcaaatttcgacggtgacgactacgactacgacggccgcgatggaaggtatctccggtggactgatgaagaagaagcgtggacggccaaggaagtatggaccggacgggactgttgtagcgttatctcctaaaccgatttcatcagcgccggcgccgtcgcatcttccgccgccgagttcacacgtcatcgatttctccgcttctgagaaacgtagcaaagtgaaaccaacgaactcgtttaacagaacaaagtatcatcaccaagttgagaatttgggtgaatgggctccttgctccgtcggtggtaatttcacacctcatataatcacagtcaacaccggcgaggatgtaacaatgaagataatctcgttttcgcaacaaggacctcgctctatttgtgttctgtcagcaaacggtgttatttcaagcgttacacttcgtcagccagattcctctggcggcacattgacatacgaaggtcggtttgagatattatcattatccgggtcattcatgcctaatgattcaggcggaacacgaagtagaacgggaggaatgagtgtatcgttagcaagtcccgatggacgtgtagtaggcggtggcctcgccggtttactagtagccgcgagtccggttcaggtggttgtaggaagttttttagcgggcactgaccatcaagatcagaaaccgaaaaagaacaaacatgatttcatgttgtcgagtcctaccgctgcaattcctatctctagtgcagctgatcaccggacaatccattcggtctcgtctcttccggtcaataataatacatggcagacttctttagcttccgatccaagaaacaagcataccgatattaatgtcaatgtaacttga

SEQ ID NO: 1138 - protein, 356 aa, Arabidopsis thaliana
MVLNMESTGEAVRSTTGNDGGITVVRSDAPSDFHVAQRSESSNQSPTSVTPPPPQPSSHHTAPPPLQISTVTTTTTTAAMEGISGGLMKKKRGRPRKYGPDGTVVALSPKPISSAPAPSHLPPPSSHVIDFSASEKRSKVKPTNSFNRTKYHHQVENLGEWAPCSVGGNFTPHIITVNTGEDVTMKIISFSQQGPRSICVLSANGVISSVTLRQPDSSGGTLTYEGRFEILSLSGSFMPNDSGGTRSRTGGMSVSLASPDGRVVGGGLAGLLVAASPVQVVVGSFLAGTDHQDQKPKKNKHDFMLSSPTAAIPISSAADHRTIHSVSSLPVNNNTWQTSLASDPRNKHTDINVNVT

SEQ ID NO: 1139 - DNA, 1587 bp, Arabidopsis thaliana
atggtgaggttcgagaaggttcatttagtgttagggttagctctggttctaactctggtcggagctccgaccaaagcccaaggacctgtttgcggtgcaggcctgcctgacaaatttagcagattaaacttccctgaaggcttcatttggggaaccgcaacagcagcatttcaggttgaaggagctgttaatgaaggttgcagaggtccaagcatgtgggatactttcactaagaagttcccacatagatgtgaaaatcataacgctgatgttgctgtggatttctatcatcgttacaaggaagatatccagttgatgaaagaccttaacactgatgcttttagactttctattgcgtggcccagaatattcccccatggaaggatgtctaagggaataagcaaagtgggagtccaattctaccacgacctcatcgatgagcttctcaaaaacaatataataccattagttacagtctttcattgggatactccccaagacttggaagatgaatatggtggtttcttaagtggtcgcatcgtgcaagattttaccgaatatgcgaatttcactttccacgaatatggacacaaagtgaaacattggatcacatttaacgagccatgggtgtttagtcgtgccggttacgacaacggaaagaaagctccgggacgttgttcgccgtacatccccggttatggacagcattgtcaggatgggcggtctggatacgaagcttatcaagtcagtcacaacttactcttgtcgcatgcttacgctgttgacgcattcagaaactgcaaacagtgtgctggaggtaaaattggaattgcacacagtccagcttggttcgaaccacaagaccttgagcatgttggaggttccattgaacgtgtgcttgatttcatcctaggatggcatttggctccaacaacttatggagattatccacaatcgatgaaggatcgtgtcggtcatagattgccaaaattcacagaagctgagaagaagttgctaaagggttctacagattacgtaggaatgaattactatacttcagtgtttgcaaaagaaattagccctgatcctaagagtccgagttggacgactgattctcttgttgattgggatagcaagagtgtggatggatacaaaattggtagcaagccgtttaatggtaaactggatgtgtattcaaaaggtttgagataccttttgaagtatattaaggataactatggcgacccagaagttatcattgccgagaatggatacggagaagaccttggagagaagcacaatgacgtaaactttgggacacaagatcacaacagaaaatattatatccaaaggcatctcttgagtatgcacgacgccatttgcaaggacaaagtgaacgttacgggatactttgtgtggtctttgatggacaactttgagtggcaagatgggtacaaggcgaggttcggactttactacatcgatttccagaacaacttgacccgtcaccaaaaagtttcgggcaaatggtattccgaattcctcaaaccacagtttccaacctccaagctgagggaagaactctag

SEQ ID NO: 1140 - protein, 528 aa, Arabidopsis thaliana [sequence omitted]

SEQ ID NO: 1141 - DNA, 2436 bp, Arabidopsis thaliana
atggaagttcttctcagaagtatctcgtcgtttctaaatctgtcatcttctaaacatattgatttagacccgtttgagaagtactataagagagttgaagagttattgagagtgttgaagcctatagcagatgttgttgttacctctgattttgtttttgatgagaaacttggtaaagcatttgaagaattgactcaggatgttgatcaatccattgatcttttcaggagttggcaagctttctctagtaaagtctatttcgttcttcaaattgaatctttgctaccaaagatgcgggacaccattgtggatacttttcagtttctcatgtcttctaagaaccatctacctgatgagctaagcccagcttctcttgagcaatgtctagagaagattaagcatcttagttatgaagaaatatcttctgtcattgacggtgctttgagggatcagagagatggtgttggacctagccctgagatcttggtgaaaattggagagaacactggtcttagatcaaaccaggagattctgattgaagctgttgctctagagaggcagaaagagatggctgagcagtctgagaataatgcagaagtcgagttccttgaccaactgattgttattgtaaaccgcatgcatgaacgtcttcttctgatcaaacagactcagacttctagtgtcgccattcttgccgacttcttttgccctctgtcacttgaagtaatgactgatccagtgattgtgtcatcaggacaaacatatgaaaaggcgtttatcaagagatggattgatttgggtttaaaagtgtgtcccaagactcgacagaccctgactcacactactctaatacccaattacaccgtgaaggccttaatcgctaactggtgtgagacaaacgatgtcaagctgcctgatcccaataaatcaacaagtttaaatgagctttctcctcttttatcatgtacagactccattcctagcacgggtgctgatgtttctgctcgtaaagttagcaacaagtcacatgattgggatgcttcttcaagtgaaaccggtaagccctcgttctcaagccgagcaactgaaagagaaggtgcttctccttcacgtcctgcttctgccttgggtgcttcttcaccgggtatatctggaaatggttacggtttggacgccaggaggggatcactaaatgattttgaagatagatcaaacgattctcgagaactgaggacagatgcacctggtaggtcatctgtatcttcaactacacgaggctcagtagaaaatggacaaacatctgagaaccaccatcataggtccccttctgctactagcactgtttccaatgaggagtttccaagggcagatgcgaatgagaattcagaagaatcagctcatgctacaccttacagcagtgatgcttcaggagaaattagatcagggcctcttgctgcaaccacttcagcagctactcgccgagatttgtctgatttttccccaaaattcatggatagacgtacccgtggtcaattttggcgacgtccatcagagagactcggttcaaggattgtttcagcgccttcgaatgagacaagacgtgatctttctgaggtcgaaactcaagttaagaagttggtggaggagttgaaaagcagctcattggatactcagagacaagcaaccgcagaactaaggttgctagccaagcacaacatggataatcggatagtcattgggaactctggagcaatcgtcttattggtggaactactttactcaactgactcagctacacaggaaaacgctgttaccgcacttctcaacttatctatcaatgacaacaacaaaaaagcaattgctgatgctggtgcaattgagccgctcattcacgtgcttgaaaatgggagctctgaagccaaggagaattcagctgctactctcttcagcctctctgtaatagaagaaaacaagattaagattggtcagtcgggtgcaatcgggcctcttgtagatcttctcggtaacggtacccctcggggtaagaaagacgctgctactgccttgtttaatctatcgatacatcaagaaaacaaggcgatgatcgtgcaatcaggtgctgtgagatatcttattgatctgatggacccagcagctgggatggtggataaagcagttgctgttttggcaaatctagctacaattccggaaggaagaaacgcgattggtcaagaaggcggaatccctcttcttgttgaagtcgttgagttgggttcagctagagggaaagaaaacgcagcagcagctcttcttcaactttcaaccaacagtggtcggttctgcaacatggttcttcaagaaggcgccgttcctccactcgtcgctctctcacagtctggtactcctagagctagagaaaaggtacaaactttataa

SEQ ID NO: 1142 - protein, 811 aa, Arabidopsis thaliana
MEVLLRSISSFLNLSSSKHIDLDPFEKYYKRVEELLRVLKPIADVVVTSDFVFDEKLGKAFEELTQDVDQSIDLFRSWQAFSSKVYFVLQIESLLPKMRDTIVDTFQFLMSSKNHLPDELSPASLEQCLEKIKHLSYEEISSVIDGALRDQRDGVGPSPEILVKIGENTGLRSNQEILIEAVALERQKEMAEQSENNAEVEFLDQLIVIVNRMHERLLLIKQTQTSSVAILADFFCPLSLEVMTDPVIVSSGQTYEKAFIKRWIDLGLKVCPKTRQTLTHTTLIPNYTVKALIANWCETNDVKLPDPNKSTSLNELSPLLSCTDSIPSTGADVSARKVSNKSHDWDASSSETGKPSFSSRATEREGASPSRPASALGASSPGISGNGYGLDARRGSLNDFEDRSNDSRELRTDAPGRSSVSSTTRGSVENGQTSENHHHRSPSATSTVSNEEFPRADANENSEESAHATPYSSDASGEIRSGPLAATTSAATRRDLSDFSPKFMDRRTRGQFWRRPSERLGSRIVSAPSNETRRDLSEVETQVKKLVEELKSSSLDTQRQATAELRLLAKHNMDNRIVIGNSGAIVLLVELLYSTDSATQENAVTALLNLSINDNNKKAIADAGAIEPLIHVLENGSSEAKENSAATLFSLSVIEENKIKIGQSGAIGPLVDLLGNGTPRGKKDAATALFNLSIHQENKAMIVQSGAVRYLIDLMDPAAGMVDKAVAVLANLATIPEGRNAIGQEGGIPLLVEVVELGSARGKENAAAALLQLSTNSGRFCNMVLQEGAVPPLVALSQSGTPRAREKVQTL

SEQ ID NO: 1143 - DNA, 2427 bp, Arabidopsis thaliana
atgaatttcaacggttttctcgacgacggtgctggagcctcaaagctactctctgatgctccgtacaacaaccacttctctttctccgccgtagacaccatgctcggaagcgccgccattgctccttctcagtctcttcctttctcttcttcaggcctctctctcggactccaaacaaatggagaaatgagtagaaacggagagattatggagtcaaacgtaagtcgtaagagtagtagaggagaagatgtagaaagcagatctgaaagtgataacgctgaagctgtctccggtgacgatttagatacctccgatagacctttaaagaagaagaaacgttaccatcgtcacactcctaaacaaattcaagacctcgaatcggtttttaaagagtgtgcacatccagacgagaagcaacgtcttgatcttagccgtcgacttaacttagatcctcgtcaagtcaagttctggttccagaatcgtcgtactcagatgaagactcaaatcgaacgacatgagaatgctttgttgaggcaagagaacgataagcttcgagctgagaatatgtctgtacgcgaagctatgagaaaccctatgtgtggtaattgcggcggacctgccgttatcggtgagatctcaatggaagagcaacatctgagaattgaaaactctcgtctcaaagatgagttagaccgagtctgtgccttaaccggtaagtttcttggccggtctaatggttcacatcatataccggactcagcacttgttctcggcgttggtgttggttctggtggatgtaatgttggtggtggtttcactctctcttctccgctgttgcctcaagcttctcctagatttgagatttctaatggaaccggttctggtttggtggctacggttaaccgtcaacaaccggttagtgttagtgattttgatcagagatcgaggtatttggatttagctcttgcggctatggatgagcttgtgaagatggctcagacacgtgagccgctctgggttcgaagctcggattctggttttgaagtgctgaaccaggaagagtacgacacaagtttctctcggtgtgttggaccaaaacaagatgggtttgtctcagaagcttctaaagaagctggaactgttatcatcaatagcttagcgctcgttgaaaccttaatggactcggaacggtgggcggaaatgtttcctagtatggtctcaagaacttcaaccacagagattatctctagtggcatgggagggcgaaatggtgcacttcacctgatgcacgcagagcttcaactgctgtctccactcgtgccggttagacaagtgtcgttcttgcggttctgtaaacagcacgcggaaggtgtttgggcagtcgtggatgtctcaattgattccattagagaaggttcttcttcgagctgtagaagattaccatccggttgcctcgtacaagacatggccaatggctactcaaaggtaacatggatcgagcacacggagtatgacgaaaaccacatccaccgtttataccgcccattactcaggtgcggtctagcgtttggtgcgcatcgatggatggctgcattacaacgtcaatgcgaatgcctcacgattctcatgtcctccactgtttccacttccactaatccatcccctataaactgcaatgggagaaaaagcatgctaaagctagcgaagaggatgactgataatttctgtggaggggtttgtgcttcgtcgttacagaaatggagcaaactcaacgttggcaacgtcgacgaagacgttaggataatgactaggaagagtgtaaacaatcctggcgagccgcctgggataattctaaatgcggcgacgtcagtttggatgccggtatctccgaggcggttgtttgacttccttggaaacgaacggcttagatcggaatgggatatcttatccaacggtggaccaatgaaagagatggcccatatagctaaaggccatgaccgttccaactccgtctccctcctccgtgccagcgcgataaatgcgaatcagagtagtatgctgatattacaagagacaagcatagacgctgcaggagcggttgtcgtgtacgcgcctgttgatatcccagcaatgcaagctgtgatgaacggtggagattctgcttacgtggcactccttccttcaggattcgccattctccctaacggtcaggctggtacgcaacgctgcgccgcagaggaacgtaacagtattggtaacggtgggtgcatggaggaaggagggtcgttactaacggtggcgtttcagatactggtgaatagtttgcctacggctaagctaacggtggaatctgtggagacggttaataatttgatatcgtgcaccgttcagaagattaaagctgctcttcattgtgatagcacctga

SEQ ID NO: 1144 - protein, 808 aa, Arabidopsis thaliana
MNFNGFLDDGAGASKLLSDAPYNNHFSFSAVDTMLGSAAIAPSQSLPFSSSGLSLGLQTNGEMSRNGEIMESNVSRKSSRGEDVESRSESDNAEAVSGDDLDTSDRPLKKKKRYHRHTPKQIQDLESVFKECAHPDEKQRLDLSRRLNLDPRQVKFWFQNRRTQMKTQIERHENALLRQENDKLRAENMSVREAMRNPMCGNCGGPAVIGEISMEEQHLRIENSRLKDELDRVCALTGKFLGRSNGSHHIPDSALVLGVGVGSGGCNVGGGFTLSSPLLPQASPRFEISNGTGSGLVATVNRQQPVSVSDFDQRSRYLDLALAAMDELVKMAQTREPLWVRSSDSGFEVLNQEEYDTSFSRCVGPKQDGFVSEASKEAGTVIINSLALVETLMDSERWAEMFPSMVSRTSTTEIISSGMGGRNGALHLMHAELQLLSPLVPVRQVSFLRFCKQHAEGVWAVVDVSIDSIREGSSSSCRRLPSGCLVQDMANGYSKVTWIEHTEYDENHIHRLYRPLLRCGLAFGAHRWMAALQRQCECLTILMSSTVSTSTNPSPINCNGRKSMLKLAKRMTDNFCGGVCASSLQKWSKLNVGNVDEDVRIMTRKSVNNPGEPPGIILNAATSVWMPVSPRRLFDFLGNERLRSEWDILSNGGPMKEMAHIAKGHDRSNSVSLLRASAINANQSSMLILQETSIDAAGAVVVYAPVDIPAMQAVMNGGDSAYVALLPSGFAILPNGQAGTQRCAAEERNSIGNGGCMEEGGSLLTVAFQILVNSLPTAKLTVESVETVNNLISCTVQKIKAALHCDST

SEQ ID NO: 1145 - DNA, 900 bp, Arabidopsis thaliana
atggcttcagaggatcaatcggcggcgagatctaccgggaaggtgaactggttcaacgcttctaaaggctatggtttcattactcctgacgatggcagcgtagagcttttcgttcatcaatcttcaattgtctccgaaggttaccggagtttaaccgtcggcgatgcggttgagttcgctattactcagggaagcgacggtaagactaaagccgtcaatgttactgctcctggtggtggttctctcaagaaggagaataactctcgtggtaacggtgctaggcgcggcggcggtggaagcggttgctacaattgcggtgagttaggtcatatctctaaagattgtggtattggtggcggcggcggaggtggtgaacgtagatctagaggaggagaaggttgttacaattgtggtgatactggtcacttcgctagggattgtacttcagctggaaacggtgaccaacgtggagccaccaaaggtggaaacgatggttgctacacttgcggtgatgttggtcacgtggctagggattgtactcagaaatcagttggaaacggagaccaacgtggagcggtcaaaggtggaaacgatggttgctacacttgtggtgatgttggtcactttgctagggattgtactcagaaggttgctgccggaaacgtcagaagcggtggtggtggtagtggaacttgttattcatgcggtggagttggtcacattgcaagagattgtgcgactaagagacagccttctcgtgggtgttaccagtgtggtggttctggtcacttggctcgtgattgtgaccagagaggaagcggtggaggaggtaatgataatgcgtgctacaagtgtggtaaggaaggtcactttgcaagggaatgttcttctgtagcttaa

SEQ ID NO: 1146 - protein, 299 aa, Arabidopsis thaliana
MASEDQSAARSTGKVNWFNASKGYGFITPDDGSVELFVHQSSIVSEGYRSLTVGDAVEFAITQGSDGKTKAVNVTAPGGGSLKKENNSRGNGARRGGGGSGCYNCGELGHISKDCGIGGGGGGGERRSRGGEGCYNCGDTGHFARDCTSAGNGDQRGATKGGNDGCYTCGDVGHVARDCTQKSVGNGDQRGAVKGGNDGCYTCGDVGHFARDCTQKVAAGNVRSGGGGSGTCYSCGGVGHIARDCATKRQPSRGCYQCGGSGHLARDCDQRGSGGGGNDNACYKCGKEGHFARECSSVA

SEQ ID NO: 1147 - DNA, 6531 bp, Arabidopsis thaliana
atggaacccactgattctactaacgagcaactcggagacactaagaccgccgctgtcaaggaagagagtcgctcctttctcggcatcgatctcaacgaaatccctaccggcgctactctcggcggtggttgcaccgctggtcaggatgacgacggcgaatatgaacctgttgaagttgttaggtcaattcacgataacccggacccagcccctggagcccctgccgaggttcctgaaccggatcgggatgcttcgtgcggcgcgtgtggaagacctgagtctatagagctcgttgtagtctgcgatgcctgtgagcgaggctttcatatgtcttgtgtcaacgatggagttgaggcggctccttccgccgattggatgtgcagcgactgtcgtactggcggcgagaggagcaaactgtggccgttgggggttaagtccaagctcattctggacatgaacgcctcgccgcccagtgatgctgagggatacggagctgaggagacgtctgattcgagaaagcatatgctcgccagcagctcttgcattggaaactcttttgattatgcaatgatgcattcaagcttctcaagtctcggtagaggacatgctagtctcgaagcttcagggttaatgtctcgtaatactaaaatgagtatggatgcattgggttcacataatctaggttttggattcccattaaacttgaacaatagtagtttgcccatgagatttccatccttggatccaagtgagttgtttctgcaaaatctcaggcatttcatatctgaaaggcatggagtattggaagatggctggcgtgtcgaattcagacaacctttaaatggttatcagttatgtgcagtgtattgtgctccgaatggaaaaacatttagttcaatacaagaagttgcttgttatctgggcttggcaattaatggtaactacagctgtatggatgctgaaatcaggaatgagaattctcttcttcaagaaagattgcatacgcccaagagaagaaagacatcaagatggccaaacaatggtttccctgagcaaaagggtagttcagtgagtgctcaactcaggcgttttccattcaatggtcagaccatgtctcctttcgccgttaaatctggtactcattttcaggctggtggttctcttagctctggaaataatggatgcggttgtgaggaagctaagaatggatgtccgatgcagtttgaagatttctttgttctgtcgcttggacgaattgacataagacagtcttaccataatgtcaacgtgatttatccaataggatataagtcctgctggcatgacaagatcacggggtcactatttacatgtgaagtatctgatggcaattctggtcccattttcaaggttacacggtcaccatgctcgaaatcatttattccagctggatcaactgtcttctcctgcccaaagattgatgaaatggtggaacagaacagtgacaaacttagtaatcgtagagatagtactcaagagcgtgatgatgacgctagtgttgagatccttctttcggaacactgcccacctcttggagatgatatattgtcttgtttacgtgagaagagtttctccaagacagtcaattccctgcgctcagaggttgattcttctcgagtagattttgataaaaatttatcctatgatcaggaccatggggttgaaattggtgacattgttgtggaagaagattcattgtctgatgcatggaaaaaagtgtctcaaaaacttgttgatgcatgttcaattgtactgaagcagaagggtaccctgaatttcctatgtaagcatgttgacagagaaacaagtgaaatcaactgggataccatgaatgagaaagacaatgtaattttatcgttgtcaaaattttgctgttcgttggctccttgcagtgtcacgtgtggtgaaaaggataaaagcgaatttgcagcagtagttgatgctttgtcaaggtggctcgatcaaaacagatttggacttgatgcagattttgtacaggaaatgattgaacatatgcctggtgccgaatcatgtacgaattataggactctgaagagtagaagttcttcttctgttcctataactgtagcggaaggagcgctagtggtcaaaccaaaaggtggggaaaatgtcaaggacgaagttttcggtgagatttctcggaaagccaagaagcctaaactaaatggtggtcatggtgtcagaaatctacaccctcctcctgggaggccaatgtgtttgaggctccctcctgggcttgttggtgacttccttcaggtatctgaagtgttctggcgtttccatgaaattttgggttttgaagaggctttctcacctgaaaaccttgaacaggagcttatcaatccagtgtttgatggtttgtttcttgataaacctgggaaagatgataagagaagtgagattaactttactgataaggattctacagctactaaacttttttctttgttcgatgaatctcgccaaccttttcctgcaaaaaatacctctgcttctgaactaaaggagaaaaaggcaggggattcttctgattttaagatttcagattcctctcgtgggtcgtgtgtgggtgcacttctaacaagggctcacatttcgcttctgcaagtgctaatatgtgagctgcaatccaaggtagctgcatttgttgatccaaactttgattctggcgaatcgagatccagacgaggacgaaaaaaggatgacagtacactttctgctaaaagaaataagctgcatatgcttcctgttaatgagttcacttggcctgaattggcccgtaggtacatcttgtctcttttatccatggatgggaacctcgaatcagcagagattgctgcacgtgaaagtggtaaggtattccgttgcttacaaggggatggtggtttgctttgcggctcgcttacaggagtggctgggatggaagcagattcaatgttacttgcagaggctattaagaaaatatctggttcgttgacaagcgaaaatgatgttctttctgtggaagatgatgattccgatggccttgatgctactgagacaaacacttgcagtggtgatattccagagtgggctcaggttttggaacctgtgaaaaagcttccaacaaatgttgggactagaatcagaaagtgtgtctatgaagctttagagagaaatccaccagagtgggcaaagaagatattggagcattctatcagtaaagaaatatataaaggcaatgcatcaggaccaacaaagaaagctgtcctctcattgctagcggatattcgaggtggagacttggtgcagaggtctattaaaggaaccaaaaagcggacatatataagtgtatctgatgtcattatgaagaaatgccgtgctgtattgcgtggtgttgcagctgcagacgaggataaagtcctttgcactttactgggaagaaagttactgaattccagtgataatgatgatgacgggctcctgggatcacctgcaatggtttcgcgtcccttagacttcagaactattgatttgaggttggctgctggtgcgtatgacggatcaactgaagcttttcttgaagatgttcttgagctgtggagtagtatacgtgttatgtatgcagatcagcccgattgtgtggacctggttgcaacattgtctgaaaaattcaagtcgttatacgaggctgaggttgtaccacttgttcagaaacttaaggactacaggaaattggaatgcctaagtgcagagatgaagaaggaaattaaggacatagttgtttcagtaaataagcttcccaaggccccgtgggatgagggggtatgtaaagtatgtggcgttgacaaagatgatgacagtgttctcttgtgtgatacatgcgatgctgagtatcacacatattgtttaaatccacctcttattagaattcctgatggaaattggtattgtccatcttgtgtcattgccaagcgcatggctcaagaggctttggaatcttacaaactagttaggcggcggaaaggtagaaagtatcagggggaactcacccgagcttctatggaactgactgctcacctggcagatgtgatggaagaaaaggactactgggagtttagtgctgaggagagaatcttgctgcttaagcttctatgcgatgaactgcttagttcatctcttgtccatcaacaccttgagcagtgtgccgaagcaataattgaaatgcagcagaagttacgctctctttcctcagaatggaaaaacgcaaaaatgcggcaagaattcctgacggctaaactggcaaaggttgaaccgagtattctgaaggaagtgggcgaaccacataattcaagctactttgcagaccaaatgggatgtgatccacaaccacaggagggcgttggagacggagttactcgtgatgatgagacttcctctactgcatatcttaacaagaatcaaggtaaatctccacttgaaaccgatactcaacccggagagtcgcatgttaatttcggtgagagcaaaatttcctccccggaaacaatatcatcccctgggaggcatgagctacctatagcagatacctctcctcttgtaacagataatctgcctgaaaaagatacctcggagaccttgcttaagtcagttggaaggaatcatgaaacacattcaccaaattccaatgcagtagaattgccgacagctcatgatgcatcttctcaggcttcccaagagttgcaggcttgtcagcaggatttgagtgccactagtaatgaaattcagaatcttcagcaatcaattagaagcatagaatcacagcttctaaagcaatctatacggagagattttctgggaaccgatgctagtggtcggttatattggggttgctgcttcccagatgaaaatcctcgtatattggttgatggaagcatatctttgcagaaacctgttcaagccgatttgataggttcaaaagtcccctctccgtttctccataccgttgaccatggaagactaaggctttcaccctggacgtattatgaaactgaaaccgagatcagtgagcttgtccaatggcttcatgatgatgatctgaaagaaagagacctgagagagtctattttgtggtggaaaaggttacgatatggagacgttcaaaaggaaaagaaacaagctcagaatttatctgctccggtatttgctacgggtcttgagaccaaggctgccatgtcaatggagaagagatatggtccatgcatcaaactggagatggaaaccttaaaaaaacgggggaagaagacaaaggttgcagagcgagagaaattgtgtagatgcgaatgcttggaatccattttgccatctatgattcactgcctcatatgccataaaacattcgcaagtgatgatgagtttgaggatcacactgagagtaagtgtattccttattcattagcaactgaagaaggcaaggacatctctgattcttcaaaagccaaagaaagtctgaaatccgattatcttaatgtaaagtctagtgccggcaaagatgtagctgaaatatccaatgtttctgaacttgattctgggttgataagatatcaagaagaagaatctatttccccataccattttgaggagatctgttccaagtttgtgacaaaggattgcaacagagatttggttaaagagatcggtctgatcagttcaaatggcattccaacatttcttccatcgtcatctactcatcttaacgactccgtgctcatctctgccaaatccaataagccagatggtggtgattcaggggatcaggtcatttttgctggtcctgaaaccaatgttgaaggcttaaattctgaatctaacatgtcattcgatagatctgtcacagacagtcacgggggtccactggataaaccaagtggactgggttttggcttctcagagcaaaagaataagaaatcttcaggtagtgggttgaaaagctgctgtgtggttccacaggctgctttgaaacgagtaactggcaaagctttgccgggtttcaggttcctgaaaaccaacttgcttgatatggatgtagcactgcctgaagaagctttaagaccatcgaaatcacatccaaaccgtagaagagcttggcgtgtatttgttaaatcgtcgcaaagtatatacgagttggttcaggcaacaattgtggtagaagatatgattaagacagagtacttgaaaaatgaatggtggtactggtcttctctttcagcggctgctaaaatctcgactctctcagcgttatccgtccgtatcttctccctcgacgctgctatcatttatgataaacccataactccatcaaatcctatcgatgaaacaaagccgatcatcagcttaccggaccaaaagtcacagccggtttcggattctcaagaaagaagcagcagagttagaagatctggcaagaaaaggaaagaacccgagggatcctag

SEQ ID NO: 1148 - protein, 2176 aa, Arabidopsis thaliana
MEPTDSTNEQLGDTKTAAVKEESRSFLGIDLNEIPTGATLGGGCTAGQDDDGEYEPVEVVRSIHDNPDPAPGAPAEVPEPDRDASCGACGRPESIELVVVCDACERGFHMSCVNDGVEAAPSADWMCSDCRTGGERSKLWPLGVKSKLILDMNASPPSDAEGYGAEETSDSRKHMLASSSCIGNSFDYAMMHSSFSSLGRGHASLEASGLMSRNTKMSMDALGSHNLGFGFPLNLNNSSLPMRFPSLDPSELFLQNLRHFISERHGVLEDGWRVEFRQPLNGYQLCAVYCAPNGKTFSSIQEVACYLGLAINGNYSCMDAEIRNENSLLQERLHTPKRRKTSRWPNNGFPEQKGSSVSAQLRRFPFNGQTMSPFAVKSGTHFQAGGSLSSGNNGCGCEEAKNGCPMQFEDFFVLSLGRIDIRQSYHNVNVIYPIGYKSCWHDKITGSLFTCEVSDGNSGPIFKVTRSPCSKSFIPAGSTVFSCPKIDEMVEQNSDKLSNRRDSTQERDDDASVEILLSEHCPPLGDDILSCLREKSFSKTVNSLRSEVDSSRVDFDKNLSYDQDHGVEIGDIVVEEDSLSDAWKKVSQKLVDACSIVLKQKGTLNFLCKHVDRETSEINWDTMNEKDNVILSLSKFCCSLAPCSVTCGEKDKSEFAAVVDALSRWLDQNRFGLDADFVQEMIEHMPGAESCTNYRTLKSRSSSSVPITVAEGALVVKPKGGENVKDEVFGEISRKAKKPKLNGGHGVRNLHPPPGRPMCLRLPPGLVGDFLQVSEVFWRFHEILGFEEAFSPENLEQELINPVFDGLFLDKPGKDDKRSEINFTDKDSTATKLFSLFDESRQPFPAKNTSASELKEKKAGDSSDFKISDSSRGSCVGALLTRAHISLLQVLICELQSKVAAFVDPNFDSGESRSRRGRKKDDSTLSAKRNKLHMLPVNEFTWPELARRYILSLLSMDGNLESAEIAARESGKVFRCLQGDGGLLCGSLTGVAGMEADSMLLAEAIKKISGSLTSENDVLSVEDDDSDGLDATETNTCSGDIPEWAQVLEPVKKLPTNVGTRIRKCVYEALERNPPEWAKKILEHSISKEIYKGNASGPTKKAVLSLLADIRGGDLVQRSIKGTKKRTYISVSDVIMKKCRAVLRGVAAADEDKVLCTLLGRKLLNSSDNDDDGLLGSPAMVSRPLDFRTIDLRLAAGAYDGSTEAFLEDVLELWSSIRVMYADQPDCVDLVATLSEKFKSLYEAEVVPLVQKLKDYRKLECLSAEMKKEIKDIVVSVNKLPKAPWDEGVCKVCGVDKDDDSVLLCDTCDAEYHTYCLNPPLIRIPDGNWYCPSCVIAKRMAQEALESYKLVRRRKGRKYQGELTRASMELTAHLADVMEEKDYWEFSAEERILLLKLLCDELLSSSLVHQHLEQCAEAIIEMQQKLRSLSSEWKNAKMRQEFLTAKLAKVEPSILKEVGEPHNSSYFADQMGCDPQPQEGVGDGVTRDDETSSTAYLNKNQGKSPLETDTQPGESHVNFGESKISSPETISSPGRHELPIADTSPLVTDNLPEKDTSETLLKSVGRNHETHSPNSNAVELPTAHDASSQASQELQACQQDLSATSNEIQNLQQSIRSIESQLLKQSIRRDFLGTDASGRLYWGCCFPDENPRILVDGSISLQKPVQADLIGSKVPSPFLHTVDHGRLRLSPWTYYETETEISELVQWLHDDDLKERDLRESILWWKRLRYGDVQKEKKQAQNLSAPVFATGLETKAAMSMEKRYGPCIKLEMETLKKRGKKTKVAEREKLCRCECLESILPSMIHCLICHKTFASDDEFEDHTESKCIPYSLATEEGKDISDSSKAKESLKSDYLNVKSSAGKDVAEISNVSELDSGLIRYQEEESISPYHFEEICSKFVTKDCNRDLVKEIGLISSNGIPTFLPSSSTHLNDSVLISAKSNKPDGGDSGDQVIFAGPETNVEGLNSESNMSFDRSVTDSHGGPLDKPSGLGFGFSEQKNKKSSGSGLKSCCVVPQAALKRVTGKALPGFRFLKTNLLDMDVALPEEALRPSKSHPNRRRAWRVFVKSSQSIYELVQATIVVEDMIKTEYLKNEWWYWSSLSAAAKISTLSALSVRIFSLDAAIIYDKPITPSNPIDETKPIISLPDQKSQPVSDSQERSSRVRRSGKKRKEPEGS

SEQ ID NO: 1149 - DNA, 714 bp, Arabidopsis thaliana
atggcgaacaatgagggagagatgcaatgtgggtccatgttgtttaagcaagaggagctacaagagatgagtggggtcaatgttggtggcgattacgttgaggtcatgtgtggttgtaccagtcaccgatacggcgatgctgttgctagacttagggttttccccaccggtgaccttgaaatcacctgcgaatgcacacctggttgcgatgaagacaagttgacaccagctgcattcgagaagcattctggaagagaaacggcaaggaagtggaaaaacaatgtgtgggttatcattgggggcgaaaaggttccattgtcaaagacagtattgctcaagtactacaatgaatcatcaaagaagtgcagtagatcaaacagatcacaaggtgccaaagtttgccatagagatgagtttgttgggtgtaacgattgtggtaaagagaggaggttcaggctgaggagcagagacgaatgccgcttgcaccacaatgcaatgggtgatccaaactggaaatgctcagatttcccatacgacaagataacatgtgaggaggaagaagagagagggagcaggaaggtgtacagagggtgcacacgttcacctagttgcaaaggctgcacttcctgcgtctgttttggctgcgagttatgccgtttctctgagtgtacttgccagacttgtgtcgacttcaccagcaatgtcaaagcttga

SEQ ID NO: 1150 - protein, 237 aa, Arabidopsis thaliana
MANNEGEMQCGSMLFKQEELQEMSGVNVGGDYVEVMCGCTSHRYGDAVARLRVFPTGDLEITCECTPGCDEDKLTPAAFEKHSGRETARKWKNNVWVIIGGEKVPLSKTVLLKYYNESSKKCSRSNRSQGAKVCHRDEFVGCNDCGKERRFRLRSRDECRLHHNAMGDPNWKCSDFPYDKITCEEEEERGSRKVYRGCTRSPSCKGCTSCVCFGCELCRFSECTCQTCVDFTSNVKA

SEQ ID NO: 1151 - DNA, 2028 bp, Arabidopsis thaliana
atggaagtgactcgtggtttctcttttttggacaagtttcttcgaaagcgtcttcactgtggatgcattgcttctagatttatgatggagcttctagagaatggtggtgttacctgtataagttgcgccaagaaatccggactaatttctatgaatgtgagccatgaatctaacggtaaggacttcccctcatttgcttcagcagagcatgtaggcagtgttcttgagaggacaaatctcaagcacttgcttcactttcaaagaatcgaccccactcattcttctcttcaaatgaaacaagaagaatcgctgcttccttccagcctagatgctcttagacacaaaactgaaaggaaagaattgtctgcacagccaaacttgagcatttcacttggacctacgcttatgacaagcccatttcatgatgctgctgttgatgacagaagtaagactaattcgattttccaactggcccctcggtccaggcagctgcttccaaaacctgcaaattcagctcccattgctgctggcatggagcctagtgggagcctggtgtcacagattcatgtcgctcggcctcctccagaaggtcgcgggaagacccaattgcttccccgttactggcctaggattactgaccaagagctgctgcaattatctggacagtatcctcatctgtatgagtccttgactgtttattttcctagctcaaattccaaaattataccactctttgaaaaagttctgagtgcgagcgatgcgggtcgtattggtcgactggttcttccgaaagcatgtgcagaggcatatttcccccctatatctctacccgagggtctcccgttaaagatacaagacataaaagggaaagaatgggtgttccagttcaggttttggcctaataataacagcaggatgtacgttttggagggtgtgactccttgcatacagtccatgcagttgcaagctggtgacactgtaacattcagccgtacagaacctgaaggaaaactcgtaatgggataccgtaaagcgacgaactctacagcgacacagatgttcaagggaagcagtgaacccaatctgaacatgttttccaacagcttgaatccgggatgtggtgacatcaattggtctaaactagagaagtctgaggacatggcaaaggataacttatttcttcagtcgtccttaacttctgctaggaaacgggttcggaacattgggactaagagcaagcgtctgctcattgatagcgtagatgttctggaactgaaaataacttgggaggaggcacaggagctgttgcggcctccccaatccaccaaacccagcatctttacgctggaaaatcaagattttgaagaatatgacaaacttccttctttacataacgaaactttcgtctcaacagagttcaaaaggaggagactggcatcatcaaacgaaaagctaaaccagtcgcaggatgcatctgctctgaatagtttaggaaatgcaggcatcaccacaaccggtgaacagggggaaatcacggttgcagccacgaccaagcatccaagacaccgggcagggtgttcgtgcatcgtctgcagccaaccaccgagcggaaaaggcaaacacaagccgtcatgcacttgcactgtgtgcgaggcagtgaagagacgattcaggacgctcatgctgcggaagcggaacaaaggagaggcaggacaggcaagccagcaggcgcagtcacagtcagagtgcagggacgagacagaagtggagagcattccagcggttgaactagccgcaggggaaaacatcgacttgaactcagacccgggggcttcccgagtaagcatgatgaggcttctccaagctgcagcgtttcctctggaagcatatctgaaacaaaaggctatttccaatacagcaggagaacagcaaagcagtgatatggtcagcacagaacacggttcgtcctcagccgcacaagaaactgagaaagacacaacaaatggagctcatgatcctgtgaactaa

SEQ ID NO: 1152 - protein, 675 aa, Arabidopsis thaliana
MEVTRGFSFLDKFLRKRLHCGCIASRFMMELLENGGVTCISCAKKSGLISMNVSHESNGKDFPSFASAEHVGSVLERTNLKHLLHFQRIDPTHSSLQMKQEESLLPSSLDALRHKTERKELSAQPNLSISLGPTLMTSPFHDAAVDDRSKTNSIFQLAPRSRQLLPKPANSAPIAAGMEPSGSLVSQIHVARPPPEGRGKTQLLPRYWPRITDQELLQLSGQYPHLYESLTVYFPSSNSKIIPLFEKVLSASDAGRIGRLVLPKACAEAYFPPISLPEGLPLKIQDIKGKEWVFQFRFWPNNNSRMYVLEGVTPCIQSMQLQAGDTVTFSRTEPEGKLVMGYRKATNSTATQMFKGSSEPNLNMFSNSLNPGCGDINWSKLEKSEDMAKDNLFLQSSLTSARKRVRNIGTKSKRLLIDSVDVLELKITWEEAQELLRPPQSTKPSIFTLENQDFEEYDKLPSLHNETFVSTEFKRRRLASSNEKLNQSQDASALNSLGNAGITTTGEQGEITVAATTKHPRHRAGCSCIVCSQPPSGKGKHKPSCTCTVCEAVKRRFRTLMLRKRNKGEAGQASQQAQSQSECRDETEVESIPAVELAAGENIDLNSDPGASRVSMMRLLQAAAFPLEAYLKQKAISNTAGEQQSSDMVSTEHGSSSAAQETEKDTTNGAHDPVN

SEQ ID NO: 1153 - DNA, 1305 bp, Arabidopsis thaliana
atggcagataacaattcaccacctggctctgtagaacagaaagcagatcaaattgttgaagctaatccattggtgaaggatgatacttcgctggaaaccatagttcgaaggttccaggattcaatgtcagaggcaaagactcataagttctgggagactcaacctgttgggcagtttaaggatattggggatacgagtttgcctgaaggtccgattgagcctgcaactccattatctgaggttaagcaagagccgtacaaccttccttctgtttacgagtggacgacatgtgatatgaactctgatgatatgtgttcagaggtatacaaccttctcaagaacaactatgttgaggatgatgagaatatgttcaggttcaattactccaaggagtttctaaggtgggcactacgtccaccgggttattaccagagctggcatattggagttcgagccaagacttcgaagaaactcgttgctttcatcagcggcgtgccagcaagaatcagggtgcgtgatgaggttgttaaaatggcagagatcaatttcttgtgtgttcacaagaagctcaggtctaagaggctcgctcctgtcatgatcaaggaggtgactagaagggttcacttggagaacatatggcaagcagcttatactgcaggagttatccttcctacaccaatcaccacctgtcaatactggcacaggtcattgaacccgaagaagctaattgatgttgggttttcaaggcttggtgcgagaatgacaatgagcagaaccatcaaactctacaagttaccagatgcaccgatcactcctggattcaggaaaatggaaccacgcgatgtccctgctgttacacggttgcttaggaactacctcagccagtttggagtcgcgactgactttgatgagaatgatgtcgagcattggctactcccaagagaagatgtcgtggacagttacctagtagaaagccctgaaactcacgatgtcactgacttctgcagcttctacactctcccttcaaccatcctcggtaacccgaactacactacattgaaagctgcgtattcttactacaatgtggccacacagacctcgtttcttcagctgatgaatgatgcgctaattgtctcaaagcaaaagggtttcgatgtgttcaacgcgttggatgtgatgcacaatgagagtttcttgaaagaactgaagtttgggccaggagatggacaacttcattactatctctacaattaccgtttgaaaagtgccttgaagccagcggaactcgggcttgttctcttataa

SEQ ID NO: 1154 - protein, 434 aa, Arabidopsis thaliana
MADNNSPPGSVEQKADQIVEANPLVKDDTSLETIVRRFQDSMSEAKTHKFWETQPVGQFKDIGDTSLPEGPIEPATPLSEVKQEPYNLPSVYEWTTCDMNSDDMCSEVYNLLKNNYVEDDENMFRFNYSKEFLRWALRPPGYYQSWHIGVRAKTSKKLVAFISGVPARIRVRDEVVKMAEINFLCVHKKLRSKRLAPVMIKEVTRRVHLENIWQAAYTAGVILPTPITTCQYWHRSLNPKKLIDVGFSRLGARMTMSRTIKLYKLPDAPITPGFRKMEPRDVPAVTRLLRNYLSQFGVATDFDENDVEHWLLPREDVVDSYLVESPETHDVTDFCSFYTLPSTILGNPNYTTLKAAYSYYNVATQTSFLQLMNDALIVSKQKGFDVFNALDVMHNESFLKELKFGPGDGQLHYYLYNYRLKSALKPAELGLVLL

SEQ ID NO: 1155 - DNA, 510 bp, Arabidopsis thaliana
atggccgccggaggaggaggaggaggaggaggatcatcgtcgggacgtactccgacgtggaaagagagagagaacaataagaagagagaaagaagaagaagagccatcactgctaagatttactctggtcttagagctcaaggtaactataagcttcctaagcactgcgataacaacgaggttcttaaagctctctgtctcgaagctggttggatcgtcgaagacgatggcaccacttatcgcaaggggtttagccaccagcatcagatatttcaggaactcctacaaacttcagcacaaattcatcaatccaaccaagtccacaatcatcagcttttccaagtcctgcaccttcgtaccacggaagtccagtctcatcatccttcccgagtccatctcgctatgacggaaacccttcttcataccttcttcttccgttcctacacaacatcgcttcttcgattcctgctaaccttccacctcttagaatatccaacagtgcgcctgtga

SEQ ID NO: 1156 - protein, 169 aa, Arabidopsis thaliana
MAAGGGGGGGGSSSGRTPTWKERENNKKRERRRRAITAKIYSGLRAQGNYKLPKHCDNNEVLKALCLEAGWIVEDDGTTYRKGFSHQHQIFQELLQTSAQIHQSNQVHNHQLFQVLHLRTTEVQSHHPSRVHLAMTETLLHTFFFRSYTTSLLRFLLTFHLLEYPTVRL

SEQ ID NO: 1157 - DNA, 1020 bp, Arabidopsis thaliana
atgtctaccggagaagaaggtcacatggcgatggcagatagaggctctagaaagagaagagtcggcgttaagaaaggtactaaagcggcgaggaacaaaaagcaaaaatcaaaaccttctacttccgataggtttaaggttacaatgaagaatcaaaagctatttcagaagagagcacgagattacaattccgatgacgatgaagaagaagatgatgaatcgaagaaacaaccagaagtaacaattcgtgagaagatcttctctgatgctaacatgggaccaaattacgaagagattggagaagaagataatgatgagaattcagatggtgaagatcatggagagattgaatctggaatcactaagtttgctactgatggatgtaatgctttcaaaatcgcttttaaagctattatgaagaagactaaaggagatgatacattgggcccagttttatcagcacataagcatcttattggagagaagctagctgaagatgaagctgaaaagaaagctaaaggtcaagctagaaaggctaaacatttgattgctgagaagggacatgttaaacctggaagttatttggattctcatgaaaagattcttattggtgttgctactaaaggagtggtcaagcttttcaatgctgtcaacaaggctcaacatgctcagaagggtttgaatccttcaaggtctaaagacgctaaagtgctgaagaagcgaagaaaagaagcattcttgtctgagttagggaaaacaaaaacagacaccaagccttcaactttggatgaacatagaagcaagttagtattctgtcttgagctggcttctatagagaaaggatcaccttcagtagcgagagccgctcacaaatctgaagacgaagctcctgtttgggctcctctacgagataattacatgttagcaaacccaaaactgaaggactgggacaagaaacaggaaacaagcgagggagatgattttgccggtttgtcaggagatgaaagttatgaagactga

SEQ ID NO: 1158 - protein, 339 aa, Arabidopsis thaliana
MSTGEEGHMAMADRGSRKRRVGVKKGTKAARNKKQKSKPSTSDRFKVTMKNQKLFQKRARDYNSDDDEEEDDESKKQPEVTIREKIFSDANMGPNYEEIGEEDNDENSDGEDHGEIESGITKFATDGCNAFKIAFKAIMKKTKGDDTLGPVLSAHKHLIGEKLAEDEAEKKAKGQARKAKHLIAEKGHVKPGSYLDSHEKILIGVATKGVVKLFNAVNKAQHAQKGLNPSRSKDAKVLKKRRKEAFLSELGKTKTDTKPSTLDEHRSKLVFCLELASIEKGSPSVARAAHKSEDEAPVWAPLRDNYMLANPKLKDWDKKQETSEGDDFAGLSGDESYED

SEQ ID NO: 1159 - DNA, 3546 bp, Arabidopsis thaliana
atggcagcgccaaggccgactggaggccaggatctgttcgatacgtatttcaggagagcagatttggatggagatggtcatattagtggagctgaggctgtcgctttcttccagggatcgaatttgcctaaacatgtccttgctcaggtatggtcctatgcagattcaaaaaaagccggctaccttggccgagcggagttttataatgctctaaagttggtaacagtggcacaaagtagacgagagttgactgctgagatagtaaaagctgcaatttatagtcctgcttcagccaatatccctgcacccaaaataaatcttgctgcaacaccttctccacagcccagaggagttttgcctgctacacaagctcagggagttacatcaatgccatcagtagcggctggtgtgagagggcctcacatgggtggaactgtaagcactagtaaccaacaagtagtcccaggccaacagaaccagtttactgggatacctccatctcagacacagcaaaactttcaaagcccgggaatgccagctggagggactaatgcacctcgtcctgcaaaccaacctatgccatctgattggctcagcggcagaagtgttggtccctctgggaacgtgaattctcaaattccttcgagtcagagtacatatggtttgacagcacctaattcaactgccaaccatataacaaaaccacatataacacctgcagtaacaagctctacaacaaccagaccccaagagtcagcgcctgtgcacaatccccaagaatcatctgctactttcggttctcgtgtatcaaatgttccatccaatcaattggtgcccaaggatcccaaggaactggctgcatcaggaaacgggtttacctctgactcacttttcggagatgtcttttcagttacttccacgcagccaaaacaacatcctacgggaagtgcatcaacaacaggcatctcatcggttactactggaactgtcgcgggccctgagatcacacagtctgtagttaggcaaagttcaatcccacaacagggttcattgagccagcatgctgttggtgttcagacccagcttactggaaactcagggcaaccatatacttcctcaggtgcggcttctggtccacctggctctactgttggagttggaatttcagctaccagtcagttggcccagcgtccgccccacccccactctcaaccacaaccccggccccagggccagtcccaacctccttggccaaaaatgactccagctgatgtccagaaatataccaaggtttttgtgcaagttgacactgatagggacggaaagatcacagggaaccaggctcggaatttgttcttaagttggaggcttccaagagacgctttgaagcaggtatgggatttatctgatcaagataatgacagcatgctctccttgcgggagttctgtattgcggtctatcttatggagcgttacagagagggccgaccacttcccccagtgttcccaagctctataatacatagtgagagcatgttcacctctcctggtcaatctgtggcaccacatggcaatgcatcctggggacatcctcaagggttccaacagcaaccacatcctgggggcttaaggccaccagctggtcccaaaggaaagcctccgaggccagtgcctctgtctcctagtgatggaatggtccagcccactcagccaaagcgtaaaatgcctgtgttagaaaaaccgctggtggatcaacttagcaaagaggagcaggattcactcaacacgaagtttgaagaagcaactgctgtggatgaactcgaaaaagaaatagctgattccaagcagaaaattgatttcttccgtgctaagatgcaagaacttgttttatacaagagcagatgtgacaaccggtacaatgagatcgcagagagagtcttgggtgataaacgtgaggagaagaaaatggaattgtaccaggcaatagtcaaatttgaagaaggcaaacttgatgatagtatagttaaggagcgcactgaacacatccagtcaggccttgaggaactgataaaaaatttgaatgagcgctgcaaacaatatggagtacgtgggaaacccacttctctggttgagcttccttttggttggcagcctggaatccaggaaggtgctgctgattgggatgaagattgggataagctagaggacgaagggtttaccttcgtcaaggagcttacacttgatattcaaaatgtcatagccccaccaaaggaaaaatcatcagcgtggagaaaagaagttgatgtctcttcaaaagaaggtgaagatgtttcattctcagatgctgactctaaaacggggaaaaagcaaagcagtggtgaagaagattctgagcagtcagagggtaaaacatccgatgttgatgccagagataaaaacggatctctggatgactctaaagttagaaagggcattgaagctgatagttcacctcgaacgaaagatacgaggagtgaaaatggccatgatgatggtgaatctactgcttctgctggcaaaactgtaaattatgactctcacgacgagacagattcagtttcaagcgtcaaccctgacaacggcaaggacaaggatcatgggaagtatgacagtggttttggatttggatttgggtttgatgacttcagtattaagcctataaaaactggttcgaccatttcaaatgacttcctccctcctaagttatctatatttgctgattccgtcccaagcccaccggcaaatgcaagcgacgtttcccctacaaaaccttctttgtttgctgattcagttccgagcactccagcgacgaacaatgcctcttacccaggccagaaatcattttttgatgactcggtcccgagcactcctgcttatccaggcaacttgtttgctgagaagaaatccttctttgacgactctgtcccgagcacccctgcttatccaggcaacttgtttgccgagaagaaatcctatttcgatgactctgtcccgagcactcctgcttatagcacgtctgattttggtgggaagccatttgcatcagagactcctcgttcagacaacctgttcccaggaagaagcccctttatgttcgactctgtcccaagtacacccgccgcacacgatgacttctctaacaacagcttctcccgcttcgattcattcaacagcaacaacaacgatgctttctctctatcccgcacagactcgatgcgcagcacaagcgagcctgacccattcgcatcaaggtttgattctttcaactatcaaagatatgattccttcaatgcacaaagctatgattcctctagcaacaacaatgcatcggagacgcctaaagcctcattgacaagattcgactcaattggaagcaccagggactctgattacagtcatgggtttgggttcgacgaccatgacccgttcggttctacaggaccattcaaaacaacgacaactacagcagagacacctcggagttctgataattggaatgctttctag

SEQ ID NO: 1160 - protein, 1181 aa, Arabidopsis thaliana
MAAPRPTGGQDLFDTYFRRADLDGDGHISGAEAVAFFQGSNLPKHVLAQVWSYADSKKAGYLGRAEFYNALKLVTVAQSRRELTAEIVKAAIYSPASANIPAPKINLAATPSPQPRGVLPATQAQGVTSMPSVAAGVRGPHMGGTVSTSNQQVVPGQQNQFTGIPPSQTQQNFQSPGMPAGGTNAPRPANQPMPSDWLSGRSVGPSGNVNSQIPSSQSTYGLTAPNSTANHITKPHITPAVTSSTTTRPQESAPVHNPQESSATFGSRVSNVPSNQLVPKDPKELAASGNGFTSDSLFGDVFSVTSTQPKQHPTGSASTTGISSVTTGTVAGPEITQSVVRQSSIPQQGSLSQHAVGVQTQLTGNSGQPYTSSGAASGPPGSTVGVGISATSQLAQRPPHPHSQPQPRPQGQSQPPWPKMTPADVQKYTKVFVQVDTDRDGKITGNQARNLFLSWRLPRDALKQVWDLSDQDNDSMLSLREFCIAVYLMERYREGRPLPPVFPSSIIHSESMFTSPGQSVAPHGNASWGHPQGFQQQPHPGGLRPPAGPKGKPPRPVPLSPSDGMVQPTQPKRKMPVLEKPLVDQLSKEEQDSLNTKFEEATAVDELEKEIADSKQKIDFFRAKMQELVLYKSRCDNRYNEIAERVLGDKREEKKMELYQAIVKFEEGKLDDSIVKERTEHIQSGLEELIKNLNERCKQYGVRGKPTSLVELPFGWQPGIQEGAADWDEDWDKLEDEGFTFVKELTLDIQNVIAPPKEKSSAWRKEVDVSSKEGEDVSFSDADSKTGKKQSSGEEDSEQSEGKTSDVDARDKNGSLDDSKVRKGIEADSSPRTKDTRSENGHDDGESTASAGKTVNYDSHDETDSVSSVNPDNGKDKDHGKYDSGFGFGFGFDDFSIKPIKTGSTISNDFLPPKLSIFADSVPSPPANASDVSPTKPSLFADSVPSTPATNNASYPGQKSFFDDSVPSTPAYPGNLFAEKKSFFDDSVPSTPAYPGNLFAEKKSYFDDSVPSTPAYSTSDFGGKPFASETPRSDNLFPGRSPFMFDSVPSTPAAHDDFSNNSFSRFDSFNSNNNDAFSLSRTDSMRSTSEPDPFASRFDSFNYQRYDSFNAQSYDSSSNNNASETPKASLTRFDSIGSTRDSDYSHGFGFDDHDPFGSTGPFKTTTTTAETPRSSDNWNAF

SEQ ID NO: 1161 - DNA, 1446 bp, Arabidopsis thaliana
atggctcacagaatactgagagatcatgaagccgatggatgggaacgctccgatttcccaatcatctgcgaatcttgtctcggtgacaacccctacgtgcgaatgaccaaagcgaattatgataaggaatgcaagatatgtacacgacctttcacggtgtttaggtggcgacctggccgggatgctagatacaagaaaaccgaaatttgtcagacttgctgcaagttgaaaaatgtttgtcaagtctgtcttctggatcttgagtatggtcttccagttcaagtaagagacacagcactcaacattagtactcatgactctatccctaaaagtgatgtcaacagagagtattttgctgaagagcatgacaggaaggctagagctggactggattatgaatcttcattcgggaagatgcgacccaatgatactattttaaagcttcaaagaacaacaccgtactataagaggaaccgagcacatgtttgtagtttcttcatcaggggtgagtgtacaagaggtgctgaatgtccataccggcatgagatgcccgaaacaggagagctatcccagcaaaacataaaagaccgttattatggtgttaatgatccagttgctatgaagttgcttggcaaagctggtgagatgggcactttggaatcgccagacgatgaaagcatcaaaaccctttacgtcggtggacttaactcgagaattctcgagcaggacatacgagaccaattctacgctcatggagaaattgaatctatcagaatcttggccgataaagcctgtgcatttgtcacatacacaagccgtgaaggtgcagagaaggctgcgcaagagctctccaacaggctagtcatcaacggtcagaggctaaaactcacatggggaagacccaaacctgatcaagatggtgcaaaccaacagggcggtgtggctcatagtgggttactacctcgagccgttatatctcagcagcacaatcaacccccaccaatgcagcagtactatatgcacccaccaccagctaaccaagacaaaccttattacccatcaatggacccacagagaatgggtgcagtcatttcaacccaagaggctggtggttcaagcactgagaacaacggagcttcatcttcttcttacatgatgcctccacaccagtcatacccaccaccaccatatggatatatgccatcgccttaccagcagcagtatcctcctaaccatcatcatcaacctagtcctatgcagcactatgccccgcctccagcagcttacccgtacccacagcaacctggtcctggatcaagacctgcaccgtctccaaccgcggtctctgctatatcacccgactctgcacctgctgggtctggagcaccttcgggatcctctcaacaagctcctgatgtttctacagctactggttcgtctcagtag

SEQ ID NO: 1162 - protein, 481 aa, Arabidopsis thaliana
MAHRILRDHEADGWERSDFPIICESCLGDNPYVRMTKANYDKECKICTRPFTVFRWRPGRDARYKKTEICQTCCKLKNVCQVCLLDLEYGLPVQVRDTALNISTHDSIPKSDVNREYFAEEHDRKARAGLDYESSFGKMRPNDTILKLQRTTPYYKRNRAHVCSFFIRGECTRGAECPYRHEMPETGELSQQNIKDRYYGVNDPVAMKLLGKAGEMGTLESPDDESIKTLYVGGLNSRILEQDIRDQFYAHGEIESIRILADKACAFVTYTSREGAEKAAQELSNRLVINGQRLKLTWGRPKPDQDGANQQGGVAHSGLLPRAVISQQHNQPPPMQQYYMHPPPANQDKPYYPSMDPQRMGAVISTQEAGGSSTENNGASSSSYMMPPHQSYPPPPYGYMPSPYQQQYPPNHHHQPSPMQHYAPPPAAYPYPQQPGPGSRPAPSPTAVSAISPDSAPAGSGAPSGSSQQAPDVSTATGSSQ

SEQ ID NO: 1163 - DNA, 1881 bp, Arabidopsis thaliana
atggaaggtgcggctgatcaaactacgaaagcgttatctgaattagccatggattcttctaccaccttgaatgctgctgagtctagcgctggtgatggagctggacctcggagtaaaaatgctttgaagaaggaacagaaaatgaagcagaaagaggaagagaagagacgaaaggacgaagagaaagctgaaaaggctaaacaagcacctaaagcaagctcccagaaggcagtggcagcagatgatgaagagatggatgcaacgcaatactatgagaacagattgaaatatcttgcggctgagaaggctaaaggggagaatccatatcctcacaagttcgctgtgtcaatgtcgattcctaaatacattgagacgtatggtagtttgaacaatggagatcatgttgaaaacgctgaggagtctttagctgggcggataatgagcaagcgatcttcctcttccaagctcttcttctatgatctacacggtgatgatttcaaggtccaagtcatggctgatgcaagtaagtcaggattggatgaagctgagttcttaaagctccattcgaatgctaagcgtggtgatattgttggagtcattgggtttccaggaaaaactaagaggggagaattgagtatctttccccgatcatttattcttctgtcccattgcctccacatgatgccgagaaaggctgataatgttaatgcaaagaaacctgaaatctgggttccaggtcaaacgagaaatcctgaagcatatgttctgaaagaccaggaatcaagatatcgtcagcgtcatcttgatatgattttgaacgtggaggttcgtcagatattcaggactagagctaaaatcatctcctatgtccgcagattcctcgacaacaaaaatttcttggaggtcgagacacctatgatgaacatgattgctggtggagcagctgctagaccttttgtgacacatcacaatgatctagatatgaggctgtacatgcgaatcgcacctgaactctatctcaagcaacttattgttggtggcttggaacgtgtttacgagataggaaagcaattcagaaacgagggtatagacctgacccacaatccggagttcaccacttgcgagttctatatggcttttgcagactacaatgacctgatggaaatgactgaggttatgttgagtggcatggttaaggaattaacaggtggttataaaatcaagtataatgctaatgggtatgacaaggatccaattgaaatcgactttactccaccattcaggaggattgagatgataggagagttagagaaggttgctaagctcaatataccaaaagacttggctagcgaagaagctaacaagtatctgattgatgcatgtgcgaggtttgatgtcaaatgccctcctcctcagacaacagctcgtctgttagataaacttgttggagaatttctggaaccgacatgtgtgaacccaactttcatcatcaaccagcccgagatcatgagtcctttggctaaatggcacagatcgaagagtggattgacagagagattcgagctgttcatcaacaaacatgaactctgcaatgcctacacggagctaaacgatcctgtggtacagcgccagcgttttgctgatcagctcaaggatcgacagtctggagacgatgaagcgatggctttagatgaaacattttgtaatgctttagaatatgggttggctcctacaggtggctggggattaggaatagacagactctctatgcttttgaccgactcactgaacatcaaggaggttcttttcttcccggcaatgaggccaccacaggaggagtcagcagccgctcaagctcctttaacagaagagaagaaataa

SEQ ID NO: 1164 - protein, 626 aa, Arabidopsis thaliana
MEGAADQTTKALSELAMDSSTTLNAAESSAGDGAGPRSKNALKKEQKMKQKEEEKRRKDEEKAEKAKQAPKASSQKAVAADDEEMDATQYYENRLKYLAAEKAKGENPYPHKFAVSMSIPKYIETYGSLNNGDHVENAEESLAGRIMSKRSSSSKLFFYDLHGDDFKVQVMADASKSGLDEAEFLKLHSNAKRGDIVGVIGFPGKTKRGELSIFPRSFILLSHCLHMMPRKADNVNAKKPEIWVPGQTRNPEAYVLKDQESRYRQRHLDMILNVEVRQIFRTRAKIISYVRRFLDNKNFLEVETPMMNMIAGGAAARPFVTHHNDLDMRLYMRIAPELYLKQLIVGGLERVYEIGKQFRNEGIDLTHNPEFTTCEFYMAFADYNDLMEMTEVMLSGMVKELTGGYKIKYNANGYDKDPIEIDFTPPFRRIEMIGELEKVAKLNIPKDLASEEANKYLIDACARFDVKCPPPQTTARLLDKLVGEFLEPTCVNPTFIINQPEIMSPLAKWHRSKSGLTERFELFINKHELCNAYTELNDPVVQRQRFADQLKDRQSGDDEAMALDETFCNALEYGLAPTGGWGLGIDRLSMLLTDSLNIKEVLFFPAMRPPQEESAAAQAPLTEEKK

SEQ ID NO: 1165 - DNA, 1701 bp, Arabidopsis thaliana
atgggcacatcatctgggtccaatcttcctcaccagatgctacctccacgtcagcaactacaaacatctctttcgcttgtatcttcagatccccacttgtcacggtctaattctggcattgtgcgtgaatcaccagctgaaagtgctagctctcaagaaacttggccaacctcaaaatctattatgggaaggaagacagatagcggaaagacagggcctgactctcatgatcaacatgtgatccgccatgtttccattgctgataaggtatcgctacgggacatagctagagagagacttgacatagtcgctgagagaatgcatcgattaccagaagaatatctcgaggagttaaagaatggtcttaaggctatccttgaaggaaatggtgcgcagcctatagatgagtttatgtttctgcagaagtttgtccagacgagatctgatttaacttcaaagacacttgtcagggctcaccgagtgcagcttgaagttcttgtggttataaacactggtatccaagcattcttgcacccaaacatcaatctctctcagtcatcactcatcgagatctttgtgtacaagagatgcagaaacatagcttgccaaaacgaactcccggctgatggttgtccctgtgagatatgcgctaataggaaaggcttctgcaacctgtgcatgtgtgtgatatgtaacaagtttgactttgcagtcaacacatgccgctggattggctgcgacgtgtgttctcattggactcatacggattgtgctattagggatggggagatttcgatgggagtttctcccaagagcgtatctgggatgggagaaatgctgttcaagtgtcgagcgtgcaaccatacttctgaattgctggggtgggtgaaagatgtgtttcagcactgtgcaccaaactgggatagggaatctttaatgaaggaacttgacttcgttagtaggattttccgtggaagcgaagatacaagaggccggaaactcttctggaagtgtgaggagcttatggagaagattaaaggtggactggctgaagcaacagcggccaagttgatactcatgtttttccaagaaattgaattggactctccaaagagccttgaaagcggagaaggtgggggtacgatagcacctcaagatgcatgcaaccgaattgctgaagttgtaaaggaaacactgaggaaaatggagatagtgggtgaggaaaagacgaggatgtacaagaaagcgcgaatggggcttgaggaatgcgagagagaggtagaagagaaagcaaagcaagtggcggaactgcagatggagaggcagaagaagaaacaacagatagaagaggtggagaggatagtgaggctgaagcaagcagaggcagagatgtttcagttaaaagcaaacgaggcaaaagtggaagcagagagattggaaaggattgtgaaagcgaaaaaggagaaaacagaagaggaatacgcaagtaactatttgaaactgaggctgagcgaggcggaggcagagaaagagtatctgtttgaaaagataaaagagcaggaaagtggtgggaatggtggtgaagcgtcacaagcagtgatgtactcaaagatcagagaaatgctgcatggatacaatgcatcgtcgccaagggtagatccaagatcaaaccagcgaaatcctttcagatccaatccttag

SEQ ID NO: 1166 - protein, 566 aa, Arabidopsis thaliana
MGTSSGSNLPHQMLPPRQQLQTSLSLVSSDPHLSRSNSGIVRESPAESASSQETWPTSKSIMGRKTDSGKTGPDSHDQHVIRHVSIADKVSLRDIARERLDIVAERMHRLPEEYLEELKNGLKAILEGNGAQPIDEFMFLQKFVQTRSDLTSKTLVRAHRVQLEVLVVINTGIQAFLHPNINLSQSSLIEIFVYKRCRNIACQNELPADGCPCEICANRKGFCNLCMCVICNKFDFAVNTCRWIGCDVCSHWTHTDCAIRDGEISMGVSPKSVSGMGEMLFKCRACNHTSELLGWVKDVFQHCAPNWDRESLMKELDFVSRIFRGSEDTRGRKLFWKCEELMEKIKGGLAEATAAKLILMFFQEIELDSPKSLESGEGGGTIAPQDACNRIAEVVKETLRKMEIVGEEKTRMYKKARMGLEECEREVEEKAKQVAELQMERQKKKQQIEEVERIVRLKQAEAEMFQLKANEAKVEAERLERIVKAKKEKTEEEYASNYLKLRLSEAEAEKEYLFEKIKEQESGGNGGEASQAVMYSKIREMLHGYNASSPRVDPRSNQRNPFRSNP

SEQ ID NO: 1167 - DNA, 1413 bp, Arabidopsis thaliana
atggcagcctcaggcacctctgctactttcagagcctccgtttcttcagctccttcctcttcttcccaattgacccatttgaaatcacccttcaaagctgtcaaatatacgcctctgccatcgtctcgctccaagtcatcatccttctccgtctcctgcaccatcgccaaggacccgcctgttctcatggccgccggatctgacccggccctgtggcaacgacccgattcgttcggtcggtttgggaagtttggtgggaagtatgtacctgaaacccttatgcacgctctatctgagcttgaatccgctttctatgctcttgccaccgacgatgatttccagagagagttggctggaatcttgaaggactatgtgggtagagaaagtcctctgtattttgcagagaggcttacggagcattacaggcgcgagaatggcgaagggcctcttatatacttgaagagagaagacttgaatcacacaggagctcacaagattaacaacgctgtggctcaggctcttcttgctaagcggttggggaagaagaggattattgctgagacaggagcgggtcaacatggtgtggctacagctactgtgtgtgcccgttttggtttggagtgtattatctatatgggtgctcaagatatggagagacaagcactcaatgtgttcagaatgcgacttcttggtgccgaggtgagaggagtccactctggaacagcgacattgaaggatgcgacatctgaagcgataagagattgggtgacaaatgtggagactacccattacatattgggatctgtggcgggtcctcatccttaccccatgatggtcagagactttcacgctgtgattggtaaagaaacaaggaaacaagcgttggagaaatggggcgggaagccggatgtcttggtggcttgtgtcggtggtggttcaaacgctatgggactcttccatgaatttgtgaatgacacagaggtccggatgatcggtgtggaagcagcgggattcggattggacagtggcaaacacgctgctacattgacaaagggagatgttggtgtcctccatggagctatgagttacttgctgcaagatgatgatggacaaatcattgaaccacactccatcagtgcaggattggactaccctggagtcggacccgagcacagtttctttaaagacatgggacgggctgaatactatagcataaccgacgaagaagcgttggaagcgttcaagagagtgtcgcggttagagggaatcattccagcactggagacctcacacgcactagcttacctcgagaagctatgtcccacattatcagacgggacgagagtggtcttgaacttcagcggaagaggagataaagatgttcagacagtggctaaatatcttgatgtttga

SEQ ID NO: 1168 - protein, 470 aa, Arabidopsis thaliana
MAASGTSATFRASVSSAPSSSSQLTHLKSPFKAVKYTPLPSSRSKSSSFSVSCTIAKDPPVLMAAGSDPALWQRPDSFGRFGKFGGKYVPETLMHALSELESAFYALATDDDFQRELAGILKDYVGRESPLYFAERLTEHYRRENGEGPLIYLKREDLNHTGAHKINNAVAQALLAKRLGKKRIIAETGAGQHGVATATVCARFGLECIIYMGAQDMERQALNVFRMRLLGAEVRGVHSGTATLKDATSEAIRDWVTNVETTHYILGSVAGPHPYPMMVRDFHAVIGKETRKQALEKWGGKPDVLVACVGGGSNAMGLFHEFVNDTEVRMIGVEAAGFGLDSGKHAATLTKGDVGVLHGAMSYLLQDDDGQIIEPHSISAGLDYPGVGPEHSFFKDMGRAEYYSITDEEALEAFKRVSRLEGIIPALETSHALAYLEKLCPTLSDGTRVVLNFSGRGDKDVQTVAKYLDV

SEQ ID NO: 1169 - DNA, 1350 bp, Arabidopsis thaliana
atgaggagcgttaataatagtagtgtcgacaccgtgaacgccgccgcttccgccatcgtctccgctgagtctagaacacaaccgtcgtcggttcagaaaaaaaggggaagctggtggagcttgtactggtgttttggatccaagaagaacaataaaaggataggccacgcggtgcttgtacccgaaccagctgcatcaggagctgcggtggctccagtccaaaactcttcgagcaattctacttcaatattcatgccctttatagctcctccttcatctcctgcttcctttctgccatcaggtcctccctctgcgtcacatactcctgatcctggtctactttgttccctaaccgtcaatgaaccgccttcagcctttactattggaccatacgctcatgagactcaacctgttactcctccagtgttctctgctttcacaacggaaccctccaccgcgccattcacgccacctcctgaatcaccttcttcccctgaagtgccttttgctcagttacttacatcttcattggaaagggctaggaggaacagtggtggtggaatgaatcagaagttttcagctgcacactacgagtttaagtcttgtcaagtgtatcctggaagtccaggtggtaatctaatctctcctggttcaggtacatcttctccttacccagggaaatgctccatcatcgagtttcgtatcggcgaacctccaaagtttcttggttttgagcacttcacagcgcgtaaatggggatcaagattcggttctggatccatcacacctgctggacaaggttcaaggttgggttcaggtgctttgactcctgatggctcaaagctaacttctggtgtagtgacaccaaatggtgcagagactgttataagaatgagttatgggaatctcacaccacttgaaggcagtcttttggatagtcagatctctgaggttgcgtctttagccaattcggaccacgggtcgtcaaggcataatgatgaagctctcgtggttcctcacagagtttctttcgagttgactggtgaagacgttgcacggtgtcttgcaagcaagctaaaccgttccggttcacatgaaaaagcaagcggcgaacatttaagaccaaactgttgtaaaacgtcgggagaaacagagagcgaacagagtcagaagctaagatcgttttctacaggctctaacaaagaattcaagtttgatagcaccaatgaagagatgatagagaaaattcgatcggagtggtgggcgaatgagaaggtcgccggaaaaggtgatcacagtccaagaaacagttggactttctttccagtcttacgctctggacatacttag

SEQ ID NO: 1170 - protein, 449 aa, Arabidopsis thaliana
MRSVNNSSVDTVNAAASAIVSAESRTQPSSVQKKRGSWWSLYWCFGSKKNNKRIGHAVLVPEPAASGAAVAPVQNSSSNSTSIFMPFIAPPSSPASFLPSGPPSASHTPDPGLLCSLTVNEPPSAFTIGPYAHETQPVTPPVFSAFTTEPSTAPFTPPPESPSSPEVPFAQLLTSSLERARRNSGGGMNQKFSAAHYEFKSCQVYPGSPGGNLISPGSGTSSPYPGKCSIIEFRIGEPPKFLGFEHFTARKWGSRFGSGSITPAGQGSRLGSGALTPDGSKLTSGVVTPNGAETVIRMSYGNLTPLEGSLLDSQISEVASLANSDHGSSRHNDEALVVPHRVSFELTGEDVARCLASKLNRSGSHEKASGEHLRPNCCKTSGETESEQSQKLRSFSTGSNKEFKFDSTNEEMIEKIRSEWWANEKVAGKGDHSPRNSWTFFPVLRSGHT

SEQ ID NO: 1171 - DNA, 1410 bp, Arabidopsis thaliana
atggcggaactaaagctatcagagagtcgggacttaaccagagtcgagcgaatcggcgcacactcacacatcagaggactaggtctcgactctgccctcgagccgcgagctgtttccgaaggtatggtcggtcaagtgaaggcgcgtaaagccgccggtgtaatccttcagatgattagagaagggaaaatcgcgggtcgggctattctaatagcgggtcaacccggaacgggtaagacagcgattgcaatgggtatggcgaaatctcttggcttggaaactccttttgcgatgattgcaggaagtgaaattttctcattagagatgtcaaagacagaagctttgactcagtcttttcgtaaagcgattggtgttaggatcaaagaagagacagaggttattgaaggagaagttgttgaggttcagattgataggcctgcttcttctggtgttgcttccaagtcagggaagatgactatgaaaacgactgatatggaaactgtgtatgatatgggagctaagatgattgaggctttgaacaaggagaaagtgcagagtggtgatgttattgccattgataaagctactgggaagattactaagcttggaagatcgttttcgaggtctcgtgattatgatgctatgggtgcgcagaccaagtttgtgcagtgccctgaaggtgagttgcagaagaggaaagaggttgtacattgtgtcactcttcacgagattgatgttatcaacagcaggacacaagggtttcttgcccttttcactggcgatactggagaaatccgatcagaagtccgggaacaaattgatacaaaagtagctgaatggagagaagaaggaaaagcagagatagttcccggagttctcttcattgatgaagtccacatgctcgacatcgaatgcttctcattccttaaccgagctctagaaaacgaaatgtcaccaatccttgtggtggcaacaaaccgaggagtgacgacaatccgtggcacaaaccagaaatcaccacacgggatcccgattgatctccttgaccgtcttctcatcatcactacccaaccttacacagacgatgacataaggaagatattagaaatccgttgccaagaggaagacgttgagatgaacgaagaggccaaacagcttttgacattgatcggacgtgatacatctctaaggtatgcgattcatcttataaccgcagctgcattgtcatgccagaaacggaaagggaaagtcgtggaggttgaggatattcagagagtttacagactgttcttggatgtgaggagatcgatgcagtatcttgttgagtatcagagtcagtatatgttcagtgaaccaatcaaaaacgatgaagctgctgcagaagacgaacaagatgctatgcagatctga

SEQ ID NO: 1172 - protein, 469 aa, Arabidopsis thaliana
MAELKLSESRDLTRVERIGAHSHIRGLGLDSALEPRAVSEGMVGQVKARKAAGVILQMIREGKIAGRAILIAGQPGTGKTAIAMGMAKSLGLETPFAMIAGSEIFSLEMSKTEALTQSFRKAIGVRIKEETEVIEGEVVEVQIDRPASSGVASKSGKMTMKTTDMETVYDMGAKMIEALNKEKVQSGDVIAIDKATGKITKLGRSFSRSRDYDAMGAQTKFVQCPEGELQKRKEVVHCVTLHEIDVINSRTQGFLALFTGDTGEIRSEVREQIDTKVAEWREEGKAEIVPGVLFIDEVHMLDIECFSFLNRALENEMSPILVVATNRGVTTIRGTNQKSPHGIPIDLLDRLLIITTQPYTDDDIRKILEIRCQEEDVEMNEEAKQLLTLIGRDTSLRYAIHLITAAALSCQKRKGKVVEVEDIQRVYRLFLDVRRSMQYLVEYQSQYMFSEPIKNDEAAAEDEQDAMQI

SEQ ID NO: 1173 - DNA, 1779 bp, Arabidopsis thaliana
atggcaccatcaatgaaagaaattttttctaaagataatttcaagaaaaacaagaaacttgttttgctatccgccgccgtagctttgctcttcgtagccgccgtcgccggaatctctgccggagcttcaaaagccaacgaaaaacgaactctatccccgtcgtctcacgccgtgctaagatcctcatgcagctccacgcgttaccctgagctctgtatctctgccgtggtaactgccggcggcgtcgagctaacgtcgcaaaaagatgtcatcgaggcatcggtgaacctaacaataaccgccgtggagcacaattacttcaccgtgaagaagctgatcaagaagaggaaaggactgacgccgcgcgagaagacggcgcttcatgactgtttggagactattgatgagacgctggacgagctccatgaaacggtggaagatctccatttgtatccaaccaaaaaaactctccgggaacacgccggagatctcaaaacactaattagctccgccattaccaaccaggagacttgtctcgacggcttctctcatgacgacgccgataagcaagttcgtaaagccttgttgaaggggcagatacacgtagagcacatgtgcagcaacgctctagcaatgatcaagaacatgactgatactgacatagccaacttcgagcaaaaagctaaaataacctcaaacaaccgtaagctcaaggaggagaatcaggaaactacggtggctgtagatatcgccggagccggagaactagactcggagggatggccaacttggttatccgctggagataggaggcttcttcagggttcaggtgtgaaagctgacgccaccgtggcagctgacggtagcggtacatttaaaactgtggctgctgcggttgccgcggcccctgaaaatagtaataagaggtatgtgatacatataaaagccggagtttacagagagaatgtggaggttgctaagaagaaaaagaatataatgtttatgggagatggtcggacgagaactattatcaccggaagtcgaaacgttgtagacggtagcaccactttccactccgccaccgttgctgctgtcggcgagagattcttagctcgtgacatcactttccaaaacacggcgggtccgtcgaagcaccaagcggtggctctccgtgtgggttctgatttctccgccttctacaattgcgacatgttagcttatcaagacactctatacgtccactctaaccgtcaattcttcgtcaaatgtctcatcgccggaaccgttgacttcatcttcggaaacgccgccgtcgtgctccaagactgtgacatccacgctcgccgccctaattccggtcagaaaaacatggtcacagctcagggaagaacggatcctaaccagaacacagggatcgttatccagaaatgtaggatcggtgccacgtcggatttacagtcggtgaaaggtagttttccgacgtacttgggtcggccatggaaggaatattcacaaacggtgataatgcagtcggctatctccgacgtgatccgacccgaagggtggtccgagtggaccgggacttttgcgttgaacactctgacttacagagagtattcgaacacaggagcaggggctggaactgcaaatagagtgaagtggaggggctttaaggtaattacggctgctgctgaagctcaaaaatatacggctggtcagtttattggtggtggaggctggttatcgtcgaccggtttccccttctcgctcggtctttga

SEQ ID NO: 1174 - protein, 592 aa, Arabidopsis thaliana
MAPSMKEIFSKDNFKKNKKLVLLSAAVALLFVAAVAGISAGASKANEKRTLSPSSHAVLRSSCSSTRYPELCISAVVTAGGVELTSQKDVIEASVNLTITAVEHNYFTVKKLIKKRKGLTPREKTALHDCLETIDETLDELHETVEDLHLYPTKKTLREHAGDLKTLISSAITNQETCLDGFSHDDADKQVRKALLKGQIHVEHMCSNALAMIKNMTDTDIANFEQKAKITSNNRKLKEENQETTVAVDIAGAGELDSEGWPTWLSAGDRRLLQGSGVKADATVAADGSGTFKTVAAAVAAAPENSNKRYVIHIKAGVYRENVEVAKKKKNIMFMGDGRTRTIITGSRNVVDGSTTFHSATVAAVGERFLARDITFQNTAGPSKHQAVALRVGSDFSAFYNCDMLAYQDTLYVHSNRQFFVKCLIAGTVDFIFGNAAVVLQDCDIHARRPNSGQKNMVTAQGRTDPNQNTGIVIQKCRIGATSDLQSVKGSFPTYLGRPWKEYSQTVIMQSAISDVIRPEGWSEWTGTFALNTLTYREYSNTGAGAGTANRVKWRGFKVITAAAEAQKYTAGQFIGGGGWLSSTGFPFSLGL

SEQ ID NO: 1175 - DNA, 906 bp, Arabidopsis thaliana
atggataagccaagcttcgtaatccaatccaaagaagcagaatccgccgcgaaacaactcggcgtttccgtcattcagctcctcccgtcgctagtcaaaccagcacaatcctacgctcgaactccgatttcgaaattcaacgtcgcagtcgtcggactcggatcatcaggtcggatcttcttaggcgtcaatgtcgaattcccaaatctccctctccaccactcaatccacgccgaacagttcctcgtcaccaatctcacactcaacggtgaacgtcatctcaatttcttcgccgtctccgccgcaccatgtggccattgccgtcaattcctccaagaaattcgcgacgcacctgaaatcaaaatccttatcaccgatccaaacaactccgccgattccgattccgccgccgattcagacggattcttacgtctcggaagcttcttgccacacagattcggtcccgacgatcttctcgggaaagatcatcctcttcttctcgaatctcacgataaccatctcaaaatctcagatctggattcgatttgtaacggaaacaccgattcatccgccgatttgaaacaaacggctttagcggcggcgaatagatcgtacgcgccgtatagtttatgtccatcgggagtttcgctggtggattgtgacgggaaagtgtacagaggttggtatatggaatcggcggcgtataatcctagtatgggaccagtacaggcggcgttggttgattatgtggctaatggtggtggaggaggatacgagaggatcgtcggagcggttctggtggagaaagaagatgcggtggtgaggcaagagcacacggcgaggttgttattagagactatatcgccgaaatgcgaattcaaagtgtttcattgctatgaagcttag

SEQ ID NO: 1176 - protein, 301 aa, Arabidopsis thaliana
MDKPSFVIQSKEAESAAKQLGVSVIQLLPSLVKPAQSYARTPISKFNVAVVGLGSSGRIFLGVNVEFPNLPLHHSIHAEQFLVTNLTLNGERHLNFFAVSAAPCGHCRQFLQEIRDAPEIKILITDPNNSADSDSAADSDGFLRLGSFLPHRFGPDDLLGKDHPLLLESHDNHLKISDLDSICNGNTDSSADLKQTALAAANRSYAPYSLCPSGVSLVDCDGKVYRGWYMESAAYNPSMGPVQAALVDYVANGGGGGYERIVGAVLVEKEDAVVRQEHTARLLLETISPKCEFKVFHCYEA

SEQ ID NO: 1177 - DNA, 1197 bp, Arabidopsis thaliana
atggttcccccgccgtctaatccgcagcaggttcagcagttcctctcctctgccctctcccagcgcggcccatcttcagtcccctacgaagagtccaacaagtggttgatccggcaacatctacttaacctaatctcttcttacccttccttagagcccaaaacggcatcgtttatgcacaacgatggtcgctccgtcaacctccttcaagcagatggtacgattccgatgccttttcatggagtcacctataacatacctgtgattatctggctcctcgagtcatatcctcgtcatcctccttgcgtctatgtgaatcccaccgctgatatgatcatcaagcgacctcacgcacatgtcactccttctggtctcgtttctcttccgtaccttcagaattgggtctaccctagctccaatctcgtagatctcgtctccgatctcagcgctgcttttgctcgtgatccgcctctttattctcgacgccgtcctcagccaccgccaccgtctcctcctacggtatacgattcgtctctgtcacgacctccttcggctgatcagtcattgcctagaccgttcccgccatcaccttacggcggaggagtaagtagggtgcaagtgcagcatgttcaccaccagcagcaatctgatgatgcggcggaggttttcaagagaaatgcgattaataagatggtggagatggttcatagcgatttggtttcgatgaggagagccagagaagctgaagcagaggagctgctgagcttgcaagctgggctgaagagaagagaggatgagcttaatatagggttgaaagagatggttgaggagaaagaaacacttgaacaacaattacagattatctccatgaacactgatattctagactcgtgggttagagagaaccaaggcaaaaccaagaatttagttgatttggatgtggataatgcttttgaatgtggtgacacactctctaagcagatgttagagtgtactgctttggatttagccattgaagatgctatttattccttggataagtcgtttcaagatggtgttgttccctttgatcagtatttgaggaatgtgaggttgttgtcgagagaacagttcttccaccgagccacgggttctaaagtcagggcggcacaaatggaggttcaggttgcagccatcgcaggtaggttacattcatga

SEQ ID NO: 1178 - protein, 398 aa, Arabidopsis thaliana
MVPPPSNPQQVQQFLSSALSQRGPSSVPYEESNKWLIRQHLLNLISSYPSLEPKTASFMHNDGRSVNLLQADGTIPMPFHGVTYNIPVIIWLLESYPRHPPCVYVNPTADMIIKRPHAHVTPSGLVSLPYLQNWVYPSSNLVDLVSDLSAAFARDPPLYSRRRPQPPPPSPPTVYDSSLSRPPSADQSLPRPFPPSPYGGGVSRVQVQHVHHQQQSDDAAEVFKRNAINKMVEMVHSDLVSMRRAREAEAEELLSLQAGLKRREDELNIGLKEMVEEKETLEQQLQIISMNTDILDSWVRENQGKTKNLVDLDVDNAFECGDTLSKQMLECTALDLAIEDAIYSLDKSFQDGVVPFDQYLRNVRLLSREQFFHRATGSKVRAAQMEVQVAAIAGRLHS

SEQ ID NO: 1179 - DNA, 1344 bp, Arabidopsis thaliana
atgggtcttcctctaatgatggagagatcatcaaacaacaacaacgtcgagctttctcgagtggcggtttcagacactcacggcgaagactcaccgtacttcgccggctggaaagcttacgacgaaaatccttacgacgaatctcataacccttccggtgtcatccaaatgggtctcgctgagaatcaggtctcgtttgatcttcttgaaacttacttggagaagaagaatccagaaggttcgatgtggggatcaaaaggagctcctgggttccgtgaaaacgcattgtttcaagactaccacggtctcaaaactttcagacaagccatggctagtttcatggaacagattcgaggaggcaaagctagatttgatcctgaccggatcgtcctcaccgccggagccaccgccgctaacgaactcttaactttcattctcgccgatcctaacgacgcccttctagttcccacaccgtattatccaggattcgatagagatttgagatggagaaccggagtgaaaatagtacccatccactgcgacagctcgaaccatttccagataaccccggaggcgctagagtcggcgtaccaaacggctcgtgacgcgaacattagagtccgaggagtgctcataaccaacccatcgaacccattaggggcgacggtccaaaagaaggttctagaagatctccttgacttctgcgtacgcaagaatattcacttggtctcagacgagatctactccggctccgtcttccatgcctccgagttcacaagcgttgccgagatcgtagaaaacatagatgacgtgtcagtaaaggaacgagttcacatcgtctacagtctctccaaggatcttggtcttcctggtttccgcgtgggaactatatactcgtacaacgataatgttgttcggacagcgagaaggatgtcgagcttcacgcttgtctcgtctcagacacaacatatgctggcttctatgttgtcggatgaggagtttacggagaagtacattaggataaaccgggaaagacttagaagacggtacgataccattgtggaagggcttaagaaggcagggattgagtgtttgaaagggaacgcagggctattttgttggatgaatttgggtttcttgctcgaaaagaaaactaaagacggcgagctccagctttgggatgtgatcttaaaggagctgaacctgaatatatctccgggatcttcgtgccactgctcggaggtcggatggtttagggtttgttttgctaatatgagtgagaacactttggagattgcgttgaagagaatacatgagttcatggaccgacgaaggaggttttga

SEQ ID NO: 1180 - protein, 447 aa, Arabidopsis thaliana
MGLPLMMERSSNNNNVELSRVAVSDTHGEDSPYFAGWKAYDENPYDESHNPSGVIQMGLAENQVSFDLLETYLEKKNPEGSMWGSKGAPGFRENALFQDYHGLKTFRQAMASFMEQIRGGKARFDPDRIVLTAGATAANELLTFILADPNDALLVPTPYYPGFDRDLRWRTGVKIVPIHCDSSNHFQITPEALESAYQTARDANIRVRGVLITNPSNPLGATVQKKVLEDLLDFCVRKNIHLVSDEIYSGSVFHASEFTSVAEIVENIDDVSVKERVHIVYSLSKDLGLPGFRVGTIYSYNDNVVRTARRMSSFTLVSSQTQHMLASMLSDEEFTEKYIRINRERLRRRYDTIVEGLKKAGIECLKGNAGLFCWMNLGFLLEKKTKDGELQLWDVILKELNLNISPGSSCHCSEVGWFRVCFANMSENTLEIALKRIHEFMDRRRRF

SEQ ID NO: 1181 - DNA, 1050 bp, Arabidopsis thaliana
atggggttttctccttcattttcttgcagtgctattggagccctaattttgggttgccttctgcttcaagcatcaaactctaatgctcagttgaggcctgatttctacttcgggacgtgcccatttgtttttgatatcattggaaatatcatcgtcgatgaactgcagactgatcctcgtattgccgcgagcctccttcgtcttcactttcacgactgctttgttcgtggttgtgatgcatcgatcttgcttgacaattccacatcattccggactgagaaagatgctgctccgaacgcaaattcggctcgagggtttaatgtcatagatagaatgaaagtagcccttgagagagcttgcccaggaagagtctcttgtgcagatattctcaccatcgcctctcaaatatcagtgcttttgtcgggaggtccatggtggccggttccgttggggaggagagacagtgtagaagctttcttcgctctggctaatacagctctgccctctccgtttttcaatcttactcaacttaaaacagcctttgctgacgttggcctaaaccgcacttccgatctagttgctctttccggtggtcacacatttggaagagcacaatgccagttcgtgacgcctcgtctctacaacttcaatggtacaaacagtccagacccaagtctgaacccaacttaccttgtcgaactccgtcgattgtgtcctcaaaacggaaacggcaccgttctggtcaacttcgatgtcgtgactccagatgctttcgatagtcaatactacaccaaccttcgtaatgggaaaggtcttattcagagtgaccaggaactcttttcgactccaggagccgatacgatccctttagtaaaccaatacagcagcgacatgtccgtgttctttcgagcattcattgacgcaatgattaggatgggaaatcttagacctttgactggaactcaaggagagattagacaaaattgtagggttgtgaatccacgaattagggttgtggagaacgacgatggtgttgtgagttctatctga

SEQ ID NO: 1182 - protein, 349 aa, Arabidopsis thaliana
MGFSPSFSCSAIGALILGCLLLQASNSNAQLRPDFYFGTCPFVFDIIGNIIVDELQTDPRIAASLLRLHFHDCFVRGCDASILLDNSTSFRTEKDAAPNANSARGFNVIDRMKVALERACPGRVSCADILTIASQISVLLSGGPWWPVPLGRRDSVEAFFALANTALPSPFFNLTQLKTAFADVGLNRTSDLVALSGGHTFGRAQCQFVTPRLYNFNGTNSPDPSLNPTYLVELRRLCPQNGNGTVLVNFDVVTPDAFDSQYYTNLRNGKGLIQSDQELFSTPGADTIPLVNQYSSDMSVFFRAFIDAMIRMGNLRPLTGTQGEIRQNCRVVNPRIRVVENDDGVVSSI

SEQ ID NO: 1183 - DNA, 3078 bp, Arabidopsis thaliana
atggtttggtttagaatcggttcttctgtggcaaagcttgccataagaaggacactgtctcagtctcgttgtggttcatatgccactagaacaagggttttgccttgtcaaaccagatgttttcactctacaatactcaaatcaaaggcagagtctgctgcacctgttccacgtcctgtcccactttctaagctaactgatagcttcttagatggaacaagcagtgtgtatctagaggagttacaaagagcttgggaggctgatcccaacagtgttgatgagtcgtgggataacttttttaggaattttgtgggtcaggcttctacatcgcctggtatctcggggcaaaccattcaagaaagcatgcgtttgttgttgctagttagagcttaccaggttaatggccacatgaaggccaagcttgatcctttaggtctagagaagagagagattccagaggatctcacgccaggtctttatgggtttactgaggctgatcttgatcgggaattctttctgggtgtatggaggatgtcgggttttctctctgagaaccgcccggttcaaacactgaggtcgatactgtcgaggcttgagcaagcttactgtgggactatagggtatgagtacatgcacattgctgatagggataaatgtaactggttgagagacaagatcgagaccccaactcctcgacagtacaatagtgagcgtcggatggttatttatgataggcttacctggagcacacagtttgagaatttcttggctactaagtggaccacggctaaaaggtttggactggaaggtgctgaatctttgattcctggcatgaaggagatgttcgataggtctgcagatctcggggtagagaacatagttatcggtatgccccataggggtcgacttaatgttttgggtaatgttgttagaaaacctctacgccaaatattcagcgagtttagcggtggtactaggccagtagatgaagttgggctttacaccggaacaggtgatgtgaaataccacttgggtacatcttatgatcgtccaactagaggaggcaaacatctccacttgtctttggtagcaaatcccagtcacttggaagcagtagatcctgttgtgataggtaaaaccagagcgaaacaatattacacgaaagacgagaacagaacaaagaacatgggtattttgatccatggggatggtagctttgccggacaaggagtggtgtatgaaactctccatcttagtgcacttcctaactactgtaccggtggaacagtgcacattgtggtgaataatcaagtggctttcacaaccgatcccagggaaggaaggtcttcacagtattgcactgatgttgcaaaggctttgagcgccccaattttccatgtcaatgcagatgacattgaagcagtagtgcatgcttgtgagcttgctgctgagtggcgccagacgttccattctgatgttgttgttgatttagtatgctaccgtcgctttgggcataacgagatagacgaaccgtcattcacacaaccaaaaatgtacaaggtgatacgcagtcatccctcgtcacttcaaatctaccaggagaagctcttgcaatctggacaggtaacccaagaagatattgataagattcaaaagaaagtaagctctatcctcaatgaagaatatgaggcaagtaaagattatattccacaaaaacgtgactggctggcaagtcactggactggattcaagtctccggagcagatttctaggattcgaaacaccggagtgaagccagagattttgaagaatgtgggaaaggcaatctcaaccttccctgagaactttaagccacacagaggagttaaaagagtttatgaacaacgtgctcaaatgattgaatcgggagaaggcattgactggggacttggagaagcacttgcttttgctacactggttgtggaagggaaccatgttcggctaagtggtcaagatgttgaaagaggaactttcagtcatagacactcagtgcttcatgatcaagaaaccggggaggaatattgtcccctcgatcacctaatcaaaaaccaagaccctgaaatgttcactgtcagcaacagctccctttcagaatttggtgttctcggtttcgaactgggttattcgatggaaaatcccaattctctggtgatatgggaagctcagtttggagactttgctaatggcgcacaagttatgtttgatcagttcataagcagtggggaagccaaatggctccgtcaaactggtctagtagttttacttcctcatggatatgatggtcagggtcctgaacattccagtggaagattggaacgtttccttcagatgagtgatgacaatccttacgttatccctgagatggacccaactcttcgaaagcagattcaagaatgtaattggcaagttgttaatgttactacacctgccaactatttccatgttctgcgtcggcagatacacagggactttcgcaagcctcttatagtgatggcccccaaaaacttgcttcgtcacaaacagtgtgtatctaatctctcggaattcgatgatgttaaaggacatcctggatttgacaagcaaggaactcgatttaaacggttgatcaaagatcaaagtggccactctgatcttgaagaaggtatcagacgtctagtcctctgctctgggaaggtctactatgagcttgacgaagagcgaaagaagtctgaaacaaaggatgtagccatttgcagagtagagcagctttgcccatttccatatgatctcatccaaagagaactaaagcgatatccaaatgcagagatcgtgtggtgtcaagaagagccgatgaacatgggaggataccaatacatagccctaaggctttgcaccgcgatgaaagcactgcaaagaggaaacttcaacgacatcaaatacgttggtcgtcttccctcagctgctacagccacaggattttaccagcttcatgttaaggagcagactgatcttgtgaagaaagctcttcaacctgaccccatcacccccgtcatcccttaa

SEQ ID NO: 1184 - protein, 1025 aa, Arabidopsis thaliana
MVWFRIGSSVAKLAIRRTLSQSRCGSYATRTRVLPCQTRCFHSTILKSKAESAAPVPRPVPLSKLTDSFLDGTSSVYLEELQRAWEADPNSVDESWDNFFRNFVGQASTSPGISGQTIQESMRLLLLVRAYQVNGHMKAKLDPLGLEKREIPEDLTPGLYGFTEADLDREFFLGVWRMSGFLSENRPVQTLRSILSRLEQAYCGTIGYEYMHIADRDKCNWLRDKIETPTPRQYNSERRMVIYDRLTWSTQFENFLATKWTTAKRFGLEGAESLIPGMKEMFDRSADLGVENIVIGMPHRGRLNVLGNVVRKPLRQIFSEFSGGTRPVDEVGLYTGTGDVKYHLGTSYDRPTRGGKHLHLSLVANPSHLEAVDPVVIGKTRAKQYYTKDENRTKNMGILIHGDGSFAGQGVVYETLHLSALPNYCTGGTVHIVVNNQVAFTTDPREGRSSQYCTDVAKALSAPIFHVNADDIEAVVHACELAAEWRQTFHSDVVVDLVCYRRFGHNEIDEPSFTQPKMYKVIRSHPSSLQIYQEKLLQSGQVTQEDIDKIQKKVSSILNEEYEASKDYIPQKRDWLASHWTGFKSPEQISRIRNTGVKPEILKNVGKAISTFPENFKPHRGVKRVYEQRAQMIESGEGIDWGLGEALAFATLVVEGNHVRLSGQDVERGTFSHRHSVLHDQETGEEYCPLDHLIKNQDPEMFTVSNSSLSEFGVLGFELGYSMENPNSLVIWEAQFGDFANGAQVMFDQFISSGEAKWLRQTGLVVLLPHGYDGQGPEHSSGRLERFLQMSDDNPYVIPEMDPTLRKQIQECNWQVVNVTTPANYFHVLRRQIHRDFRKPLIVMAPKNLLRHKQCVSNLSEFDDVKGHPGFDKQGTRFKRLIKDQSGHSDLEEGIRRLVLCSGKVYYELDEERKKSETKDVAICRVEQLCPFPYDLIQRELKRYPNAEIVWCQEEPMNMGGYQYIALRLCTAMKALQRGNFNDIKYVGRLPSAATATGFYQLHVKEQTDLVKKALQPDPITPVIP

SEQ ID NO: 1185 - DNA, 2325 bp, Arabidopsis thaliana
atgtcttgttataataaagcactattgatcggcaacaaagtcgtcgttatacttgtattcctcttatgtttggttcactcgtcagagtcacttcgaccactgtttgcatgtgatccagcaaacgggttaacccggacgctccggttctgtcgggccaatgtaccgatccatgtgagagttcaagatttgctcggaaggctcacgttgcaggagaagatccgcaacctcgtcaacaatgctgccgccgtaccacgtctcggtattggaggctatgagtggtggtccgaggctctccacggcatttccgacgttggtccaggcgctaagttcggtggtgcttttcccggtgccaccagcttccctcaggtcatcaccaccgcagcttctttcaaccagtctctatgggaagagatcggacgggtggtgtctgatgaggcaagagctatgtacaatggtggcgtggccggtctgacatattggagtccgaatgtgaatatcttgagggacccgcggtggggccgaggccaagaaactcccggagaagatcctatcgttgccgcaaaatatgccgccagctacgtccggggacttcagggtactgctgccggtaaccgccttaaagtcgccgcatgttgcaaacattacactgcttatgatcttgataattggaatggcgtcgaccgtttccacttcaacgctaaggtcacccaacaagatttagaggacacatacaacgtgccattcaaatcatgtgtttacgaaggaaaagtagcgagtgtaatgtgttcgtacaaccaagtcaatggaaagcccacatgtgctgatgaaaatctcttaaagaacactattcgtggtcaatggcgtctcaatgggtacattgtctcagattgtgactctgttgatgttttcttcaaccaacaacattacactagcactccggaagaagccgccgccagatccattaaagccggtttggacttggactgcgggccgtttttggcgattttcacggaaggtgcagtgaagaaaggattgttaacggagaatgacatcaatttagcacttgctaatacattaacagtccaaatgagacttggtatgtttgatggtaaccttgggccgtacgctaatcttgggccaagagatgtttgtactccggcccataaacatttagctcttgaagcagcccatcaagggattgttcttctcaaaaactctgctcgctctcttccactctcccccagacgccaccgcaccgtcgccgtgattggtccaaactccgacgtcactgagactatgatcggcaactatgcagggaaagcatgcgcctatacgtcgccgttgcaagggatttcaagatacgcgaggacacttcaccaagctggctgtgccggcgtggcttgcaaagggaaccaaggatttggtgcagcggaggcagcggcgcgtgaagccgacgcgacggttcttgtgatgggattagatcagtcgatagaggcagagacacgagatcgaaccgggcttctcttaccgggttatcaacaagacctagtgacccgtgtagctcaagcttctagaggtccagtcattttggtccttatgagtggtggaccaatcgatgtaaccttcgctaagaatgatcctcgtgttgctgccatcatttgggctgggtatccgggtcaagcgggtggagctgccatcgccaatatcatctttggtgctgctaatcccggaggaaaactaccaatgacatggtatccacaagattacgtggccaaagtgccaatgacggtaatggccatgagagcatccggtaattatccaggaaggacatacagattctacaaaggtccagtagtatttccatttgggttcggtttaagttacactaccttcactcatagtttggccaaaagcccattggcccaactatcagtttcactctccaatctcaactctgccaataccattctcaactcttcatcacactccatcaaagtgtctcacaccaactgcaattcatttccgaaaatgccccttcacgtcgaagtatcaaacacaggtgaattcgatggaacacacacggtgtttgtatttgctgagccgccgataaacggaataaaaggattgggtgtgaacaaacaattgatagcgttcgagaaggttcatgtcatggcaggggcaaaacagaccgttcaagttgatgttgatgcttgcaagcatcttggtgtagtggatgagtatggaaagaggagaatcccaatgggtgagcataagctgcacattggtgaccttaaacatactattttggtccaaccgcaactttga

SEQ ID NO: 1186 - protein, 774 aa, Arabidopsis thaliana
MSCYNKALLIGNKVVVILVFLLCLVHSSESLRPLFACDPANGLTRTLRFCRANVPIHVRVQDLLGRLTLQEKIRNLVNNAAAVPRLGIGGYEWWSEALHGISDVGPGAKFGGAFPGATSFPQVITTAASFNQSLWEEIGRVVSDEARAMYNGGVAGLTYWSPNVNILRDPRWGRGQETPGEDPIVAAKYAASYVRGLQGTAAGNRLKVAACCKHYTAYDLDNWNGVDRFHFNAKVTQQDLEDTYNVPFKSCVYEGKVASVMCSYNQVNGKPTCADENLLKNTIRGQWRLNGYIVSDCDSVDVFFNQQHYTSTPEEAAARSIKAGLDLDCGPFLAIFTEGAVKKGLLTENDINLALANTLTVQMRLGMFDGNLGPYANLGPRDVCTPAHKHLALEAAHQGIVLLKNSARSLPLSPRRHRTVAVIGPNSDVTETMIGNYAGKACAYTSPLQGISRYARTLHQAGCAGVACKGNQGFGAAEAAAREADATVLVMGLDQSIEAETRDRTGLLLPGYQQDLVTRVAQASRGPVILVLMSGGPIDVTFAKNDPRVAAIIWAGYPGQAGGAAIANIIFGAANPGGKLPMTWYPQDYVAKVPMTVMAMRASGNYPGRTYRFYKGPVVFPFGFGLSYTTFTHSLAKSPLAQLSVSLSNLNSANTILNSSSHSIKVSHTNCNSFPKMPLHVEVSNTGEFDGTHTVFVFAEPPINGIKGLGVNKQLIAFEKVHVMAGAKQTVQVDVDACKHLGVVDEYGKRRIPMGEHKLHIGDLKHTILVQPQL

SEQ ID NO: 1187 - DNA, 669 bp, Arabidopsis thaliana
atggccaagatgggcttgaaacccgacccggctactactaaccagacccacaataatgccaaggagattcgttacagaggcgttaggaagcgtccttggggccgttatgccgccgagatccgagatccgggcaagaaaacccgcgtctggcttggcactttcgatacggctgaagaggcggcgcgtgcttacgatacggcggcgcgtgattttcgtggtgctaaggctaagaccaatttcccaacttttctcgagctgagtgaccagaaggtccctaccggtttcgcgcgtagccctagccagagcagcacgctcgactgtgcttctcctccgacgttagttgtgccttcagcgacggctgggaatgttcccccgcagctcgagcttagtctcggcggaggaggcggcggctcgtgttatcagatcccgatgtcgcgtcctgtctactttttggacctgatggggatcggtaacgtaggtcgtggtcagcctcctcctgtgacatcggcgtttagatcgccggtggtgcatgttgcgacgaagatggcttgtggtgcccaaagcgactctgattcgtcatcggtcgttgatttcgaaggtgggatggagaagagatctcagctgttagatctagatcttaatttgcctcctccatcggaacaggcctga

SEQ ID NO: 1188 - protein, 222 aa, Arabidopsis thaliana
MAKMGLKPDPATTNQTHNNAKEIRYRGVRKRPWGRYAAEIRDPGKKTRVWLGTFDTAEEAARAYDTAARDFRGAKAKTNFPTFLELSDQKVPTGFARSPSQSSTLDCASPPTLVVPSATAGNVPPQLELSLGGGGGGSCYQIPMSRPVYFLDLMGIGNVGRGQPPPVTSAFRSPVVHVATKMACGAQSDSDSSSVVDFEGGMEKRSQLLDLDLNLPPPSEQA

SEQ ID NO: 1189 - DNA, 870 bp, Arabidopsis thaliana
atgccgatagcgaaaccgatcaaccaaaacactactgttccatatccaccacaacattacagtaaaccgcctctagtcataatcctaaccgtgatcctcctcgtcgtctttttcatcggttttttcgctatctatttctgtaaatgtttctaccacactctcaccgaagcttggaaccaccattaccacaacggattgcccgaaaatcaaatccaagcacaacaagaacccgttcaaccaccggttaaccctggtctagagccacacatcatccaatcctaccctttgtttccattctcatccgtcaaagatctcagggaagacaaatacggtctcgaatgcgcgatttgtctacttgaattcgaagaagaacacatcctcctacgactcttgacaacttgttaccatgtttttcatcaagaatgcatcgatcaatggcttgaatctaacaaaacatgccctgtatgtcgtcggaatttagatccaaacgcgccagaaaacatcaaagagttgatcatcgaagtcatacaagaaaacgcacatgaaaatcgcgatcaggaacaaacgtcaacatcaaacgaggttatgttgtcgagacaaagtagtggtaacaacgagagaaagattgagacgttaccggataaattctcgagatcgaaaacgacaggtcattcaattgtgaggaataaaccggaggaagaagatcggtatactttgaggttaccggatcatgttaagattaaggttacgagaagacacaacaataatcaaacagagagttgtatttcatttggtgagcttgttagaaacagagaaggccggtttggtgaagtttctggtcaatcacttgtaccggaatcaggaagttaa

SEQ ID NO: 1190 - protein, 289 aa, Arabidopsis thaliana
MPIAKPINQNTTVPYPPQHYSKPPLVIILTVILLVVFFIGFFAIYFCKCFYHTLTEAWNHHYHNGLPENQIQAQQEPVQPPVNPGLEPHIIQSYPLFPFSSVKDLREDKYGLECAICLLEFEEEHILLRLLTTCYHVFHQECIDQWLESNKTCPVCRRNLDPNAPENIKELIIEVIQENAHENRDQEQTSTSNEVMLSRQSSGNNERKIETLPDKFSRSKTTGHSIVRNKPEEEDRYTLRLPDHVKIKVTRRHNNNQTESCISFGELVRNREGRFGEVSGQSLVPESGS

SEQ ID NO: 1191 - DNA, 1239 bp, Arabidopsis thaliana
atggcaggatctgcaccagaaggcacacagtttgatgcacgtcagtttgaccagaaactcaatgaagtacttgagggacaagatgagttcttcacatcctatgatgatgttcatgagagctttgatgccatgggtcttcaagagaaccttctcaggggtatttatgcttatggttttgagaagccttctgctattcagcaaagaggaatcgtccccttctgtaagggtcttgatgtgattcaacaggctcagtctggtactgggaaaacagcaactttctgctctggtgtcttgcagcagctggacttctcccttatccagtgtcaggctttggttctagctccaactagagagcttgctcagcaaattgagaaggtcatgagggcccttggtgattaccttggtgtcaaggttcacgcctgtgttggtggaaccagtgtccgtgaggatcagcgcatcctccaagctggtgtccatgttgttgttggaactccagggcgtgtctttgacatgttgaagaggcagtctcttcgtgctgacaacatcaagatgtttgttctcgatgaagctgatgaaatgctctcccgtggtttcaaggaccagatctatgacatattccagcttcttccaccaaagatccaagttggtgtgttctccgcaacaatgccaccagaagctcttgagatcacaaggaagttcatgagcaagccagtgagaatcttggtgaagcgtgatgagcttacccttgaaggtatcaagcagttctacgtcaacgttgagaaagaagagtggaagctcgagacactctgtgatctctacgagactcttgccatcactcagagtgtcatcttcgtgaacaccaggcgtaaggttgattggctcacagacaaaatgagaagccgtgaccacacagtctctgcaactcacggagacatggaccagaacaccagggacatcatcatgagagagttcaggtctggttcctcccgtgttctcatcaccactgacctcttagctcgtggtattgatgtccaacaagtctccctggttatcaacttcgatctcccaactcagccagagaactaccttcaccgtatcggaagaagtggaaggttcgggagaaagggtgttgcgatcaatttcgtgacccgtgatgatgagaggatgctgtttgatattcagaaattctacaatgtggttgtcgaagagctgccttcgaacgtggccgatctgctgtga

SEQ ID NO: 1192 - protein, 412 aa, Arabidopsis thaliana
MAGSAPEGTQFDARQFDQKLNEVLEGQDEFFTSYDDVHESFDAMGLQENLLRGIYAYGFEKPSAIQQRGIVPFCKGLDVIQQAQSGTGKTATFCSGVLQQLDFSLIQCQALVLAPTRELAQQIEKVMRALGDYLGVKVHACVGGTSVREDQRILQAGVHVVVGTPGRVFDMLKRQSLRADNIKMFVLDEADEMLSRGFKDQIYDIFQLLPPKIQVGVFSATMPPEALEITRKFMSKPVRILVKRDELTLEGIKQFYVNVEKEEWKLETLCDLYETLAITQSVIFVNTRRKVDWLTDKMRSRDHTVSATHGDMDQNTRDIIMREFRSGSSRVLITTDLLARGIDVQQVSLVINFDLPTQPENYLHRIGRSGRFGRKGVAINFVTRDDERMLFDIQKFYNVVVEELPSNVADLL

SEQ ID NO: 1193 - DNA, 1341 bp, Arabidopsis thaliana
atggcaaatgatgcggctgcatgtgcagaaagggctacaaatgatatgctgattggtccagattgggctattaacattgaattgtgtgatcttatcaacatggatcctagtcaagcaaaagaagctgtgaaggtgctcaagaagcggttaggaagtaaaaactctaaagtccagattcttgcactttatgcattggaaactttaagtaagaattgtggcgaaaacgtgtaccagcttatcattgaccgtggtctattgaatgacatggtcaaaatagtgaagaaaaagccggaactgaatgtgagggaaaagatactaactttgttagacacatggcaagaagcctttggtggacgtggaggtcgatacccacaatactacaatgcctataacgatctcaggtctgctggaattgagtttccgcctcgaacggaaagcagtctatcgttctttactccaccgcagactcagccagatgaagatgctgctattcaggcttcgttgcaaggagatgatgcttctagcctcagcctggaagagattcaaagcgctgagggatcagttgatgttttgatggacatgcttggagcacatgatcccgggaatcccgagagtttaaaagaagaagttatagtagacttggttgagcaatgtcgtacttatcaaagacgtgtaatgactcttgtgaacactacaacagatgaggaacttctgtgtcagggattggcattaaacgataatttgcagcatgttcttcagcgtcacgatgatatcgcaaatgtcggctctgttccttcaaatggaaggaatactagagctcctcctccagttcagattgttgacatcaatcatgatgatgaagatgacgaatcagatgatgagtttgctcggcttgctcacaggtcttcaacacctacaaggagaccagtacatggtagtgattcgggtatggtggatatccttagtggggacgtctataaacctcaaggcaactcctcctcacagggagtaaagaagcctcctcctcctcctccgcatacttcttcttcctcttcttctcctgttttcgatgatgcaagtccacaacaaagcaaatcctctgaggtaattaggaatcttccacctccgccttcaaggcacaaccagaggcaacagttctttgagcatcaccactcgagtagcggctcagattcctcttacgagggacagacccggaacctttctttgacaagtagtgaaccgcagaaagaagagaaaccagaggatttgcttttcaaagacctggttgagttcgccaaaaccaggtcctccaaagccaacaataataataggtcgctctga

SEQ ID NO: 1194 - protein, 446 aa, Arabidopsis thaliana
MANDAAACAERATNDMLIGPDWAINIELCDLINMDPSQAKEAVKVLKKRLGSKNSKVQILALYALETLSKNCGENVYQLIIDRGLLNDMVKIVKKKPELNVREKILTLLDTWQEAFGGRGGRYPQYYNAYNDLRSAGIEFPPRTESSLSFFTPPQTQPDEDAAIQASLQGDDASSLSLEEIQSAEGSVDVLMDMLGAHDPGNPESLKEEVIVDLVEQCRTYQRRVMTLVNTTTDEELLCQGLALNDNLQHVLQRHDDIANVGSVPSNGRNTRAPPPVQIVDINHDDEDDESDDEFARLAHRSSTPTRRPVHGSDSGMVDILSGDVYKPQGNSSSQGVKKPPPPPPHTSSSSSSPVFDDASPQQSKSSEVIRNLPPPPSRHNQRQQFFEHHHSSSGSDSSYEGQTRNLSLTSSEPQKEEKPEDLLFKDLVEFAKTRSSKANNNNRSL

SEQ ID NO: 1195 - DNA, 444 bp, Arabidopsis thaliana
atgaagtttgatgaatcgaaaacgctcttaccggtgagaaaacctgtaaatggcaaccgcaaaaccgctggttacaagctttgggttctaatcgctgttctactcttggcctttggttctatgttaaccggttccgtctctctcaaaggaatcggtttgttccattctgctgacggcgttaacgcattctctttcggcgatgatctcgacgttctggaaattgaagagagagagaaagtggtgagacagatgtgggatgtgtacggacgctccggtggcgttaaggttcctcggttctggcgagaagctttcgaagcggcgtatgagtttctcatcagtgattccgccgccgttcgaaatgctgccgtttccgatatcgcaaagttgtctcttgttcgttttgttaagtcagagtctacttcggcccagcccaatcttcattga

SEQ ID NO: 1196 - protein, 147 aa, Arabidopsis thaliana
MKFDESKTLLPVRKPVNGNRKTAGYKLWVLIAVLLLAFGSMLTGSVSLKGIGLFHSADGVNAFSFGDDLDVLEIEEREKVVRQMWDVYGRSGGVKVPRFWREAFEAAYEFLISDSAAVRNAAVSDIAKLSLVRFVKSESTSAQPNLH

SEQ ID NO: 1197 - DNA, 213 bp, Arabidopsis thaliana
atgaccacatgttccaaagagaagcctactaaaccttcctatagaaactgtgaacgccagatagcatcaggaagaccagataagacacaacaccaaagcctaaccaatcgcaacaccgacaaggaaggcaaaaggcttcacccgataccaaggaatcatgaaccactagagccaagtcacaccatagcagacggagataaagagacaggctag

SEQ ID NO: 1198 - protein, 70 aa, Arabidopsis thaliana
MTTCSKEKPTKPSYRNCERQIASGRPDKTQHQSLTNRNTDKEGKRLHPIPRNHEPLEPSHTIADGDKETG

SEQ ID NO: 1199 - DNA, 1002 bp, Arabidopsis thaliana
atggagactctgagtcgtttattggttttcatgtctctgttttccggtttagtttctggatttgctctgcaaaatcttccaatcacatcttttgaagaaagttacactcaactttttggtgacaagaacttatttgttcatcaagatggcaaatctgtccggttaacgctcgatgaaagaaccggttccggttttgtttcaaatgattattacttgcatggattcttcagtgcttcaattaaattaccttctgattatacagctggagttgttgttgccttttatatgtctaatggagatatgtatgagaagaatcatgatgagatagattttgagtttcttggtaacattagagaaaaagaatggagagttcagacaaacatttacggtaatggaagtactcattcaggaagagaagagagatataatctctggtttgatcctactgaagattttcatcaatacagtatcctctggtctgattctcacatcatattctttgtagacaatgttcctattagagaggtcaaacgtactgcggaaatgggtggtcactttccatcaaagccgatgtctctctacacaacaatatgggacggttctaaatgggcaactaacggtggaaagtacggtgtaaactacaaatatgcgccttacattgcgcggttctcggatctagtcctgcacggctgccccgtggaccctatcgagcagtttccgaggtgcgatgaaggcgcggctgaggatatgcgtgcggcgcaagagattactccttcacaaaggagtaaaatggatgttttcagacggagactcatgacatattcatattgctatgatcgggctaggtacaatgttgctttatcggagtgtgtggtgaatcccgctgaggctcaaaggcttagggtttatgatccggtcagatttggcggcattccgaggcgccaccgcaatggaaagcaccggagcaagagaagccgggttgatggaaccgagtcgatatga

SEQ ID NO: 1200 - protein, 333 aa, Arabidopsis thaliana
METLSRLLVFMSLFSGLVSGFALQNLPITSFEESYTQLFGDKNLFVHQDGKSVRLTLDERTGSGFVSNDYYLHGFFSASIKLPSDYTAGVVVAFYMSNGDMYEKNHDEIDFEFLGNIREKEWRVQTNIYGNGSTHSGREERYNLWFDPTEDFHQYSILWSDSHIIFFVDNVPIREVKRTAEMGGHFPSKPMSLYTTIWDGSKWATNGGKYGVNYKYAPYIARFSDLVLHGCPVDPIEQFPRCDEGAAEDMRAAQEITPSQRSKMDVFRRRLMTYSYCYDRARYNVALSECVVNPAEAQRLRVYDPVRFGGIPRRHRNGKHRSKRSRVDGTESI

SEQ ID NO: 1201 - DNA, 1752 bp, Arabidopsis thaliana
atggaaccagatcttcatgaccagcaacaacaacaacgagtccacagcgtagtcataatcactctcccaccatctgatgatccttcacaaggcaaaacaatctctgctttcactctcactgaccacgattacccactcgaaatcccacccgaggataacccaaacccgagttttcaacccgacccacttcaccgaaaccaacaatctcgcctcttgttctcggatctctcaatgaattcgccgagattagttctgggtcttctcggaatctcgcttctcgcggttgctttctacgcctctgtttttcccaactctgttcaaatgtttagggtttctcctgatgagaggaaccgtgacgacgacgataatctccgtgaaacggcgtcgtttgttttccctgtatatcacaaattgagagctcgagagttccacgagcggatcttagaggaagatttaggtttagagaatgaaaactttgtggaatcaatggatttagagctggtcaaccctgtaaaagtcaacgatgttttatctacaagtgccggttctattgactcctccactacgatttttcccgtcggtggtaatgtgtatccagatgggctgtattatacacgcattcttgttggaaagcctgaagatggacaatactatcatcttgatattgatacgggaagtgaattgacttggatccaatgtgatgctccttgtactagttgtgctaagggagcaaatcaactatataagcctagaaaagataacttagtgagatcttcagaggccttttgtgtagaagtccaaaggaatcaactgacagaacattgtgaaaattgtcatcaatgtgactacgagattgaatatgctgatcatagctactccatgggagttctcaccaaagataagtttcatctcaaactccataacggatcactagccgagtcagatatagttttcgggtgcgggtatgatcagcaaggactactgttgaatactctgctaaagacagacgggattctcggtctaagcagagctaaaattagcttaccttctcaacttgcaagcagaggtattatcagcaatgtggttggccattgccttgcctctgatttaaacggtgaaggatatatcttcatgggaagtgatttggttccatcacacggaatgacatgggttcctatgcttcacgattcccgcttggatgcttatcagatgcaagttacaaagatgagctacgggcagggtatgcttagcttagatggggaaaacggaagagtagggaaagtcttatttgacacaggaagttcctatacatacttccctaaccaggcttactcccaattggtcacatcacttcaagaagtttctggtttagaactaacacgcgatgattcagacgaaacactgcctatctgctggcgagccaaaactaacttcccgtttagttccttgtcggatgttaagaagttcttcagaccaataactctgcaaatagggagcaaatggttgatcatatcaagaaaacttttgattcaacccgaggattacttgatcatcagcaacaaaggaaatgtctgtcttgggatattagatggaagcagtgttcatgatggttccactattattcttggagatatctcgatgcgtggacacttgatcgtgtacgacaatgtgaaacggagaatcggatggatgaaatcagattgcgtccggcctcgtgagattgatcacaatgtacctttctttcaaggctga

SEQ ID NO: 1202 - protein, 583 aa, Arabidopsis thaliana [sequence omitted]

SEQ ID NO: 1203 - DNA, 909 bp, Arabidopsis thaliana
atggatacaatcagtgtagaatttggggcttcaagggtttcctcaagcaaggtgtatggtgcagtaccaccaccacagcaactgatttctggagctccgggttctgaccaggagaaccaaaatttgatttcaacgtatggtttgatgacatcgatacccatcacagcaccaccatacgctgttagttcgtttccagttactccagcaacaagtctttatcctcagtttccagtaatgcaatctctaggaatatcaaatggtggcccctcgcagcccgtggctggaggaactagctatagtgggtatgctggaatataccctcaagccacaccattgcaacaagttgctcaagtccttaagcaatcaatttctcctgttatctctactgtgccccctactatgttgacagctacgtccttatcgatcccaagtgataatgcaagtaatgaaatggaaaggcgtccaccccggaagcgaaagtttcaggaacttccagctgattgtaaggttccagaaaaagacaaacagcaatcggagttagcaatgacaggtgatgttactccatcagcaaatagagtgcggtcgccgccttcaccaagatctgtaatgcctcctcctccaccaaagaccatcgcaccaccgccttctaagaccatgtctcctccatcatcaaaaagcatgcttcctccaccaccacgttctaagaccatgtctcctctatcatcaaaaagcatgcttcctccaccaccgcgatttacactgacaactcaacgttcaagattacaggacaaccacatcagtgtaaagaaaccaaatccagttccagatacgttaataaagctgatggaatatggagacgatgaagacgatgatgacgatcctgatgagccattgacaactagatcgtga

SEQ ID NO: 1204 - protein, 302 aa, Arabidopsis thaliana
MDTISVEFGASRVSSSKVYGAVPPPQQLISGAPGSDQENQNLISTYGLMTSIPITAPPYAVSSFPVTPATSLYPQFPVMQSLGISNGGPSQPVAGGTSYSGYAGIYPQATPLQQVAQVLKQSISPVISTVPPTMLTATSLSIPSDNASNEMERRPPRKRKFQELPADCKVPEKDKQQSELAMTGDVTPSANRVRSPPSPRSVMPPPPPKTIAPPPSKTMSPPSSKSMLPPPPRSKTMSPLSSKSMLPPPPRFTLTTQRSRLQDNHISVKKPNPVPDTLIKLMEYGDDEDDDDDPDEPLTTRS

SEQ ID NO: 1205 - DNA, 417 bp, Arabidopsis thaliana
atggaggtggaggaagccaagatcttgctcggctttcctcctaattctcgtcccgatccttctcaggttaaagctgcttacaggaagaaagtatgggaatcacatcctgacttatttcctgatgatcagaagcttgttgccgagtctaagttcaaatcgatatctgaagcttattcttgcctagagtctggtgatgttaaaggtcaatggtattacagagcaggtgtgtattcgagggtcgtcaagactggggttcctcggccatattcatctgccaaaagaggtaaccgttggttgatcggtgcacctttccttttgattgtcttaggaaccatcggacttggtggaatcaaagctaacagggcatataatctgcaaaaacagacgttcccatctcacaatcctttccttccttga

SEQ ID NO: 1206 - protein, 138 aa, Arabidopsis thaliana
MEVEEAKILLGFPPNSRPDPSQVKAAYRKKVWESHPDLFPDDQKLVAESKFKSISEAYSCLESGDVKGQWYYRAGVYSRVVKTGVPRPYSSAKRGNRWLIGAPFLLIVLGTIGLGGIKANRAYNLQKQTFPSHNPFLP

SEQ ID NO: 1207 - DNA, 999 bp, Arabidopsis thaliana
atggcgaaagaaccagttcgtgtgctcgttactggagctgcaggacaaatcggatatgctcttgtacctatgattgcaaggggtatcatgcttggtgctgaccaacctgttatcctccacatgttggatattcctccagctgctgaagctttgaacggtgttaagatggagttgatcgatgctgctttccctcttcttaaaggtgttgttgctacaactgatgccgttgagggatgtactggagtcaatgttgctgttatggttggtggtttcccgaggaaagaaggtatggagaggaaggatgtgatgtccaagaatgtttccatctacaagtctcaggctgctgccttggagaagcatgccgctcctaactgcaaggttcttgttgtggccaacccggcaaacaccaacgcattgatcctcaaggaatttgcaccatcaatccctgaaaagaacatctcttgtttgacaaggcttgaccacaacagggctttgggacagatctctgagaggttgagcgtgccagtgtctgatgttaagaacgtgatcatctggggaaaccactcatcctcacagtacccagatgtcaaccatgctaaagtgcagacctcgtctggagagaagcctgtccgtgagctcgtcaaggacgatgcatggttggacggagaatttatctctacagttcaacaacgtggagctgcaatcatcaaggcgaggaagttgtctagtgcgctctctgctgctagctctgcttgtgaccacatccgtgactgggtccttggaactccagagggtacgttcgtttccatgggagtatactccgatggctcttacagcgttccatcaggacttatctactccttccctgtaacttgtcgcaatggagactggagtattgtccaaggccttccgattgatgaagtatcaaggaagaagatggatttgactgcagaggagctcaaggaagagaaggacttggcgtactcatgcctctcttaa

SEQ ID NO: 1208 - protein, 332 aa, Arabidopsis thaliana
MAKEPVRVLVTGAAGQIGYALVPMIARGIMLGADQPVILHMLDIPPAAEALNGVKMELIDAAFPLLKGVVATTDAVEGCTGVNVAVMVGGFPRKEGMERKDVMSKNVSIYKSQAAALEKHAAPNCKVLVVANPANTNALILKEFAPSIPEKNISCLTRLDHNRALGQISERLSVPVSDVKNVIIWGNHSSSQYPDVNHAKVQTSSGEKPVRELVKDDAWLDGEFISTVQQRGAAIIKARKLSSALSAASSACDHIRDWVLGTPEGTFVSMGVYSDGSYSVPSGLIYSFPVTCRNGDWSIVQGLPIDEVSRKKMDLTAEELKEEKDLAYSCLS

SEQ ID NO: 1209 - DNA, 1731 bp, Arabidopsis thaliana
atggctgcatctttctctgtcccctctatgataatggaagaagaagggagattcgaagcggaggttgcggaagtgcagacttggtggagctcagagaggttcaagctaacaaggcgcccttacactgcccgtgacgtggtggctctacgtggccatctcaagcaaggctatgcttcgaacgagatggctaagaagctgtggagaacgctcaaaagccatcaagccaacggtacggcctctcgcaccttcggagcgttggaccctgttcaggtgaccatgatggctaaacatttggacaccatctatgtctctggttggcagtgctcgtccactcacacatccactaatgagcctggtcctgatcttgctgattatccgtacgacaccgttcctaacaaggttgaacacctcttcttcgctcagcagtaccatgacagaaagcagagggaggcaagaatgagcatgagcagagaagagaggacaaaaactccgttcgtggactacctaaagcccatcatcgccgacggagacaccggctttggcggcaccaccgccaccgtcaaactctgcaagcttttcgttgaaagaggcgccgctggggtccacatcgaggaccagtcctccgtcaccaagaagtgtggccacatggccggaaaggtcctcgtggcagtcagcgaacacatcaaccgccttgtcgcggctcggctccagttcgacgtgatgggtacagagaccgtccttgttgctagaacagatgcggtcgcagctactctgatccagtcgaacattgacgcgagggaccaccagttcatcctcggtgccactaacccgagccttagaggcaagagtttgtcctcgcttctggctgagggaatgactgtaggcaagaatggtccggcgttgcaatccattgaagatcagtggcttggctcggccggtcttatgactttctcggaagctgtcgtgcaggccatcaagcgcatgaacctcaacgagaacgagaagaatcagagactgagcgagtggttaacccatgcaaggtatgagaactgcctgtcaaatgagcaaggccgagtgttagcagcaaaacttggtgtgacagatcttttctgggactgggacttgccgagaaccagagaaggattctaccggttccaaggctcggtcgcagcggccgtggtccgtggctgggcctttgcacagatcgcagacatcatctggatggaaacggcaagccctgatctcaatgaatgcacccaattcgccgaaggtatcaagtccaagacaccggaggtcatgctcgcctacaatctctcgccgtccttcaactgggacgcttccggtatgacggatcagcagatggttgagttcattccgcggattgctaggctcggatattgttggcagttcataacgcttgcgggtttccatgcggatgctcttgtggttgatacatttgcaaaggattacgctaggcgcgggatgttggcttatgtggagaggatacaaagagaagagaggacccatggggttgacactttggctcaccagaaatggtccggtgctaattactatgatcgttatcttaagaccgtccaaggtggaatctcctccactgcagccatgggaaaaggtgtcactgaagaacagttcaaggagagttggacaaggccgggagctgatggaatgggtgaagggactagccttgtggtcgccaagtcaagaatgtaa

SEQ ID NO: 1210 - protein, 576 aa, Arabidopsis thaliana
MAASFSVPSMIMEEEGRFEAEVAEVQTWWSSERFKLTRRPYTARDVVALRGHLKQGYASNEMAKKLWRTLKSHQANGTASRTFGALDPVQVTMMAKHLDTIYVSGWQCSSTHTSTNEPGPDLADYPYDTVPNKVEHLFFAQQYHDRKQREARMSMSREERTKTPFVDYLKPIIADGDTGFGGTTATVKLCKLFVERGAAGVHIEDQSSVTKKCGHMAGKVLVAVSEHINRLVAARLQFDVMGTETVLVARTDAVAATLIQSNIDARDHQFILGATNPSLRGKSLSSLLAEGMTVGKNGPALQSIEDQWLGSAGLMTFSEAVVQAIKRMNLNENEKNQRLSEWLTHARYENCLSNEQGRVLAAKLGVTDLFWDWDLPRTREGFYRFQGSVAAAVVRGWAFAQIADIIWMETASPDLNECTQFAEGIKSKTPEVMLAYNLSPSFNWDASGMTDQQMVEFIPRIARLGYCWQFITLAGFHADALVVDTFAKDYARRGMLAYVERIQREERTHGVDTLAHQKWSGANYYDRYLKTVQGGISSTAAMGKGVTEEQFKESWTRPGADGMGEGTSLVVAKSRM

SEQ ID NO: 1211 - DNA, 1140 bp, Arabidopsis thaliana; identical to SEQ ID NO: 1079

SEQ ID NO: 1212 - protein, 379 aa, Arabidopsis thaliana; identical to SEQ ID NO: 1080

SEQ ID NO: 1213 - DNA, 312 bp, Arabidopsis thaliana
atgtcaggtcgtggaaagggaggcaaaggtttgggcaaaggtggagccaaacgtcataggaaggttctgagagacaacatccaaggaatcactaaaccggcgattcggagattggctcgtagaggtggtgttaaacgtattagtggtttgatctacgaggagacacgtggcgttctcaagatctttttggaaaatgttatccgtgacgccgttacttacactgagcacgctcggaggaagacggtgactgctatggatgttgtttatgctcttaagagacaaggaagaactctctatggattcggtggttga

SEQ ID NO: 1214 - protein, 103 aa, Arabidopsis thaliana
MSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 1215 - DNA, 900 bp, Arabidopsis thaliana
atggagactcagtatccgaaactaatcgaaccatccaagacccgaattggatggattgggatcgggataatgggatcagcgatggtttctcatatcctcgccgcaggctattcagtcaccgtttatgctcgcgatcttcgtaaaacaaaggatctgcaaaccaaaggaggtcgtaccgccaatagccccaaagagttaggggagatgagcgacgttgtgttcacgatcgttggaaactctaacgatgttagatcgttgcttcttggggatgatggtgtactctctggtcttaaacccggtggagtaacagtggacatgactagtagcaagccaggattggcgcgtgagatatacgcggaggcgaggcggagggattgctgggcggtggatgcgcctgtatcgggtggagacgctggagcacgtgaggggaagctaacgatattcgccggcggagattccgagattgtggagtggttggctccggtgatgaaaacgatgggaattgtgaggtttatgggaggagctgggagtggacagagctgtaaaattgggaatcagatttgtgttggaagcaacatgattggattagctgaagggattgtgtttgctgagaaggcgggtttagatccggtgaaatggcttgaggcggttaaggacggtgcagctggatcggcggttatgcggcttttcggggagatgatggcggtgagggactataaggcgacggggtttgcggagtatatggtgaaagatttgggaatggcggcggaggcggcaatggcgatgcctggaactgctttgaacaagcagttgttcactgtaatggtggcaaatggagatgggaagttaggatttcaaggcgtcgtcgatgttattaggagacttaacggcttatcctga

SEQ ID NO: 1216 - protein, 299 aa, Arabidopsis thaliana
METQYPKLIEPSKTRIGWIGIGIMGSAMVSHILAAGYSVTVYARDLRKTKDLQTKGGRTANSPKELGEMSDVVFTIVGNSNDVRSLLLGDDGVLSGLKPGGVTVDMTSSKPGLAREIYAEARRRDCWAVDAPVSGGDAGAREGKLTIFAGGDSEIVEWLAPVMKTMGIVRFMGGAGSGQSCKIGNQICVGSNMIGLAEGIVFAEKAGLDPVKWLEAVKDGAAGSAVMRLFGEMMAVRDYKATGFAEYMVKDLGMAAEAAMAMPGTALNKQLFTVMVANGDGKLGFQGVVDVIRRLNGLS

SEQ ID NO: 1217 - DNA, 3012 bp, Arabidopsis thaliana
atgagattagtgaaggcagcttctcttctgatttcttcaaccaaacctccgtctagggttttttactcttcccatctccgccgcccttttttctctcacttccgtttttcttcctcttcgtcgacgtcttcctccgtcgcagtcatgccgggttccgaaccatcggagactcagtggccagcaaagagagtccgggatacttatgtcgatttcttcagaggcaaaggccacaagttctggccatcaagccccgttgttcctcataatgatcctactcttctcttcgctaacgctggaatgaaccagtataagccaatatttttgggtacggccgatccaaatactgagcttagcaagctatctcgggcatgtaacacccaaaagtgtattcgtgctggtggaaagcataatgatttggatgatgtcggcaaagatacgtaccatcacaccttctttgaaatgcttggtaactggtcctttggagattatttcaagaaggaagctatcgaatgggcttgggagctcttaaccaaggtctatgggctaccgactgatcgaatctacgctacatattttggcggtgatgagaaagctggccttcaacctgataatgaggctagggatatatggttgaaggttcttccatctggacgtgtgctgccatttggttgcaaagacaatttctgggaaatgggcgacacaggtccgtgtggaccttgtactgaaatacattatgatcgcattggtaaccgtgatgctgcatccttagttaacaatgacgatccaacatgtttagaaatatggaatcttgtctttattcagttcaaccgagaaagtgatggctcgctaaaacctctgcctgctaagcatgttgataccgggatgggcttcgagaggttgacttctgttcttcaaaacaaaatgagcaactatgatacagatgtgttcatgcctatctttgatgacatccaaaaggcaacgggagctaggccatattctggaaaagttggtccggaagatgttgacagagttgacatggcatatagagtggttgctgatcatattagaaccctatcatttgcaattgcggatggctctcgtcctggtaatgagggccgtgagtatgttctgcggcgtattcttcgtcgagcggttcgctatggaaaggagatcctaaaagctgaagaaggatttttcaacgggcttgtaagttctgtcattcgggtgatgggcgatgtctttacagagttgaaggaacatgagaaaaagatcacagatataattaaagaagaggaagcaagcttttgcaagaccttggcaaagggaattgagaaatttcggaaagctggacaggcggttcaggggaatacactgagtggagatgatgcttttatcttatgggatacatatggtttcccgttagatttaactcagttgatggctgaagaaagagggttactggttgatgttgatggtttcaacaaagccatggaagaggcgagggaaagatcgagaagtgcccagaataagcaagctggtggtgccattgttatggatgctgatgctacatcaacattgcacaaggctggtgtttcagcaacagatgattcttttaaatacatttggttccaggaccacgagagtgaactaaaggcaatctatactggctctactttcctagaaagttcagctgctagtgataacgtgggactagtattggggtctacaagcttctatgctgagcagggtggtcagatttttgacactggacttatagaaggctcgtttgggacattcaatgtatgcaatgtacaaatatttgggggctttgttcttcacattggttatctctctaaagaaactggagaggtatctgtgggtgataaagtgatttgcaaggttgactatgagaggcgtaaactcatcgctcctaatcatacttgcacacatatgttgaattatgccctgaaggaagtgctcggggatcatattgatcagaagggatcaattgttcttcctgaaaaactgcgatttgatttttctcatggcaagccggttgatcctgaagatttgagaaggatcgaatccatagtgaataaacagatcaaggatgaattagatgtgttttccaaggaagctgtgctttctgaagccaagcgcatcaaaggtctaagagcagtgtttggagaagtctaccccgatcccgtcagagtggtgtcaattgggaggaaggttgaggatctcttggctgatcctgaaaacaatgaatggtcattgctttcttccgagttttgtggaggaacccacataacaaacacccgcgaagccaaagcatttgctcttctatcggaggagggaattgctaaaggtattcgtagggtaactgctgtgactactgaatgtgcttttgatgcattgaatgcggcgtccttacttgaaagagaagtagaggatgcctccagagcggagggaagtgcattggaaaagaaagtttctgctttgaaaagccgagtagatgcagcaattatcccagcagctaaaaaggcagatattaggactaagattgcttcgcttcagaatgaagtaagaaaagctcagaagaaaatagcggaacaaaacctgaaaaaatctgtcaaattagcaacagaggcagctgagtccgcagcatcagatgggaagactttctgcataatccagctggatgtgggtcttgatgcagcagctgtgcgagaggccgtttcaaaagtcatggaaaagaagggtatgtcgataatggtgttcagcacagatgaaagcacaaacaaggcggttgtgtgtgcaggagtgccagaaaaatcagaccagtttaagccgttagacgtcactgaatggttgacaactgcattgggtcctctaaaaggaaggtgcgggaaagggaaaggtggtcttgcatcagggcagggaacggatgcttctcaagtgcaggcggctttggatatggcttcatcatttgcatcaatgaagctcaactga

SEQ ID NO: 1218 - protein, 1003 aa, Arabidopsis thaliana
MRLVKAASLLISSTKPPSRVFYSSHLRRPFFSHFRFSSSSSTSSSVAVMPGSEPSETQWPAKRVRDTYVDFFRGKGHKFWPSSPVVPHNDPTLLFANAGMNQYKPIFLGTADPNTELSKLSRACNTQKCIRAGGKHNDLDDVGKDTYHHTFFEMLGNWSFGDYFKKEAIEWAWELLTKVYGLPTDRIYATYFGGDEKAGLQPDNEARDIWLKVLPSGRVLPFGCKDNFWEMGDTGPCGPCTEIHYDRIGNRDAASLVNNDDPTCLEIWNLVFIQFNRESDGSLKPLPAKHVDTGMGFERLTSVLQNKMSNYDTDVFMPIFDDIQKATGARPYSGKVGPEDVDRVDMAYRVVADHIRTLSFAIADGSRPGNEGREYVLRRILRRAVRYGKEILKAEEGFFNGLVSSVIRVMGDVFTELKEHEKKITDIIKEEEASFCKTLAKGIEKFRKAGQAVQGNTLSGDDAFILWDTYGFPLDLTQLMAEERGLLVDVDGFNKAMEEARERSRSAQNKQAGGAIVMDADATSTLHKAGVSATDDSFKYIWFQDHESELKAIYTGSTFLESSAASDNVGLVLGSTSFYAEQGGQIFDTGLIEGSFGTFNVCNVQIFGGFVLHIGYLSKETGEVSVGDKVICKVDYERRKLIAPNHTCTHMLNYALKEVLGDHIDQKGSIVLPEKLRFDFSHGKPVDPEDLRRIESIVNKQIKDELDVFSKEAVLSEAKRIKGLRAVFGEVYPDPVRVVSIGRKVEDLLADPENNEWSLLSSEFCGGTHITNTREAKAFALLSEEGIAKGIRRVTAVTTECAFDALNAASLLEREVEDASRAEGSALEKKVSALKSRVDAAIIPAAKKADIRTKIASLQNEVRKAQKKIAEQNLKKSVKLATEAAESAASDGKTFCIIQLDVGLDAAAVREAVSKVMEKKGMSIMVFSTDESTNKAVVCAGVPEKSDQFKPLDVTEWLTTALGPLKGRCGKGKGGLASGQGTDASQVQAALDMASSFASMKLN

SEQ ID NO: 1219 - DNA, 2106 bp, Arabidopsis thaliana
atggcttctgaagatactctctcctcgaatcctctattgcagaattttgacttccctccgtttgactccgttgatgctcaccatgtcagacctgggattcgtgctctgttgcagcagctcgaagctgaattggagcagctagaaaaagctgtagagccttcatggccaaaactagtggagccattagagaagattattgatcggttatctgttgtttggggaatgatcaatcatcttaaggctgtcaaggacacacctgagcttcgtgctgccattgaagaagttcagccggagaaggtgaagttccagctcaggttgggacagagcaaacccatttacaatgcatttaaggctattcgagaatctccagactggaattcattgagcgaagctcgtcaacgattagttgaagcccaaataaaggaggcggttctgagtggtattgctcttgaagatgataagagggaagaatttaacaaaattgaacaggaacttgaaaaactttctcataagttttctgagaatgttttggacgctacaaagaagtttgaaaagttgataacagacaagaaagagattgaggggttgccaccatctgcacttggattgttcgcacaagcagctgtttccaagggccatgaaactgcaactgctgacactggaccatggctcattacactcgatgctcctagttatcttcccgttatgcaacatgccaaaaaccgagctctgcgcgaggaagtctaccgtgcttacttatcccgtgcctcttcgggtgatttagataatacagcaattatcgaccaaatcttgaagcttcgactggaaaaggctaagcttcttggttacagaaattatgctgaggtaagcatggccacgaaaatggctactgtggagaaagcagatgagctactagaaaagcttcgcagtgcttcatgggatccggctgttcaagacatagaagaccttaagagttttgcgaagaaccaaggtgctgcagaggctgacagtttgactcactgggacatcactttctggagtgagaggcttcgtgaatccaaatacgatattaatgaggaagaactgcgaccttacttctcattgccaaaggttatggatgcgttattcggtctagctaagacactatttggaattgatgttgtgccagcagacggtgtagcgccggtctggaacagcgatgttaggttctactgtgtcaaagattcttctggaaatccaactgcttatttctactttgatccctactctcgcccttcagaaaagagagacggcgcttggatggatgaagttttttctcgtagccgagtcatggcccagaagggttcctccgttagactccctgttgctcaaatggtctgcaaccaaactccacctgttggtgacaagccaagccttatgacattccgtgaggtagagactgtgttccatgaatttggccatgctcttcagcatatgcttaccaaagaggatgaggggctagtggctggtatccggaatatcgagtgggatgcagttgaattaccgtcacagtttatggagaactggtgctaccacagggataccttaatgagcattgctaagcattatcaaacaggagaaactcttcccgagaatgtatacaagaagctactggctgcaagaacattccgtgcagggtcccttagtcttcgccagttgaagtttgctacagttgatctggagctgcacacaaaatacatgccaggtggggcagagaccatctacgaagttgatcaaagggtgtccataaaaacacaagtgatccctccacttcctgaagatagattcctctgtagcttcagtcatatatttgcaggtggttatgcagctggatactacagttacaagtgggcggaggttttgtctgcagatgcgttttcagcttttgaagatgctgggttggatgacattaaggctgtcaaagaaacaggacagagattcagaaacactatacttgctctgggaggaggaaaagctcctctaaaagtgtttgtggagttcagaggacgagaaccttccccagagcctctgctcagacacaatggactcttggctgcttctgcttga

SEQ ID NO: 1220 - protein, 701 aa, Arabidopsis thaliana
MASEDTLSSNPLLQNFDFPPFDSVDAHHVRPGIRALLQQLEAELEQLEKAVEPSWPKLVEPLEKIIDRLSVVWGMINHLKAVKDTPELRAAIEEVQPEKVKFQLRLGQSKPIYNAFKAIRESPDWNSLSEARQRLVEAQIKEAVLSGIALEDDKREEFNKIEQELEKLSHKFSENVLDATKKFEKLITDKKEIEGLPPSALGLFAQAAVSKGHETATADTGPWLITLDAPSYLPVMQHAKNRALREEVYRAYLSRASSGDLDNTAIIDQILKLRLEKAKLLGYRNYAEVSMATKMATVEKADELLEKLRSASWDPAVQDIEDLKSFAKNQGAAEADSLTHWDITFWSERLRESKYDINEEELRPYFSLPKVMDALFGLAKTLFGIDVVPADGVAPVWNSDVRFYCVKDSSGNPTAYFYFDPYSRPSEKRDGAWMDEVFSRSRVMAQKGSSVRLPVAQMVCNQTPPVGDKPSLMTFREVETVFHEFGHALQHMLTKEDEGLVAGIRNIEWDAVELPSQFMENWCYHRDTLMSIAKHYQTGETLPENVYKKLLAARTFRAGSLSLRQLKFATVDLELHTKYMPGGAETIYEVDQRVSIKTQVIPPLPEDRFLCSFSHIFAGGYAAGYYSYKWAEVLSADAFSAFEDAGLDDIKAVKETGQRFRNTILALGGGKAPLKVFVEFRGREPSPEPLLRHNGLLAASA

SEQ ID NO: 1221 - DNA, 2046 bp, Arabidopsis thaliana
atgaggaagcccaagttgtcaaaactcgagaggttagagaaattcgacattttcgtttctctaagcaagcagagatcggttcagatactaatggcggttgggttactctacatgcttcttatcacattcgaaatccctttcgtcttcaaaaccgggcttagttctttatctcaggatccgttaacccgacccgagaagcacaatagtcagagagagttacaagagagacgagctccgactcgacctttaaagagtctgctttaccaggaatcacaatcggaatcaccggctcagggtttaagaagaaggactcggatcctttctagtttgagattcgacccggaaacgtttaacccgagtagcaaagatgggtctgtggagcttcataaatctgctaaggtagcttgggaagttggtcgaaagatatgggaagagcttgagtctgggaaaacgttgaaagctttggagaaggagaagaagaagaagattgaggaacatgggacaaactcgtgttctctctctgtttccttaaccgggtctgatcttttgaaacgtgggaatatcatggagcttccatgtggtttaactcttgggtcacatattacagtggttgggaagccacgagctgctcattcggagaaggaccctaagatatcgatgttaaaggaaggagatgaagctgtgaaggtttcacagtttaagttggagcttcagggtttgaaagcagtggaaggagaagagccacctcggatactccacttgaatccaaggcttaagggtgattggagtggtaagcctgtgattgagcagaacacttgctatagaatgcaatggggctcagcacaaagatgtgaaggatggagatctagggatgatgaagagactgttgatggtcaggttaagtgcgagaaatgggctcgggatgatagcattacatctaaagaagaagagtctagcaaggcggcttcatggtggcttagtcgattaataggtcggagcaagaaagtaactgttgaatggccatttccattcacagttgacaagcttttcgtgcttactcttagtgctggattggaaggctaccatgttagtgtcgatgggaagcatgtcacttcctttccataccgaactggatttacgcttgaggatgctactggtctaaccattaacggggacatagatgttcactctgttttcgctggctctctcccaacctcgcatcctagtttttctcctcagaggcatcttgagctctcgagcaattggcaagccccatcacttcctgatgagcaagttgatatgttcattggtatcctttctgctggtaaccattttgctgagaggatggctgtgaggaggtcgtggatgcaacataaactcgttaaatcttccaaagtagtggctcggttctttgttgcactgcactcaaggaaagaagtaaatgtggagctaaagaaggaagctgaattctttggggacatagttatagtcccttacatggacagttatgaccttgtcgtcctcaaaaccgttgcaatttgcgagtacggggctcatcaacttgcagctaaattcatcatgaagtgtgatgacgatacatttgtacaagtggatgcggttcttagtgaagcaaagaaaacacccacagatagaagtctatacattggcaacatcaattattatcacaaaccacttcgccagggtaaatggtctgttacatatgaggaatggccagaggaagactatccaccttatgctaatggccccggatacatattatcaaacgatatatctcgctttatcgtgaaagagtttgagaaacacaaattaaggatgttcaaaatggaagatgtaagcgtgggaatgtgggtagaacaattcaacaatggtacaaaaccggtggactacattcacagcctcaggttttgtcagtttggttgcatagagaattacttgacggcgcattatcagtcgccgagacagatgatttgcttgtgggataagctggtgttgacaggcaaacctcagtgctgcaacatgagatga

SEQ ID NO: 1222 - protein, 681 aa, Arabidopsis thaliana
MRKPKLSKLERLEKFDIFVSLSKQRSVQILMAVGLLYMLLITFEIPFVFKTGLSSLSQDPLTRPEKHNSQRELQERRAPTRPLKSLLYQESQSESPAQGLRRRTRILSSLRFDPETFNPSSKDGSVELHKSAKVAWEVGRKIWEELESGKTLKALEKEKKKKIEEHGTNSCSLSVSLTGSDLLKRGNIMELPCGLTLGSHITVVGKPRAAHSEKDPKISMLKEGDEAVKVSQFKLELQGLKAVEGEEPPRILHLNPRLKGDWSGKPVIEQNTCYRMQWGSAQRCEGWRSRDDEETVDGQVKCEKWARDDSITSKEEESSKAASWWLSRLIGRSKKVTVEWPFPFTVDKLFVLTLSAGLEGYHVSVDGKHVTSFPYRTGFTLEDATGLTINGDIDVHSVFAGSLPTSHPSFSPQRHLELSSNWQAPSLPDEQVDMFIGILSAGNHFAERMAVRRSWMQHKLVKSSKVVARFFVALHSRKEVNVELKKEAEFFGDIVIVPYMDSYDLVVLKTVAICEYGAHQLAAKFIMKCDDDTFVQVDAVLSEAKKTPTDRSLYIGNINYYHKPLRQGKWSVTYEEWPEEDYPPYANGPGYILSNDISRFIVKEFEKHKLRMFKMEDVSVGMWVEQFNNGTKPVDYIHSLRFCQFGCIENYLTAHYQSPRQMICLWDKLVLTGKPQCCNMR

SEQ ID NO: 1223 - DNA, 1587 bp, Arabidopsis thaliana
atgtcagctccgaaatcgggtggtgatccactaccacatccgccgaaagaacagcttccagatatctcttactgcattacaagtcctcctccatggcctgaggctgttctgcttgggtttcaacactaccttgtgatgcttggaacaacagttctgattccatcggctcttgttccacaaatgggaggtagaaatgaagagaaggcaaagctgatccagacaatattgtttgtagctggattgaacacactgctccaaactgtgtttggaactagattacctgctgttattggagcatcttatacatttgtcccggttactatctcaatcatgctttctgggagattcaatgacgttgcagatccagttgagcgatttaagaggataattcgggcaacccaaggtgctcttattgttgcttcaactcttcaaattatccttggcttcagtggcctttggcgtaatgttgtaaggttcttaagtccactatctgctgctcctttggttggattagttggttatggcctgtacgagttaggttttcccggtgttgctaagtgtattgagattggactgcctgggcttattattctcatactaatatcacagtacatgccccatgttataaaaggaggaaaacatgtgtttgctcgctttgctgtcatattttctgtggcgatagtatggctttatgctttctttcttacacttggtggtgcctataatggtgttgggacagatactcaaagaagctgtcggactgatcgcgctgggcttataagtgctgctccatggataagagttccgtggcctttccaatggggagcaccattgtttgatgctggtgaagcatttgccatgatgatggcttcttttgttgctcttgttgagtccacaggtgcttttattgccgtctcaagatatgctagtgccacaatgccgccaccttctgttatcagccgcggggttggttggcagggagttgcaattttaatctcagggttgttcggaactggtatagggtcttcagtttctgtcgagaatgcgggtctgctggcactaacaaaaattggtagcaggagagttgttcaaatatctgcaggctttatgatattcttctcaattcttgggaagttcggggcagtatttgcatccataccttctcctatcatagctgccttgtactgtctcttctttgcgtatgtaggtgctggaggactgagtttgctgcaattctgcaacctgaatagcttcaggacattattcatactgggcttctcaatcttcctaggcctatcaattccacaatatttcaacgagcacacagccatcaaaggctatggtccagttcataccggggcaagatggttcaacgacatggtcaatgtgcccttctcgtccaaggcctttgtgggaggatgtgtggcttacttgttggacacgacgcttcacaagaaagatggttcgatcaggaaagaccgaggtaaacactggtgggacagattctggactttcaagaacgacccgagaacagaagagttctatgctcttccgttcaacctcaacaaatatttcccttctgtctga

SEQ ID NO: 1224 - protein, 528 aa, Arabidopsis thaliana
MSAPKSGGDPLPHPPKEQLPDISYCITSPPPWPEAVLLGFQHYLVMLGTTVLIPSALVPQMGGRNEEKAKLIQTILFVAGLNTLLQTVFGTRLPAVIGASYTFVPVTISIMLSGRFNDVADPVERFKRIIRATQGALIVASTLQIILGFSGLWRNVVRFLSPLSAAPLVGLVGYGLYELGFPGVAKCIEIGLPGLIILILISQYMPHVIKGGKHVFARFAVIFSVAIVWLYAFFLTLGGAYNGVGTDTQRSCRTDRAGLISAAPWIRVPWPFQWGAPLFDAGEAFAMMMASFVALVESTGAFIAVSRYASATMPPPSVISRGVGWQGVAILISGLFGTGIGSSVSVENAGLLALTKIGSRRVVQISAGFMIFFSILGKFGAVFASIPSPIIAALYCLFFAYVGAGGLSLLQFCNLNSFRTLFILGFSIFLGLSIPQYFNEHTAIKGYGPVHTGARWFNDMVNVPFSSKAFVGGCVAYLLDTTLHKKDGSIRKDRGKHWWDRFWTFKNDPRTEEFYALPFNLNKYFPSV

SEQ ID NO: 1225 - DNA, 1284 bp, Arabidopsis thaliana
atgggagacgctagagacaacgaagcctacgaggaggagctcttggactatgaagaagaagacgagaaggtcccagattctggaaacaaagttaacggcgaagctgtgaaaaaagggtacgtgggaatacacagttctggattcagagacttccttttgaaaccggagcttctcagagctattgttgactcaggatttgaacatccatctgaagtgcaacacgaatgtatccctcaagctatcttgggtatggatgttatctgccaagcaaagtctggtatggggaagactgctgtgtttgtcctgtctactctacaacagattgaaccatctcctggccaggtttctgcacttgtcttgtgccatacaagagagctagcttaccagatctgcaatgagtttgtgcgattcagtacctatctgcctgatacaaaagtttcggtgttctatggtggagtcaacattaaaattcacaaagacttgctgaagaatgaatgtcctcacattgttgttggtacccctggtcgagtgcttgcacttgccagggagaaagatctctctttgaagaatgtgaggcattttattcttgatgagtgtgataaaatgctcgagtcacttgacatgcgaagggatgtgcaggagattttcaagatgactcctcatgacaaacaagtaatgatgttctcagcaacgctcagcaaagagatacgcccagtctgcaagaagtttatgcaagatccaatggaaatatatgttgatgatgaagccaagttgactcttcatggacttgtccagcactacatcaaactgagcgagatggagaaaaatcgcaagttgaatgaccttcttgatgcgttggacttcaatcaagttgtcatttttgtgaagagcgtgagcagggctgcggagctgaacaagttactggtggaatgcaatttcccctcaatatgcatacactctggcatgtctcaagaagagaggttgactcgatacaaaagtttcaaggaagggcacaagaggatccttgtggcgactgacttggtaggaagagggattgacatagagcgtgtcaacattgttatcaactatgacatgccagattctgcggatacctatcttcatagggttgggagagctggtagatttggaaccaagggtcttgcaatcacatttgttgcatctgcttcagattcagaggtccttaatcaggttcaagagaggtttgaggtcgatataaaggagcttcctgagcagattgatacatcgacttacatgccgtcttaa

SEQ ID NO: 1226 - protein, 427 aa, Arabidopsis thaliana
MGDARDNEAYEEELLDYEEEDEKVPDSGNKVNGEAVKKGYVGIHSSGFRDFLLKPELLRAIVDSGFEHPSEVQHECIPQAILGMDVICQAKSGMGKTAVFVLSTLQQIEPSPGQVSALVLCHTRELAYQICNEFVRFSTYLPDTKVSVFYGGVNIKIHKDLLKNECPHIVVGTPGRVLALAREKDLSLKNVRHFILDECDKMLESLDMRRDVQEIFKMTPHDKQVMMFSATLSKEIRPVCKKFMQDPMEIYVDDEAKLTLHGLVQHYIKLSEMEKNRKLNDLLDALDFNQVVIFVKSVSRAAELNKLLVECNFPSICIHSGMSQEERLTRYKSFKEGHKRILVATDLVGRGIDIERVNIVINYDMPDSADTYLHRVGRAGRFGTKGLAITFVASASDSEVLNQVQERFEVDIKELPEQIDTSTYMPS

SEQ ID NO: 1227 - DNA, 1524 bp, Arabidopsis thaliana
atggcgatggcgagcttagctaggagaaaagcgtactttctcaccagaaacatctctaattctcccactgatgctttcagattctctttctccctcactcgcggcttcgcttcgtcaggatccgacgacaacgacgtcgtcatcatcggcggcggtcctggaggttatgtggcggcgattaaagcggcacagctcggtcttaagactacctgtatcgaaaagcgaggcgctctcggtggtacttgtcttaacgtcggctgtattccttcaaaggcccttcttcactcttctcacatgtaccatgaagcaaagcacgtttttgctaaccatggtgttaaggtctcttcggttgaggtagatcttcctgctatgttggcgcagaaagacacagccgtcaagaatttaacccgtggagtcgaaggtctgttcaagaagaacaaggtaaactatgttaagggctatggtaagtttctgtccccatcggaagtctctgtggacacaatcgatggagaaaacgtggttgtgaaaggcaaacatatcatagttgcaactggctcggatgtcaagtctttgcctggaatcaccatcgatgaaaagaagattgtctcatcaaccggggcactgtctctgacagagatcccaaagaaactcattgtcattggtgctggctatattgggctagagatgggttctgtatggggacggctaggatcagaggtcacagttgttgagtttgcagcggatatcgtaccagcaatggatggtgaaatccgcaagcagtttcaacgctcactagagaagcagaagatgaaatttatgctcaaaactaaagtcgttggggtagattcatctggagatggtgttaaactcatagtggaacctgctgaaggtggagaacagaccactctagaagctgatgtggtcctcgtctcagctggtagaactccgttcacatctggacttgatctagagaaaatcggagttgagacagacaaaggcgggagaattctggtgaacgagagattctcgacaaatgtttcaggcgtttatgcaattggagatgtgattccaggaccaatgctggctcacaaagccgaagaagatggtgttgcatgtgttgagtttatagcaggcaaacacgggcatgtggattacgacaaagtccctggggttgtctacacgtaccctgaagttgcgtcggttggtaaaaccgaggagcagctgaagaaagaaggtgtaagctacaatgttggaaaattcccattcatggccaatagcagagccaaggccatagacacagcagagggaatggtcaagattttggctgataaagagacagacaagatcttgggagttcacattatgtcaccaaacgcaggagaattgatccatgaggcggttctagctatcaactatgatgcatcaagtgaagacattgctcgagtctgtcacgctcatcccaccatgagtgaggctatcaaggaagctgccatggctacctatgacaagcccattcacatgtag

SEQ ID NO: 1228 - protein, 507 aa, Arabidopsis thaliana
MAMASLARRKAYFLTRNISNSPTDAFRFSFSLTRGFASSGSDDNDVVIIGGGPGGYVAAIKAAQLGLKTTCIEKRGALGGTCLNVGCIPSKALLHSSHMYHEAKHVFANHGVKVSSVEVDLPAMLAQKDTAVKNLTRGVEGLFKKNKVNYVKGYGKFLSPSEVSVDTIDGENVVVKGKHIIVATGSDVKSLPGITIDEKKIVSSTGALSLTEIPKKLIVIGAGYIGLEMGSVWGRLGSEVTVVEFAADIVPAMDGEIRKQFQRSLEKQKMKFMLKTKVVGVDSSGDGVKLIVEPAEGGEQTTLEADVVLVSAGRTPFTSGLDLEKIGVETDKGGRILVNERFSTNVSGVYAIGDVIPGPMLAHKAEEDGVACVEFIAGKHGHVDYDKVPGVVYTYPEVASVGKTEEQLKKEGVSYNVGKFPFMANSRAKAIDTAEGMVKILADKETDKILGVHIMSPNAGELIHEAVLAINYDASSEDIARVCHAHPTMSEAIKEAAMATYDKPIHM

SEQ ID NO: 1229 - DNA, 1446 bp, Arabidopsis thaliana
atgggagacgcagagagcactaaggatcgcttgctgctgccggtagagagagtcgagaacgtgacatggagcgatctgcgagatggttcattcaccgtagaactcaaaaggcttatcttcttcgccgctcctatggctgctgttgttatcgctcagttcatgttacaaatcgtttcaatgatgatggttggtcacctcggcaatctctccctcgctagcgcctctctcgcctcctccttctgcaacgtcactggcttcagcttcatcataggattgtcatgtgccttagatactttgagtggtcaagcttatggagctaagctataccggaaactaggagttcagacttacactgctatgttctgtcttgcattagtgtgtctccctctttctctcatttggttcaacatggaaaagcttcttttgatccttggccaagacccttctattgctcacgaagccggaaaatatgccacctggcttatcccaggactgtttgcttacgctgttctacagccgctcactcgctactttcaaaaccagagtttgatcacacctctcctcatcacctcctatgttgtgttctgtatccacgttcctctctgctggtttttggtttacaactcagggcttggtaatcttggaggagctttggctatcagtttgtcaaactggctctatgccattttccttggatctttcatgtactactcctctgcctgttctgagacacgtgcgccgctctccatggagatattcgatggcattggagagttcttcaaatatgctcttccttctgcggctatgatttgcctagagtggtggtcttatgaacttataatattactctctggtctcttacccaacccacaactggagacttctgtgctctctgtctgtcttcagacaatttcaacaatgtattcgataccactagcaatcgcggctgcagcaagcacaagaatctcaaatgaattaggtgctggaaactctcgagcagcacatatcgtggtctatgcggcaatgtctcttgcagttattgatgcattgatagttagtatgtctctactaatcggcaggaatcttttcgggcacattttcagcagtgacaaggaaactatcgactatgttgcaaagatggctccattggtctctatttctctcatgcttgacgctttacaaggggtcctctcaggtattgcaaggggatgcggatggcaacatataggagcttacataaacttaggagctttctatctctgggggatacccattgctgcatctttagccttctggattcatctgaaaggtgttggcctttggattggaatccaagccggtgccgttctgcaaacgcttctgcttgctcttgtcacgggctgtacaaactgggaaagccaggccgataaagcgaggaatcgaatggctttggcctatggaacataa

SEQ ID NO: 1230 - protein, 481 aa, Arabidopsis thaliana
MGDAESTKDRLLLPVERVENVTWSDLRDGSFTVELKRLIFFAAPMAAVVIAQFMLQIVSMMMVGHLGNLSLASASLASSFCNVTGFSFIIGLSCALDTLSGQAYGAKLYRKLGVQTYTAMFCLALVCLPLSLIWFNMEKLLLILGQDPSIAHEAGKYATWLIPGLFAYAVLQPLTRYFQNQSLITPLLITSYVVFCIHVPLCWFLVYNSGLGNLGGALAISLSNWLYAIFLGSFMYYSSACSETRAPLSMEIFDGIGEFFKYALPSAAMICLEWWSYELIILLSGLLPNPQLETSVLSVCLQTISTMYSIPLAIAAAASTRISNELGAGNSRAAHIVVYAAMSLAVIDALIVSMSLLIGRNLFGHIFSSDKETIDYVAKMAPLVSISLMLDALQGVLSGIARGCGWQHIGAYINLGAFYLWGIPIAASLAFWIHLKGVGLWIGIQAGAVLQTLLLALVTGCTNWESQADKARNRMALAYGT

SEQ ID NO: 1231 - DNA, 861 bp, Arabidopsis thaliana
atggcgatgatcagttactccaccattgtggttgctctgcttgcttcttttatgatttgctctgtttccgccaattttcaacgagacgtagagataacttggggagacggacgtggacagatcacaaacaacggcgatcttcttacactctctctcgacaaagcttcaggctcaggattccaatccaagaacgaatatttgttcggtaaaatcgacatgcagatcaaactcgttgccggaaactccgctggaactgtcaccgcttactatttgaaatcccctggatctacatgggacgagattgactttgagttcttgggaaacctaagtggtgatccttacacacttcatactaatgtctttacgcaaggaaaaggcgatagagaacaacaattcaaactctggttcgatcccactagtgatttccacacttactctatcctctggaacccacaacgcatcatattctccgtggatggaactcccataagagaattcaagaacatggaatctcaaggaactctgtttcctaagaaccagccaatgagaatgtactctagtctatggaacgctgaagaatgggccacaaggggtggtctcgtcaaaaccgactggtctaaagctcccttcactgcttcctaccgcggcttcaacgaagaagcttgcgtcgtgatcaacggccagtcttcatgccctaacgtgtcaggacaagggagtactggttcgtggttgtctcaggagctagactcgacgggtcaagaacagatgagatgggtacagaataactacatgatttacaattactgtacggacgctaaaaggttccctcaaggtcttccacgcgagtgcttagctgcgtaa

SEQ ID NO: 1232 - protein, 286 aa, Arabidopsis thaliana
MAMISYSTIVVALLASFMICSVSANFQRDVEITWGDGRGQITNNGDLLTLSLDKASGSGFQSKNEYLFGKIDMQIKLVAGNSAGTVTAYYLKSPGSTWDEIDFEFLGNLSGDPYTLHTNVFTQGKGDREQQFKLWFDPTSDFHTYSILWNPQRIIFSVDGTPIREFKNMESQGTLFPKNQPMRMYSSLWNAEEWATRGGLVKTDWSKAPFTASYRGFNEEACVVINGQSSCPNVSGQGSTGSWLSQELDSTGQEQMRWVQNNYMIYNYCTDAKRFPQGLPRECLAA

SEQ ID NO: 1233 - DNA, 438 bp, Arabidopsis thaliana
atggcgaaggcagataagaaaccagcggagaagaaaccggcagagaaaactccggcagccgaaccagcagcagcggcagagaagaaaccaaaagccggaaagaaactcccgaaggaaccagccggcgccggagacaagaagaagaagagatcaaagaagaacgttgagacatacaagatctacatcttcaaggtgttgaagcaagttcatccagatatcggaatctccagcaaagccatgggaatcatgaacagtttcatcaatgatatctttgagaaacttgctggtgagtcttcgaagcttgcgaggtacaacaagaagccgacgattacttctagggagattcagactgcggtgagacttgtgttgcctggagagttggcgaaacatgctgtttctgaagggactaaggcggttacgaagtttacgagttcttag

SEQ ID NO: 1234 - protein, 145 aa, Arabidopsis thaliana
MAKADKKPAEKKPAEKTPAAEPAAAAEKKPKAGKKLPKEPAGAGDKKKKRSKKNVETYKIYIFKVLKQVHPDIGISSKAMGIMNSFINDIFEKLAGESSKLARYNKKPTITSREIQTAVRLVLPGELAKHAVSEGTKAVTKFTSS

SEQ ID NO: 1235 - DNA, 2247 bp, Arabidopsis thaliana
atgggttctctttcttgttcaataatccatctggttcttattctgcaactacaaacatttttcgttttttctcaaaacatcagaaacggctctgttcctgtcggagaatctctcaccgcttcagagtcccaacaaatctctagttcatggcgttcaccttccggtgactttgctttcgggttccgcaagatccaaccaaacgacggtttcactctctccatttggttcgacaagatttctgacaagaccatcgtgtggcacgcacaagccgtcaacacaaccaccggtcttgtccctaatggttcgaaggttacattaactgcagatggcggtctggttatcgctgaccctcgaggtcaggagctgtggagagcgttgagtggtggctctgtttctcgagggcgatttactgacgacggaaacttcgttcttttcagagatgggtcagaagattctgacgaggttctatggtcgagctttgaaaatcccaccgacactctgttacctaatcagaatatagaagttggaaggaatctgtcatcacgtaggacagagacgagcttcaaaaaaggaagattcagcctacgtctagaggatgacggaaatcttcagcttcactctctcaacgccgagactgcctcagaatcagacatatactctcagtactacgaaagtaataccaacgatccaaacaaccccgggattcaattagttttcaaccagtcaggggaaatatatgttcttcaaaggaacaattcaagattcgtcgtcaaagatagagatccggatttttctatcgccgcgccgttctacatttcgacgggccccgatgatgcacttgggaatatggcttgtgggtataataatatatgtagtttaggaaacaacaagaggccaaaatgtgagtgtcctgagaggtttgtgttaaaggatccgagcaatgagtatggtgattgtttgccagattttgagatgcagacttgtagaccagagaaccaaaccgcaaactcagatgtgaatctttacgagttcattactttagagaagacgaattggccgtttggggattatgagagttatgccaactatgatgaagaaagatgtaaagcttcttgtcttagcgattgtttatgtgctgcggttatttttggaacaaatcgggatctaaaatgttggaagaagaagtttcccttgtctcacggtgaaagatctccacgtggtgatagtgatacattcattaaggttcgaaaccgctccatcgcggatgttccagttaccggaaacagagcgaaaaaacttgactgggtctttacatatggagagcttgcagaggctacaagagatttcacggaagagcttggaagaggagcctttggtatagtttacaaaggatatttagaagttgccggtggttctgaagttaccgtggctgtgaagaaactagatcgtcttgatttagataacgaaaaagagttcaagaatgaggttaaagtgataggtcagattcaccacaagaacctagtgaggctcattggcttctgcaacgaaggacagagccagatgatcgtctatgagtttttaccacaagggacgctagccaattttctcttcaggcgtccgaggccgagctgggaagatagaaagaatattgcggtggccattgctcgtggaatcttgtatctacatgaagagtgcagcgagcagatcatacactgtgacataaaaccgcagaacatactcctagatgagtattacactcctcggatctcggattttggtctagcaaagcttttgttgatgaaccaaacgtatacgctcactaacatccgtggaacaaaagggtatgtggcccctgaatggttcaggaatagccccattacatccaaagtagatgtttatagctatggagtaatgcttttagaaatcgtgtgctgcaagaaagccgtcgaccttgaggataacgtgattctcatcaattgggcttacgattgttttcgacaaggaaggttggaagatctgactgaggacgattcagaggcaatgaatgacatggaaactgtggagagatatgtgaaaatagcgatatggtgtatacaagaagagcatgggatgagacctaacatgagaaatgttacacagatgcttgaaggtgtgattcaagtttttgatcctccaaatccgtctccttatagcactttcacttggtctgatgaatctttgtctagtgatccagtgtcacttgtttga

SEQ ID NO: 1236 - protein, 748 aa, Arabidopsis thaliana
MGSLSCSIIHLVLILQLQTFFVFSQNIRNGSVPVGESLTASESQQISSSWRSPSGDFAFGFRKIQPNDGFTLSIWFDKISDKTIVWHAQAVNTTTGLVPNGSKVTLTADGGLVIADPRGQELWRALSGGSVSRGRFTDDGNFVLFRDGSEDSDEVLWSSFENPTDTLLPNQNIEVGRNLSSRRTETSFKKGRFSLRLEDDGNLQLHSLNAETASESDIYSQYYESNTNDPNNPGIQLVFNQSGEIYVLQRNNSRFVVKDRDPDFSIAAPFYISTGPDDALGNMACGYNNICSLGNNKRPKCECPERFVLKDPSNEYGDCLPDFEMQTCRPENQTANSDVNLYEFITLEKTNWPFGDYESYANYDEERCKASCLSDCLCAAVIFGTNRDLKCWKKKFPLSHGERSPRGDSDTFIKVRNRSIADVPVTGNRAKKLDWVFTYGELAEATRDFTEELGRGAFGIVYKGYLEVAGGSEVTVAVKKLDRLDLDNEKEFKNEVKVIGQIHHKNLVRLIGFCNEGQSQMIVYEFLPQGTLANFLFRRPRPSWEDRKNIAVAIARGILYLHEECSEQIIHCDIKPQNILLDEYYTPRISDFGLAKLLLMNQTYTLTNIRGTKGYVAPEWFRNSPITSKVDVYSYGVMLLEIVCCKKAVDLEDNVILINWAYDCFRQGRLEDLTEDDSEAMNDMETVERYVKIAIWCIQEEHGMRPNMRNVTQMLEGVIQVFDPPNPSPYSTFTWSDESLSSDPVSLV

SEQ ID NO: 1237 - DNA, 777 bp, Arabidopsis thaliana
atgggtcgtgtcatcagagctcaacgtaagggtgcgggttccgtcttcaaatcccacactcaccaccgcaaaggtccggctaagttccgtagcctcgatttcggcgagagaaatggttacctcaagggcgtcgtgacggagatcatccacgatcctggtcgtggtgctcctcttgctcgtgtcactttccgtcatcctttccgtttcaagaaacaaaaggagctcttcgtcgccgccgaaggtatgtacaccggtcagttcttgtactgcggtaagaaagctactctcgtcgttggaaatgttctccctcttagatctattcctgaaggagctgttgtctgcaacgtcgagcatcacgtcggtgatcgtggtgtcctcgctagagcttctggtgattacgccattgttatcgctcacaaccctgacagcgacactactaggattaagttgccatcgggttcgaagaagattgtcccaagtggatgcagggctatgattggacaagttgctggaggtggaagaactgagaagccgatgctcaaggcaggaaacgcgtaccacaagtaccgtgtgaagaggaactcatggcctaaggttcgtggtgtggctatgaatccagtggagcatcctcatggaggaggtaaccatcagcacattggtcacgccagtactgttaggcgtgatgcacctcctggacagaaggttggtcttattgctgcaaggaggactggtcgtctcagaggtcaagctgctgcttcagctgccaaggcagactag

SEQ ID NO: 1238 - protein, 258 aa, Arabidopsis thaliana [sequence omitted]

SEQ ID NO: 1239 - DNA, 1839 bp, Arabidopsis thaliana
atggccggaggaatcgtctcaccggcctctctactcgacctaatcgctgatatcgtcgagattccactcaacaccggaatgttcaagaaggattgcgcagatctcactcgacgagtttgtctcttaacgcatttgttagaggagattagagactcaactcctatcgattccgccgcttcgtcgtcgtcggagaatgattggtggtctgatctcgtggtcggacttcaagccgcgaagcgtcttctctccacagctcgattccaagctcgcgattcctctgatggtgctgcgaagagaatctcatttcagttccaatgtgttacatggaagcttgagaaagcattgagcaatcttccatatgatctttatgatatctctgacgaagttggagaacaagtggagctagcgagatcacagttgcgaagagcaatgcagagatatggatcgttgaattcgaacaagttctcgagtgctttatctgagccaatggagagagatggttttagtaatgttataaagatcaaagctgaggaaaagcttgagagtgtttcagaaacacttcattttggtgaggaggaggagaaacaaagttcgccgcctctaaggagaagctcttccatttctttggcttattatttgtccaaagatgctgatactgatagattagacaaaatggttaacaagaacactgatgaatcgaagaaatctgataaactcacgattccggttgattttctttgtccggtgtcgcttgaactgatgaaggatcctgtcattgttgccacaggacagacttacgagagggcatacatacagagatggatcgactgtgggaatctaacatgtcctaagactcagcagaaactcgaaaactttacgcttacaccaaactatgttctcagaagtctcatctctcggtggtgcgctgaacacaacattgagcaacctgcaggttacattaacggcaggacaaaaaacagtggagatatgtcggtgatccgggccttggttcagagactctcaagccggtcaacagaggatcgaaggaatgcggtttctgaaatccgctctctgtcaaagagaagtacggataatcgcattctgattgcagaagcaggagcaatccctgttttggtgaatcttttaacctcagaggatgttgcaacgcaggaaaacgcaatcacatgtgttctcaacctctctatatatgaaaacaacaaagagctgataatgtttgctggtgcagtcacctcaattgttcaagtccttagagccggaaccatggaagcaagagaaaacgcagcagcgacactttttagcctgtcgttagccgatgagaacaagatcataataggcgggtcaggtgcgatacctgccttagttgatctgctcgagaacgggaccccgagagggaagaaagatgcagcaacggcattgttcaatctctgcatttatcatggaaacaaaggtagagcagtcagagccggtatagtaactgcattggttaagatgctcagtgattccacccgccaccggatggttgatgaagctttgacaattctctcagttcttgcaaataatcaagacgcgaaatccgcgatagtaaaagcgaatactctacccgcgttgataggtattctccaaacggatcaaactagaaaccgagagaacgcagcagcgatattgctttcgctgtgtaaaagagacactgagaaactgatcactatcggtagactcggtgcggttgtcccgttaatggatttatcgaagaatggaacagagagaggcaaaaggaaagccatatctttgttagagcttcttcgtaaagcatgccaataa

SEQ ID NO: 1240 - protein, 612 aa, Arabidopsis thaliana
MAGGIVSPASLLDLIADIVEIPLNTGMFKKDCADLTRRVCLLTHLLEEIRDSTPIDSAASSSSENDWWSDLVVGLQAAKRLLSTARFQARDSSDGAAKRISFQFQCVTWKLEKALSNLPYDLYDISDEVGEQVELARSQLRRAMQRYGSLNSNKFSSALSEPMERDGFSNVIKIKAEEKLESVSETLHFGEEEEKQSSPPLRRSSSISLAYYLSKDADTDRLDKMVNKNTDESKKSDKLTIPVDFLCPVSLELMKDPVIVATGQTYERAYIQRWIDCGNLTCPKTQQKLENFTLTPNYVLRSLISRWCAEHNIEQPAGYINGRTKNSGDMSVIRALVQRLSSRSTEDRRNAVSEIRSLSKRSTDNRILIAEAGAIPVLVNLLTSEDVATQENAITCVLNLSIYENNKELIMFAGAVTSIVQVLRAGTMEARENAAATLFSLSLADENKIIIGGSGAIPALVDLLENGTPRGKKDAATALFNLCIYHGNKGRAVRAGIVTALVKMLSDSTRHRMVDEALTILSVLANNQDAKSAIVKANTLPALIGILQTDQTRNRENAAAILLSLCKRDTEKLITIGRLGAVVPLMDLSKNGTERGKRKAISLLELLRKACQ

SEQ ID NO: 1241 - DNA, 1500 bp, Arabidopsis thaliana
atggaaactgaagacgatttgtgcaacaccaattggggaagctcttcttcgaaatcgcgagagccgggttcatcagactgtgggaattcgacattcgcaggttttacgtcccagcagaagtgggaagatgcttcaatcttggattatgagatgggtgtggagcctggattgcaagagagcattcaagcaaatgttgatttcttacaaggtgttagggctcaagcgtgggatccaaggacgatgttgagtaacctttcttttatggagcagaagattcaccagctgcaggatcttgttcatcttcttgttggtcgtggtgggcagcttcaaggtcgtcaagacgagctcgcggctcagcagcagcagcttataacgacggatcttacttccattatcatacagcttatttcaactgcaggtagtcttcttccatctgttaagcataatatgtcaacagctccgggtccattcactgggcagcccggttcagccgtgttcccttatgtaagggaggctaataacgttgcttcacagagtcagaacaataacaactgtggtgctcgagagttcgatttgcctaagccggttcttgttgatgagagggaaggtcatgttgtggaggaacatgagatgaaagatgaagatgatgtggaagaaggagagaaccttcctcccggttcgtatgagatattgcagcttgagaaagaagagattctcgcaccgcatactcacttctgcacgatatgtggcaagggtttcaagagagacgcgaatttgaggatgcatatgagagggcatggagatgagtacaaaacagcagctgctctggcgaaaccgaacaaagaatccgtacccgggtctgagccgatgctgatcaagaggtactcgtgcccattccttggttgcaaacgtaacaaggagcacaaaaagttccagcctttgaaaacgattctatgcgtgaagaatcactataaacgcacccactgcgataaaagcttcacttgcagccggtgccataccaagaaattctctgtcattgcagatcttaaaacccacgagaagcactgcgggaaaaacaagtggctttgttcctgtggtacaacattttcaaggaaagacaagttgtttggtcacatagctctgttccagggacacacgcctgcaatccctcttgaagagacaaaaccatcagccagtacatctactcagagagggagctctgaaggcgggaacaacaaccaaggaatggttggcttcaatcttggttctgcatcaaatgctaaccaagaaaccacacagcctggaatgactgatgggaggatatgttttgaggagtcgttctcaccaatgaactttgatacatgtaattttggagggttccacgagtttccgcgactgatgtttgatgattcagagagttcttttcaaatgcttattgcgaatgcctgtggtttctcgcccaggaatgttggtgagtctgtttcagatactagtctctaa

SEQ ID NO: 1242 - protein, 499 aa, Arabidopsis thaliana
METEDDLCNTNWGSSSSKSREPGSSDCGNSTFAGFTSQQKWEDASILDYEMGVEPGLQESIQANVDFLQGVRAQAWDPRTMLSNLSFMEQKIHQLQDLVHLLVGRGGQLQGRQDELAAQQQQLITTDLTSIIIQLISTAGSLLPSVKHNMSTAPGPFTGQPGSAVFPYVREANNVASQSQNNNNCGAREFDLPKPVLVDEREGHVVEEHEMKDEDDVEEGENLPPGSYEILQLEKEEILAPHTHFCTICGKGFKRDANLRMHMRGHGDEYKTAAALAKPNKESVPGSEPMLIKRYSCPFLGCKRNKEHKKFQPLKTILCVKNHYKRTHCDKSFTCSRCHTKKFSVIADLKTHEKHCGKNKWLCSCGTTFSRKDKLFGHIALFQGHTPAIPLEETKPSASTSTQRGSSEGGNNNQGMVGFNLGSASNANQETTQPGMTDGRICFEESFSPMNFDTCNFGGFHEFPRLMFDDSESSFQMLIANACGFSPRNVGESVSDTSL

SEQ ID NO: 1243 - DNA, 1434 bp, Arabidopsis thaliana
atgaaatcgaatcaaaaaaaacaaaaatccccaaattaccaaaatcctcggcgacaaagaggagagatagagagagagaaagaggcgaaaataatggcgtcgatccctccgccggagcttgacaacgactcactggcgtcatcgccgagatcggagtacgatagtcagccacgcgtacggttcatgtgtacttttggaggaaggatcttgccacgtccgccggataatcagctctgttacgtcggcggcgataatcgcatggtcgctgttcatcgtcacactactttcgcctctctccttagtaaacttgctaaactctccggtaaaagcaacataagcgtgaagtaccagctaccaaacgaagatcttgacgcgttgatttccgtatcaacggacgaagatgtagagaacatgatggacgaatacgaccgcgtcgcacagaatcaaaacccacgcgcctctcgtcttcgtctttttctcttcaccaaaaacgtcgccggagaagaagataacgatagtcgagctagcagtatcagctctctcctcgatagctctgttaatcgggagcaatggttcctcgacgctcttaacctcggttcttccgccgccgcaaccgcggtatctaacggtgggtccggtagagtctttgagcgagttagatctgaagtctcgtcgattgtttctgaagttcctgattatctctttggattggataatttcgatgaaactgctccgccgcatgagcttcgtgatcgtgatccgagagctaagatccaacgagaagtctcgacgctttcggatcctggttcgcctcgtcgcgatgttccttcgccgtatggttcgacgtcttcggctcctgtgatgcgaatatctacaccggaacttccaccaccagtttttattaaaccggaaagtccagaaccggtttcgactccgaaatccaatcctcaaccggaacaagtaatgcaacagagtaatctcccggttaactcgcaatggcaatatgcccctggcccaggccaacaggttcattaccagggtcataccattcaccaatcaccggtttattacgttcctggttcggttccgggtaatcatatggtccagcaaggaaatcatatggttcaaccgggtaatcatatggtacaaccggttcaaatgccgggtcagtatcttcaacaataccatcatgtaccaatgggataccaccaacctcagactcatcagatggctggtccgggtcaagtatatggtggaacggttaggccggttatgatggcagttgatggaatgaaccggacgggttattatggaatgaaaacacccggtccggttcaaatgtatcagcatcacactggtatggttgttcctggtgtagaagaacaacaacaatacagaaccgaaacggattcggatacgggtcgggcttcttag

SEQ ID NO: 1244 - protein, 477 aa, Arabidopsis thaliana
MKSNQKKQKSPNYQNPRRQRGEIEREKEAKIMASIPPPELDNDSLASSPRSEYDSQPRVRFMCTFGGRILPRPPDNQLCYVGGDNRMVAVHRHTTFASLLSKLAKLSGKSNISVKYQLPNEDLDALISVSTDEDVENMMDEYDRVAQNQNPRASRLRLFLFTKNVAGEEDNDSRASSISSLLDSSVNREQWFLDALNLGSSAAATAVSNGGSGRVFERVRSEVSSIVSEVPDYLFGLDNFDETAPPHELRDRDPRAKIQREVSTLSDPGSPRRDVPSPYGSTSSAPVMRISTPELPPPVFIKPESPEPVSTPKSNPQPEQVMQQSNLPVNSQWQYAPGPGQQVHYQGHTIHQSPVYYVPGSVPGNHMVQQGNHMVQPGNHMVQPVQMPGQYLQQYHHVPMGYHQPQTHQMAGPGQVYGGTVRPVMMAVDGMNRTGYYGMKTPGPVQMYQHHTGMVVPGVEEQQQYRTETDSDTGRAS

SEQ ID NO: 1245 - DNA, 1077 bp, Arabidopsis thaliana
atggtgaagaagcaatcgccattacacgttgtcggtgtgtctgttttgatggtgttgttatgcagtgttaattacagtctctgtgaaaagatcaaaacgtataagctcacaagaggaagcttaagtgttactttcactaactatggtgctgtcatgacctctcttctcctccctgacagacatggaaaacaagacgatgttgttcttggatttgatactgttgatggttacaagaatgatacaacatattttggagcaattgtgggaagagtggctaatagaataggaggtgctaaattcaagttaaatggtcatctctacaaaaccgatcccaacgaaggccgtaacactctccatggtggttcaaagggatttagtgatgtgatttggtcagtccaaaagtatgttcccactagtcacattactttcacatacgatagcttcgacggtgaagaaggttttccgggcaatgtgacggtgaaagtgacgtacatgttgatcggagaaaacaaactcggtgtaaaaatggaagcaaagccactcaacaaacctacaccaatcaacttagctctccacacttactggaacctccacagccacaactccgggaacatcctctcccacaaaattcaactcctcgccggaaaaatcactcccgtcgacgacaaactcattcccaccggagaaatcacctccattaccggaactccttacgatttcctcgagccacgtgagatcggtagccggatccacgaattacccggcggttacgacatcaattacgtgatcgacggaccgatcgggaaacatctgaggaaaactgcggttgtgacggagcaagtcaccgggaggaagatggagctgtggacgaatcagcctggtgttcagttttacacgagtaatatgatgaaacgtgtcgtcggtaaaggtaaagccgtttatgagaaatacggtggcttgtgtttggagactcaaggcttcccagattccgtcaatcacaagaactttccgtcgcagattgttaatcccggcgagagttatttgcatgttatgctcttcagattcactgctcactaa

SEQ ID NO: 1246 - protein, 358 aa, Arabidopsis thaliana
MVKKQSPLHVVGVSVLMVLLCSVNYSLCEKIKTYKLTRGSLSVTFTNYGAVMTSLLLPDRHGKQDDVVLGFDTVDGYKNDTTYFGAIVGRVANRIGGAKFKLNGHLYKTDPNEGRNTLHGGSKGFSDVIWSVQKYVPTSHITFTYDSFDGEEGFPGNVTVKVTYMLIGENKLGVKMEAKPLNKPTPINLALHTYWNLHSHNSGNILSHKIQLLAGKITPVDDKLIPTGEITSITGTPYDFLEPREIGSRIHELPGGYDINYVIDGPIGKHLRKTAVVTEQVTGRKMELWTNQPGVQFYTSNMMKRVVGKGKAVYEKYGGLCLETQGFPDSVNHKNFPSQIVNPGESYLHVMLFRFTAH

SEQ ID NO: 1247 - DNA, 975 bp, Arabidopsis thaliana
atgttaacggacgagagagaagtagtctgtgtcaccggcgccagtggctgcatcggctcgtggctggtccatcagctcctcctccgcggctactccgtccacgccaccgtgaaaaacctccaggatgagaaagagacgaaacatctagaaggtctcgaaggtgcagccacacgcctccatctattcgagatggatctcctacaatacgacaccgtttccgccgccatcaatggttgctccggcgtattccacctcgcatcaccttgtatcgtcgatgaagtccaagatccccagaagcaactacttgacccggcggttaaaggaaccataaatgttctgacggcggcaaaagaagccagtgttaagagagttgttgtgacgtcttcgatatcggcgattactccaagtcccaactggcctgctgataagatcaagaatgaggaatgttgggctgctgaagactactgcaggcaaaatggattgtggtatccactgtcgaagacgcttgctgagaaggcagcttgggaatttgcagaggagaaaggattggatgtggttgtggtgaatccaggcactgtcatggggcctgtgattcctccgtctcttaacgctagcatgcacatgcttctacgccttcttcaggggtgcacggagacatacgagaacttctttatggggtctgtgcatttcaaggatgtggctttagctcatattcttgtatacgaggatccatattcgaaaggaaggcacttgtgcgttgaggctatctctcactacggtgattttgtagccaaagttgctgagctctatcccaattacaatgtccccaagttaccgagagagactcaaccgggtttacttcgagataagaatgcatcaaagaagctcatagatttggggttaaagttcatttccatggaggaaatcatcaaggaaggtgtggagagtcttaaaagcaaaggatttatctcttaa

SEQ ID NO: 1248 - protein, 324 aa, Arabidopsis thaliana
MLTDEREVVCVTGASGCIGSWLVHQLLLRGYSVHATVKNLQDEKETKHLEGLEGAATRLHLFEMDLLQYDTVSAAINGCSGVFHLASPCIVDEVQDPQKQLLDPAVKGTINVLTAAKEASVKRVVVTSSISAITPSPNWPADKIKNEECWAAEDYCRQNGLWYPLSKTLAEKAAWEFAEEKGLDVVVVNPGTVMGPVIPPSLNASMHMLLRLLQGCTETYENFFMGSVHFKDVALAHILVYEDPYSKGRHLCVEAISHYGDFVAKVAELYPNYNVPKLPRETQPGLLRDKNASKKLIDLGLKFISMEEIIKEGVESLKSKGFIS

SEQ ID NO: 1249 - DNA, 1491 bp, Arabidopsis thaliana
atggccgggactggattgtttgctgagattcttgatggagaagtatacaaatactacgctgatggtgagtggaaaacttcttcctcaggtaagagtgttgccatcatgaacccggccacgaggaagacacagtacaaggttcaagcatgcacgcaagaagaagtgaacgcggtgatggaactggcgaaatcagctcagaaatcgtgggcgaaaactcctctttggaaaagagctgagcttcttcacaaggctgcagcaatccttaaggacaacaaagctcccatggctgagtctcttgttaaagaaatcgctaaacccgccaaagattctgttactgaggttgtgaggtctggagatttgatctcttattgtgctgaagaaggtgttaggatcttaggtgaagggaagtttcttctctccgatagcttccccggtaatgaccgtactaagtactgcctcacttccaagattccactcggtgtggttttggctattcctccattcaattatccagttaatctcgctgtatcgaagatcgctcctgctttgatcgccggaaactcccttgtcctcaaacctccaactcaaggagctgtttcttgccttcacatggtacattgctttcacttagccggtttcccaaaaggtcttatcagctgcatcaccggaaaaggatctgagatcggcgatttcctcactatgcaccctgctgttaactgcattagtttcacgggtggtgataccggaatctcaatctcaaagaaagctggtatgatccctcttcaaatggaacttggaggtaaagatgcatgcattgttctagatgatgctgatcttgatttagttgcttccaatatcatcaaaggaggattctcttacagcgggcagagatgcactgcggttaaggtagtcctagtgatggaatcagtagcggatgagcttgttgagaaagtgaaagctaaagtggccaaactcacggtgggaccgcccgaagagaactccgatatcacggcagtggtgtcggaatcttcagctaatttcattgaaggattggtgatggatgctaaggagaaaggagcaacgttttgtcaagagtataaaagagagggtaacttgatttggccgttgcttttggataatgttagaccggacatgaggatcgcgtgggaggaaccattcggtcctgttgtgccggtcttgaggatcaattctgttgaagaagggattaatcattgcaatgcaagcaactttggccttcagggatgtgtattcactaaagacatcaacaaggcaatactgatcagtgatgcaatggagacaggaaccgttcagatcaactctgcgccagctcgtggaccggaccacttccctttccagggacttaaggacagtggaatagggtcacaaggtgtgacaaatagcatcaatttgatgactaaagtgaagaccactgtcattaacttgcctacaccttcttactctatgggttag

SEQ ID NO: 1250 - protein, 496 aa, Arabidopsis thaliana
MAGTGLFAEILDGEVYKYYADGEWKTSSSGKSVAIMNPATRKTQYKVQACTQEEVNAVMELAKSAQKSWAKTPLWKRAELLHKAAAILKDNKAPMAESLVKEIAKPAKDSVTEVVRSGDLISYCAEEGVRILGEGKFLLSDSFPGNDRTKYCLTSKIPLGVVLAIPPFNYPVNLAVSKIAPALIAGNSLVLKPPTQGAVSCLHMVHCFHLAGFPKGLISCITGKGSEIGDFLTMHPAVNCISFTGGDTGISISKKAGMIPLQMELGGKDACIVLDDADLDLVASNIIKGGFSYSGQRCTAVKVVLVMESVADELVEKVKAKVAKLTVGPPEENSDITAVVSESSANFIEGLVMDAKEKGATFCQEYKREGNLIWPLLLDNVRPDMRIAWEEPFGPVVPVLRINSVEEGINHCNASNFGLQGCVFTKDINKAILISDAMETGTVQINSAPARGPDHFPFQGLKDSGIGSQGVTNSINLMTKVKTTVINLPTPSYSMG

SEQ ID NO: 1251 - DNA, 1914 bp, Arabidopsis thaliana
atgcagatcgctggtttgcccatcggcaagttcatggctcggactcttcccaccacttctcacaaccttcttgggtggagttttagcctcaatcctggtccttttaacatcaaggagcatgtcattatcaccatctttgctaattgtggcgttgcttacggtggtggtgatgcttactctattggggctatcactgttatgaaagcttactataaacagagccttagcttcatctgtggtctcttcatcgtcttgaccactcagattttgggttatggttgggctgggattctaaggaggtaccttgttgatcctgttgacatgtggtggccttcaaatctcgctcaagtttctctcttcagagcgttgcacgagaaggaaaacaagtctaaaggcttgacgaggatgaagttctttctagtagctcttggtgctagctttatttactatgcacttccaggctatctattcccaatcttgactttctcctcatgggtttgttgggcttggccaaacagcatcacggctcagcaggttggttcagggtaccatggccttggggttggagccttcactcttgactgggctggcatctctgcttaccatggtagtccattggtggctccatggtcctctatcctcaacgttggtgttggtttcatcatgtttatatacatcatcgtccctgtttgttactggaagttcaacactttcgatgccagaaagttccccatttcctccaaccagctattcactactagtggccagaagtatgacacaaccaagatcttgacaccgcagtttgatctggatattggtgcttataacaactacgggaaactttacctcagccctcttttcgcactctctatcggatccgggtttgcgagattcactgcaacactaactcatgtggcattgttcaacggcagggacatatggaagcagacttggtctgcagtgaacaccacgaagctggacatccatggaaaattgatgcaaagctacaaaaaagtgcctgagtggtggttttatatattgctggcaggaagtgtagccatgtctctcctaatgtcttttgtgtggaaggagtcagtgcagcttccatggtggggaatgctctttgcttttgcattggccttcattgtcacactccctatcggtgtcattcaagcaactacaaatcagcaaccaggatatgatataatagggcagttcattatcggttatatcctgcctggaaaacccattgcaaacctgattttcaagatttacgggagaatcagcacagtccatgctctctcatttttggcagaccttaagcttggccattacatgaaaatcccaccgccctgcatgtacacggctcagctggtgggcactgtggtagctggtgtggtgaatctgggagtggcctggtggatgttggagagcattcaagacatatgcgacatcgaaggagaccaccctaatagcccctggacttgccccaagtatagagtgacgttcgatgcttcagttatttgggggttgataggaccaagacggctctttggaccaggaggcatgtaccgtaaccttgttgggttcttcctcattggagctgtcctgcctgttccccgtgtgggcgctgagcaagatcttcccaaacaagaagtggatccctctcatcaacattccagttatctcctacggctttgcagggatgcctccagccactccaaccaacattgccagctggttggtcacaggaaccatcttcaactactttgtgttcaattaccacaagagatggtggcagaagtacaattacgtactctctgcagcgctcgatgcagggaccgcgttcatgggggtgctcttgttcttcgccctgcagaatgctggacacgacctcaaatggtggggcactga

SEQ ID NO: 1252 - protein, 637 aa, Arabidopsis thaliana
MQIAGLPIGKFMARTLPTTSHNLLGWSFSLNPGPFNIKEHVIITIFANCGVAYGGGDAYSIGAITVMKAYYKQSLSFICGLFIVLTTQILGYGWAGILRRYLVDPVDMWWPSNLAQVSLFRALHEKENKSKGLTRMKFFLVALGASFIYYALPGYLFPILTFSSWVCWAWPNSITAQQVGSGYHGLGVGAFTLDWAGISAYHGSPLVAPWSSILNVGVGFIMFIYIIVPVCYWKFNTFDARKFPISSNQLFTTSGQKYDTTKILTPQFDLDIGAYNNYGKLYLSPLFALSIGSGFARFTATLTHVALFNGRDIWKQTWSAVNTTKLDIHGKLMQSYKKVPEWWFYILLAGSVAMSLLMSFVWKESVQLPWWGMLFAFALAFIVTLPIGVIQATTNQQPGYDIIGQFIIGYILPGKPIANLIFKIYGRISTVHALSFLADLKLGHYMKIPPPCMYTAQLVGTVVAGVVNLGVAWWMLESIQDICDIEGDHPNSPWTCPKYRVTFDASVIWGLIGPRRLFGPGGMYRNLVGFFLIGAVLPVPRVGAEQDLPKQEVDPSHQHSSYLLRLCRDASSHSNQHCQLVGHRNHLQLLCVQLPQEMVAEVQLRTLCSARCRDRVHGGALVLRPAECWTRPQMVGH

SEQ ID NO: 1253 - DNA, 3090 bp, Arabidopsis thaliana
atgccgcgaagcagagacgaagacgatgaattagacggtgactacgaagcattagatttagaggaagaagaggaagaagacgaagaagaagaagaagagagaggaagaggtggcggcggttctagacggaagagaggaagatcgaattttatcgatgattatgctgaggaagattctcaggaagaagatgatgacgatgaagattatggtagtagccgtggaggtaaaggagctgctagtaagagaaagaagccatctgcttctattttcttagaccgagaagctcatcaagttgatgatgaagacgaagaggaagaagatgaagcagaagatgattttattgtggataatggaacggaccttccggatgagcgtggtgatagacggtacgaacggaggtttcttcctcgagacgaaaatgatgaggatgtggaagatctcgagagaagaattcaagagcggttctcctctaggcatcatgaagaatatgatgaagaagctacagaagttgagcaacaagcgcttttgccatcagtccgtgatccgaaattgtggatggtgaaatgtgcgattggccgtgaaagggaggttgctgtttgtcttatgcaaaaatttatagatcgaggagctgatttgcagattagatctgttgttgcccttgaccatcttaagaattttatatatgttgaagcagacaaggaagctcatgtgaaagaggcaatcaagggcatgaggaatatatatgctaatcagaagatcttacttgtcccgataagagaaatgacagatgttctttctgttgagagcaaagccattgatctatcacgggatacctgggttagaatgaaaatcgggacgtataaaggtgatcttgcaaaggtagttgatgttgataatgtgcgtcagagggtcacagtcaagttaatcccaagaattgatctgcaggcactagccagtaagctggacggaagagaagtttcaaagaaaaaagcctttgttccacctccacgtttcatgaacattgatgaagcgagggaactgcacatacgtgttgagcgtcggcgtgatcacatgactggtgattactttgaaaatattggtggcatgcttttcaaagatgggtttcattacaaacaagtatcattgaagtccatcactgttcagaatgttacaccaacttttgacgaacttgaaaaattcaataaaccaagtgaaaatggagagggcgactttggtggtctgtcaacattatttgcaaacagaaagaaaggtcatttcatgaagggtgatgcagttattgttatcaagggggatctgaaaaacttgaagggttgggttgagaaagtagatgaagaaaatgtccttatcagatcagaagtgaaaggtctccctgatcctcttgctgtaaatgagagagagctttgcaagtactttgaacctggaaatcatgtgaaggttgtctctgggacccatgaaggagcaacaggcatggttgtcaaagttgatcaacacgtccgagtgtttgctgatcatgttgttgagagttcagaagtgacaactggtgttaccaaaattggggactatgaacttcatgatcttgtgcttctggataacctgagctttggagtaattatacgactagagaatgaagcttttcaggttcttaaaggggttcctgacagaccagaggttgctcttgtcaaactcagagaaatcaaatgcaaacttgagaagaaaatcaatgttcaagatcgctacaaaaatgtcattgctgtgaaagatgacgtcagagtgatcgagggtcctagcaaaggtaaacaaggtcctgtaaagcatatctacaaaggagtcttatttatatatgatcgacatcaccttgagcatgctggatttatctgcgctaaatgcacatcatgcattgttgttggtggatcacgttctggtgctaatagaaatggtggtgattcgctttcaaggtatggcaatttcaaggcacctgccccagtaccctcatctccaggaagatttcaacgtggcagaggcggaggatataataactctggagggaggcatgggggtggaagaggacggggagacgattctttattgggtactactgttaaaatccgtctaggacctttcaaggggtataggggacctgtagtagaagtgaaaggaaattcagtgcgtgtagaacttgagatgaagattgtgacagttgatcggggtgcaatatcagataatgttgcgacaacaccgtttagagatacatctcggtatagtatgggaagcgaaacacctatgcatccttcacggactccacttcatccttatatgactccaatgcgggactctggagctacaccaatccatgatggaatgaggacacccatgcgtgatagagcttggaatccttacacgcctatgagtccacctagggataactgggaagatggaaatccgggatcttggggaacgagtcctcaatatcagccgggaagtcctccttcacgggcatatgaagcaccaacgcctggctcaggatgggctagtactcctggtggtagttactcggatgcggggacacctagagaccatggttcagcttatgctaatgccccaagtccttacctgccatcaacacctgggcaacccatgacaccaagctcggcttcatacttacctggtactcccggaggacaaccaatgactcctggaactggcctcgatgtcatgtctcctgttataggtggggatgctgaagcatggttcatgcccgatattttggttgacatacacaaggctggagaggacaccgatgtgggcgtcatccgagatgtttcggatggaacgtgtaaagtgtctctcgggtccagcggtgaaggtgacactataatggccctcccaagcgaactggagataattcctccgaggaaatccgatcgtgtcaaaatagttggcggtcagtatcgtgggtctacaggtaagctgatcggaatcgacgggtctgacggtatcgttaagatagatgataatcttgacgtcaagattctggacctggccttattagccaagtttgtgcaaccgtga

SEQ ID NO: 1254 - protein, 1029 aa, Arabidopsis thaliana
MPRSRDEDDELDGDYEALDLEEEEEEDEEEEEERGRGGGGSRRKRGRSNFIDDYAEEDSQEEDDDDEDYGSSRGGKGAASKRKKPSASIFLDREAHQVDDEDEEEEDEAEDDFIVDNGTDLPDERGDRRYERRFLPRDENDEDVEDLERRIQERFSSRHHEEYDEEATEVEQQALLPSVRDPKLWMVKCAIGREREVAVCLMQKFIDRGADLQIRSVVALDHLKNFIYVEADKEAHVKEAIKGMRNIYANQKILLVPIREMTDVLSVESKAIDLSRDTWVRMKIGTYKGDLAKVVDVDNVRQRVTVKLIPRIDLQALASKLDGREVSKKKAFVPPPRFMNIDEARELHIRVERRRDHMTGDYFENIGGMLFKDGFHYKQVSLKSITVQNVTPTFDELEKFNKPSENGEGDFGGLSTLFANRKKGHFMKGDAVIVIKGDLKNLKGWVEKVDEENVLIRSEVKGLPDPLAVNERELCKYFEPGNHVKVVSGTHEGATGMVVKVDQHVRVFADHVVESSEVTTGVTKIGDYELHDLVLLDNLSFGVIIRLENEAFQVLKGVPDRPEVALVKLREIKCKLEKKINVQDRYKNVIAVKDDVRVIEGPSKGKQGPVKHIYKGVLFIYDRHHLEHAGFICAKCTSCIVVGGSRSGANRNGGDSLSRYGNFKAPAPVPSSPGRFQRGRGGGYNNSGGRHGGGRGRGDDSLLGTTVKIRLGPFKGYRGPVVEVKGNSVRVELEMKIVTVDRGAISDNVATTPFRDTSRYSMGSETPMHPSRTPLHPYMTPMRDSGATPIHDGMRTPMRDRAWNPYTPMSPPRDNWEDGNPGSWGTSPQYQPGSPPSRAYEAPTPGSGWASTPGGSYSDAGTPRDHGSAYANAPSPYLPSTPGQPMTPSSASYLPGTPGGQPMTPGTGLDVMSPVIGGDAEAWFMPDILVDIHKAGEDTDVGVIRDVSDGTCKVSLGSSGEGDTIMALPSELEIIPPRKSDRVKIVGGQYRGSTGKLIGIDGSDGIVKIDDNLDVKILDLALLAKFVQP

SEQ ID NO: 1255 - DNA, 486 bp, Arabidopsis thaliana
atgtcatcgaagaacggagttgttcgtagctgtttaggatcaatggacgacatcaaaaaagtcttccaacgattcgacaaaaacggcgacgggaaaatctccgtcgacgagctcaaagaagtgatccgcgctctctcaccaacagcatcaccagaagaaacagtaacgatgatgaaacaattcgatctagacggtaacggattcatagatctggacgaattcgtcgcgcttttccaaatcggaatcggaggaggaggtaacaatcgaaacgacgtaagcgatttgaaagaagcgtttgagttatatgatttggatggtaatggaaggatctcggcgaaagagcttcattcagtgatgaagaatttgggtgagaagtgctctgtgcaagattgtaagaagatgattagtaaagttgatattgatggtgatggttgtgttaattttgatgagtttaagaagatgatgagtaatggtggtggtgcttga

SEQ ID NO: 1256 - protein, 161 aa, Arabidopsis thaliana
MSSKNGVVRSCLGSMDDIKKVFQRFDKNGDGKISVDELKEVIRALSPTASPEETVTMMKQFDLDGNGFIDLDEFVALFQIGIGGGGNNRNDVSDLKEAFELYDLDGNGRISAKELHSVMKNLGEKCSVQDCKKMISKVDIDGDGCVNFDEFKKMMSNGGGA

SEQ ID NO: 1257 - DNA, 753 bp, Arabidopsis thaliana
atggctagatacgatcgagcaattactgtcttctcccccgacggtcacctctttcaagtcgaatacgcccttgaagccgtccgcaagggtaacgccgccgtcggtgtccgcggtaccgacaccgttgtcctcgccgtcgagaagaagtccacccccaagcttcaggattctagatcagccagaaaaattgtgagccttgacaatcacattgccttggcatgcgcggggctcaaggctgatgcccgagtcttgattaacaaagcaaggatcgagtgtcaaagccacaggcttacacttgaggaccctgtcactgttgagtacatcactcgctacattgctggccttcaacagaagtatacccaaagtggtggtgtcagacccttcggtctttctactcttatcgttggctttgacccttactctcgcctcccttccctatatcagactgatccttctgggactttctctgcttggaaagctaatgctaccggcagaaactccaactctattagggaattcctcgagaagaactacaaagaatcctctggccaagaaactattaaactcgctatccgtgctctgcttgaggtagttgagagtggcggaaagaacattgaggttgccgtaatgacacgggaggaaactgggctgcgccagctagaagaagctgaaattgatgcaatcgtggccaagatcgaagctgaaaaggcggccgcagaagcagccaagaaaggccctccaaaggaaacttga

SEQ ID NO: 1258 - protein, 250 aa, Arabidopsis thaliana
MARYDRAITVFSPDGHLFQVEYALEAVRKGNAAVGVRGTDTVVLAVEKKSTPKLQDSRSARKIVSLDNHIALACAGLKADARVLINKARIECQSHRLTLEDPVTVEYITRYIAGLQQKYTQSGGVRPFGLSTLIVGFDPYSRLPSLYQTDPSGTFSAWKANATGRNSNSIREFLEKNYKESSGQETIKLAIRALLEVVESGGKNIEVAVMTREETGLRQLEEAEIDAIVAKIEAEKAAAEAAKKGPPKET

SEQ ID NO: 1259 - DNA, 2766 bp, Arabidopsis thaliana
atgagatctcttctctttgtactatcactcatttgcttttgctctcaaacagcactttcatggaagaaggaagagtttcgcagctgtgaccaaactccattttgtaaacgcgctcgatctcgtactcccggcgcgtgttctctaattgtcggcgatgtttccatcactgatggagatctcgtagcgaagcttctaccgaaagcgcctaatcaaggcgatggggatcagatcaagccgttgattctttctctctcagtttacaaggatgggatcgtgcggcttaaaatcgatgaggaccattcgttgaacccgccgaagaagaggttccaagttcctgatgtggtagtgtctgagtttgaggagaagaagatctggctgcagaaagtagcgacggagacgatctctggagacactagtccgtcttcagtagtttatgtatccgatggttacgaggcggtggtgcgacacgatccgtttgaggtgtatgtgcgtgagaaatcaggtgatcgccgtcgcgttgtgtcattgaattctcatggattatttgattttgagcagttggggaggaaaactgaaggagataactgggaagagaaatttaggactcatacagattctagaccatctggtcctcaatctattagtttcgatgtttcgttttatgattccagtttcgtttatggaattcctgaacacgccactagcttcgcgttgaagcctaccaagggtcctggagttgaggaatctgaaccctacaggctttttaatctagatgtgtttgaatacgatcatgaatcaccgtttgggctttacgggtcgattccgttcatggtttcgcatgggaagtctggtaaaacttcaggatttttctggttgaatgctgcggaaatgcagattgatgtgttggctaatggttgggatgcagagagtggtatttctttgccttctagtcacagtaggatcgacacattctggatgagcgaggcagggattgtggatacattctttttcgttgggcctgagccaaaggatgttgtaaagcagtatgcaagtgtgacaggtacttcagccatgcctcagttgtttgccactggttatcatcaatgtaggtggaactacaaagatgaggaggatgtggcacaggtggactcgaaattcgatgaacacgatattccttatgatgttctctggcttgacattgagcatacagatgggaagagatactttacatgggatagtgtgttgtttcctcatccagaggagatgcaaaagaaattggctgcaaagggtaggaagatggtgaccattgtggatcctcatatcaagagggatgactcatacttcttacacaaagaggctactcagatgggatactatgttaaggattcatctggaaaagactttgatggttggtgctggcctggttcatcatcttacattgatatgttgagcccagagattagaaaatggtggggtgggaggttctcgtataagaactatgttggttcaactccatcattgtacacctggaatgacatgaatgagccttctgtattcaatggtcccgaggttactatgccaagagatgcattacatgttgggggtgttgaacacagagaagttcataacgcatatggatattacttccacatggcgacttccgatggacttgttatgcgtgaagaaggaaaggataggccttttgtattgtcaagagcaatctttcccggcactcaaagatacggagcaatttggactggagataacacagccgaatgggaacaccttagagtctccattccaatgatattgacacttggtcttactggaattacattctctggagctgatattggtgggttttttggaaatcctgaaccagaacttctagttaggtggtaccaagtgggtgcttactatccatttttcaggggtcatgctcatcacgataccaaaagacgagagccttggttgtttggtgaacggaacacagaactcatgagagatgccatacacactcgttacacactgctcccatacttctacacgttgttcagagaagcaaacgttacgggtgttcctgttgtacgcccattatggatggaattcccgcaagatgaagctacttttagcaacgatgaagccttcatggtcggtagtggtctactggttcaaggagtttacaccaagggaacaacgcaagcttccgtgtatttgcctggcaaagaatcatggtatgacttgagaaacggtaagacttacgttggaggcaagactcacaagatggatgctccagaggagagtattcctgcgtttcaaaaggcaggaaccatcatcccaaggaaggaccggtttaggcgaagttcctctcaaatggacaatgatccttatactttggtggtagctttgaacagttctcaagaagcagaaggtgaactctacatcgatgacggcaaaagctttgaattcagacgaggctcttacatccatcgtcgcttcgtcttctcaaagggtgttcttacatcaacgaacttagctcctccagaagctcgtctctcttcccaatgcttgatcgacagaattatcctcttgggacacagctcaggtccaaaatctgcgttggtggaaccgttgaatcaaaaggcagagattgagatgggacctctgcgaatgggtgggcttgtagcttcctcgggtacaaaggtgttgactatccgcaaaccgggtgttcgagtggaccaagactggaccgtaaagattctgtga

SEQ ID NO: 1260 - protein, 921 aa, Arabidopsis thaliana
MRSLLFVLSLICFCSQTALSWKKEEFRSCDQTPFCKRARSRTPGACSLIVGDVSITDGDLVAKLLPKAPNQGDGDQIKPLILSLSVYKDGIVRLKIDEDHSLNPPKKRFQVPDVVVSEFEEKKIWLQKVATETISGDTSPSSVVYVSDGYEAVVRHDPFEVYVREKSGDRRRVVSLNSHGLFDFEQLGRKTEGDNWEEKFRTHTDSRPSGPQSISFDVSFYDSSFVYGIPEHATSFALKPTKGPGVEESEPYRLFNLDVFEYDHESPFGLYGSIPFMVSHGKSGKTSGFFWLNAAEMQIDVLANGWDAESGISLPSSHSRIDTFWMSEAGIVDTFFFVGPEPKDVVKQYASVTGTSAMPQLFATGYHQCRWNYKDEEDVAQVDSKFDEHDIPYDVLWLDIEHTDGKRYFTWDSVLFPHPEEMQKKLAAKGRKMVTIVDPHIKRDDSYFLHKEATQMGYYVKDSSGKDFDGWCWPGSSSYIDMLSPEIRKWWGGRFSYKNYVGSTPSLYTWNDMNEPSVFNGPEVTMPRDALHVGGVEHREVHNAYGYYFHMATSDGLVMREEGKDRPFVLSRAIFPGTQRYGAIWTGDNTAEWEHLRVSIPMILTLGLTGITFSGADIGGFFGNPEPELLVRWYQVGAYYPFFRGHAHHDTKRREPWLFGERNTELMRDAIHTRYTLLPYFYTLFREANVTGVPVVRPLWMEFPQDEATFSNDEAFMVGSGLLVQGVYTKGTTQASVYLPGKESWYDLRNGKTYVGGKTHKMDAPEESIPAFQKAGTIIPRKDRFRRSSSQMDNDPYTLVVALNSSQEAEGELYIDDGKSFEFRRGSYIHRRFVFSKGVLTSTNLAPPEARLSSQCLIDRIILLGHSSGPKSALVEPLNQKAEIEMGPLRMGGLVASSGTKVLTIRKPGVRVDQDWTVKIL

SEQ ID NO: 1261 - DNA, 609 bp, Arabidopsis thaliana
atgagaccaccaatgagaggcggcgggggtttccgtggaaggggaggacgagacggtggtggtggcggtaggttcggtggaggaggcggtagattcggtggaggaggaggacgctttggtggtggaggcggtcgctttggtggttttagagacgaaggtcctcctagcgaagtcgtggaggttgcaactttcgttcatgcttgcgagggagatgctgtgaccaaactctcacaggagaagattcctcattttaacgctccgatctacctagagaacaagactcagattgggaaagtagatgaaatctttggcccaattaatgaatctttgttttctatcaaaatgatggaaggtattgtagccacctcgtattctccaggagataagttcttcatcgacccttacaagcttttgccactcgctcgattccttcctcagccaaagggtcagtcaacgggtggacgtggaggtgcaggtcgtggaagaggtgatagtagaggtcgtggaagaggtggatcatttagtagaggtagaggtgctccaagaggtggtagatttccaccacgcggtggctctcgtggaagctttagaggccgaggaagattttag

SEQ ID NO: 1262 - protein, 202 aa, Arabidopsis thaliana
MRPPMRGGGGFRGRGGRDGGGGGRFGGGGGRFGGGGGRFGGGGGRFGGFRDEGPPSEVVEVATFVHACEGDAVTKLSQEKIPHFNAPIYLENKTQIGKVDEIFGPINESLFSIKMMEGIVATSYSPGDKFFIDPYKLLPLARFLPQPKGQSTGGRGGAGRGRGDSRGRGRGGSFSRGRGAPRGGRFPPRGGSRGSFRGRGRF

SEQ ID NO: 1263 - DNA, 2757 bp, Arabidopsis thaliana
atgagtggtgttccaaagagatctcacgaagagggtgttactcatccatcttcttcttcatcagtagcaaaataccctcacgaggattctggatcttaccctaaatcgccgcatcagcctgtgacgccaccaccggctcaggttcatcataaccatcaacagccccatcagcatccccaatctcaatctcaatctcagcctcaacctcacctccaggcgcttcctcaccctcattctcattctcactcccattcaccacttgctgctgctgcttctgcttctgctccttatgaggttgaatctagaacggtggttaaggttgcgagaagcgagcctagagatggagagagacgctctcctctgcctcttgtctatcggtctccgtcgctgcccacaactgtttcttctagtgatcctcatttgactcacgcccctgtgccgatggagccgagagatggtgctaaggatggcagggaaattagggttgagagtagagaaaataggagtgatgggagagagatatatggtgagacaaagagggagattcagggtcctaagggagacagagatgtgaaatttgagagatcagtagatgactttagcggaaaaggtaataccggaagctatactaggaatgatgggagagagatgtatggtgagactaagagggagattcagggtcctaagagtgacagggatgccaagtttgagcgtccaggggatgattttagcgggaaaagtaatgccggtagctatactagggatacaaaatttgatagggagaatcaaaattataatgaacaaaagggggagattaagatggaaaaggaagggcatgctcacttggcttggaaagagcagaaggattaccatagagggaagagagttgctgaaggttcgactgcaaatgtggacccgtgggttgtatcccgcggtaatccgcaaggcccaactgaggttgggcctaaagatctctctgcgcctgtggaggggtctcatttggaaggacgtgaaaccgtcggagaaaacaaggttgatgccaaaaacgaagatagatttaaggaaaaagataagaaaagaaaagagttaaagcatcgagaatggggggaccgagacaaggatagaaatgaccgtcgagtatctgtgcttgttggtagtgtcatgagtgaacccaaagagattggaagagaagaaagggaatccgataggtgggaacgggagaggatggagcagaaagatcgagaaagaaataaagagaaagataaagatcatatcaaaagagagccaaggactggtgctgagaaagagatctcgcagaacgagaaagagctgggagaagcatctgccaaaccctcagagcaggaatatgtggcaccagagcagaagaagcagaacgaaccggataattgtgaaaaagacgaaagagaaacaaaggaaaaaaggagagagagggatggtgattcagaggcagaaagagctgaaaagcgcagcagaatcagtgaaaaagaatctgaagatgggtgtttagagggtgaaggagctaccgagagggaaaaggatgccttcaattatggggttcagcagaggaagagagcgctgagaccgagaggcagcccacaaaccactaatcgcgacaatgtccgctcacggagtcaggacaacgaaggagtacaaggcaagtcagaggtgtcgattgttgtttacaaagttggcgaatgtatgcaagaactgattaagttgtggaaagaatatgatttgtctcatcctgataaaagcggtgatttcgctaataatggccccactcttgaagttaggattccagctgagcatgttactgctacaaatcgccaagtaagaggtggccaactatggggaacagatatatacacagacgattccgatcttgttgctgttctcatgcatacaggttactgtcgtcccacagcttctcctcctccaccgacaatgcaagagctgcgcactactattagagtcttgccgtcacaagattactacacctccaagctaaggaacaatgtccgttctcgagcatggggagctggaatcggatgcagttatagagttgagcggtgctatatactgaagaaaggaggtgggactattgaactggaaccttcccttacacactcctcaactgtggagccaactcttgcaccaatggctgttgaaagatctatgaccaccagagctgcagcttcgaatgctctgcggcaacaaaggtttgtacgagaagtcacaatacaatacaatctctgcaatgaaccttggattaaatatagcataagcattgttgctgataaaggtctcaagaagcctcttttcacctctgcccgcttgaagaaaggggaagttttgtacttagaaactcattcatgcaggtatgagctctgtttcgcaggagagaagaccatcaaagcaatccaagcctcacaacaacaatcatcacatgaagctatggagacagataataataataacaagtcacagaaccatctgacaaacggtgacaaaacagattcagacaacagtttaattgatgttttccgctggtcacgatgtaagaaacctctcccacagaagcttatgcggtctatcgggtttccactcccagcagatcatatcgaggtgttggaggagaatcttgattgggaagatgtacagtggtcacaaactggtgtttggattgctggaaaagagtacactcttgctcgtgttcattttctctcccccaactaa

SEQ ID NO: 1264 - protein, 918 aa, Arabidopsis thaliana
MSGVPKRSHEEGVTHPSSSSSVAKYPHEDSGSYPKSPHQPVTPPPAQVHHNHQQPHQHPQSQSQSQPQPHLQALPHPHSHSHSHSPLAAAASASAPYEVESRTVVKVARSEPRDGERRSPLPLVYRSPSLPTTVSSSDPHLTHAPVPMEPRDGAKDGREIRVESRENRSDGREIYGETKREIQGPKGDRDVKFERSVDDFSGKGNTGSYTRNDGREMYGETKREIQGPKSDRDAKFERPGDDFSGKSNAGSYTRDTKFDRENQNYNEQKGEIKMEKEGHAHLAWKEQKDYHRGKRVAEGSTANVDPWVVSRGNPQGPTEVGPKDLSAPVEGSHLEGRETVGENKVDAKNEDRFKEKDKKRKELKHREWGDRDKDRNDRRVSVLVGSVMSEPKEIGREERESDRWERERMEQKDRERNKEKDKDHIKREPRTGAEKEISQNEKELGEASAKPSEQEYVAPEQKKQNEPDNCEKDERETKEKRRERDGDSEAERAEKRSRISEKESEDGCLEGEGATEREKDAFNYGVQQRKRALRPRGSPQTTNRDNVRSRSQDNEGVQGKSEVSIVVYKVGECMQELIKLWKEYDLSHPDKSGDFANNGPTLEVRIPAEHVTATNRQVRGGQLWGTDIYTDDSDLVAVLMHTGYCRPTASPPPPTMQELRTTIRVLPSQDYYTSKLRNNVRSRAWGAGIGCSYRVERCYILKKGGGTIELEPSLTHSSTVEPTLAPMAVERSMTTRAAASNALRQQRFVREVTIQYNLCNEPWIKYSISIVADKGLKKPLFTSARLKKGEVLYLETHSCRYELCFAGEKTIKAIQASQQQSSHEAMETDNNNNKSQNHLTNGDKTDSDNSLIDVFRWSRCKKPLPQKLMRSIGFPLPADHIEVLEENLDWEDVQWSQTGVWIAGKEYTLARVHFLSPN

SEQ ID NO: 1265 - DNA, 1236 bp, Arabidopsis thaliana
atgaatgctttagcagcaacaaacagaaacttcaagttagctgctaggcttcttggtctggattctaagctcgagaaaagtcttctcatccccttccgagaaatcaaggtggaatgtaccataccgaaagacgatggtacactagcatcattcgttgggttcagagttcaacacgacaatgcaagaggtcccatgaaaggtggaatcagatatcatcctgaggttgatccggatgaagtgaacgcattggctcagctcatgacatggaaaacagcagtggctaagattccttacggaggagctaaaggagggattggttgtgatcctagcaagctcagtatctccgagctcgagcggttgactcgagttttcactcagaagattcatgatctcattgggattcatactgatgttccagctccagatatgggcactggtcctcagacaatggcttggattcttgatgaatactctaagtttcatggatactcgcctgcagttgtgactggaaaacccattgatcttggtggatcgctagggagagacgcggctactggaagaggagtgatgtttggtaccgaagctttgcttaacgagcacggaaagaccatatcagggcagcgttttgtcatccagggatttggtaatgtgggttcttgggcggcaaagctgataagtgaaaagggtgggaagattgttgccgtgagtgacattaccggagcaatcaagaacaaggatggtatcgatatcccggccttgctcaagcatactaaagaacacagaggtgtcaaagggtttgatggtgcagatccgatcgatccaaactccatactggttgaggattgtgatatcctcgtccctgcagcacttggtggtgtcatcaacagggagaatgcgaatgagattaaagcaaagttcatcatagaagcagctaatcatccaactgatccggacgcggatgagatcctaagtaagaaaggtgtggttattctcccggacatatatgcaaactctggaggagtcactgtaagttacttcgaatgggttcagaacattcaaggctttatgtgggaggaagagaaggtgaacgatgagctaaagacttacatgactcgctctttcaaggacttgaaagagatgtgcaaaactcactcttgcgatctccggatgggagctttcacactcggtgttaatcgtgtggctcaagctaccattctcagaggctggggagcttaa

SEQ ID NO: 1266 - protein, 411 aa, Arabidopsis thaliana
MNALAATNRNFKLAARLLGLDSKLEKSLLIPFREIKVECTIPKDDGTLASFVGFRVQHDNARGPMKGGIRYHPEVDPDEVNALAQLMTWKTAVAKIPYGGAKGGIGCDPSKLSISELERLTRVFTQKIHDLIGIHTDVPAPDMGTGPQTMAWILDEYSKFHGYSPAVVTGKPIDLGGSLGRDAATGRGVMFGTEALLNEHGKTISGQRFVIQGFGNVGSWAAKLISEKGGKIVAVSDITGAIKNKDGIDIPALLKHTKEHRGVKGFDGADPIDPNSILVEDCDILVPAALGGVINRENANEIKAKFIIEAANHPTDPDADEILSKKGVVILPDIYANSGGVTVSYFEWVQNIQGFMWEEEKVNDELKTYMTRSFKDLKEMCKTHSCDLRMGAFTLGVNRVAQATILRGWGA

SEQ ID NO: 1267 - DNA, 591 bp, Arabidopsis thaliana
atggccaccgcgatacctctcttcgcctctttcaagtatgccgatagtctcaccgtcgttggaatctctttctgcacggcgttggtctgcgaagcaatctcatggatcctaatctatcgcacaagctcttacaaatcgttgaaatcttccattgacaaagcctctaagaagcttgagacgatgaagacagataatccttcctcgaagctaacaaacaagaaatcgaagacgaagaagatagatcgcgttgaatccagcttaaaggaatcgagcagagatctatcactcttcaagtttaaatctggtgccgttgtggctttggttctctttgtcgtgtttggattgttgaattcgcttttcgaagggaaagtggtagcgaagcttccgtttcatccgattacgattgtgaggaagatgagtcatagaggattgaaaggcgatgattccactgattgttccatggcttttctttatctgctttgttctattagtataaggactaatctgcagaagttcttgggtttctctccacctagaggagctgctggtgctggtggtttgttcccaatgcctgatccaaagaccaattga

SEQ ID NO: 1268 - protein, 196 aa, Arabidopsis thaliana
MATAIPLFASFKYADSLTVVGISFCTALVCEAISWILIYRTSSYKSLKSSIDKASKKLETMKTDNPSSKLTNKKSKTKKIDRVESSLKESSRDLSLFKFKSGAVVALVLFVVFGLLNSLFEGKVVAKLPFHPITIVRKMSHRGLKGDDSTDCSMAFLYLLCSISIRTNLQKFLGFSPPRGAAGAGGLFPMPDPKTN

SEQ ID NO: 1269 - DNA, 2496 bp, Arabidopsis thaliana
atggcgcaacccctcgtgaagaaagacgatgatcacgacgatgagttggagtattctccattcatgggaattgagaaaggagcggttcttcaagaggctagagtctttaatgaccctcaggttgatcctagacgatgctcccaggtcattacgaagcttctttatttgcttaaccaaggggagtcattcaccaaggttgaagcaacggaagttttcttttcagttacaaagctttttcaatcaaaagacacgggtttgaggagaatggtctacttgatcattaaggagttatctccatcatctgatgaggttatcatcgtaacaagctctctgatgaaggatatgaatagtaaaattgatatgtatcgagcaaatgctatccgtgtcctctgccggataatagacggaacccttctcactcagattgagcgatacttgaaacaagccattgtggataagaatcccgttgtttcaagtgcagctttagtcagtgggcttcacttgctcaagacaaacccagaaattgttaaaagatggagcaatgaagttcaagaaggtattcaatccagatcagcccttgttcagttccatgccctagctttgctccatcagatacgccaaaatgatcgcttggctgttagcaaattggttggtagcttgaccaggggatctgtccgctctcccttggctcagtgtcttttgatacaacgtccgttctatgaatttttggagagttgcctgcgccataaggcagaaatggtgatccttgaggctgccagggcaattactgagcttgatggtgtgacaagccgagaactgactccagcaatcactgttcttcagctctttttgagttcccccagaccagtgttgagatttgccgctgtccggactctgaacaaggttgcaatgactcatcctatggctgtcaccaactgcaacattgatatggagagtttaatctctgatcaaaatagaagcattgctacactcgcaataaccacactattgaaaacagggaacgaatcaagtgtagaacgtttgatgaagcagataactaattttatgtcagatattgctgatgagttcaaaattgtggtcgtggacgcaataagatcgttgtgtgtgaaattcccactgaaatacagatccttgatgaccttcttaagcaacattcttagggaagaaggtggatttgagtataaaagagcaatagtagattctattgtgaccattatcagagatattccggatgcaaaggaaagtggactgcttcatctatgtgaattcattgaagattgtgaattcacatatctttcaacacagatccttcattttctgggaattgaggggcctaacacctcagatccaagcaagtatatacgatatatatataatcgtgtgcatctagaaaacgccactgtccgggctgctgctgtttccacacttgcaaagtttgggtttatggttgaatccttgaagccccggattactgttctattgaagcgttgcatctatgacagtgatgatgaggtccgtgatagggcaacactatatttgagtgagccctctgaagaagcttttgatatcaactccgtacctaaggaagttaaatctcagccccttgcagagaagaaagcccagggtaaaaagcccactggtcttggtgcaccaccagctgcacctgcttctggttttgatggctatgaaagacttctctcatccattccagagtttgccgcctttggaaaacttttcaagtcttctttacctgtggagctaactgaagcagaaacagaatacgctgtcaatgttgttaagcatatctttgacagtcatgtggtgtttcagtacaactgcactaacacaataccagagcagttgttggagagggtactgaacattgaagctgaggaattcagtgaagtaacttcaaaggccctaaactcacttccttacgattcacccggtcaagcctttgtggtttttgagaagccagctggggtccctgctgttggaaagttctccaacacattgactttcgttgttaaggaggtacatgttgacccaagcacaggtgaagcagaagatgatggagtagaagatgagtaccagctagaggatcttgaggttgtagctggagattacatggtgaaagtgggtgtctccaatttcaggaatgcgtgggaaagcatggatgaagaagatgagcgtgtagacgaatatggccttggccaaagagagagtttgggagaagctgtaaaggctgtcatggatcttcttggcatgcagacttgtgaggggacggagacaattccgctcaatgcaaggtcacacacgtgtctattgtcaggtgtgtacataggcaacgtgaaagtgttagtgagggcacagtttggaatggacagctcaaaggacattgcaatgaagctgacagttagagctgaagacgtttctgtcgccgaggccattcacgagattgttgccagcggctaa

SEQ ID NO: 1270 - protein, 831 aa, Arabidopsis thaliana
MAQPLVKKDDDHDDELEYSPFMGIEKGAVLQEARVFNDPQVDPRRCSQVITKLLYLLNQGESFTKVEATEVFFSVTKLFQSKDTGLRRMVYLIIKELSPSSDEVIIVTSSLMKDMNSKIDMYRANAIRVLCRIIDGTLLTQIERYLKQAIVDKNPVVSSAALVSGLHLLKTNPEIVKRWSNEVQEGIQSRSALVQFHALALLHQIRQNDRLAVSKLVGSLTRGSVRSPLAQCLLIQRPFYEFLESCLRHKAEMVILEAARAITELDGVTSRELTPAITVLQLFLSSPRPVLRFAAVRTLNKVAMTHPMAVTNCNIDMESLISDQNRSIATLAITTLLKTGNESSVERLMKQITNFMSDIADEFKIVVVDAIRSLCVKFPLKYRSLMTFLSNILREEGGFEYKRAIVDSIVTIIRDIPDAKESGLLHLCEFIEDCEFTYLSTQILHFLGIEGPNTSDPSKYIRYIYNRVHLENATVRAAAVSTLAKFGFMVESLKPRITVLLKRCIYDSDDEVRDRATLYLSEPSEEAFDINSVPKEVKSQPLAEKKAQGKKPTGLGAPPAAPASGFDGYERLLSSIPEFAAFGKLFKSSLPVELTEAETEYAVNVVKHIFDSHVVFQYNCTNTIPEQLLERVLNIEAEEFSEVTSKALNSLPYDSPGQAFVVFEKPAGVPAVGKFSNTLTFVVKEVHVDPSTGEAEDDGVEDEYQLEDLEVVAGDYMVKVGVSNFRNAWESMDEEDERVDEYGLGQRESLGEAVKAVMDLLGMQTCEGTETIPLNARSHTCLLSGVYIGNVKVLVRAQFGMDSSKDIAMKLTVRAEDVSVAEAIHEIVASG

SEQ ID NO: 1271 - DNA, 1059 bp, Arabidopsis thaliana
atggagagagattttctcgggttgggttcgaaaaattctccgatcactgtcaaggaggaaaccagcgaaagctctagagattcagctcccaacagaggaatgaactggtctttctcaaacaaagtatcagcttcttcttctcagtttctatccttcaggccaactcaagaagatagacatagaaagtctggaaattatcatcttcctcactctggttccttcatgccatcatcagtagctgatgtttatgattcaacccgcaaagctccttacagttctgtacagggagtgaggatgttccctaattccaatcaacacgaagaaactaacgcagtttccatgtcgatgccgggtttccagtctcatcattatgcaccaggaggaagaagcttcatgaacaataacaataactcacaacctttggtaggagttcctatcatggcacctccaatttcaatccttcctcctccaggttccattgtagggactactgatattagatcttcttccaagccaataggttcacctgcgcagttgacgatcttttatgccggttcagtttgtgtttacgatgacatatctcctgaaaaggcaaaggcgataatgttgctagctgggaacggttcctctatgcctcaagtcttttcgccgcctcaaactcatcaacaagtggtccatcatactcgtgcctctgtcgattcttcagctatgcctcctagcttcatgcctacaatatcttatcttagccctgaagctggaagtagcacaaacggactcggagccacaaaagcgacaagaggcttgacgtcaacatatcacaacaaccaagctaatggatccaatattaactgcccagtaccagtttcttgttctaccaatgtaatggctccaacagtggcattacctctggctcgcaaagcatccctggctaggtttttagagaaacgcaaagaaagggtcacgagcgtatccccatattgcttagacaagaagtcatcgacagattgtcgcagatcaatgtctgaatgcattagttcttctctcagctctgcaacctaa

SEQ ID NO: 1272 - protein, 352 aa, Arabidopsis thaliana
MERDFLGLGSKNSPITVKEETSESSRDSAPNRGMNWSFSNKVSASSSQFLSFRPTQEDRHRKSGNYHLPHSGSFMPSSVADVYDSTRKAPYSSVQGVRMFPNSNQHEETNAVSMSMPGFQSHHYAPGGRSFMNNNNNSQPLVGVPIMAPPISILPPPGSIVGTTDIRSSSKPIGSPAQLTIFYAGSVCVYDDISPEKAKAIMLLAGNGSSMPQVFSPPQTHQQVVHHTRASVDSSAMPPSFMPTISYLSPEAGSSTNGLGATKATRGLTSTYHNNQANGSNINCPVPVSCSTNVMAPTVALPLARKASLARFLEKRKERVTSVSPYCLDKKSSTDCRRSMSECISSSLSSAT

SEQ ID NO: 1273 - DNA, 588 bp, Arabidopsis thaliana
atgttccttttgattctccttgtgttctgtataacagtttttgcctttgttgttactaacaaaggagctggtgaagctattgaaggaaaaggttataaagagtataaacttggtgattactctacttggttacagaaacgtgttgagaatggtaaaaattggaataagattaggagttgtcttgtggagagcaaagtttgttctaagcttgaagccaagtttgttaatgttcctgtcaatagtttctacaaggaacatcttactgctcttcagtctggttgctgcaaaccttcagatgaatgtggtttcgagtacgtaaacccaacaacctggaccaagaacacaacgggaacacacactaatccagactgccaaacctgggacaacgcaaaagaaaagctctgcttcgattgtcaatcttgtaaagcgggtctactcgacaacgtcaaaagcgcttggaagaaagttgcaatcgttaacatcgtcttccttgtcttcctcatcattgtctactctgttggttgctgtgctttcaggaacaacaagagggatgacagttattcccgtacctacggatataagccttga

SEQ ID NO: 1274 - protein, 195 aa, Arabidopsis thaliana
MFLLILLVFCITVFAFVVTNKGAGEAIEGKGYKEYKLGDYSTWLQKRVENGKNWNKIRSCLVESKVCSKLEAKFVNVPVNSFYKEHLTALQSGCCKPSDECGFEYVNPTTWTKNTTGTHTNPDCQTWDNAKEKLCFDCQSCKAGLLDNVKSAWKKVAIVNIVFLVFLIIVYSVGCCAFRNNKRDDSYSRTYGYKP

SEQ ID NO: 1275 - DNA, 1530 bp, Arabidopsis thaliana
atgagcggttctaggataaaagttgctgggagatttttaccctgtgtgcacatgggctgttttgaccttgatgtgtttgtggagttgaatcaacgttccagaaagtggcagtgccctatttgtctgaagaactactcagtggagcatgtaatcgtcgatccttattttaaccgtatcacgtctaagatgaagcattgtgatgaagaggtgactgaaattgaagtgaaacctgatggttcttggcgtgtaaagttcaaaagagagagtgagcgaagggaactgggggaactctcacagtggcatgcacctgatggtagcctttgcccctctgctgttgatattaaacggaagatggaaatgttaccggttaagcaagaaggttactcagatggtccagccccgctaaaacttggaataaggaagaatcgtaatggcatttgggaagttagcaaacctaatacaaatggattatcttccagtaataggcaagaaaaggttgggtatcaggagaagaatattataccaatgagtagtagtgctactggaagtggtagggatggtgatgatgcaagcgtaaaccaggatgctattggaacttttgactttgtagccaacggcatggaacttgattccatttccatgaatgttgattcaggttataactttcctgacagaaaccaatctggcgagggtggaaataatgaagtcatcgttctgagtgattctgatgacgagaatgatttagtgatcactccagggcctgcatacagtggttgtcaaacagatggtggacttacttttccactgaaccctcctggaataattaactcatataatgaggacccacacagcatagctgggggaagttcaggcttaggtcttttcaatgatgatgatgaatttgatacgcccctttggtcatttccttctgaaactccagaagcccctgggttccaactatttagatctgatgctgacgtttcaggaggtttagttggtttgcatcatcatagtccactaaactgttctcctgaaataaatggaggttataccatggctcctgagacatcaatggcatctgttcctgtggttcctggctctactggccgatctgaagcaaacgatggcctagttgacaatcctcttgcatttggtagagacgatccctcacttcaaatatttttgccaacaaaaccagatgcttcagctcagtcgggttttaaaaaccaagctgatatgtcaaatggtctccgtagtgaagactggatctcgcttaggctaggcgatagcgcctctgggaatcatggagatcctgcaactacaaacgggattaactcaagccatcagatgtctacgagggaaggttctatggatactacaacagagactgcgtcgttgcttctgggtatgaatgacagtagacaagacaaggcaaagaagcaaagatcagataatccattttcatttcctcgccagaagcgttctgtaagacctcggatgtacctctccattgactcggattctgagtaa

SEQ ID NO: 1276 - protein, 509 aa, Arabidopsis thaliana
MSGSRIKVAGRFLPCVHMGCFDLDVFVELNQRSRKWQCPICLKNYSVEHVIVDPYFNRITSKMKHCDEEVTEIEVKPDGSWRVKFKRESERRELGELSQWHAPDGSLCPSAVDIKRKMEMLPVKQEGYSDGPAPLKLGIRKNRNGIWEVSKPNTNGLSSSNRQEKVGYQEKNIIPMSSSATGSGRDGDDASVNQDAIGTFDFVANGMELDSISMNVDSGYNFPDRNQSGEGGNNEVIVLSDSDDENDLVITPGPAYSGCQTDGGLTFPLNPPGIINSYNEDPHSIAGGSSGLGLFNDDDEFDTPLWSFPSETPEAPGFQLFRSDADVSGGLVGLHHHSPLNCSPEINGGYTMAPETSMASVPVVPGSTGRSEANDGLVDNPLAFGRDDPSLQIFLPTKPDASAQSGFKNQADMSNGLRSEDWISLRLGDSASGNHGDPATTNGINSSHQMSTREGSMDTTTETASLLLGMNDSRQDKAKKQRSDNPFSFPRQKRSVRPRMYLSIDSDSE

SEQ ID NO: 1277 - DNA, 2643 bp, Arabidopsis thaliana
atggaagctaattcagctgatcagaaacaaaaacctaactttcttgttgaggttaataacattgagaaacagctatggacattaatccattcaaagactatattgcataccgatgtttcagaattatacgcgaaagctggttcgacctacgagcaaatctttaaaagcaatctccaacacgaagagcttcaagaagtagagttctgtctctggaaactccactataaacacatcgatgagtttcgtaaaggccttaaaacaaatgatcatgccaagcatatgaaagcattcaagttgtttctgtcaaaagcagctgagttttaccagaatctgatttccaaagtcagaggatattaccacagactctccgaggaatcaggagagcaaaaaagcagattcttatgccatcgtttctacatttgtcttggagatcttcaaaggtatcaagaacaatatctgaaagcacatgaacatcctaattggtcaactgcagctacttactatcttgaagctgcaaaatcttggcctgatagtggaaatcctcataaccagctagctgtattggccacatatgttagtgatgagttattggctctgtatcactgcgtaagaagcttagctgtgaaagagccttttcctggtgcttcgaacaatcttcttttgttgtttgagaagaacaggtcatctccattgcagtctctgtctactgatgcagagtttaactacttaaacccatcagagaaaaaagtttctgtgaaggaacgagatttgtcaaaagcaaaaggagaactagttgccggaattgatttatggcccctggttgttcgaacaactagcttctttttccttaaatccagttttgatgagtttggtcgggcatttgcatcaactataagagaactggatgcagcgtttgcagcagatgatagaaatctagaagccatgttggagtcttatcaatttatggacacggcgagaaagggaccttataaaatcctccaaattgttgcggtttttatctacatcttccacaatttagcagaggctaatggatccgacatcgtgaaagaggaagttaagctaacaaatttagcattaactatggtgtttatcgtcatggggcgagttgttgagagatgtttgaagacaactcccttggattcttgccctctcttacctgctctacttgtatttctagactacttaccgtttctgcttgacaaggtagaagaagaagaagaagaatgcaggtttgatgagaagagcaagagtgcaatatcttacttctttggcaaactcgttgatatcttgaaccagttaaaggtgaaagacaaaaactgccctgctaaaacgttgttagctctctgggaagatcatgaactgaagtccttggctcctctggctcccatacatgcacttttggatttctcaagtaatatggatcttagagagagttttgatagagggaaggagcttcgtcttcaacggattattagttcagcaattgatatcacaactaggcagaagaagggttctcaaaagtggctattctttgacaatcaacggactcatttctacacaacttcgggtgaattgcaaagcaacggagagctctttcatggaaatggagagggtagaaacagaaaatgcgttactattggaccagttgaaatcattcctttggagaatgaaagatctgttcctgtagaagaggaagaagtcattcttctcaagccgctcgtaaggtgtcaatctgctccaatatattcttctggcattgcagcaaagccacttagctctgattgcacaacttcaggaaatcaaacaactacatccaatgacagcctaagacgtaccttatcactcattgggtctgaaagtttcagctttacgcaaggtcttaaggacacggatccacaacatttgcatctcgaagaaggcactgtctcaggaagacctccatcgctgagcgcgtgggtggttgacaagaacaaagagaaaggacgactcggtttaagtaaaccaaacggattgggccctattgatgaaacaggtcctgtctcagcctttgatagtctctccatcaatagcagcaccgagcatcctgcgtcttcctattcgcctcctactccgtctgctccactactgcctgaagacgcttcttggtttcataatgacgctagtactaacaaagcagagagcttctatgatcagacacgatatatggaactccccggtatcatgaagccatacacaaacccaccctttgttgggatttcttcttctgaatggttacgtcggtacagagaaagtaggaatcttggaccagcctattcctatcaagctcagggaacaaacaatttgagaaactttatggctcatggctcttccaagttcagtctcttagctaggtacgggacaccaaacgattcttctcaaaactcaacgtttcaccctcagctctacatggaagaccatgaatctagaggagagaagctcggcaacgttcaacaaagcacaacaaatccttatggcttcagtgacgatcccggaccgtttcttagatttctgagagaaaaagagtggctgaatgagaacggtcagaggctaagaggacctcctcctgcatatatgaacaactaa

SEQ ID NO: 1278 - protein, 880 aa, Arabidopsis thaliana
MEANSADQKQKPNFLVEVNNIEKQLWTLIHSKTILHTDVSELYAKAGSTYEQIFKSNLQHEELQEVEFCLWKLHYKHIDEFRKGLKTNDHAKHMKAFKLFLSKAAEFYQNLISKVRGYYHRLSEESGEQKSRFLCHRFYICLGDLQRYQEQYLKAHEHPNWSTAATYYLEAAKSWPDSGNPHNQLAVLATYVSDELLALYHCVRSLAVKEPFPGASNNLLLLFEKNRSSPLQSLSTDAEFNYLNPSEKKVSVKERDLSKAKGELVAGIDLWPLVVRTTSFFFLKSSFDEFGRAFASTIRELDAAFAADDRNLEAMLESYQFMDTARKGPYKILQIVAVFIYIFHNLAEANGSDIVKEEVKLTNLALTMVFIVMGRVVERCLKTTPLDSCPLLPALLVFLDYLPFLLDKVEEEEEECRFDEKSKSAISYFFGKLVDILNQLKVKDKNCPAKTLLALWEDHELKSLAPLAPIHALLDFSSNMDLRESFDRGKELRLQRIISSAIDITTRQKKGSQKWLFFDNQRTHFYTTSGELQSNGELFHGNGEGRNRKCVTIGPVEIIPLENERSVPVEEEEVILLKPLVRCQSAPIYSSGIAAKPLSSDCTTSGNQTTTSNDSLRRTLSLIGSESFSFTQGLKDTDPQHLHLEEGTVSGRPPSLSAWVVDKNKEKGRLGLSKPNGLGPIDETGPVSAFDSLSINSSTEHPASSYSPPTPSAPLLPEDASWFHNDASTNKAESFYDQTRYMELPGIMKPYTNPPFVGISSSEWLRRYRESRNLGPAYSYQAQGTNNLRNFMAHGSSKFSLLARYGTPNDSSQNSTFHPQLYMEDHESRGEKLGNVQQSTTNPYGFSDDPGPFLRFLREKEWLNENGQRLRGPPPAYMNN

SEQ ID NO: 1279 - DNA, 1143 bp, Arabidopsis thaliana
atggctgatgataaggagatgcctgctgctgtagttgatggacatgatcaagtcactggtcatattatttccaccacaatcggtggcaaaaatggtgaaccaaaacagacaattagttacatggcggagcgagttgttggtacaggctcgttcgggatcgttttccaagcaaaatgtttggagactggagaaaccgtggcgataaagaaggttttgcaagatagaagatacaagaaccgagaacttcagttgatgcgtgtgatggatcatccgaatgtggtttgtttgaagcattgcttcttttcgactacaagtaaagacgagcttttcttgaacttggttatggagtatgtccctgagagcttgtatcgagttctgaaacattatagtagtgcaaaccaaagaatgcctcttgtctatgttaaactttacatgtatcagatcttccggggacttgcttacattcacaatgttgctggagtttgtcacagagatctaaagcctcaaaatcttctggttgatcctcttactcatcaagtcaaaatctgtgactttggcagtgcgaaacagctcgttaaaggtgaagccaacatttcttacatctgctcacgattctaccgtgcacccgagctcatatttggtgccactgagtacacaacttctattgatatctggtctgctggttgtgttcttgctgagcttcttcttggtcagccattatttcccggagaaaatgctgtggatcagctcgttgaaattataaaagttcttggtacaccaactcgagaagaaatccgttgtatgaatccacattacacagatttcaggtttccacagataaaggcacatccctggcacaagatcttccacaaaaggatgcccccagaagcgattgattttgcatcaaggctgcttcaatactctccaagtctaagatgcacagcgctcgaagcttgtgcacatccgttctttgatgaactcagagaaccaaacgctcgtttaccaaatggacggcctttcccgcctctcttcaacttcaaacaagaagtagctggatcatcacctgaactggtcaacaagttgattccagaccatatcaagagacaattgggtctaagcttcttgaatcaatctggaacttaa

SEQ ID NO: 1280 - protein, 380 aa, Arabidopsis thaliana
MADDKEMPAAVVDGHDQVTGHIISTTIGGKNGEPKQTISYMAERVVGTGSFGIVFQAKCLETGETVAIKKVLQDRRYKNRELQLMRVMDHPNVVCLKHCFFSTTSKDELFLNLVMEYVPESLYRVLKHYSSANQRMPLVYVKLYMYQIFRGLAYIHNVAGVCHRDLKPQNLLVDPLTHQVKICDFGSAKQLVKGEANISYICSRFYRAPELIFGATEYTTSIDIWSAGCVLAELLLGQPLFPGENAVDQLVEIIKVLGTPTREEIRCMNPHYTDFRFPQIKAHPWHKIFHKRMPPEAIDFASRLLQYSPSLRCTALEACAHPFFDELREPNARLPNGRPFPPLFNFKQEVAGSSPELVNKLIPDHIKRQLGLSFLNQSGT

SEQ ID NO: 1281 - DNA, 1272 bp, Arabidopsis thaliana
atggcaacggcgatggcggaggatacgagcttcgagggagaccaactagcttccatgactactgatgacatcggtagagcttctcgtctcttagccaacgagattcgcatcctcaaggaagaatcgcagaggacaaaccttgatttggaatcagtgaaggagaaaataaaggagaaccaggagaagattaagcttaacaaacagcttccttacttagttggcaatatcgttgagattcttgagatgagtccagaggatgatgcagaggaagatggagcgaatatcgatctggactctcagaggaagggaaagtgtgtcgttctaaaaacatcaactcgtcagaccatcttcctccctgttgttggacttgttgatccagatacattgaagcctggggacttagttggagttaacaaagatagttacttgattctggatactttaccttctgagtatgattcaagagtaaaagcaatggaggtcgacgaaaaacctactgaagactacaatgatatagggggactagaaaaacagatacaagaacttgttgaagccattgtgttgccaatgactcataaagagcagttcgaaaagttgggtatccgtccaccaaaaggtgtactcttgtatggtcctcctggaaccggaaagacgttgatggcccgagcttgtgcagcacagacaaatgcaactttcctcaaactagcagggccacaacttgttcagatgttcatcggagatggagcaaaacttgtccgtgatgctttcctgcttgcaaaagagaaatccccttgtattatattcatagatgagattgacgcaatagggacaaagcgttttgatagcgaagttagtggagaccgtgaggtacaaaggacaatgttggagctgctcaaccagcttgatggattcagcagcgatgatcgcattaaggttattgcagcgacaaatcgtgctgatatactagatcctgcccttatgcgttctggtcgtttggatcgtaaaatcgagtttccgcaccccactgaagaagctagaggcaggatcttacagatacattcaaggaaaatgaatgtgaatgcagacgtcaattttgaagagcttgctcggtcaacggatgatttcaatggagctcaactcaaagcagtgtgtgttgaagcgggtatgcttgccctgcgccgggatgcaactgaggtgaaccatgaggatttcaatgaaggtataattcaagtacaagccaagaagaaagcaagcttgaattactacgcctaa

SEQ ID NO: 1282 - protein, 423 aa, Arabidopsis thaliana
MATAMAEDTSFEGDQLASMTTDDIGRASRLLANEIRILKEESQRTNLDLESVKEKIKENQEKIKLNKQLPYLVGNIVEILEMSPEDDAEEDGANIDLDSQRKGKCVVLKTSTRQTIFLPVVGLVDPDTLKPGDLVGVNKDSYLILDTLPSEYDSRVKAMEVDEKPTEDYNDIGGLEKQIQELVEAIVLPMTHKEQFEKLGIRPPKGVLLYGPPGTGKTLMARACAAQTNATFLKLAGPQLVQMFIGDGAKLVRDAFLLAKEKSPCIIFIDEIDAIGTKRFDSEVSGDREVQRTMLELLNQLDGFSSDDRIKVIAATNRADILDPALMRSGRLDRKIEFPHPTEEARGRILQIHSRKMNVNADVNFEELARSTDDFNGAQLKAVCVEAGMLALRRDATEVNHEDFNEGIIQVQAKKKASLNYYA

SEQ ID NO: 1283 - DNA, 1164 bp, Arabidopsis thaliana
atggaagctctcttcacttcaacacacacacccaatttacagactaagcctctcctcaaatctccgctgcccacttcttcccagtcttcgtgttggttttgtaattcgctacccaaaacgcaattcccgaagctgagactcagtaatggatcaagtcacgggcttcgtatacaagctctcttacgtaacgagacgccaagtgaaggtgaagataataatgggtttggtttttttcctggggatatcttctctttatcacaggaaaagctcgggagtaatagcaatggtgaaacttctcatagtgtaatcgatgtggaggcatctcttgcacatcctcaaggtggtggaggaaatcgagctgggctttttagaactccaatatctggtggtgttcaaaatgctacatcagctcatgctttacctcggcctgctttagctgtacggaacttgttggaacaggctaggtttgctcatctgtgcacagtgatgtccaaaatgcaccaccgcagggaagggtacccatttggctcattggtagattttgcacctgatcggatggggcatccaatatttttgttttcaccgctggccatccacacacgaaatctcttgaatgaacctagatgcagcctcgttgttcagatacccggatggagtggcttatcgaatgcaagagtgacattatttggtgatgtgtacccattgtcagaggatgaacaggagtgggcccataagcaatatattgcaaagcacccgcacgggccttcagagcaatggggaaactttcattattttagaatgcagaacataagtgatatatatttcattggaggctttggcacggtcgcttgggttgatgtcaaagagtatgaaggtttacaaccagataagatagctgttgatggtggtgagcggaacctcaaggaactaaatgccatcttctcgaaaccgctgagagagctactgtctactgaatcagaggtagacgatgctgctctcatttcaatagatagcaaaggaatagatgtacgggttcgtcaaggtgctcagtttaacatacaaaggctagcatttgaggaaggtcatggtgttgagacactagaagaagctaagtctgcattatggaaagtgttggagaaggtcaagctgaatttgcagaaatga

SEQ ID NO: 1284 - protein, 387 aa, Arabidopsis thaliana
MEALFTSTHTPNLQTKPLLKSPLPTSSQSSCWFCNSLPKTQFPKLRLSNGSSHGLRIQALLRNETPSEGEDNNGFGFFPGDIFSLSQEKLGSNSNGETSHSVIDVEASLAHPQGGGGNRAGLFRTPISGGVQNATSAHALPRPALAVRNLLEQARFAHLCTVMSKMHHRREGYPFGSLVDFAPDRMGHPIFLFSPLAIHTRNLLNEPRCSLVVQIPGWSGLSNARVTLFGDVYPLSEDEQEWAHKQYIAKHPHGPSEQWGNFHYFRMQNISDIYFIGGFGTVAWVDVKEYEGLQPDKIAVDGGERNLKELNAIFSKPLRELLSTESEVDDAALISIDSKGIDVRVRQGAQFNIQRLAFEEGHGVETLEEAKSALWKVLEKVKLNLQK

SEQ ID NO: 1285 - DNA, 2343 bp, Arabidopsis thaliana
atgtccgtcgacgatctccctccgtcgtcggcctccgccgtaacgccactaggctcctccgtgattccgattgtgaacaagctccaagacatattcgctcagctaggaagtcaatcgacgatcgctcttccgcaagtagctgtcgtcggaagtcaaagcagtggcaaatccagcgttctagaagctctcgtcggccgtgactttcttcctcgtggcaatgatatttgcacgcgccgacctctccgtctccagcttgttcagacgaaacctagctctgatggtggatccgatgaagagtggggcgagtttcttcaccacgatcctgttagacgtatctacgatttctctgagattcgccgtgagattgaggcggagactaatagagtatcaggagagaacaaaggtgtatcagatattccgattggtttgaagatattttcacctaatgttttggatattagtcttgtggatcttcctggtatcactaaggttcctgttggtgatcagccaagtgatatcgaagcgcgtataagaacgatgatcttgacttacattaaggaacctagttgcttgatacttgctgttagccctgctaatactgatttagcaaattcagatgcattacaaatcgcaggaaatgctgatcctgatggtcatagaaccataggtgtaatcacaaagttggatattatggacagaggtactgatgctcggaatcaccttctgggaaaaacaattcctcttcgacttggatacgtgggagttgtaaatcgtagtcaagaggatattttgatgaaccgtagcatcaaggatgctcttgttgcagaggaaaagttctttcgtagtcgtccagtttacagcggtctcacagatcgtttgggtgtccctcaactggcaaagaaattaaatcaggtccttgttcaacacatcaaggcactgcttcctagtttaaagtcacgtatcaacaatgcattgtttgctacagcaaaggagtatgagagctatggggatataacagagtctaggggtggtcaaggagctcttctcctcagttttattacaaaatactgcgaagcatactcctctaccctggaagggaaaagtaaagaaatgtcaacatctgagctctcgggtggagcaagaattctctacattttccaatcagtatttgttaagagcttagaggaggttgatccatgtgaagacttaacagctgatgatattcggactgcaatacaaaatgcaactggtcccagatctgcattatttgttccagatgttccatttgaagttcttgtcaggaggcaaatatctcgtttattagatcccagccttcagtgcgctaggttcatcttcgatgagctagtaaagattagtcatcagtgtatgatgaaagagttacagcggtttccagtcctgcaaaagcgcatggatgaggttattgggaactttctgcgagaaggtcttgaaccttcgcaggcaatgatccgagatcttattgaaatggagatggattatataaacacctcacacccaaattttatcgggggaactaaagccgtggagcaagcaatgcaaacagtcaaatcttctaggattccgcatcctgttgcgcggccaagggatactgtggagcctgagaggacggcttcttccgggagtcaaataaaaacccgatcttttctcggccgacaagctaatggaatcatcactgatcaggcagttccaactgcagcagatgctgaaagacctgcaccagctggaagcacaagctggagtggtttctcatcaatttttcgggggagtgatggtcaggcagctgctaaaaacaacctattaaacaaaccattcagcgaaactactcaagaagtgtatcagaacttgtcaacaatctatttaaaggagcctccaactattttgaagtcatctgaaactcattcagaacaggagtcagttgagattgagataacaaagctattattgaaatcctactatgacattgtaaggaagaatgtcgaggacttggtcccaaaagcaatcatgcattttctggtaaattacacgaaacgtgagctgcacaatgttttcatcgagaagctttacagggagaacttaattgaagaactgttgaaagagcccgatgagttagcgataaagaggaaacgcacgcaagagactcttcgcattcttcagcaggctaatcggacgttagacgagctgccgttagaagctgaatcggtcgagagaggttacaaaattggttcagaagcgaaacatgaggagttaccgggcacaagaagatcaaggacagaaactaatgggaacggacggcttcatatgtaa

SEQ ID NO: 1286 - protein, 780 aa, Arabidopsis thaliana
MSVDDLPPSSASAVTPLGSSVIPIVNKLQDIFAQLGSQSTIALPQVAVVGSQSSGKSSVLEALVGRDFLPRGNDICTRRPLRLQLVQTKPSSDGGSDEEWGEFLHHDPVRRIYDFSEIRREIEAETNRVSGENKGVSDIPIGLKIFSPNVLDISLVDLPGITKVPVGDQPSDIEARIRTMILTYIKEPSCLILAVSPANTDLANSDALQIAGNADPDGHRTIGVITKLDIMDRGTDARNHLLGKTIPLRLGYVGVVNRSQEDILMNRSIKDALVAEEKFFRSRPVYSGLTDRLGVPQLAKKLNQVLVQHIKALLPSLKSRINNALFATAKEYESYGDITESRGGQGALLLSFITKYCEAYSSTLEGKSKEMSTSELSGGARILYIFQSVFVKSLEEVDPCEDLTADDIRTAIQNATGPRSALFVPDVPFEVLVRRQISRLLDPSLQCARFIFDELVKISHQCMMKELQRFPVLQKRMDEVIGNFLREGLEPSQAMIRDLIEMEMDYINTSHPNFIGGTKAVEQAMQTVKSSRIPHPVARPRDTVEPERTASSGSQIKTRSFLGRQANGIITDQAVPTAADAERPAPAGSTSWSGFSSIFRGSDGQAAAKNNLLNKPFSETTQEVYQNLSTIYLKEPPTILKSSETHSEQESVEIEITKLLLKSYYDIVRKNVEDLVPKAIMHFLVNYTKRELHNVFIEKLYRENLIEELLKEPDELAIKRKRTQETLRILQQANRTLDELPLEAESVERGYKIGSEAKHEELPGTRRSRTETNGNGRLHM

SEQ ID NO: 1287 - DNA, 1782 bp, Arabidopsis thaliana
atggtggaacaaactgtggttagagaacatatcaaagcgagagtcatgtcattagtgaggtctgcagagccatcctcatataggaacccgaagctttacacgttgaatgagaatggtaataacaatggtgtcagttctgctcaaatctttgatccagataggtcaaagaatccttgtctgactgatgattcttacccaagccaaagttatgagaagtactttcttgattcgccaactgatgagtttgttcaacatcctattggctctggtgcctcggttagctcatttggctctttagactcatttccttatcagtcaagaccagttcttggatgttccatggaatttcagttaccgttggattcaacctctacttcatctacaaggcttttgggagattaccaagcggtttcttacagtccgagcatggatgtagtggaggagtttgatgatgagcaaatgagatcaaagattcaagagcttgaaagagcgcttctcggcgatgaagatgataaaatggttggaatagataacctcatggagattgacagcgaatggtcgtaccaaaacgaaagcgaacagcatcaagactcgcccaaagaatcatcgtctgcagattccaactctcatgtaagtagcaaagaagtggtgtctcaagccactccaaagcaaatcttgatatcttgtgctcgtgcgctatctgaaggaaaattagaagaagctttgtcaatggtaaatgagctgaggcagatagtttctatccaaggagacccttctcagagaatcgcagcttacatggtggaaggtctagctgcaagaatggccgcttcaggaaaattcatctacagagcattgaaatgcaaagagcctccttcggatgagaggcttgcagctatgcaagtcctgtttgaagtctgcccttgtttcaagttcgggtttttagcagctaatggtgcgatacttgaagcaatcaaaggtgaagaagaagttcacataatcgatttcgatataaaccaagggaaccaatacatgacactgatacgaagcattgctgagttgcctggtaaacgacctcgcctgaggttaacaggaattgatgaccctgaatcagtccaacgctccattggagggctaagaatcatcggtctaagactcgagcaactcgcagaggataatggagtatccttcaaattcaaagcaatgccttcaaagacttcgattgtctctccatcaacactcggttgcaaaccaggagaaaccttaatagtgaactttgcattccaacttcaccacatgcctgacgagagtgtcacaacagtaaaccagcgggacgagctacttcacatggtcaaaagcttaaacccaaagcttgtcacggtcgttgaacaagacgtgaacacaaacacttcaccgttctttcccagattcatagaggcttacgaatactactcagcagttttcgagtctctagacatgacacttccaagagaaagccaagagaggatgaatgtagaaagacagtgtctcgctagagacatagtcaacattgttgcttgcgaaggagaagaacggatagagagatacgaggctgcgggaaaatggagagcaaggatgatgatggctggattcaatccaaaaccaatgagtgctaaagtaaccaacaatatacaaaacctgataaagcaacaatattgcaataagtacaagcttaaagaagaaatgggtgagctccatttttgctgggaggagaaaagcttaatcgttgcttcagcttggaggtaa

SEQ ID NO: 1288 - protein, 593 aa, Arabidopsis thaliana
MVEQTVVREHIKARVMSLVRSAEPSSYRNPKLYTLNENGNNNGVSSAQIFDPDRSKNPCLTDDSYPSQSYEKYFLDSPTDEFVQHPIGSGASVSSFGSLDSFPYQSRPVLGCSMEFQLPLDSTSTSSTRLLGDYQAVSYSPSMDVVEEFDDEQMRSKIQELERALLGDEDDKMVGIDNLMEIDSEWSYQNESEQHQDSPKESSSADSNSHVSSKEVVSQATPKQILISCARALSEGKLEEALSMVNELRQIVSIQGDPSQRIAAYMVEGLAARMAASGKFIYRALKCKEPPSDERLAAMQVLFEVCPCFKFGFLAANGAILEAIKGEEEVHIIDFDINQGNQYMTLIRSIAELPGKRPRLRLTGIDDPESVQRSIGGLRIIGLRLEQLAEDNGVSFKFKAMPSKTSIVSPSTLGCKPGETLIVNFAFQLHHMPDESVTTVNQRDELLHMVKSLNPKLVTVVEQDVNTNTSPFFPRFIEAYEYYSAVFESLDMTLPRESQERMNVERQCLARDIVNIVACEGEERIERYEAAGKWRARMMMAGFNPKPMSAKVTNNIQNLIKQQYCNKYKLKEEMGELHFCWEEKSLIVASAWR

SEQ ID NO: 1289 - DNA, 1590 bp, Arabidopsis thaliana
atggaagtctcaaatcagaccagaaaacggaaagcaatcgacgccggacatggctcgcagccgacggcgtatcgaggctcagatggtgtagatctttctctccttgaagcacttgagaagtcttcgcataatggagtagaagcgcttgatcttaaaaccctaaaaaagcttgtcctctccttcgagcggcgtcttagagacaacatagctgctcgtctcaagtatgtggagaatccagaaaagttcgctgactcagaggttgacctacacgacgatcttcagaagctcaaggtgctcgctggagctccggaactttacccggaccttgttgcttccaatacggttccttcgattgtcaatctcctctctcatgaaaactccgatatcgccaacgatgttgttcagcttcttcaggatctgactgacgaagatgccttagaggataacgatgagcctgcgcgtgtgttagtcgacgccttggttgaaaacaatgtgctcgagctcttggttcagaatatgaatcgtttgtctgaggctgaccctgacgaagctacggctatatacgcaactttgacggtgattgagaatttggtggaagtaaagccggctgttgctcaattggtgtgtgaaaggacgaagctattgcggtggcttctgacgaagattaaggtgagggaattcgaaggaatcaagcagtacgcgtctgagattcttgcaattctgctgcaaaacagtacggcgaatcagaaacggctaggtcagatgaatggtgtagacgctgtgcttgaaggtgtggcgatgtataagtcaaaggatcctaaaactcctgatgaggaagagatgttagagaatctgtttgattgtttgtgttgcctcttgatgccattggagaacaaggagaggtttgtgaatgcggaaggtgtagagctgatgattattatcatgaaacagaagaaatatgcttacgggtctgctattcgagctctagacttcgccatgaccaattatccaccagcatgtgagaggtttgtggatgttatgggactgaaaacagcatttgctgctttcatgggtaagattccgctaaacaagagaatcaaaagggagcggtataaggaggagctagaggagcgggttatttccctgattgcgtcattatttgctgggatattaaggggttctaggagagatcgattgttgagtaaattcgtggagaatgaatttgagaagattgaccggctcatggaattatatttgagatactctgatagggttagatcagaggcggaaaggttagaccagcttgagcttgatgaccttgagttggatgaagatgagaaatataatcggaagctagaatcaggtctctacagtcttcagcttgttgctgttatcctggggcatatttggtgttctgagcattctggaatgagagcgcgggtggagctgctactgaagcaacagaagcttagtaaaaccgatgtcaagcagattcttcaggagtatcacgacaacattggagatcttgatggagcagaggagaaggaacgaggacaggcgagaattcagttgttcatatcagcgatgtga

SEQ ID NO: 1290 - protein, 529 aa, Arabidopsis thaliana
MEVSNQTRKRKAIDAGHGSQPTAYRGSDGVDLSLLEALEKSSHNGVEALDLKTLKKLVLSFERRLRDNIAARLKYVENPEKFADSEVDLHDDLQKLKVLAGAPELYPDLVASNTVPSIVNLLSHENSDIANDVVQLLQDLTDEDALEDNDEPARVLVDALVENNVLELLVQNMNRLSEADPDEATAIYATLTVIENLVEVKPAVAQLVCERTKLLRWLLTKIKVREFEGIKQYASEILAILLQNSTANQKRLGQMNGVDAVLEGVAMYKSKDPKTPDEEEMLENLFDCLCCLLMPLENKERFVNAEGVELMIIIMKQKKYAYGSAIRALDFAMTNYPPACERFVDVMGLKTAFAAFMGKIPLNKRIKRERYKEELEERVISLIASLFAGILRGSRRDRLLSKFVENEFEKIDRLMELYLRYSDRVRSEAERLDQLELDDLELDEDEKYNRKLESGLYSLQLVAVILGHIWCSEHSGMRARVELLLKQQKLSKTDVKQILQEYHDNIGDLDGAEEKERGQARIQLFISAM

SEQ ID NO: 1291 - DNA, 1080 bp, Arabidopsis thaliana
atggactggaatttcaaacttagctctggttatttatctggattcgatcaagaaccagatttatcaccaatggatggttcgatctcgtttggtgggtcgtcacagtcaaaagcggatttttcatttgatctaaaacttggaagaaacattggaaactcttcctctgtttttggtgatacagagcaagtgattagtcttagtaagtggaaagatagtgctttagctaaaccagaaggttcaagaagctcgagttcaaagagaacaagagggaatggtgttggaaccaaccagatgccgatttgtcttgttgatggatgtgattctgattttagtaattgtagagagtatcataagagacataaagtttgtgatgttcattcaaaaactcctgtggttactattaatggtcataaacagaggttttgtcaacaatgcagcaggtttcatgctttggaggagtttgatgaagggaagagaagttgtaggaaacgtcttgatggacataatcgaagacgacggaagccgcagcctgaacatatcggtcgtcctgccaacttctttacgggttttcaaggtagcaaattgctagagttttctggtggttcacatgtgtttccaactacatctgtgttgaacccgagctggggaaatagtcttgtaagcgttgctgtagccgccaatggttcgagttatgggcagagccagagctatgttgttggttcttctcctgcaaagacagggataatgtttccaatctcttcttctccaaacagtaccagaagcatagcaaaacaattccctttcttgcaagaagaagaaagctcgagaaccgcatcgttgtgtgagagaatgacgagttgcatccatgactctgattgtgctctctctcttctgtcatcctcctcgtcgtcagtccctcatttgcttcaaccaccactttctttgtcccaagaagcagttgagacagttttttacgggtcgggattgtttgagaatgcgagtgcagtctctgatggatcggttatatccggtaacgaggctgtccgtcttccgcagacattcccgtttcattgggagtag

SEQ ID NO: 1292 - protein, 359 aa, Arabidopsis thaliana
MDWNFKLSSGYLSGFDQEPDLSPMDGSISFGGSSQSKADFSFDLKLGRNIGNSSSVFGDTEQVISLSKWKDSALAKPEGSRSSSSKRTRGNGVGTNQMPICLVDGCDSDFSNCREYHKRHKVCDVHSKTPVVTINGHKQRFCQQCSRFHALEEFDEGKRSCRKRLDGHNRRRRKPQPEHIGRPANFFTGFQGSKLLEFSGGSHVFPTTSVLNPSWGNSLVSVAVAANGSSYGQSQSYVVGSSPAKTGIMFPISSSPNSTRSIAKQFPFLQEEESSRTASLCERMTSCIHDSDCALSLLSSSSSSVPHLLQPPLSLSQEAVETVFYGSGLFENASAVSDGSVISGNEAVRLPQTFPFHWE

SEQ ID NO: 1293 - DNA, 6687 bp, Arabidopsis thaliana
atgaagcagaaacgaagaaaacttccgtctatactagatatattagaccaaaaagtggatagttctatggcttttgattccccggaatacacttcttcctctaaaccaagtaagcagcggcttaagactgattcgactcctgaaaggaactcctctaagaggaaaggaaatgatgggaattattttgaatgtgtgatctgtgaccttggtggtgatttattgtgttgtgatagttgtcctcggacctatcataccgcatgcctcaatccacctcttaagcggattccaaatggtaagtggatctgcccaaaatgttccccaaacagtgaagcactcaagcctgtcaatcgtttagatgccattgctaagcgagcaagaacaaaaaccaagaaaagaaattcaaaagccggaccaaagtgcgaaagagcttctcagatttattgcagttctataatttctggagaacaatcttcagagaaagggaaatctatatcggccgaagagagcaaatccacaggaaaggaagtttattcttccccgatggatggctgttcaactgctgagcttggtcatgcatctgcggatgaccgacctgattcatcgtctcatggagaagatgatttggggaaacccgtcatacccactgcagatttaccatctgatgcaggattaacgttgctgtcctgtgaagatctctccgaatctaaactatcagatacggagaaaactcatgaagcacccgtggagaagttggaacatgcttccagtgagatcgtggagaacaagacagttgctgaaatggagactggaaaaggtaaaaggaaaaaacggaagcgtgaactaaatgatggggaaagtcttgaaaggtgcaagactgataagaaacgcgcgaagaaaagtttgtccaaagtgggttccagttctcagactaccaaatcaccggagtcttcgaaaaaaaagaaaaagaaaaatcgtgtgactttaaaatccttgtccaaacctcagtccaagacagaaacaccagaaaaagtgaagaagcttcccaaggaggaacgtcgtgcagtacgtgccactaataaatcttctagttgtttggaagatacaaactctcttccggttggaaacctccaggttcatcgtgttttaggatgccgaatccaaggtctgactaaaacctcgctgtgtagtgctctttcagatgacttgtgttcggataatttacaagctactgaccaacgggatagcttagtacaagatacgaatgctgaattagtagttgctgaggacagaatagattcttcttctgagacaggtaaaagttcgagggattcacgactgagggataaagatatggatgattctgctttaggtaccgagggtatggttgaggtgaaagaagagatgctttctgaagacatttccaatgccacattgagtagacatgtggatgatgaagatatgaaagttagtgaaacgcatgtatctgttgagagggagttacttgaagaagcacatcaggaaacaggggaaaaaagcactgtggctgatgaagaaattgaggagcctgttgctgctaaaacttcagatcttattggtgagactgtatcatatgagtttcttgttaaatgggtggataaatctaatattcataatacttggatttctgaggcggagctgaaaggtctagctaaaagaaaactagagaactacaaagcaaagtacggaacagctgtaataaacatctgtgaagataaatggaaacagcctcagcgaatagttgctctccgggtttcaaaagaaggtaaccaagaagcttacgtaaagtggacaggcttagcttatgatgaatgcacgtgggagagcttggaggagcctattcttaaacattcatcccatttaatagatctttttcatcagtatgagcagaaaacattggaaaggaatagtaagggtaatcccacaagggaaaggggtgaagtcgttaccctcacagaacaacctcaagagctcagaggaggtgccttgtttgcccatcagcttgaggctttgaattggctgcgtagatgctggcataaatcaaaaaatgtaatacttgctgatgagatggggcttggaaaaactgtgtctgctagtgcattcctctcctccctttattttgaatttggagttgcaagaccttgtttagtcctggttccactttcaacaatgccaaactggctatcagagttttctctttgggctccactccttaatgttgtggagtatcatggaagtgcaaagggacgagccataattcgagactatgagtggcatgctaagaattctactgggacgaccaagaagccgacatcctacaaatttaatgtccttttaactacttatgaaatggttctggctgactcatctcatctacgtggggttccatgggaagttcttgtggttgatgaagggcatcgtctaaagaattcagaaagtaagctgtttagcttgctcaacacattctcttttcaacaccgtgtgctcttgactggcacccctcttcagaataacattggtgagatgtataatctgctcaacttcttgcaaccatcttcattcccttctttgtcttcttttgaggagaggttccatgatttgacaagtgctgagaaagtagaagaactgaagaaacttgttgctcctcatatgcttcgccggcttaaaaaagatgcgatgcagaatattcctccaaagacagagaggatggtccctgtcgagttgacatcgatccaggcggaatattatcgtgcaatgctaactaagaactatcagatactacgaaatatcggaaaaggggtagcgcaacaatcaatgcttaacatagtgatgcagttgagaaaggtttgcaatcacccatatctcataccaggtactgagccagagtctgggtcattggagtttcttcacgatatgagaataaaagcgtcagccaagttgactctgttgcactctatgcttaaggtgctacataaggaaggccatagagttctgatattttcacagatgacaaagcttctagacattctggaggactacctgaacatagaatttgggcctaaaacatttgaaagggtagatggttctgttgctgtagctgatcgtcaggcagctatagcacgtttcaaccaagacaaaaatcggttcgtttttctgttatcaactcgtgcctgtggtcttggtatcaatctggcaacagctgatactgttattatctatgactctgatttcaaccctcacgctgatatccaagccatgaatagagctcatcgaattggacagtccaaacgacttttggtatacagacttgttgtccgtgccagcgttgaagagcgcattttgcagctggccaagaagaagttgatgctcgatcagctttttgtaaacaagtcgggatcccagaaggaatttgaagatattctacgctggggtactgaagaacttttcaacgactccgctggtgagaacaagaaagatacagctgaaagtaatggaaacttagatgtaatcatggatttagaaagcaagagtaggaaaaaaggtggtggcctcggagatgtttatcaagacaaatgtacagaaggaaatgggaagattgtttgggatgatattgcaattatgaagttgcttgatcggtcaaatcttcaatctgcctccactgatgccgctgatactgagttggataatgatatgctcggctccgtgaagcctgtggaatggaatgaggaaacagctgaagaacaagttggagctgaatcacctgcactggtgactgatgatactggtgaaccgagttcagagaggaaagatgatgatgtcgttaattttactgaagaaaatgaatgggacaggcttctgcgtatgaggttggagttccctctttctctgagttcagcgtcttggctttggtcttggcagcatatatgggagaaatatcagagcgaggaagaagcagcgcttggcagagggaagcgtttgagaaaggctgtttcgtatagggaagcatatgccccacataccagtggacctgtaaatgagagtggtggtgaagatgagaaagaaccagaaccagaacttaagaaggaatatacaccggcagggcgagccctaaaagaaaagtttaccaaactgcgagagaggcaaaagaacctgattgcgagaaggaattctgttgaagagtctcttcctagcggcaatgtggatcaggtaactgaagtagctaatcaggacgaagaaagccctacatcaatggacttggacgatagcaaagctagccagcaatgtgatgcacagaaaagaaaagccagttcttcagatcctaaaccagatcttctaagccaacatcatcatggcgcagaatgtctgccatctttacccccaaacaacctgccagtccttggactgtgtgctcctaattttactcagtcagaatcctcccggagaaattattctcgtccaggtagtagacagaacagacccataacaggaccccattttcccttcaatctaccccaaacatcgaacttggttgagagggaagcaaatgaccaggaacctcctatgggtaaactaaaaccacagaacataaaggaagaaccttttcagcagcctcttagtaatatggatggttggcttccacatcgtcagtttcctccgtcaggggattttgagcgtcctcgaagttctggtgctgcttttgctgatttccaggagaagtttccgttgcttaaccttccatttgatgataagctgcttcctcgatttccatttcagccgagaacaatgggaacttcgcatcaagacataatggccaatctttcgatgaggaaaagatttgaaggtactggtcattctatgcaagacctatttggcggaacaccaatgccgtttctacccaatatgaaaatccctcctatggatccacctgtcttcaaccaacaagagaaggacttaccgcctttgggtttggatcagtttccatcagctctttcatctatcccagagaaccatcgaaaggtgctggagaatataatgctaagaactggctctggaattgggcacgtacagaaaaagaaaacaagagtagatgcatggtccgaggatgaactagattctctctggattgggattcgcagacatgggtatggaaactgggagacaattctcagagatccaaggctcaaattttcgaaatttaaaacaccagagtacttggcagctaggtgggaagaagagcaacgtaaattcttggatagtctttcatctctgccatctaaatcaagcaggactgataagtccaccaaatcttccttgtttcctggtcttccccaaggaataatgaatcgggccttacatggtaaatatgccactcctccaaggttccaatcccatctcacagacataaaactcggattcggcgatctagcatctccccttccgttatttgaaccatctgatcacctgggatttcgaagtgagcattttcctcccatggcaaatctgtgcactgacaatcttcccggggagccttctgctggaccatctgaacgagcagggacatcgacaaatattcccaacgagaagccttttccactcaactctcttggaatgggcaacttaggttcattgggtttggatagtttaagttccttaaacacactgagagcagaggaaaaacgggatgctattaagcgcgggaaactacccttgtttttagatatgccgttacctcagatgcttgattcaagcaacaacgtattcttgggaagatcagccaatccatctttccttcacccaaatcgagggttgaatccctccaatcccatggggagagacataatgggaattagctcttcagagaacaagctacctcattggttacggaatgttgtgactgttcctaccgtgaagtcacctgaaccacccactctacctccaactgtgtcagctatagctcaatcagtccgcgttttatatggtgaagactctacaaccattccaccgtttgtgataccagagccgccacctcctgctcccagagatccaagacacagtctgcgtaagaaaaggaaacgtaaattgcattcatcgagtcaaaagactacagacattggtagtagcagccacaatgctgtagaaagcagctctcaaggcaatccacaaacatctgcaactcctcctttgcctccaccgtctctggcgggtgaaacttcagggtcttctcaacccaaattacctcctcacaacctaaatagcacagaaccactgtcctctgaagcaatcataattccaccacctgaagaagattctgtgatagcagcagcgccatctgaagcaccagggcctagtctagagggaatcactggtacaacaaagtcaatctcgctagagagccaaagctctgaaccagaaactattaatcaagatggagacttagatccagaaactgatgagaaagttgagtctgaacgaaccccgcttcattcagatgagaaacaagaggagcaagaatctgaaaatgcattgaacaagcagtgtgagcccatagaggctgaaagtcaaaacaccaatgcagaagaagaagcagaggcacaagaagaagatgaagaatccatgaagatggtgactggtaattctcttagtgacgactga

SEQ ID NO: 1294 - protein, 2228 aa, Arabidopsis thaliana
MKQKRRKLPSILDILDQKVDSSMAFDSPEYTSSSKPSKQRLKTDSTPERNSSKRKGNDGNYFECVICDLGGDLLCCDSCPRTYHTACLNPPLKRIPNGKWICPKCSPNSEALKPVNRLDAIAKRARTKTKKRNSKAGPKCERASQIYCSSIISGEQSSEKGKSISAEESKSTGKEVYSSPMDGCSTAELGHASADDRPDSSSHGEDDLGKPVIPTADLPSDAGLTLLSCEDLSESKLSDTEKTHEAPVEKLEHASSEIVENKTVAEMETGKGKRKKRKRELNDGESLERCKTDKKRAKKSLSKVGSSSQTTKSPESSKKKKKKNRVTLKSLSKPQSKTETPEKVKKLPKEERRAVRATNKSSSCLEDTNSLPVGNLQVHRVLGCRIQGLTKTSLCSALSDDLCSDNLQATDQRDSLVQDTNAELVVAEDRIDSSSETGKSSRDSRLRDKDMDDSALGTEGMVEVKEEMLSEDISNATLSRHVDDEDMKVSETHVSVERELLEEAHQETGEKSTVADEEIEEPVAAKTSDLIGETVSYEFLVKWVDKSNIHNTWISEAELKGLAKRKLENYKAKYGTAVINICEDKWKQPQRIVALRVSKEGNQEAYVKWTGLAYDECTWESLEEPILKHSSHLIDLFHQYEQKTLERNSKGNPTRERGEVVTLTEQPQELRGGALFAHQLEALNWLRRCWHKSKNVILADEMGLGKTVSASAFLSSLYFEFGVARPCLVLVPLSTMPNWLSEFSLWAPLLNVVEYHGSAKGRAIIRDYEWHAKNSTGTTKKPTSYKFNVLLTTYEMVLADSSHLRGVPWEVLVVDEGHRLKNSESKLFSLLNTFSFQHRVLLTGTPLQNNIGEMYNLLNFLQPSSFPSLSSFEERFHDLTSAEKVEELKKLVAPHMLRRLKKDAMQNIPPKTERMVPVELTSIQAEYYRAMLTKNYQILRNIGKGVAQQSMLNIVMQLRKVCNHPYLIPGTEPESGSLEFLHDMRIKASAKLTLLHSMLKVLHKEGHRVLIFSQMTKLLDILEDYLNIEFGPKTFERVDGSVAVADRQAAIARFNQDKNRFVFLLSTRACGLGINLATADTVIIYDSDFNPHADIQAMNRAHRIGQSKRLLVYRLVVRASVEERILQLAKKKLMLDQLFVNKSGSQKEFEDILRWGTEELFNDSAGENKKDTAESNGNLDVIMDLESKSRKKGGGLGDVYQDKCTEGNGKIVWDDIAIMKLLDRSNLQSASTDAADTELDNDMLGSVKPVEWNEETAEEQVGAESPALVTDDTGEPSSERKDDDVVNFTEENEWDRLLRMRLEFPLSLSSASWLWSWQHIWEKYQSEEEAALGRGKRLRKAVSYREAYAPHTSGPVNESGGEDEKEPEPELKKEYTPAGRALKEKFTKLRERQKNLIARRNSVEESLPSGNVDQVTEVANQDEESPTSMDLDDSKASQQCDAQKRKASSSDPKPDLLSQHHHGAECLPSLPPNNLPVLGLCAPNFTQSESSRRNYSRPGSRQNRPITGPHFPFNLPQTSNLVEREANDQEPPMGKLKPQNIKEEPFQQPLSNMDGWLPHRQFPPSGDFERPRSSGAAFADFQEKFPLLNLPFDDKLLPRFPFQPRTMGTSHQDIMANLSMRKRFEGTGHSMQDLFGGTPMPFLPNMKIPPMDPPVFNQQEKDLPPLGLDQFPSALSSIPENHRKVLENIMLRTGSGIGHVQKKKTRVDAWSEDELDSLWIGIRRHGYGNWETILRDPRLKFSKFKTPEYLAARWEEEQRKFLDSLSSLPSKSSRTDKSTKSSLFPGLPQGIMNRALHGKYATPPRFQSHLTDIKLGFGDLASPLPLFEPSDHLGFRSEHFPPMANLCTDNLPGEPSAGPSERAGTSTNIPNEKPFPLNSLGMGNLGSLGLDSLSSLNTLRAEEKRDAIKRGKLPLFLDMPLPQMLDSSNNVFLGRSANPSFLHPNRGLNPSNPMGRDIMGISSSENKLPHWLRNVVTVPTVKSPEPPTLPPTVSAIAQSVRVLYGEDSTTIPPFVIPEPPPPAPRDPRHSLRKKRKRKLHSSSQKTTDIGSSSHNAVESSSQGNPQTSATPPLPPPSLAGETSGSSQPKLPPHNLNSTEPLSSEAIIIPPPEEDSVIAAAPSEAPGPSLEGITGTTKSISLESQSSEPETINQDGDLDPETDEKVESERTPLHSDEKQEEQESENALNKQCEPIEAESQNTNAEEEAEAQEEDEESMKMVTGNSLSDD

SEQ ID NO: 1295 - DNA, 1875 bp, Arabidopsis thaliana
atgacgactatggagagtttgattgggttagttaataggatacagagagcatgtaccgtactcggtgactatggtggtggaactggaagtaacgctttcaattctctctgggaagctcttccaaccgtcgccgtcgtcggtggtcagagttctgggaaatcttcggttcttgagagtatagttgggagagattttcttcctagaggatctggtatcgttacgagacggcctttagtgttgcagcttcataagactgatgatggaacagaggagtatgcagagttccttcatcttcccaagaagcaattcacagattttgctttggttcgcagggagattcaggatgagactgatagaatcacagggaaaaacaaacagatatctccagttcctattcacctcagtatctactctccaaatgttgtgaatttgacactcattgatttgcccggtttaactaaagtggctgttgagggacagccggaaaccattgctgaggatatcgaatccatggttcgcacatatgttgataagcccaattgtatcatattggctatatctcctgccaaccaagacattgccacatcagatgcaattaagctcgcaaaagatgtcgatccaacaggtgagaggacatttggtgttcttaccaagttagacttgatggacaaaggaactaatgcgttagaagttcttgaaggaagatcttacaggctgcaacatccttgggttgggatagtgaaccgttcacaagcagatattaataagaatgtcgatatgatgcttgcaagacgcaaggaacgagaatattttgataccagtcctgactatggtcacttagccagcaaaatgggttcagaatatctggcaaagctgctctctaagcacttggagtctgttatcaggacccgtattccaagtatactatccttaataaacaaaagcattgaagaacttgaaagagagttagaccgaatgggtcggcctgtcgcagttgatgctggggctcaactatacactatattggagatgtgccgtgcattcgataagatattcaaggaacatcttgatggcgggcgtcctggaggtgaccgtatctatggagtctttgacaaccaacttccagctgcacttaaaaagcttccttttgatcgccatctttctctacaaagcgtgaagaaaatcgtgtccgaggcagatggttatcaacctcacttgattgcaccagaacagggttatcgccgtctaatcgaaggggcactgggttactttagaggtccagctgaagcttctgtggatgctgttcactatgtcttgaaagagcttgtgaggaaatcaatatcagaaactgaggagctaaagcgtttcccttcactgcaagtcgagcttgctgcagcagccaacagctccttggagaaattcagggaagaaagcaagaagtcggttattcgacttgttgacatggaatctgcgtatctaaccgctgagttcttccggaaacttcctcaagaaatagaaagaccagtaaccaacagcaaaaaccaaaccgcttctccttcgtctgcaacattagaccagtatggagacggacatttcagaaggatagcatcaaatgtatctgcgtatgttaatatggtttcggacacacttcgtaacaccattccaaaagcttgtgtgtactgtcaggttagacaagccaagctcgcattgctcaattacttctactctcagatcagcaagagagaggggaaacagttgggacagttactagatgaagatccggcattgatggaccggagactagagtgcgcgaagaggctagagttatacaagaaagcaagagatgagattgatgctgttgcttgggtaagatga

SEQ ID NO: 1296 - protein, 624 aa, Arabidopsis thaliana
MTTMESLIGLVNRIQRACTVLGDYGGGTGSNAFNSLWEALPTVAVVGGQSSGKSSVLESIVGRDFLPRGSGIVTRRPLVLQLHKTDDGTEEYAEFLHLPKKQFTDFALVRREIQDETDRITGKNKQISPVPIHLSIYSPNVVNLTLIDLPGLTKVAVEGQPETIAEDIESMVRTYVDKPNCIILAISPANQDIATSDAIKLAKDVDPTGERTFGVLTKLDLMDKGTNALEVLEGRSYRLQHPWVGIVNRSQADINKNVDMMLARRKEREYFDTSPDYGHLASKMGSEYLAKLLSKHLESVIRTRIPSILSLINKSIEELERELDRMGRPVAVDAGAQLYTILEMCRAFDKIFKEHLDGGRPGGDRIYGVFDNQLPAALKKLPFDRHLSLQSVKKIVSEADGYQPHLIAPEQGYRRLIEGALGYFRGPAEASVDAVHYVLKELVRKSISETEELKRFPSLQVELAAAANSSLEKFREESKKSVIRLVDMESAYLTAEFFRKLPQEIERPVTNSKNQTASPSSATLDQYGDGHFRRIASNVSAYVNMVSDTLRNTIPKACVYCQVRQAKLALLNYFYSQISKREGKQLGQLLDEDPALMDRRLECAKRLELYKKARDEIDAVAWVR

SEQ ID NO: 1297 - DNA, 519 bp, Arabidopsis thaliana
atgtgtcacgcagctctcaagtatcttaagaaaggagcgcctggaagagactcatcaagcggtggaggttcgattattaacattagcgcgactttgcactacacggcttcttggtaccaaatacatgtctctgcagccaaggctgcagttgatgctaccacaagaaacttggcattggagtggggaactgactatgatattagagtgaacgggattgctccaggtcctattggaggtacacctggaatgagtaaacttgtacctgaggagattgaaaacaaaaccagagagtacatgcctctttataaagttggagagaagtgggatatcgctatggctgcactctacctcagctgtgattctgggaaatatgtgagcggactaacaatggtggtagatggaggactgtggcttagcaaacctcgccacttgcctaaagaagcggtgaagcaactctctcgtgcggtggagaagaggtctagggccaagcctgttggtctcccaaccagcaagctgtag

SEQ ID NO: 1298 - protein, 172 aa, Arabidopsis thaliana
MCHAALKYLKKGAPGRDSSSGGGSIINISATLHYTASWYQIHVSAAKAAVDATTRNLALEWGTDYDIRVNGIAPGPIGGTPGMSKLVPEEIENKTREYMPLYKVGEKWDIAMAALYLSCDSGKYVSGLTMVVDGGLWLSKPRHLPKEAVKQLSRAVEKRSRAKPVGLPTSKL

SEQ ID NO: 1299 - DNA, 1221 bp, Arabidopsis thaliana
atgtccttcaagagtctcattcaggacatgagaggagagcttgggagtatatccagaaagggattcgatgtcagattcgggtatggtagatccaggtctcaacgtgttgttcaggatacttctgttcctgttgatgctttcaagcagagctgctgggctagtatgcctccggagctcctgagagatgttcttatgaggattgagcaatccgaagacacttggccgtctaggaaaaatgttgtttcttgcgctggtgtctgcaggaactggcgagaaatcgtcaaagagatcgtcagagttcctgagctttctagcaaactcacttttcctatctccctcaaacagccgggtcctagaggatcacttgttcaatgctatattatgagaaaccgcagcaatcaaacctactatctatacctcgggttaaaccaagcagcttcaaatgatgatggaaagttccttcttgctgccaagaggtttcggaggccaacttgcactgactacatcatctccttaaactgcgatgatgtctctcgaggaagcaatacctatatcggaaagcttagatctaactttctggggaccaagttcactgtctatgacgctcagccgacgaatcctggaactcaggttaccagaacccgttcaagcagacttctcagtttgaaacaagtgagcccgagaattccatctggcaactatcctgtagcacatatctcatatgagcttaacgtcttgggttccagaggaccgaggaggatgcagtgtgtcatggatgccatccctgcatcagctgtagaacctggaggaacagctccaactcagacggaacttgtccatagcaatcttgatagtttcccctcattctccttcttcaggtcgaaatcaattcgtgcagagagtctcccttctggtccatcatctgctgctcagaaggaaggactgcttgtcctgaaaaacaaagcgcccagatggcacgaacagctccagtgctggtgcctcaacttcaatgggagagtcacagttgcttccgtcaaaaactttcagctggtagctgctcctgagaatggacctgcaggacctgagcacgaaaacgtgattctccagtttggaaaagtcggaaaagatgtgttcacaatggattatcagtaccctatctctgccttccaggccttcaccatttgcctcagcagtttcgacaccaagatagcatgtgaatga

SEQ ID NO: 1300 - protein, 406 aa, Arabidopsis thaliana
MSFKSLIQDMRGELGSISRKGFDVRFGYGRSRSQRVVQDTSVPVDAFKQSCWASMPPELLRDVLMRIEQSEDTWPSRKNVVSCAGVCRNWREIVKEIVRVPELSSKLTFPISLKQPGPRGSLVQCYIMRNRSNQTYYLYLGLNQAASNDDGKFLLAAKRFRRPTCTDYIISLNCDDVSRGSNTYIGKLRSNFLGTKFTVYDAQPTNPGTQVTRTRSSRLLSLKQVSPRIPSGNYPVAHISYELNVLGSRGPRRMQCVMDAIPASAVEPGGTAPTQTELVHSNLDSFPSFSFFRSKSIRAESLPSGPSSAAQKEGLLVLKNKAPRWHEQLQCWCLNFNGRVTVASVKNFQLVAAPENGPAGPEHENVILQFGKVGKDVFTMDYQYPISAFQAFTICLSSFDTKIACE

SEQ ID NO: 1301 - DNA, 1194 bp, Arabidopsis thaliana
atggattaccgaccttctgatagtagtggtacagatgatgacctgcctccatctcatcaaggtagatatcaaagaaacgccagacctaccgggaatggaaggccttcagttctcaattctgctcctttatcacgggtgcacaatgaaatggaaactcaaattcatctcattgagcaagaagcttatagctcgatactccgcgcatttaaagcccagtccgatgctattacctgggagaaagaaagtttgatcactgaactcagaaaagaacttcgagtgtctgatgaggaacacagagagctgttatcaagggttaacgctgatgaaatgatcaggcgaataagggaatggagaaaggcaaacagccttcagtctagtgttcctcagctggttcatgatgctccgagtccggctgtatcaggatcacgtaagaagcaaaagacatcacaatcaatcgcctcattagcgatgggcccaccatctccttctttgcacccttcaatgcaaccatcgtcatctgcactaagaaggggaggtcctccaccaggtccaaagaccaagaagccaaagacatcgatgcagtacccatctacaggcattgctggaaggccccaggctggcgctttaacaaatgaaccaggtgaatcgggatcatatgacccgttggttggaaggaaggtatggacgaagtggcctgatgacaaccaatactacgaagctgttataactgactacaaccctgttgaggggcgtcatgctttagtgtatgatattaactctgcgaatgaaacctgggaatgggtaaatcttaaagagatatctccgggagatatcagatgggaaggtgaagatcctgggatttctcgtaaaggaggacatcctgggcaaggccgtggaacaaaaaccatggctcgtggtggtcctgcaagcaatgcgggtggtagaggtaggggaagcatgaggatgcagcaacctaagacacagaatggcatcggaaagaaagctttaggcgaaatcgaaattctccacactgagacattgttaaaagaggtggaaaaagtttttgggtcagttaaccccaacccagcagaggtagagaaggcaaagagagtgctgagagatcatgaactagctcttatggatgccatcgcaaagcttgaagaaatatcagatggagaaagcggtaatatttga

SEQ ID NO: 1302 - protein, 397 aa, Arabidopsis thaliana
MDYRPSDSSGTDDDLPPSHQGRYQRNARPTGNGRPSVLNSAPLSRVHNEMETQIHLIEQEAYSSILRAFKAQSDAITWEKESLITELRKELRVSDEEHRELLSRVNADEMIRRIREWRKANSLQSSVPQLVHDAPSPAVSGSRKKQKTSQSIASLAMGPPSPSLHPSMQPSSSALRRGGPPPGPKTKKPKTSMQYPSTGIAGRPQAGALTNEPGESGSYDPLVGRKVWTKWPDDNQYYEAVITDYNPVEGRHALVYDINSANETWEWVNLKEISPGDIRWEGEDPGISRKGGHPGQGRGTKTMARGGPASNAGGRGRGSMRMQQPKTQNGIGKKALGEIEILHTETLLKEVEKVFGSVNPNPAEVEKAKRVLRDHELALMDAIAKLEEISDGESGNI

SEQ ID NO: 1303 - DNA, 1020 bp, Arabidopsis thaliana; identical to SEQ ID NO: 987

SEQ ID NO: 1304 - protein, 339 aa, Arabidopsis thaliana; identical to SEQ ID NO: 988

SEQ ID NO: 1305 - DNA, 1461 bp, Arabidopsis thaliana
atgaaaatccctgcatcatctcctcaagacacgaccaacaacaacaacaacactaatagtactgatagtaatcacttatcaatggacgaacatgtcatgcgttcaatggattgggattccatcatgaaagaattggagcttgatgacgattctgctcctaactcacttaaaaccggtttcaccacaaccacaacagattctactattttgcctctttacgccgtcgattcaaatctccctggctttcccgatcagattcaaccgtcggatttcgaatcgtcttccgatgtttatcctggtcagaaccaaacaactgggtacggttttaattctcttgatagtgtcgacaatggaggatttgatttcattgaagatctcatccgagtcgtggattgtgttgaatcggacgagttacaactcgctcaggtggttttatcacggcttaatcaacgcttgagatctccggcgggtagaccgttacagagagctgcgttttactttaaggaagctctcggttcgtttttaaccggatcaaaccggaatccaatccggttatcttcttggtccgagattgttcagaggatccgagcgattaaggaatattccgggatttctccgatccctctcttctctcatttcacggcgaatcaagcgatactcgattcgttgagctcgcagtcgtcttctccgtttgttcacgtggtggattttgagattggattcggtggccaatacgcatcgcttatgagagaaatcactgagaaatctgtaagcggtggatttttaagagttacggcagtggtggcggaggagtgcgccgtagagacgcgactagtgaaagaaaacctaactcaattcgcggcggagatgaaaattcgtttccagattgagtttgtgctgatgaagacttttgagatgttatctttcaaagcgattaggtttgttgagggggagaggaccgtcgttttgatttccccggcgatatttcgtcgtctaagtggaatcactgattttgttaacaatttacggagagtatcacctaaggtcgttgtattcgtggatagtgaaggatggacggagatcgccggatctggatcattccggcgagagtttgttagcgctcttgagttctacacgatggtgctggagtcgctcgacgctgcagctcctcccggagatttggtgaagaagatagtggaagcgttcgttctacgaccgaagatctccgctgcggtagaaacggcggctgacaggagacacaccggcgaaatgacttggcgggaagcgttttgcgccgccgggatgaggccgatacagcaaagccagttcgccgactttcaagctgagtgtttattggagaaagcgcaagttagaggattccacgtggcgaaacgacaaggagaattggtgctgtgctggcatggaagagcacttgttgccacatcagcttggcggttttag

SEQ ID NO: 1306 - protein, 486 aa, Arabidopsis thaliana
MKIPASSPQDTTNNNNNTNSTDSNHLSMDEHVMRSMDWDSIMKELELDDDSAPNSLKTGFTTTTTDSTILPLYAVDSNLPGFPDQIQPSDFESSSDVYPGQNQTTGYGFNSLDSVDNGGFDFIEDLIRVVDCVESDELQLAQVVLSRLNQRLRSPAGRPLQRAAFYFKEALGSFLTGSNRNPIRLSSWSEIVQRIRAIKEYSGISPIPLFSHFTANQAILDSLSSQSSSPFVHVVDFEIGFGGQYASLMREITEKSVSGGFLRVTAVVAEECAVETRLVKENLTQFAAEMKIRFQIEFVLMKTFEMLSFKAIRFVEGERTVVLISPAIFRRLSGITDFVNNLRRVSPKVVVFVDSEGWTEIAGSGSFRREFVSALEFYTMVLESLDAAAPPGDLVKKIVEAFVLRPKISAAVETAADRRHTGEMTWREAFCAAGMRPIQQSQFADFQAECLLEKAQVRGFHVAKRQGELVLCWHGRALVATSAWRF

SEQ ID NO: 1307 - DNA, 1383 bp, Arabidopsis thaliana
atgatagagaagtgtataggagcgcatcggtttcggagattacagagattcatgcgtcaagggaaagtgacgattctttgtctcgttctcaccgtcatcgtcttacgtggcacaatcggagccggtaagtttggtacgccggagaaagatatcgaggagatccgtgagcatttcttctacacgcgtaaacgcggcgagcctcaccgtgtcctcgtcgaggtctcttccaaaacgacgtcgtccgaagacggaggaaatggtggtaacagctacgagaccttcgatatcaacaagctattcgttgatgaaggagacgaagagaaatctcgagaccggactaataaaccttattctcttggtcccaagatctctgattgggatgagcagagacgtgattggctcaaacaaaaccctagcttccctaatttcgtggcgccaaacaagcctagggttcttcttgtcacaggttcagctcctaaaccgtgtgagaatcctgtaggagaccattacctcttgaaatcgattaagaacaaaatcgattactgtagaatacacggaatcgagatcttctacaacatggcgttgctcgatgctgagatggctggattctgggctaagcttccgttgattaggaagttactcttgtcacatcctgagattgagtttctatggtggatggatagtgatgccatgttcacggacatggtgttcgagcttccatgggagaggtacaaagattacaacttggtgatgcatggttggaacgagatggtttatgaccagaagaattggattggtctcaacacgggaagtttcttgctcaggaactcacagtggtcgcttgatcttcttgacgcttgggctcctatgggcccaaaagggaagatccgagaagaagcgggtaaagtcttgacccgggaacttaaagaccgacccgctttcgaagctgacgatcaatcggcgatggtttatctgctggcgacggagagagagaaatggggaggcaaagtttatctagagagtggttattacttgcacggttattgggggattttggtagaccggtacgaggagatgattgagaatcataaaccgggttttggagaccatcggtggccattggttacgcatttcgtcgggtgtaaaccgtgcgggaaatttggagattatccggtggaacggtgtctacggcagatggatagagcgtttaatttcggagacaatcagatccttcaaatgtatggtttcacgcataaatcgcttgggagccggcgcgtgaaacccacgcgcaatcagacggataggccgctcgatgccaaggacgagtttgggctgcttcatccgccgttcaaagcggccaagcttagtacgacgacgacgtga

SEQ ID NO: 1308 - protein, 460 aa, Arabidopsis thaliana
MIEKCIGAHRFRRLQRFMRQGKVTILCLVLTVIVLRGTIGAGKFGTPEKDIEEIREHFFYTRKRGEPHRVLVEVSSKTTSSEDGGNGGNSYETFDINKLFVDEGDEEKSRDRTNKPYSLGPKISDWDEQRRDWLKQNPSFPNFVAPNKPRVLLVTGSAPKPCENPVGDHYLLKSIKNKIDYCRIHGIEIFYNMALLDAEMAGFWAKLPLIRKLLLSHPEIEFLWWMDSDAMFTDMVFELPWERYKDYNLVMHGWNEMVYDQKNWIGLNTGSFLLRNSQWSLDLLDAWAPMGPKGKIREEAGKVLTRELKDRPAFEADDQSAMVYLLATEREKWGGKVYLESGYYLHGYWGILVDRYEEMIENHKPGFGDHRWPLVTHFVGCKPCGKFGDYPVERCLRQMDRAFNFGDNQILQMYGFTHKSLGSRRVKPTRNQTDRPLDAKDEFGLLHPPFKAAKLSTTTT

SEQ ID NO: 1309 - DNA, 2043 bp, Arabidopsis thaliana
atgttttgcagaaacgtatcggtgaggcggaagaagaattctggtacggtaccggtttatctgaatgtttacgatcttaccccaatgaatgtttatggttactggctcggaattgggatctatcactctggtctcgaagttcatggggttgagtatggatacggggcacacgagaaatcgagctcggggatttttgaggtggagccaaagaagtgtcctggtttcacattcaggaaatcgattcttgttggtgaaacagagatgaaggctaaagaagttcgaagctttatggagaaattatcagaagagtatcagggtaacaagtaccatctcatcacaaggaactgcaaccatttctgcaaccatgtttctttgaaacttactcacaaatcaatccctagttgggtcaaccgtcttgctcgcttaggtttcctctgcaactgtgtcttgccggcttgcttgaacgagactaaagtgaagcgggtaggaaaagacgggaagctgctcttggaaggagaaaatacgaagaagaagaagaggaagaagaaaatacgaagaagccgatcaggtcctttatcttcgtcttcttcaaatgcaagattagataatactcctacacataacagatcaatatcaacgggtaatcctcctctttctgcttctccatcttgtcctttgagacctcgacttccttctgttgcatctggagctgaagatcaaaatcctccaagcagatacctcaacgccagcttctgcagtgaagtgcaatgtcaccggctttgctttgcatatgagaggatgaatcagaatgaaggtgacgcccttgtcgattccatcaaagcgaagttagcctttttatcttctctttccaccaaatgctgtatatacaaggtacctaataagctccgcagactcaatcctgatgcatatacgcctcggcttgtgtcttttggcccgcttcatcgtggtaaagaagagcttcaagctatggaagatcagaaatacaggtatttgctgagttttatccctagaacgaactctagtctagaggaccttgttagacttgctaggacttgggaacaaaatgctcgcagctgttatgcagaagatgtgaaacttcatagcgatgagtttgttgagatgttagttgtagatggtagcttcttggttgaacttcttttgaggtctcattatcctcgacttagaggcgagaatgatcgcatatttggcaattcaatgatgatcaccgacgtgtgccgtgacatgattttgatagaaaatcagttaccctttttcgttgtgaaggagatatttcttctcttgttgaattactaccaacaaggaacaccttcaatcatacagctcgcgcaacgccacttcagttatttcttgagccgcattgatgatgagaagtttattacagagccagaacattttgttgatcttctgaggtcttgttatctgccacagtttccaattaaattagaatacactacagtgaaagtggacaatgcacctgaagcaacagagcttcacactgctggtgttaggttcaagccagcagagaccagtagttgtttacttgacattagttttgctgatggagtactgaagattccaaccattgtcgtcgatgatctcacggaatccctctacaaaaacatcattgggtttgaacaatgtcgttgctcaaataaaaacttcctcgactacatcatgctgctcggttgcttcattaaatcccctacagatgctgacttgctcatccacagtgggatcatcgtaaactatctcgggaactcagtagatgtttcaaacttgttcaatagcatcagcaaagaggttatctatgacagaagattctacttttcgatgctctctgagaaccttcaagcttactgcaacacaccatggaacaggtggaaggcgattctgagacgtgactacttccacaatccttgggcagttgcttctgtttttgcagctttacttcttctccttctcactttcatacagtccgtatgctctatcttggctctgtaa

SEQ ID NO: 1310 - protein, 680 aa, Arabidopsis thaliana
MFCRNVSVRRKKNSGTVPVYLNVYDLTPMNVYGYWLGIGIYHSGLEVHGVEYGYGAHEKSSSGIFEVEPKKCPGFTFRKSILVGETEMKAKEVRSFMEKLSEEYQGNKYHLITRNCNHFCNHVSLKLTHKSIPSWVNRLARLGFLCNCVLPACLNETKVKRVGKDGKLLLEGENTKKKKRKKKIRRSRSGPLSSSSSNARLDNTPTHNRSISTGNPPLSASPSCPLRPRLPSVASGAEDQNPPSRYLNASFCSEVQCHRLCFAYERMNQNEGDALVDSIKAKLAFLSSLSTKCCIYKVPNKLRRLNPDAYTPRLVSFGPLHRGKEELQAMEDQKYRYLLSFIPRTNSSLEDLVRLARTWEQNARSCYAEDVKLHSDEFVEMLVVDGSFLVELLLRSHYPRLRGENDRIFGNSMMITDVCRDMILIENQLPFFVVKEIFLLLLNYYQQGTPSIIQLAQRHFSYFLSRIDDEKFITEPEHFVDLLRSCYLPQFPIKLEYTTVKVDNAPEATELHTAGVRFKPAETSSCLLDISFADGVLKIPTIVVDDLTESLYKNIIGFEQCRCSNKNFLDYIMLLGCFIKSPTDADLLIHSGIIVNYLGNSVDVSNLFNSISKEVIYDRRFYFSMLSENLQAYCNTPWNRWKAILRRDYFHNPWAVASVFAALLLLLLTFIQSVCSILAL

SEQ ID NO: 1311 - DNA, 1473 bp, Arabidopsis thaliana
atgacgaaagtgtgtcctgaaatagaagggacattatctttatcagtggttccagtatcagtagatgtgagctttgcttctgatcactttccaacatataaattaggacctgataatcagatagtagaggaaccaaaggaagatgaaaaaggtccatctgtgaaggagactgtcgagaaagagagcgagttgttgtctgatcagcacaagcggctttcggtccgtgacctcgctagtaaattcgacaagaatcttgctgcagctgttagtttggctaatgaggctaagttaagagaggtggcttctttggagggacatgttatgttgaagaagctaagggatgctttagaatacatgagaggacgcacggatgggcaaaacaaacaggatgtggagacagctatctccatggtggaagctctagctgtgaagttaactcagaatgaaggtgaattgattcaggagaagtttgaagtgaagaaactaggaaacttcctcaagcagacttcagaagatgcaaagaaactggtaaatcaagaaaagtcattctcttgtgctgagatcgaaactgcaagggccgttgtgctgagacttggagaggcttttgaagaacaagaacggatttctgaagcttctagagctcaggggccggatgtggagaaattggttgaggaagttcaagaggctaggcaaatcaaacggatgcatcacccaacaaaggtgatgggcatgcaacacgagcttcatggtttaaggaatcgaatccaagagaagtatatgaattctgttaaacttcataaagagatagcaataatcaagagagttgaggaatccaagtcttgtccatttgttcttgaaggcaaacaaagtctcggctcttgcttaagaatccgtgtcaatgctcaagacaatgctccagatctttccaactgttctattcagtggtatcgtgcagcatgtgaaactagtcgcagggaagctatatctggtgccatccaatcgatgtatgctccagaaccatttgatgttgggaggatattacaggcagacattctttcaaatggtcaaaagttcacagttacaaccgatgatccagttgatcctgattctggcttgccatcccgcgtagagtcgctgatgcgaaagtctaacagtgaattcagtgtggttatatcgcagatgaatggacaagactatgcatctcgatcgcacgtttttaccgttggaaagacgaggataaagctgtctcgaggatggatcacaaaggcgagagaattatattcgacatccatgcagctctgtggagttagaggcaatattaaggctcctaccaaggcagtgttctggcaaccaagaaagagtctaactttcatactaacctttgagtcagaacacgaacgtaacgcagccatagcccttgctcgaaaatacgctttcgattgcagtgttacactgcttggtccagatgattaa

SEQ ID NO: 1312 - protein, 490 aa, Arabidopsis thaliana
MTKVCPEIEGTLSLSVVPVSVDVSFASDHFPTYKLGPDNQIVEEPKEDEKGPSVKETVEKESELLSDQHKRLSVRDLASKFDKNLAAAVSLANEAKLREVASLEGHVMLKKLRDALEYMRGRTDGQNKQDVETAISMVEALAVKLTQNEGELIQEKFEVKKLGNFLKQTSEDAKKLVNQEKSFSCAEIETARAVVLRLGEAFEEQERISEASRAQGPDVEKLVEEVQEARQIKRMHHPTKVMGMQHELHGLRNRIQEKYMNSVKLHKEIAIIKRVEESKSCPFVLEGKQSLGSCLRIRVNAQDNAPDLSNCSIQWYRAACETSRREAISGAIQSMYAPEPFDVGRILQADILSNGQKFTVTTDDPVDPDSGLPSRVESLMRKSNSEFSVVISQMNGQDYASRSHVFTVGKTRIKLSRGWITKARELYSTSMQLCGVRGNIKAPTKAVFWQPRKSLTFILTFESEHERNAAIALARKYAFDCSVTLLGPDD

SEQ ID NO: 1313 - DNA, 1404 bp, Arabidopsis thaliana
atggttcagaagcagcaagcctccgccggtccgggtaccgagcctaagaagcgtcgccgtgtcggattttctcccgccgatactggtgtcgaggctaacgagtgcatcaaaatttatctcgtttcaagcaaagaggaagttgattcctctgatatttccagcgtgaagccagttgacttgaatgatttctttgatggagatggcaagatttatggttaccaaggtttgaagataaatgtatggatcaatagcatctcattacattcatatgctgatatcacataccagagcaccattaacggagacaaaggcatcacggacctcaaatctgctttacagaacatatttgctgagaccattgttgataccaaggatgagtttctgcaaaccttttcgacacagagagattttatcagaaatatggtctcgaatggagaggtaatgcatgctggagcaacagatggaagcagcaagaatgctgaagtggttccttctgatccccaggttatacggatggaaattggttctccaaatgctggactcctctatagccgattggtaccccttgttcttctttttgtcgatggcagcaatccgattgatgtcactgatcctgactggcatttatatctcttaatccagaagaaagaggaaaaagaagatcctttgtatcgaattgtgggctttaccgcaatttataagttctatcgttatcctgacaggctgcggatgcgactcagccagatcttggtcttaccatccttccaaggaaaaggactcggaagctatcttatggaggtagtaaacaacgtggccataacagaaaacgtttacgatttgacagttgaggagccatctgaaaagttccaacacatccgcacttgcatagacataaaccgcttgcgcagtttcgatccaatcaaaccagacattgattcagctgttcagactctcacaaaaggaaagctatcaaagaaagctcagatacctcgattcaccccgcctctgaacgccattgagaaagtccgcgaatctctgaagatcaacaagaaacagttcctcaaatgctgggagattttgatataccttgctcttgatcctattgacaagtacatggaagattacacatcagtcatcacgaaccatgtgagaaccgacattctgggaaaagatatagaaactccaaagaaacaagtcgttgatgttccaagctctttcgagccagaagcatcgtttgtggttttcaagtctgtaaacggagaagaggctaataccaatgttcaagttgatgaaaacaaaccggatcaagagcagcagctgaagcaacttgttgaggaaaggattcgtgagatcaagttggttgctgagaaagtctccaagagtggtcaaacgctaaaagtctga

SEQ ID NO: 1314 - protein, 467 aa, Arabidopsis thaliana
MVQKQQASAGPGTEPKKRRRVGFSPADTGVEANECIKIYLVSSKEEVDSSDISSVKPVDLNDFFDGDGKIYGYQGLKINVWINSISLHSYADITYQSTINGDKGITDLKSALQNIFAETIVDTKDEFLQTFSTQRDFIRNMVSNGEVMHAGATDGSSKNAEVVPSDPQVIRMEIGSPNAGLLYSRLVPLVLLFVDGSNPIDVTDPDWHLYLLIQKKEEKEDPLYRIVGFTAIYKFYRYPDRLRMRLSQILVLPSFQGKGLGSYLMEVVNNVAITENVYDLTVEEPSEKFQHIRTCIDINRLRSFDPIKPDIDSAVQTLTKGKLSKKAQIPRFTPPLNAIEKVRESLKINKKQFLKCWEILIYLALDPIDKYMEDYTSVITNHVRTDILGKDIETPKKQVVDVPSSFEPEASFVVFKSVNGEEANTNVQVDENKPDQEQQLKQLVEERIREIKLVAEKVSKSGQTLKV

SEQ ID NO: 1315 - DNA, 1185 bp, Arabidopsis thaliana
atggcgtctattgttcaaccatcgcctactttcccggcgctaaatctccggcgttcttctctgattcgtccgccttcttccgttcgatttcctcttaagtgtaacgcggcggatccgtacaagttcgacggcggaaactctgccggtttccatctgcttactggcgacaccgttccggctagcttttcgaggacacgtttggaagattcgatttatcagaacaccacacgacttcgtatcttttccggcactgctaatcctattttggctcaggagatttcttgctatttgggtctggaccttgggaaaatcaagattaaacgctttgctgatggtgagatctatgttcagctacaagagagtgtaaggggatgtgatgtgttccttgtacagcctacatgcccacctgcaaatgaaaaccttatggaattgctcgttatgattgatgcttgtcggagagcatcagccaaaactatcacggctgtgattccttactttggttatgcacgagctgatagaaagactcaaggacgtgaatctattgcagccaagcttgtggccaatttgattacacagtctggtgcagaccgtgtccttgcttgtgatcttcactccggacagtctatgggctactttgatattccagtcgatcatgtttatggccagcctgtcatacttgattacctagcaagtaaggccatatcctctgaagatttggtggtagtttcacctgatgttggtggcgtcgcaagagctcgcgcttttgcgaagaagttatctgatgcacctttagcaatagttgataaaagacgtcatgggcacaatgttgcagaggtgatgaacttaattggggatgttaaagggaaagtagccataatggtggatgacatgattgacacagcaggaaccataagcaaaggtgcggctctgttacaccaagaaggagcaagagaagtatacgcttgtaccactcatgccgtttttagccctcctgcaatcagtcgactatcgagcggactgtttcaagaggtgatcataaccaacacgattccattgtcagagaagaactattttcctcagcttacagttctctcagtagcaaaccttcttggggagaccatatggcgtgttcatgatgattgctcgggagccattgagccattttcgacgttggggattgattga

SEQ ID NO: 1316 - protein, 394 aa, Arabidopsis thaliana
MASIVQPSPTFPALNLRRSSLIRPPSSVRFPLKCNAADPYKFDGGNSAGFHLLTGDTVPASFSRTRLEDSIYQNTTRLRIFSGTANPILAQEISCYLGLDLGKIKIKRFADGEIYVQLQESVRGCDVFLVQPTCPPANENLMELLVMIDACRRASAKTITAVIPYFGYARADRKTQGRESIAAKLVANLITQSGADRVLACDLHSGQSMGYFDIPVDHVYGQPVILDYLASKAISSEDLVVVSPDVGGVARARAFAKKLSDAPLAIVDKRRHGHNVAEVMNLIGDVKGKVAIMVDDMIDTAGTISKGAALLHQEGAREVYACTTHAVFSPPAISRLSSGLFQEVIITNTIPLSEKNYFPQLTVLSVANLLGETIWRVHDDCSGAIEPFSTLGID

SEQ ID NO: 1317 - DNA, 1062 bp, Arabidopsis thaliana
atggccaacgatcagaagaatagtgagtcttttccagcgaaggaagatcataagaaggatgatgcggcagctccagcagaagtagaccataaggatgaattctcggcatcacagccacatccggtcgaaaacatagttttagttgggcgtacagggaacggcaaaagcgccacggggaacagcatcgtcagatcaaaggtgtttaagtcgaaaacaaaatcatcaggtgttacgatggaatgccatgcagttaaagcagtgacaccagaaggccctatactcaatgtgattgacactcctggtctatttgatttgtcggtatctgctgaatttatcggtaaagaaatagttaaatgcctaactctagcggatggagggctacacgctgtgctcttagttttatctgtaaggactcgaattagtcaagaggaagagatggtacttagtaccttgcaggttcttttcggtagtaagattgttgattaccttatcgttgttttcacggggggagatgtattggaagatgacggtatgacattggaggattacttgggtgataacatgccggacttcctaaagagagttctcatattgtgtggccaacgaatgattctgtttgataacaaaaccaaggatgatgagaaaaagacaaagcaagtccatgaacttctcaaacttatcgacttggtcagaaagcagaacaacaatattccgtataccgatgagatgtaccatatgataaaggaagaaaatgaaaggcacaagaaagaacaagaggagctagaatcaaaagggcattcagaagagcagctcgcagcattgatgaaggagttacagataatgaatgaacgaaacctcaaggcaatggcagagatgatggagaaaaatatgaaaatagctatggaggcgcaggagaagctctttgagcaaagagaaaaagctcaggagatgagctaccagcaaaaaatggaaatgcaggagaagttaaagcagatggaaggacgtatgcgtgctgaaatggaagcgcaaatgctcagccgtcagcagtgcagcattctctga

SEQ ID NO: 1318 - protein, 353 aa, Arabidopsis thaliana
MANDQKNSESFPAKEDHKKDDAAAPAEVDHKDEFSASQPHPVENIVLVGRTGNGKSATGNSIVRSKVFKSKTKSSGVTMECHAVKAVTPEGPILNVIDTPGLFDLSVSAEFIGKEIVKCLTLADGGLHAVLLVLSVRTRISQEEEMVLSTLQVLFGSKIVDYLIVVFTGGDVLEDDGMTLEDYLGDNMPDFLKRVLILCGQRMILFDNKTKDDEKKTKQVHELLKLIDLVRKQNNNIPYTDEMYHMIKEENERHKKEQEELESKGHSEEQLAALMKELQIMNERNLKAMAEMMEKNMKIAMEAQEKLFEQREKAQEMSYQQKMEMQEKLKQMEGRMRAEMEAQMLSRQQCSIL

SEQ ID NO: 1319 - DNA, 1164 bp, Arabidopsis thaliana
atgtgttatgtaccacaaactctgcatatatggtcacactgcacctgctcatcatcttttctctctctaacgaattcattaatttattatcttcttcttcttcttcgaccttccaaaactctctctctctctctgtcgtcaacaatggatagtccgacgagcatacgtagtaaaccactaccggagactctttctccatgcggtagtcaacgacggagaagcagctgcgactctaacccacctgagttcgagttctggcgtttaactaactcttcatttcctcaagctgattcagatctcctctccgccgacgagctttttcacgacggtgttcttctccctcttgacctcctctccgttaaatcagagcttcagtccgacccgaatatcgcagaatgcgacccggatccatctccttcgactggtagtttgattacagagcaaaaaagtgatcttgaacccggtttaggatccgagttgacccgagaaacaacggtttcgaagcggtggagagatattttcaggaagagcgaaaccaaaccgccggggaagaaagagaaggtgaaagagaataagaaggagaagaagaaaaccgggtcgggtccaagttcgggttcgggttcaggagcggagctgaatatcaacatttggccgttttcaagaagtagatccgctggtaacaacgtgacccgaccgagaatgtcgtttggagctccgacgacccggaaagtaagcagtgcgccgtgttcacgtagcaactccaccggagaatccaaatcgaggaagtggccgagtagtcccagtcgtaacggcgtgcatcttggtcggaatagtccggtttggcaagtccggcgtggaggaggagctccggttgggaaaacgataccggaaccgatgggtcgggttgtgggtaaaagggagattcccgagacgcgtaagggtaaaacagtaattgagagcaataaagcaaaagtcttgaacttgaacgtgcctatgtgcatcggttatcggagccggttaagctgcagaaccgaagagagtagtggtggtggtaatagtaacattgggagtgacaacaataataataataacgccaacgctaataatcctaatcctaatggtttatttggctttcgtaatctcttcattaagaaagtgtattga

SEQ ID NO: 1320 - protein, 387 aa, Arabidopsis thaliana
MCYVPQTLHIWSHCTCSSSFLSLTNSLIYYLLLLLRPSKTLSLSLSSTMDSPTSIRSKPLPETLSPCGSQRRRSSCDSNPPEFEFWRLTNSSFPQADSDLLSADELFHDGVLLPLDLLSVKSELQSDPNIAECDPDPSPSTGSLITEQKSDLEPGLGSELTRETTVSKRWRDIFRKSETKPPGKKEKVKENKKEKKKTGSGPSSGSGSGAELNINIWPFSRSRSAGNNVTRPRMSFGAPTTRKVSSAPCSRSNSTGESKSRKWPSSPSRNGVHLGRNSPVWQVRRGGGAPVGKTIPEPMGRVVGKREIPETRKGKTVIESNKAKVLNLNVPMCIGYRSRLSCRTEESSGGGNSNIGSDNNNNNNANANNPNPNGLFGFRNLFIKKVY

SEQ ID NO: 1321 - DNA, 870 bp, Arabidopsis thaliana
atgaatctcctcaagacgattcattaccagtctaccattactcgattttaccgttttgcccctacacgctcctttgcttcttctgtgtcactctctccacagagacacataatctctctcgtttctatctctaatcgtggaaggtgcttcgcattctcgagcgtctctggtgcttcgctttataataatcaagaggatgggaagaaagaagaatccgagagaaattacgcttcgacgaaggaaggagatgaagtggtttaccagaaaacgctgagattagtagaatgtgccatgttcgctgctgtgacaggcctcgtttactttctcagcaattctctcgccattgagaactactttgggtgtttcttctcactaccaattgtgatttcttcgataagatggaacattgcaggtggcaggaagacaatggttgctactgtcatgctgttgttcatattatcaggtccggtcaaggcattaacttactttcttactcatggtcttgtggggcttgcactgggatcattgtggagtatgggggcaagctggcgtctctcgattttcttgtgcacaatggttcgagcattgggtctcataggctatgttctgacatcatccttcttaataagagaaaatattctcgctgtgatcacaattaacatccacgcttctctctcttatgttttcacggccatgggcctgaacataatgccttcgatgagcctcatttatatgatatttgggacagtgctgttacttaacagtggattctttgtgttgttgctgcatctgctatactcgatcttcctaacaagactaggaatgaaatcttcgttgagattaccagcctggttggacaaagctatatga

SEQ ID NO: 1322 - protein, 289 aa, Arabidopsis thaliana
MNLLKTIHYQSTITRFYRFAPTRSFASSVSLSPQRHIISLVSISNRGRCFAFSSVSGASLYNNQEDGKKEESERNYASTKEGDEVVYQKTLRLVECAMFAAVTGLVYFLSNSLAIENYFGCFFSLPIVISSIRWNIAGGRKTMVATVMLLFILSGPVKALTYFLTHGLVGLALGSLWSMGASWRLSIFLCTMVRALGLIGYVLTSSFLIRENILAVITINIHASLSYVFTAMGLNIMPSMSLIYMIFGTVLLLNSGFFVLLLHLLYSIFLTRLGMKSSLRLPAWLDKAI

SEQ ID NO: 1323 - DNA, 696 bp, Arabidopsis thaliana
atgccttcttttgcttttggatctcatcaccatttggcgaatcctacagactcgccgccgtactccgtcgaaattagcatcgacggtgactcctccgactgggattctttgtctcaggtcgatttagagtccggcggtgtaccggcgccggagaaacagctacattccggtggtaagaagaggagaactaggaggagaaagaggaggaagaagaagaagaagaagaaaggtggaagagattgcaggatctgtcatcttcctttagagactaacaaagaagctgaagatgaagatgaagaagaagaagatgattctgatgatgatgaagatgaagaagatgaagaagaagaagaagaagaagaagaagaagaatattatggtttgcctttgcaattaggttgctcttgtaaaggtgatttgggtgttgctcatagtaagtgtgctgagacttggtttaagatcaaaggaaacatgacatgtgagatatgcggcgcaatggctctaaacgtggctggtgaacaatctaatccggagagcactgcttctacacattcacaagcagctgcgggacaatctctaactcagacagagccacgaggaatctggcatggtcgccctgttatgaacttcttacttgctgctatggtcttcgccttcgttgtttcttggctttttcacttcaaagtcctcaagtga

SEQ ID NO: 1324 - protein, 231 aa, Arabidopsis thaliana
MPSFAFGSHHHLANPTDSPPYSVEISIDGDSSDWDSLSQVDLESGGVPAPEKQLHSGGKKRRTRRRKRRKKKKKKKGGRDCRICHLPLETNKEAEDEDEEEEDDSDDDEDEEDEEEEEEEEEEEYYGLPLQLGCSCKGDLGVAHSKCAETWFKIKGNMTCEICGAMALNVAGEQSNPESTASTHSQAAAGQSLTQTEPRGIWHGRPVMNFLLAAMVFAFVVSWLFHFKVLK

SEQ ID NO: 1325 - DNA, 2157 bp, Arabidopsis thaliana
atggggaagccaacgactcaaaacaatagctttattaaccatttcagccacccccaccgccttcaactaaccccggcgacgtcatcaccaccgtgctccgcctgcaaactcaccggaggtaacggccgggtttactcatgtaggccatgcaacttctctctccatgagtcgtgtagcaagatgaagcaggtaataacacatccctctcacccttcgcatacgcttagcctgctcgtggctcctgtctacgatggtggatacttcaactgtgacggttgtggcatccacgggacgggttttagttaccaatgctctgtatgcgacttcgacatccacgcgctttgtgcttacaagccgctctcaatcatccacaagtctcatccgcaacacaatcttaaactcgcgtttcaatctccatatggcgctaataaaggtttctcttgcgacatctgtcgtaagattgggaagaaccagtggctttaccggtgcatcccctgcgaattcgatgctcatgtcggttgtatcactggtcctaatcctcacctccttcaacatagtacttccgcacctaatcctcatactcatcatgccggtcaccctcaacatcaaaactcgcttcctgtgcctaatcaaggcagtaacagggtcaggcccatgcctatgacaaggcccaataggaccattaatcctaataggcctatagctcaaaacgcggctgtcaatggaccaagaagacagaacaacaacttgggttataatgctcaggttgggcctaatggaccaaatgaacttactggtcaaggatcaatggatgggagtggttacaatggtagtgcaagtgcaacgaataaagagtttgatgttgatgtcgatgttgatgttgatgttgatgttgatgtcgatgtcgatgtcgaggttgaatatgaaggtgatgtgtatgttgaagaggctaatgacgagggagaagacgttgatggtaacgacgagggagaagatgttgatggtaacgggcttgaaattgtggcttgtgtcgataatttaagtgttgcttatagtgagagtgattttggaagcagtagtgatgctcgtagccaatgtaatgatttgtctgatgctgatctatatccactgtctctggataacacacaaggaccaagaccggttcgtatgaaccaaggctcgggtggcggaaggaagaaaaacacgaaccagaatggtcaggcttctcggtctaagaaaatagttggtaatggcccacgtggtgggcttcaaggatccaacagtccaatacaaagccctagaggacctcaaactagaagggtacaaaatgttcgtaataatccaacaagaggtcgtggtggggctgtgagtgtaagagttaatagacctcgtgacccatctgcatttattgcacctcaaggatttaatgggccgagtggtggaccctccaatgcaatagatagtggtgccaacaatgataactacaacgaagtcgaaggcactgatgtctatgttggtgaagataatgttggttacgaggagagttatggtggtggtgatggtgattgtgactttgaagttggaggtgacttcggtgatgagggctatgatcagtcttatgatgacaattatggtgaaaatgatttcgaaagctatagcgacatcactggaggaagtgagtctatgtatgaagatggtgaatcttacgggactatgaatgattcacaatatagtggtttcaatgaagagcccaataaccagtatgcacccatggttgggccggttggtggaccaggaatgaataaccagaaccaatacggtcaaaatggtaggccgaggaatgtgggcatgtatggaagaggtggtacaaacatgaacagatatgggaacgtgaaccaaggtgcaaataggatgcaaccgagaactatgggtggtcgacctctccaatataggcccaatggaagacctaacatggcaaatggaggagtacccaatggacctctaggacttggcactccaatgttgatgaatacaatggtgcaaggtttatgccaaagctttgggatgaacatgctcattggtggtggcggtgatgctaatggtggagcgggtgatggtggtggaggaggcttttttggtggtgaaacagaattctaa

SEQ ID NO: 1326 - protein, 718 aa, Arabidopsis thaliana
MGKPTTQNNSFINHFSHPHRLQLTPATSSPPCSACKLTGGNGRVYSCRPCNFSLHESCSKMKQVITHPSHPSHTLSLLVAPVYDGGYFNCDGCGIHGTGFSYQCSVCDFDIHALCAYKPLSIIHKSHPQHNLKLAFQSPYGANKGFSCDICRKIGKNQWLYRCIPCEFDAHVGCITGPNPHLLQHSTSAPNPHTHHAGHPQHQNSLPVPNQGSNRVRPMPMTRPNRTINPNRPIAQNAAVNGPRRQNNNLGYNAQVGPNGPNELTGQGSMDGSGYNGSASATNKEFDVDVDVDVDVDVDVDVDVEVEYEGDVYVEEANDEGEDVDGNDEGEDVDGNGLEIVACVDNLSVAYSESDFGSSSDARSQCNDLSDADLYPLSLDNTQGPRPVRMNQGSGGGRKKNTNQNGQASRSKKIVGNGPRGGLQGSNSPIQSPRGPQTRRVQNVRNNPTRGRGGAVSVRVNRPRDPSAFIAPQGFNGPSGGPSNAIDSGANNDNYNEVEGTDVYVGEDNVGYEESYGGGDGDCDFEVGGDFGDEGYDQSYDDNYGENDFESYSDITGGSESMYEDGESYGTMNDSQYSGFNEEPNNQYAPMVGPVGGPGMNNQNQYGQNGRPRNVGMYGRGGTNMNRYGNVNQGANRMQPRTMGGRPLQYRPNGRPNMANGGVPNGPLGLGTPMLMNTMVQGLCQSFGMNMLIGGGGDANGGAGDGGGGGFFGGETEF

SEQ ID NO: 1327 - DNA, 2346 bp, Arabidopsis thaliana
atggagaaattgaaatcactgattcctgaagatcttcttcaaacggtgaaaagcagcagcgtcgatgatcttctttccacttcttcttcgcttctccgtttgtttctgggtcttccccaatttcaccaagcggtgagtgagttagcgaatcctgaattgggatgctgtgggaagaacgaggagacatctttggatttgaaacgtagaggaaatcactgtttccgtagccgagattttgacgaagctttgcgattatactccaaggctttacgtgttgctcctctagatgctattgacggagataagagcttacttgcttctctgtttctgaatagagctaatgtccttcataatcttggtcttctcaaagagagtttgcgggactgccatcgtgctcttcggattgatccttattatgcaaaggcgtggtataggagaggcaaacttaatactcttcttggaaactataaagatgcatttcgtgacattacagtttctatgtcgcttgagtcatcacttgtggggaagaagcagctacaaaatgagcttaaggctatacctgactaccaaaataaccaaacattggaacacgatgaatatcgtccaagcaatgatgctggcgtggatcatctgccgagtgtgcaaatggaagtaaagctgcgttgtgtgtcgacaaaagagaaaggaaggggtatggtatcagaatgtgatatcgaagaagcttctgtgatacatgttgaagaaccttttagtgtgttgcctgctgatactgtcccatgtccatcatgctcaatacctgtgtactgctcagagtcctgccaaatccaatcaggtggaatgctgtctacaaatgagatggataagcatcacatttttcaaaaactacctgatgatattgttgagcatataaaaggcgttacatcagctgatatttattattttgcgactgatctcattcaagaacaccagcatgagtgtaggggagccaattggcctgctgtactgccatctgatgctgttttagctggtcgaattataatgaagttaataaatcaagggaaagcagctactgatctttctaaccttcaggagatattagaactttcccatacctactctaagatgaatccagagaacaagttggagctgcatctactttccatagtattgatttggtgccttagtaaatctagctgccctaatctttcggtttgtgaagcttctgtgacgcagactatcatactgctgtcacaaatcaaggtgaactctatagctgttgcccgtatgaaatccagcggcgattctttcaagtgcctcccatctggaaacatctcaacaaaagagccaattcagagtttagagcagataagagttggccaggctctttataaaactggtagtttgttcaatcattcctgcaaaccaaacatccatttgtatttcctttcccgtggactgattatgcaaactacagagtttgttcccacgggttgtccccttgagctgtcatatggtcctgaggttgggaaatgggactgcaaaaatcgcattagatttcttgaagaggagtactttttccattgtcggtgccgtggctgtgctcaaattaacatatcagaccttgtcatcaatgggtatggctgtgtcaatacaaactgtactggtgtagttttagatagtaatgtggccacatgtgagtccgagaagctaaaccatttttttactgctccaagaaacgtggatcagcaagttcagatgagagagaaggtttatgctgatgttggggaagtggcttcgagtttgctaagtaaacctagtggttccctacatatagaacctgagatatgtttgaaatgtggttcccgctgtgacatagaaaattctcatgcagaggtgaacaaagcttggaatcacatgagaagggtggaagagttgatgaattcaggacgggccaattattctgtattatcagattgttcaaggtccatcgccgtgctcagaactttcctgcacatgtataacaaagacatcgctgatgcggaggataaggttgctcaggcgtgctatttagctggggaactggtggatgcaagaaagcattgtgaagcatccattaagattctgaagaggctgtatgaggatgaacacgtggtgattggaaatgaaatggtgaagcttgcgtcgattcagcttgcatcaggtgattccagtggagcttgggacactacaaagagatcgtctcagatattctcaaagtattacgggtcacatgctgagactctcttctcttatctcccatgtcttaagcaagaaactgccaaagctgtgaatttgtcaacttcttaa

SEQ ID NO: 1328 - protein, 781 aa, Arabidopsis thaliana
MEKLKSLIPEDLLQTVKSSSVDDLLSTSSSLLRLFLGLPQFHQAVSELANPELGCCGKNEETSLDLKRRGNHCFRSRDFDEALRLYSKALRVAPLDAIDGDKSLLASLFLNRANVLHNLGLLKESLRDCHRALRIDPYYAKAWYRRGKLNTLLGNYKDAFRDITVSMSLESSLVGKKQLQNELKAIPDYQNNQTLEHDEYRPSNDAGVDHLPSVQMEVKLRCVSTKEKGRGMVSECDIEEASVIHVEEPFSVLPADTVPCPSCSIPVYCSESCQIQSGGMLSTNEMDKHHIFQKLPDDIVEHIKGVTSADIYYFATDLIQEHQHECRGANWPAVLPSDAVLAGRIIMKLINQGKAATDLSNLQEILELSHTYSKMNPENKLELHLLSIVLIWCLSKSSCPNLSVCEASVTQTIILLSQIKVNSIAVARMKSSGDSFKCLPSGNISTKEPIQSLEQIRVGQALYKTGSLFNHSCKPNIHLYFLSRGLIMQTTEFVPTGCPLELSYGPEVGKWDCKNRIRFLEEEYFFHCRCRGCAQINISDLVINGYGCVNTNCTGVVLDSNVATCESEKLNHFFTAPRNVDQQVQMREKVYADVGEVASSLLSKPSGSLHIEPEICLKCGSRCDIENSHAEVNKAWNHMRRVEELMNSGRANYSVLSDCSRSIAVLRTFLHMYNKDIADAEDKVAQACYLAGELVDARKHCEASIKILKRLYEDEHVVIGNEMVKLASIQLASGDSSGAWDTTKRSSQIFSKYYGSHAETLFSYLPCLKQETAKAVNLSTS

SEQ ID NO: 1329 - DNA, 6687 bp, Arabidopsis thaliana; identical to SEQ ID NO: 1293

SEQ ID NO: 1330 - protein, 2228 aa, Arabidopsis thaliana; identical to SEQ ID NO: 1294

SEQ ID NO: 1331 - DNA, 768 bp, Arabidopsis thaliana
atggatgagcaggtccaagaacctctttctgatcaggtgtttatcaacttccgaggagatgagctgcgcgaaatctttgtcaaccatctagagctgcaattaagaaacgcagggatcaacgtcttcatagacactaaagagcagaaagggagaagactacaatatctcttcacaaggatcaagaagtcaaaaatcgcgcttgctatcttctccaagaggtactgtgagtcaaagtggtgtttggatgagcttgtgacgatgaatgaacagatgaaggaaaagaaactcgtggtgattccaatcttctataacgtaagatcggacgatgtaaaaagagcagccaatcccgatggagaaggcaatcttgatggagagttttcccttccttttaagcaactgaagcaaaaccatgcaggggagcctgagagggtcgagggttgggagcgtgccctgagatctgtgacaaaaagaatagggttttcccggtcaaactcaaagtacaaacacgataccgattttgttttggatattgttaaggaggttaagaaacagctaaacataccaactgacaacagttggtcagctataggagttgctttcttggctataaccatcaacttgatctttagtttcttcattgcccctaagtatctccctgatcagaagtttttccagactcctgaatggttcataggtactctggcagttgttcttgcgtcgtggttttggtacaaaaataaccagaacaaagcaccacctccttcataa

SEQ ID NO: 1332 - protein, 255 aa, Arabidopsis thaliana
MDEQVQEPLSDQVFINFRGDELREIFVNHLELQLRNAGINVFIDTKEQKGRRLQYLFTRIKKSKIALAIFSKRYCESKWCLDELVTMNEQMKEKKLVVIPIFYNVRSDDVKRAANPDGEGNLDGEFSLPFKQLKQNHAGEPERVEGWERALRSVTKRIGFSRSNSKYKHDTDFVLDIVKEVKKQLNIPTDNSWSAIGVAFLAITINLIFSFFIAPKYLPDQKFFQTPEWFIGTLAVVLASWFWYKNNQNKAPPPS

SEQ ID NO: 1333 - DNA, 750 bp, Arabidopsis thaliana
atggcgggaggaatagggctgggagacacgacatacacgaaggtgtttgtgggaggattagcttgggagacgcataaggagacgatgaagaagcactttgagcagtttggagagattttggaagccgtagtcatcaccgacaaggcctccggtagatccaagggctacggattcgtgacattcagggaagcggaggcggcgaggagtgcttgtgtggatgctactccggtgatcgacgggagaagagcaaattgcaacctcgcctctctcggtcttcaaagatccaaaccctccactcctaaccatggaggaggaggcaggattaacaatatgagagtgatgatgagcacaatgcagactggttttggaccacctccaccaccacaaccacccaccttcactcactatccccatctccctctcaatctctttgggtactctccatactcgccagactactcatcattccctacgaacttatacggcatgtacggctgcacttctggaggacaatacggagtctatggaaacagaaacagcggaggcggtggactaaccgcagcagccgcatccgctactcctttttatccttgtggtggaggacatggtggggtccagttctctcaaccacaaccattttatcatcacttgtcttcttataaccctcaccattactctcctccgaccttttctatgcaacaaggcgtaacaggctttccgcttcaaccacctcttattccttaccgttaa

SEQ ID NO: 1334 - protein, 249 aa, Arabidopsis thaliana
MAGGIGLGDTTYTKVFVGGLAWETHKETMKKHFEQFGEILEAVVITDKASGRSKGYGFVTFREAEAARSACVDATPVIDGRRANCNLASLGLQRSKPSTPNHGGGGRINNMRVMMSTMQTGFGPPPPPQPPTFTHYPHLPLNLFGYSPYSPDYSSFPTNLYGMYGCTSGGQYGVYGNRNSGGGGLTAAAASATPFYPCGGGHGGVQFSQPQPFYHHLSSYNPHHYSPPTFSMQQGVTGFPLQPPLIPYR

SEQ ID NO: 1335 - DNA, 1284 bp, Arabidopsis thaliana
atggcggataagaagaagcgaaagcgatcaaaagatgacgaggcggaggaacttcctttcaaaagcattctggaatcagacgacgttatcacggagcttctcaaatcgtatatttcctcttctatcaaagccgccgccggagccggcggtgcctcctcctcttcatcgaaacctctaaccctagctgacctctctctatcatcttcctgtcgtgaagtcgcagatctctcactctcctccgtgcagacagagatagagacagtcatcgtccagatcgcccgttctattctcgccggtgatggcttctccttcagtgttccttcacgcgccgcctcgaatcagctgtatgttcctgagctcgaccgtatagtgctaaaagacaaatctaccctccgtccatttgcctccgtttcttctgtcaggaaaaccaccatcaccactcgtatcctcgcccttatccaccaactctgcctcaggaacattcacgttactaagcgtgatctcttctacaccgacgttaagcttttccaggaccagacacagagtgatgctgtgttggatgatgtctcatgtatgctcggttgcacaaggtcaagtctcaatgtcattgcagcagagaaaggtgtggtggtgggaaggcttatattcagtgacaatggagacatgatagattgcacaaagatgggaatgggtgggaaagccattccaccaaacattgaccgggttggagatatgcagagtgatgctatgttcatactcttagttgaaaaagatgcagcttatatgaggttagctgaagacagattctataaccggttcccttgtatcatcgtgactgcaaaaggccagcctgatgtagctacaaggctcttcttgaggaaaatgaaaatggagcttaagcttccggtacttgccttggtggatagtgatccttacggattgaagatcttgtcggtgtatggatgtgggtcgaagaacatgtcatatgatagtgcaaacttgactacgcctgatattaagtggcttggaattaggccgagtgatttggacaagtataagatacctgaacagtgtaggttgccgatgactgagcaggatattaagaccgggaaggatatgctagaggaggatttcgtgaagaaaaatcccgggtgggtcgaggaacttaacctgatggtgaaaacgaagcaaaaggctgagattcaggcgttgagctcttttggtttccagtatttatcggaagtttacttgcccctgaaactgcagcagcaggattggctctga

SEQ ID NO: 1336 - protein, 427 aa, Arabidopsis thaliana
MADKKKRKRSKDDEAEELPFKSILESDDVITELLKSYISSSIKAAAGAGGASSSSSKPLTLADLSLSSSCREVADLSLSSVQTEIETVIVQIARSILAGDGFSFSVPSRAASNQLYVPELDRIVLKDKSTLRPFASVSSVRKTTITTRILALIHQLCLRNIHVTKRDLFYTDVKLFQDQTQSDAVLDDVSCMLGCTRSSLNVIAAEKGVVVGRLIFSDNGDMIDCTKMGMGGKAIPPNIDRVGDMQSDAMFILLVEKDAAYMRLAEDRFYNRFPCIIVTAKGQPDVATRLFLRKMKMELKLPVLALVDSDPYGLKILSVYGCGSKNMSYDSANLTTPDIKWLGIRPSDLDKYKIPEQCRLPMTEQDIKTGKDMLEEDFVKKNPGWVEELNLMVKTKQKAEIQALSSFGFQYLSEVYLPLKLQQQDWL

SEQ ID NO: 1337 - DNA, 1458 bp, Arabidopsis thaliana
atgctgaataagctcacgcacggcgttttcacgtaccgtgccagcctcaccgccatgttatcttcttcaacctctgctggtttatcgtcttcgttcgtttcttcgagatttcttagttccggtatattctctagtggcgcttcgaggaatcgcgtgacttttcccgttcagtttcatcgcgcatcagctgttcgatgttttgcttcttcaggcggttctgatagaattcaggttcagaatcctatcgttgaaatggatggcgatgaaatgacgagggtgatatggagtatgataaaggagaaacttattcttccttatctggatttggacattaagtacttcgacttggggattctgaatcgcgatgctactgatgacaaggttacagttgaaagtgcagaagcagctcttaagtacaatgttgctatcaaatgtgccactataactcctgatgagggtagagtgaaggagtttggactgaaatcaatgtggaggagtcctaatgggacgatcagaaacattctagatggaaccgtattccgtgaacctattatgtgcagcaatatcccccggcttgttcctggttgggaaaagcctatatgcattggtagacatgcctttggtgaccagtatcgtgccactgatacagtaattaaagggccaggaaagttgaaaatggtttttgtcccagaagatggaaacgcacctgtggagctagatgtatatgatttcaagggcccaggtgtcgcacttgctatgtacaacgtagatgagtcaattagagcttttgctgagtcatctatggcgatggcattaactaagaaatggccattatacttgagcaccaagaacacaattctcaagaaatatgatggcagatttaaggacatatttcaagaagtttatgaggcgaattggaagcaaaagtttgaagagcactcaatctggtacgagcaccggttgattgatgacatggtggcttacgcagtcaaaagtgaaggtggctatgtctgggcttgcaaaaactacgacggtgatgttcaaagcgatcttcttgcccaagggtttggctcattaggcctcatgacctccgttttgctgtccgctgatgggaaaacactcgagtcggaagcggctcatggaacagtaactcggcatttccgactgcaccaaaagggacaagaaaccagtactaacagcatagcctcaatatttgcatggacacgcggcttagaacacagggcgaaactggataagaacgagaaattaatggatttcgtgaagaagctcgagtcgtcatgtgtaaacactgttgagacagggaaaatgaccaaggatcttgcccttttaatccatggtcccaaggtgagtagggatttgtttttgaacacggaagagttcattgatgcagtagcctccaagctcaaaacacagttcaaagagcttcctcttgtctga

SEQ ID NO: 1338 - protein, 485 aa, Arabidopsis thaliana
MLNKLTHGVFTYRASLTAMLSSSTSAGLSSSFVSSRFLSSGIFSSGASRNRVTFPVQFHRASAVRCFASSGGSDRIQVQNPIVEMDGDEMTRVIWSMIKEKLILPYLDLDIKYFDLGILNRDATDDKVTVESAEAALKYNVAIKCATITPDEGRVKEFGLKSMWRSPNGTIRNILDGTVFREPIMCSNIPRLVPGWEKPICIGRHAFGDQYRATDTVIKGPGKLKMVFVPEDGNAPVELDVYDFKGPGVALAMYNVDESIRAFAESSMAMALTKKWPLYLSTKNTILKKYDGRFKDIFQEVYEANWKQKFEEHSIWYEHRLIDDMVAYAVKSEGGYVWACKNYDGDVQSDLLAQGFGSLGLMTSVLLSADGKTLESEAAHGTVTRHFRLHQKGQETSTNSIASIFAWTRGLEHRAKLDKNEKLMDFVKKLESSCVNTVETGKMTKDLALLIHGPKVSRDLFLNTEEFIDAVASKLKTQFKELPLV

SEQ ID NO: 1339 - DNA, 1857 bp, Arabidopsis thaliana
atggaaggtctgattcaaaccagaggaattctctctttacccgcgaagcccatcggagtgagaaggcttctccaaccctcacatggcttaaagcaaagacttttcaccacaaacttacctgccttgtccttatcctctaatggtcacaagaaatttcaagcctttcagcaaatcccacttgggatttcggtttcccacaaggagagaagcagaggattcatctgcaaggcggaagctgcggcggccggaggcggaaatgtgttcgacgaaggagacacagcggcgatggcggtgtcgcctaagattttcggtgtggaggttacgactctgaagaagattgttcctttagggctaatgttcttttgcatccttttcaattacacaatccttagggacacgaaggatgttttggtggtgacggctaaaggaagttctgctgagattataccctttttgaagacatgggtgaatcttccgatggctattgggtttatgttgctatacaccaaactttccaatgttctctccaaaaaggctctcttttacactgttattgttcctttcattgtctactttggagcctttggtttcgtgatgtaccctctcagcaatttgattcatcctgaagctcttgctgataagcttcttgcaacactcggccccagattcatgggtcctctcgcaatcatgaggatttggagtttctgtttgttctatgtcatggctgagctttggggtagtgttgtcgtttcagttctcttctggggatttgccaaccagattacaactgttgacgaagccaaaaagttctatcctctgtttggacttggggccaatgttgcacttatcttctcaggaagaactgtgaaatatttctctaatatgagaaagaatcttggtcctggagttgatggctgggctgtttcattaaaagctatgatgagtattgtcgtggggatgggtctcgccatctgtttcctctactggtgggtgaatagatatgtgcccctcccaacccgtagcaagaagaagaaggtgaaaccacagatgggaacaatggagagcttgaagttcttggtgtcatcaccatacattagggatcttgctactttggtggttgcatatggaattagtatcaaccttgttgaagtcacatggaaatcaaagcttaaagctcagttccctagcccgaacgaatactcagcatttatgggcgacttctcaacctgcacaggtattgcaacattcacaatgatgcttctaagccaatacgtgtttaagaagtatggttggggagtagctgcaaagatcacaccaaccgttctgctattgaccggtgttgccttcttctctctgatactgtttggtggcccattcgcaccattggttgccaagcttggtatgacaccgctactcgcagcagtgtacgttggtgccctccagaatatcttcagcaagagtgccaagtacagcttgttcgatccttgcaaagaaatggcttatatcccattggatgaggacaccaaggttaaaggcaaagctgcaattgatgtggtctgcaacccattggggaaatcaggcggtgctctaatccagcagttcatgatccttacattcggctcactcgccaattccacaccttaccttggagtcatcctgctcggtatagtcactgcatggttagcagcagctaaatcgctggagggacagtttaacactctcatgtctgaggaagagcttgagagggaaatggagagagcttcatcagtcaagattcctgttgtatctcaggaggatgcgccatcaggagaaactacgagccaactatcggagaaatctactcctactggcatttag

SEQ ID NO: 1340 - protein, 618 aa, Arabidopsis thaliana
MEGLIQTRGILSLPAKPIGVRRLLQPSHGLKQRLFTTNLPALSLSSNGHKKFQAFQQIPLGISVSHKERSRGFICKAEAAAAGGGNVFDEGDTAAMAVSPKIFGVEVTTLKKIVPLGLMFFCILFNYTILRDTKDVLVVTAKGSSAEIIPFLKTWVNLPMAIGFMLLYTKLSNVLSKKALFYTVIVPFIVYFGAFGFVMYPLSNLIHPEALADKLLATLGPRFMGPLAIMRIWSFCLFYVMAELWGSVVVSVLFWGFANQITTVDEAKKFYPLFGLGANVALIFSGRTVKYFSNMRKNLGPGVDGWAVSLKAMMSIVVGMGLAICFLYWWVNRYVPLPTRSKKKKVKPQMGTMESLKFLVSSPYIRDLATLVVAYGISINLVEVTWKSKLKAQFPSPNEYSAFMGDFSTCTGIATFTMMLLSQYVFKKYGWGVAAKITPTVLLLTGVAFFSLILFGGPFAPLVAKLGMTPLLAAVYVGALQNIFSKSAKYSLFDPCKEMAYIPLDEDTKVKGKAAIDVVCNPLGKSGGALIQQFMILTFGSLANSTPYLGVILLGIVTAWLAAAKSLEGQFNTLMSEEELEREMERASSVKIPVVSQEDAPSGETTSQLSEKSTPTGI

SEQ ID NO: 1341 - DNA, 645 bp, Arabidopsis thaliana
atggtgaaactaacaatagttggtagggttgaagatggattgcctcttgcacaagatcaaacctatgtcaaccaagaggacaatactagtttcttgctgtacaagcaacaagcagaatttcttcttaaacaagtctccaaagactcattattacatccaaagatgaccatcttgctcgatcatcattctttccacttcctggtggagaagaagatatgttacatcgcgctatctgattcttcatatccaagaaagctattgtttaattacttgcagaatctgaacaaggagcttgataagctggacgagaaagcactgatccagaaaatctcaaagccctatagcttcattaggtttggtaagatcatagggagaataagaaaacaatatatagacacgagaacacaagctaatctatcgaagctgaatgcattgcggaaacaagaactcgatgtagttactgagcatttgaatgatataatacaaagacaacaaattttaggcgtcctcagatcctccaatgattgtttcaaccatttggagctcacgatgtcttcaggatatttcgttaaaatggacaccagtgacgattattattctcgttattcttgttcttttcaaagcaagcttgattatgacagatga

SEQ ID NO: 1342 - protein, 214 aa, Arabidopsis thaliana
MVKLTIVGRVEDGLPLAQDQTYVNQEDNTSFLLYKQQAEFLLKQVSKDSLLHPKMTILLDHHSFHFLVEKKICYIALSDSSYPRKLLFNYLQNLNKELDKLDEKALIQKISKPYSFIRFGKIIGRIRKQYIDTRTQANLSKLNALRKQELDVVTEHLNDIIQRQQILGVLRSSNDCFNHLELTMSSGYFVKMDTSDDYYSRYSCSFQSKLDYDR

SEQ ID NO: 1343 - DNA, 2256 bp, Arabidopsis thaliana
atgtcaatggagaagccacctttggcctccggtttagctcgaacacgatcggagcagctatatgagacggttgcagcagacataaggtcacctcacggctccatggacgctaatggtgtgcctgcgacggctccagcagccgttggaggaggaggaacgttgtcgaggaaatcaagccggaggttgatggggatgtctccggggaggagtagcggcgccggaacacacataaggaagtctaggagcgctcagcttaagctcgagctagaggaagtgagtagcggcgcagctttgagccgtgcgtctagcgcatcgctcggtctttcattttccttcaccgggtttgctatgccgccggaggaaatctccgactctaaaccgttcagcgacgacgagatgatacccgaagatattgaagcgggaaagaagaagcctaagtttcaagcagaaccaacattgcccatctttctcaagttcagggatgttacatacaaagtggtgatcaagaaattgacttcatctgtggagaaagagatattaactgggataagtgggagtgtgaatcctggtgaagttcttgctctcatgggaccctcagggagtggcaaaacaactcttcttagcttacttgctggtcgaatctctcaatcctctactggaggctctgttacttacaacgacaagccttactctaaatacttgaaaagcaagattgggtttgtgactcaagatgatgttctgtttcctcatcttaccgtgaaagaaacgctaacctatgctgctcgtctgcgcttacccaagactcttacgagagagcagaagaagcaacgagctttagacgttatccaagagttgggtttagagagatgccaagacactatgattggtggagcattcgtgcgtggtgtatcaggtggagagaggaaaagagtttctattggaaacgagatcatcattaatccttctctattacttcttgatgaaccaacctctggtttagattccaccactgctcttagaaccattctgatgctccatgacatcgccgaggcggggaaaaccgtgatcacaacgatacatcagccctcgagtaggctcttccataggtttgacaagctgattctactaggaagaggaagtcttctctactttggaaaatcatcagaagctttagattacttctcttccattggatgctctcctcttatcgccatgaatcctgcagagttcttgctcgatcttgccaacggtaacatcaacgatatctctgtaccttctgagttagatgatagagttcaagttggcaattcaggtagagaaactcaaactggcaagccatctcctgctgctgttcatgagtatctagtggaggcctacgagactagggttgcagaacaggagaagaagaaactattggatcctgtgccactcgatgaagaagctaaggccaaaagtacgcgtctaaagcgccaatggggaacgtgctggtgggagcaatattgcatactattctgcagaggactcaaagaacggcgacacgaatacttcagttggttgcgtgttacgcaagttctttccacagctgtcattttaggtcttctctggtggcagtcggacattaggactccaatgggactacaagatcaggctggtttgctcttcttcatagcagttttttggggattcttccctgttttcacagcgatctttgcgtttccgcaagagcgagcgatgttaaataaggagagagcagcggatatgtacagattaagcgcatatttcctagctcgaaccacgagtgatctccctctcgactttattctaccttctctcttccttcttgtcgtctatttcatgacaggtcttcggatcagcccatatcccttcttcttgagcatgctcacagttttcctttgcatcatcgcagctcagggactcggacttgcaattggtgccattttaatggatttaaagaaggctacgactttggcttcagtaactgtcatgacattcatgctcgccggaggattcttcgtcaagaaagtgccggttttcatatcgtggatacgttatctatctttcaattaccacacctacaagcttcttcttaaagtacaatatcaggacttcgctgtgtccatcaacgggatgagaatagacaacggactaactgaagtagccgcactcgttgtcatgatattcggttatcgcctcctcgcgtatctgtctctaaggcaaatgaagatcgtaacataa

SEQ ID NO: 1344 - protein, 751 aa, Arabidopsis thaliana
MSMEKPPLASGLARTRSEQLYETVAADIRSPHGSMDANGVPATAPAAVGGGGTLSRKSSRRLMGMSPGRSSGAGTHIRKSRSAQLKLELEEVSSGAALSRASSASLGLSFSFTGFAMPPEEISDSKPFSDDEMIPEDIEAGKKKPKFQAEPTLPIFLKFRDVTYKVVIKKLTSSVEKEILTGISGSVNPGEVLALMGPSGSGKTTLLSLLAGRISQSSTGGSVTYNDKPYSKYLKSKIGFVTQDDVLFPHLTVKETLTYAARLRLPKTLTREQKKQRALDVIQELGLERCQDTMIGGAFVRGVSGGERKRVSIGNEIIINPSLLLLDEPTSGLDSTTALRTILMLHDIAEAGKTVITTIHQPSSRLFHRFDKLILLGRGSLLYFGKSSEALDYFSSIGCSPLIAMNPAEFLLDLANGNINDISVPSELDDRVQVGNSGRETQTGKPSPAAVHEYLVEAYETRVAEQEKKKLLDPVPLDEEAKAKSTRLKRQWGTCWWEQYCILFCRGLKERRHEYFSWLRVTQVLSTAVILGLLWWQSDIRTPMGLQDQAGLLFFIAVFWGFFPVFTAIFAFPQERAMLNKERAADMYRLSAYFLARTTSDLPLDFILPSLFLLVVYFMTGLRISPYPFFLSMLTVFLCIIAAQGLGLAIGAILMDLKKATTLASVTVMTFMLAGGFFVKKVPVFISWIRYLSFNYHTYKLLLKVQYQDFAVSINGMRIDNGLTEVAALVVMIFGYRLLAYLSLRQMKIVT

SEQ ID NO: 1345 - DNA, 444 bp, Arabidopsis thaliana
atggatataaaatcggaaacagagcaatacaaaagaaaagcagagatagagaaacacacaaaggagccaaataaacacagagacgaagcagtgctccaaaatagagctgggaggcacagagaccgagccgtaatagatcacaaaagcgaagaaagagagagagaaagcgtacagaatgttacagagatgagtgggattgagagatctgagggtgagtggtcgccgccggtggaaggaattaccgacgaggagctgccgtctcactcgccgatggatgatctagggtttgctttgttcgcgagttgggggagaaagacagagagacagagaatgggatctcctgacataaggatttatatttttaatccgataaaaaagataataataatggaaactagaatccggtttggtctagaatggaaaccaagcggttttggttcttga

SEQ ID NO: 1346 - protein, 147 aa, Arabidopsis thaliana
MDIKSETEQYKRKAEIEKHTKEPNKHRDEAVLQNRAGRHRDRAVIDHKSEERERESVQNVTEMSGIERSEGEWSPPVEGITDEELPSHSPMDDLGFALFASWGRKTERQRMGSPDIRIYIFNPIKKIIIMETRIRFGLEWKPSGFGS

SEQ ID NO: 1347 - DNA, 963 bp, Arabidopsis thaliana
atggctacggctgttggtggcggaagcgatgtggaggttggatttgcgaagcttcaaggtgaggatttcgagtactatatgcagtcttactccattatactcggccggaattctaagaaagccaccgtcgacgttgatctctcatccctcggcggtgggatgaacatctcgcgcaaccacgctcggatcttctatgacttcactagacgacgcttctctctcgaggtccttggcaaaaatggctgcctcgttgaaggtgttcttcatctccctgggaatcctaacgtcaagctcgattcacaagaccttttgcagatcggagacaaagagttctactttctcctaccggttcggagcatcttaggcgggccgttgggacctaggcaccacgtctctgggcaaacaagtgttgttccataccataattatcagtcgggtccaggttctgggtcgggtaagaagggcgtcaggagtagagagttgtatgagtacgatgatgaagatgatgatgacgacgacgatgaggaggacgatatgagaggaagtggaaagaaaacaaggagagatggacatgaagtagtatatgcttccggagagaagaagagagagggaagatcaaaggtagatcgtgaagctgatgatcaacaatttttgcagctggaggaaaaagatgttgtatcgtctgttgccactgtgctttccgatttgtgtggtccgggagagtggatgcctatggaaaaacttcattcggtgatattaaaggagtatggaaacgtatggcatcacagtcgagtaagaagatacctatcacaagaagactgggctatccctgaagcaaaaggtaaaccatggtacggtttgctgatgctgctgagaaaatacccggagcatttcgtcatcaacacgagatcaaagggaagagttacccttgaattcgtttccctcgttaccctactctcatga

SEQ ID NO: 1348 - protein, 320 aa, Arabidopsis thaliana
MATAVGGGSDVEVGFAKLQGEDFEYYMQSYSIILGRNSKKATVDVDLSSLGGGMNISRNHARIFYDFTRRRFSLEVLGKNGCLVEGVLHLPGNPNVKLDSQDLLQIGDKEFYFLLPVRSILGGPLGPRHHVSGQTSVVPYHNYQSGPGSGSGKKGVRSRELYEYDDEDDDDDDDEEDDMRGSGKKTRRDGHEVVYASGEKKREGRSKVDREADDQQFLQLEEKDVVSSVATVLSDLCGPGEWMPMEKLHSVILKEYGNVWHHSRVRRYLSQEDWAIPEAKGKPWYGLLMLLRKYPEHFVINTRSKGRVTLEFVSLVTLLS

SEQ ID NO: 1349 - DNA, 510 bp, Arabidopsis thaliana
atggcggatgaatctccaaagtctatctacgacttcaccgtcaaggatatcggaggtaacgatgtgagtttggaccaatacaaaggcaaaactcttttggttgtaaacgttgcttccaaatgtggtctgacggatgcgaactacaaggaactgaatgttctgtacgagaaatacaaggagcaagggttggagatattagcattcccgtgtaatcagttcttaggacaagaaccaggaaacaatgaagagattcaacaaactgtctgcaccaggttcaaagctgaattccccatctttgacaaggtggatgtgaacggtaagaacacggcaccattatacaagtacttgaaagcagagaaaggaggtttgctcattgatgctatcaaatggaacttcaccaaattcttggtttctcctgatggcaaggtcttacagagatattctcccagaacctctcctcttcaattcgagaaggacattcaaactgcgttgggacaggcctcttcttaa

SEQ ID NO: 1350 - protein, 169 aa, Arabidopsis thaliana
MADESPKSIYDFTVKDIGGNDVSLDQYKGKTLLVVNVASKCGLTDANYKELNVLYEKYKEQGLEILAFPCNQFLGQEPGNNEEIQQTVCTRFKAEFPIFDKVDVNGKNTAPLYKYLKAEKGGLLIDAIKWNFTKFLVSPDGKVLQRYSPRTSPLQFEKDIQTALGQASS

SEQ ID NO: 1351 - DNA, 2178 bp, Arabidopsis thaliana
atggagattaacggggcacacaagagcaacggaggaggagtggacgctatgttatgcggcggagacatcaagacaaagaacatggtgatcaacgcggaggatcctctcaactggggagctgcagcggagcaaatgaaaggtagccatttggatgaagtgaagagaatggttgctgagtttaggaagccagttgtgaatcttggtggtgagactctgaccattggacaagtggctgcgatctcaactattggtaacagtgtgaaggtggagctatcggagacagctagagccggtgtgaatgctagtagtgattgggttatggagagtatgaacaaaggcactgatagttatggtgttactactggttttggtgctacttctcatcggagaaccaaaaacggtgtcgcacttcagaaggaacttattagattccttaacgccggaatattcggaagcacgaaagaaacaagccacacattgccacactccgccacaagagccgccatgcttgtacgaatcaacactctcctccaaggattttccggtatccgatttgagattctcgaagcaattaccagtttcctcaacaacaacatcactccatctctccccctccgtggtacaatcaccgcctccggagatctcgttcctctctcctacatcgccggacttctcaccggtcgtcccaattccaaagctactggtcccaacggtgaagctttaacagcagaggaagctttcaaattagcaggaatcagctccggattctttgatctccagcctaaggaaggtctcgcgctagtcaatggcacggcggttggatctggaatggcgtcaatggtgttattcgaaacgaatgttctctctgttttggctgagattttgtcggcggttttcgcagaggtgatgagtggtaagcctgagttcaccgatcatctcactcacagacttaaacatcatcccggtcaaatcgaagcggcggcgataatggagcatatcctcgacggaagctcgtacatgaaattagctcagaagcttcacgagatggatccgttacagaaacctaaacaagatcgttacgctcttcgtacttctcctcaatggttaggtcctcaaatcgaagtgatccgttacgcaacgaaatcgatcgagcgtgagattaactccgtcaacgataatccgttgatcgatgtttcgaggaacaaggcgattcacggtggtaacttccaaggaacaccaatcggagtttcaatggataacacgagattggcgatagcagcgattggtaaactcatgtttgctcaattctcagagcttgtgaatgatttctacaacaatggtttaccctcgaatctaaccgcttcgaggaatccaagtttggattatggattcaagggagctgagattgcaatggcttcttattgttcagagcttcaatacttagctaatcctgtgactagccatgttcaatcagcagagcaacataaccaagatgtcaactctttgggactaatctcgtctcgcaaaacttctgaagctgttgatattctcaagcttatgtcaacaacgttcctcgttgcgatttgtcaagctgtggatttgagacatttggaggagaatttgagacagactgtgaagaacactgtctctcaagtggcgaagaaagttcttactactggagtcaatggtgagcttcatccttctcgcttctgcgaaaaggatttactcaaagttgtagaccgtgaacaagtctacacatacgcggatgatccttgtagcgcaacgtacccgttgattcagaagctgagacaagttattgttgaccatgctttgatcaatggtgagagtgagaagaatgcagtgacttcaatcttccataagattggagctttcgaggaggagcttaaggcagtgctaccgaaagaagtggaagcagcaagagcagcctacgataacggaacatcggctatcccgaacaggatcaaggaatgtaggtcgtatccattgtatagattcgtgagggaagagcttggaacagagcttttgaccggagagaaagtgacgtcgcctggagaagagttcgacaaggttttcacggcgatttgtgaaggtaaaatcattgatccgatgatggaatgtctcaacgagtggaacggagctcccattccaatatgttaa

SEQ ID NO: 1352 - protein, 725 aa, Arabidopsis thaliana
MEINGAHKSNGGGVDAMLCGGDIKTKNMVINAEDPLNWGAAAEQMKGSHLDEVKRMVAEFRKPVVNLGGETLTIGQVAAISTIGNSVKVELSETARAGVNASSDWVMESMNKGTDSYGVTTGFGATSHRRTKNGVALQKELIRFLNAGIFGSTKETSHTLPHSATRAAMLVRINTLLQGFSGIRFEILEAITSFLNNNITPSLPLRGTITASGDLVPLSYIAGLLTGRPNSKATGPNGEALTAEEAFKLAGISSGFFDLQPKEGLALVNGTAVGSGMASMVLFETNVLSVLAEILSAVFAEVMSGKPEFTDHLTHRLKHHPGQIEAAAIMEHILDGSSYMKLAQKLHEMDPLQKPKQDRYALRTSPQWLGPQIEVIRYATKSIEREINSVNDNPLIDVSRNKAIHGGNFQGTPIGVSMDNTRLAIAAIGKLMFAQFSELVNDFYNNGLPSNLTASRNPSLDYGFKGAEIAMASYCSELQYLANPVTSHVQSAEQHNQDVNSLGLISSRKTSEAVDILKLMSTTFLVAICQAVDLRHLEENLRQTVKNTVSQVAKKVLTTGVNGELHPSRFCEKDLLKVVDREQVYTYADDPCSATYPLIQKLRQVIVDHALINGESEKNAVTSIFHKIGAFEEELKAVLPKEVEAARAAYDNGTSAIPNRIKECRSYPLYRFVREELGTELLTGEKVTSPGEEFDKVFTAICEGKIIDPMMECLNEWNGAPIPIC

SEQ ID NO: 1353 - DNA, 816 bp, Arabidopsis thaliana
atggaccgaaccatgtttctttccctgacaatagcctcactcttggtcggagtcgtctcagctggtgactggaacatcttgaaccaactcagaggactcggctcatcgtcaagccaaaatggtatcgtttctaaaggtatcaagacggacctgaaaggatactgtgaaagctggaggatcaacgtggaagttcacaacatcagaaagttcgatgtggtgcctcaagagtgtgtatcgcacattaaggattacatgacgtcatcgcagtacaaggatgacgtggcgagaaccgttgatgaggtcattcttcatttcgggagcatgtgctgtagcaagtctaagtgtgacggcatggacgcttggatctttgatatcgatgacacgcttctctctaccatcccttaccacaagaaaaatggcttcttcggaggagagaaattgaactcaacgaaattcgaggattggatacagaagaagaaagcaccagcagtgccacacatgaagaaattgtaccacgacatcagagaaagaggcattaagatcttcttgatctcttcccggaaagaatatctcaggtctgccaccgtcgacaacctcatccaagccggttactatggctggtccaacctaatgctcagggggctagaagatcagcaaaaggaagtgaaacaatacaagtcagagaagagaaaatggctaatgagtcttggttacagagtctggggagtgatgggtgaccaatggagtagctttgcaggctgtcctcttcccaggagaaccttcaagctccctaactccatctactatgtcgcctga

SEQ ID NO: 1354 - protein, 271 aa, Arabidopsis thaliana
MDRTMFLSLTIASLLVGVVSAGDWNILNQLRGLGSSSSQNGIVSKGIKTDLKGYCESWRINVEVHNIRKFDVVPQECVSHIKDYMTSSQYKDDVARTVDEVILHFGSMCCSKSKCDGMDAWIFDIDDTLLSTIPYHKKNGFFGGEKLNSTKFEDWIQKKKAPAVPHMKKLYHDIRERGIKIFLISSRKEYLRSATVDNLIQAGYYGWSNLMLRGLEDQQKEVKQYKSEKRKWLMSLGYRVWGVMGDQWSSFAGCPLPRRTFKLPNSIYYVA

SEQ ID NO: 1355 - DNA, 1434 bp, Arabidopsis thaliana
atgggattctggggacttgaagtgaaacctgggaagcctcaagcttataatccaaaaaatgaacaaggaaagattcacgtgacccaggcaactctaggtacgggtttgagcaaagaaaagagtgtgattcagtgttcaataggagacaaggctcctattgctttgtgttcattgttgccaaacaaaatcgaatgttgccctctgaatcttgagtttgacgatgatgatgagccagtggaattcaccgtgactggtgacagaagtatccacttgtctggattcttggagtattatcaggacgatgaagatgattatgagcatgatgaagatgattcagatggtattgatgttggtgagtctgaggaagacgattcgtgtgaatatgatagtgaagaggatgagcaattggatgaatttgaagacttccttgatagcaatcttgaaaggtatcggaatgctgctgccccaaagagtggagttataattgaggagatagaagatgaagagaaacctgccaaagataataaggcaaaacaaaccaagaagaagagtcaagctagcgaaggtgagaatgcaaagaaacaaatcgttgccatagagggtgcccatgttccagttttggaaagcgaagatgaagacgaagacggtttacctattcctaaaggaaaatcatctgaagtagagaatgcgtcaggtgagaagatggttgtagataatgacgaacaaggtagtaacaagaaacggaaggccaaggctgctgagcaagatgatggacaagaaagtgcaaacaagagtaaaaagaagaaaaatcagaaagagaagaagaaaggggaaaatgtcttaaatgaggaagctggacaagttcagacgggaaatgttctgaagaagcaggatattagccaaatttcttcaaacacaaaagctcaagatggaactgcaaacaatgccatgagtgaaagctccaagaccccagataaatctgctgagaagaaaactaaaaataagaaaaagaagaaaccaagtgacgaagctgcagaaatttctggtactgttgagaagcaaaccccagcggactccaagtcttctcaagtacggacatacccaaatgggctcattgttgaagagttgagcatgggaaaacccaacggcaagagagctgatcctggaaaaacggtttctgtgcgctatattggaaaacttcagaagaatgggaagattttcgattccaacattggaaaatcaccatttaagtttcgtctaggtattggatcagtcattaagggatgggatgttggagttaatggcatgcgcgttggtgacaaaaggaagcttacaattcctccatcaatggggtatggtgtgaagggtgctggtggccagattcctcctaattcttggctgacttttgatgtcgaactgattaatgttcaataa

SEQ ID NO: 1356 - protein, 477 aa, Arabidopsis thaliana
MGFWGLEVKPGKPQAYNPKNEQGKIHVTQATLGTGLSKEKSVIQCSIGDKAPIALCSLLPNKIECCPLNLEFDDDDEPVEFTVTGDRSIHLSGFLEYYQDDEDDYEHDEDDSDGIDVGESEEDDSCEYDSEEDEQLDEFEDFLDSNLERYRNAAAPKSGVIIEEIEDEEKPAKDNKAKQTKKKSQASEGENAKKQIVAIEGAHVPVLESEDEDEDGLPIPKGKSSEVENASGEKMVVDNDEQGSNKKRKAKAAEQDDGQESANKSKKKKNQKEKKKGENVLNEEAGQVQTGNVLKKQDISQISSNTKAQDGTANNAMSESSKTPDKSAEKKTKNKKKKKPSDEAAEISGTVEKQTPADSKSSQVRTYPNGLIVEELSMGKPNGKRADPGKTVSVRYIGKLQKNGKIFDSNIGKSPFKFRLGIGSVIKGWDVGVNGMRVGDKRKLTIPPSMGYGVKGAGGQIPPNSWLTFDVELINVQ

SEQ ID NO: 1357 - DNA, 864 bp, Arabidopsis thaliana
atggaaggcaaagaagaagacgtcaatgttggagccaacaagttcccagagagacagccgatcggtacggcggctcagacggagagcaaggactataaggaaccaccaccggcgccgtttttcgaacccggcgagctcaaatcttggtctttctacagagcagggatagctgagttcatagccactttccttttcctctacgtcaccgttttgacagtcatgggtgttaagagagctcccaatatgtgtgcctctgttggaatccaaggcatcgcttgggcttttggtggcatgatctttgctcttgtttactgtactgctggaatctcaggaggacatattaatccggcggtgacttttggtttgttcttggcgaggaagctatctttaaccagagctctgttctacatagtaatgcagtgccttggagctatatgtggtgctggtgtggttaaagggtttcaaccagggctgtaccagacgaatggcggtggagctaatgtggtggctcatggttacacaaagggttcaggtcttggtgcagagattgttggaacttttgttctggtttacactgttttctcagctactgatgctaagagaagtgccagagactctcatgtccctatcttggctccgcttccaattgggtttgctgtcttcttggtgcacttggctaccatcccaattactggaactggcattaacccggccaggagtctcggagctgccatcatctacaacaaggatcatgcttgggatgaccattggatcttctgggtcggtccattcattggtgctgcgcttgctgctctgtaccatcagatagtcatcagagctattcctttcaagtccaagacataa

SEQ ID NO: 1358 - protein, 287 aa, Arabidopsis thaliana
MEGKEEDVNVGANKFPERQPIGTAAQTESKDYKEPPPAPFFEPGELKSWSFYRAGIAEFIATFLFLYVTVLTVMGVKRAPNMCASVGIQGIAWAFGGMIFALVYCTAGISGGHINPAVTFGLFLARKLSLTRALFYIVMQCLGAICGAGVVKGFQPGLYQTNGGGANVVAHGYTKGSGLGAEIVGTFVLVYTVFSATDAKRSARDSHVPILAPLPIGFAVFLVHLATIPITGTGINPARSLGAAIIYNKDHAWDDHWIFWVGPFIGAALAALYHQIVIRAIPFKSKT

SEQ ID NO: 1359 - DNA, 1479 bp, Arabidopsis thaliana
atggatccttacaagtatcgtccagctagttcttacaactctcccttcttcaccaccaactctggtgctcctgtatggaacaacaactcctccatgaccgttggacccagaggtcctatccttcttgaggattaccatctcgttgagaagcttgccaatttcgacagggaacggattccagagcgtgtggttcatgccagaggagccagtgctaaaggtttctttgaggtcactcatgatatctctaacctcacttgtgctgactttctccgagctcccggtgttcagactcctgtcattgtccggttctccaccgttatccatgagcgtggaagtcccgagaccttgagagaccctcgtggttttgcagtcaagttctacaccagagaggggaactttgatcttgttggaaacaactttcctgttttcttcatccgcgatgggatgaagttccctgacatggtccacgctcttaagccgaacccaaaatctcacatccaagagaactggagaatccttgacttcttctcccaccaccctgaaagtttgaacatgttcactttcctcttcgatgatatcggtatcccacaagattacaggcacatggatggttcaggtgtcaatacatacatgttgatcaacaaagctggcaaagctcactacgtgaagttccattggaaaccaacttgtggagtcaagtctcttttggaagaagatgcaattcgtgttggaggaaccaaccacagtcatgcgactcaagacttgtatgactctatagctgctggaaactaccctgaatggaagctctttatccaaatcattgatcctgctgatgaagacaagttcgactttgacccgctcgatgtgaccaagacctggcctgaggatatcttgcctcttcaacctgttggacgtatggtgttgaacaagaacattgacaacttctttgcagagaatgagcaacttgctttctgtcctgcaattattgtcccagggatacattactcagatgataagctgcttcaaacccgtgtcttctcctatgccgatactcagagacaccgtcttggaccaaactaccttcagctgccagtcaatgctccaaaatgtgctcaccacaacaaccaccatgagggattcatgaatttcatgcacagggacgaggaggttaactacttcccgtcgaggtatgaccaggttcgtcatgctgagaagtatccaactccgcctgctgtctgttctggaaaacgtgagaggtgcattattgagaaagagaacaacttcaaggagcctggagagagataccgtacctttacaccagagaggcaagaacgattcatccagagatggattgatgccctatccgacccacgcatcacgcatgaaatccgcagtatctggatctcttactggtctcaggctgataagtctttgggacagaagctggcaagccgtctgaacgtgagaccaagcatctaa

SEQ ID NO: 1360 - protein, 492 aa, Arabidopsis thaliana
MDPYKYRPASSYNSPFFTTNSGAPVWNNNSSMTVGPRGPILLEDYHLVEKLANFDRERIPERVVHARGASAKGFFEVTHDISNLTCADFLRAPGVQTPVIVRFSTVIHERGSPETLRDPRGFAVKFYTREGNFDLVGNNFPVFFIRDGMKFPDMVHALKPNPKSHIQENWRILDFFSHHPESLNMFTFLFDDIGIPQDYRHMDGSGVNTYMLINKAGKAHYVKFHWKPTCGVKSLLEEDAIRVGGTNHSHATQDLYDSIAAGNYPEWKLFIQIIDPADEDKFDFDPLDVTKTWPEDILPLQPVGRMVLNKNIDNFFAENEQLAFCPAIIVPGIHYSDDKLLQTRVFSYADTQRHRLGPNYLQLPVNAPKCAHHNNHHEGFMNFMHRDEEVNYFPSRYDQVRHAEKYPTPPAVCSGKRERCIIEKENNFKEPGERYRTFTPERQERFIQRWIDALSDPRITHEIRSIWISYWSQADKSLGQKLASRLNVRPSI

SEQ ID NO: 1361 - DNA, 1206 bp, Arabidopsis thaliana
atggctctaaagtttaaccctttggtggcatctcagccttacaaattcccttcctcgactcgtccgccaactccttctttcagatctcccaagttcctctgcctcgcttcttcttctccggctctcagctccggccccaaggaggttgagagtttgaagaaaccatttacgccacccagggaagtgcatgttcaagtcttgcactccatgccacctcaaaagatcgagatcttcaaatctatggaaaactgggccgaggagaaccttctgattcacctcaaggatgtggagaagtcttggcaaccccaggatttcttgcctgaccctgcatcagatgggtttgaagatcaggtaagagagttaagagagagggctagagagctccctgatgattactttgttgttttggtgggggacatgatcacagaagaagcacttccgacctatcaaactatgttgaacactttggatggagttagggatgaaacaggtgctagtcctacttcatgggctatttggaccagagcttggactgcagaagaaaaccgacatggcgatcttctgaataaatacctttacttgtctggtcgtgttgacatgaggcagatcgaaaagaccattcagtacttgattggatctggaatggatccgcggacagagaataacccctaccttggcttcatctatacgtcattccaagaaagagcgacattcatctctcacggaaacacagcccgccaagccaaagagcacggggacatcaaactagcccaaatatgtggcacaatagctgcagacgagaagcgtcatgaaacagcatacaccaagatagttgaaaagctctttgagattgatcctgatggtactgtcatggcttttgcagacatgatgagaaagaaaatctcaatgcctgctcacttgatgtatgatgggcgcaacgacaacctctttgacaacttctcttccgtggctcagaggctcggtgtttacaccgccaaagactatgcagacattcttgagtttctggttggtaggtggaaaatccaggacttaaccgggctttcaggtgaaggaaacaaagcacaagactatttatgcgggttggctccaaggatcaagagattggatgagagagctcaagcaagagccaagaaaggacccaagattcctttcagttggatacacgacagagaagtgcagctctaa

SEQ ID NO: 1362 - protein, 401 aa, Arabidopsis thaliana
MALKFNPLVASQPYKFPSSTRPPTPSFRSPKFLCLASSSPALSSGPKEVESLKKPFTPPREVHVQVLHSMPPQKIEIFKSMENWAEENLLIHLKDVEKSWQPQDFLPDPASDGFEDQVRELRERARELPDDYFVVLVGDMITEEALPTYQTMLNTLDGVRDETGASPTSWAIWTRAWTAEENRHGDLLNKYLYLSGRVDMRQIEKTIQYLIGSGMDPRTENNPYLGFIYTSFQERATFISHGNTARQAKEHGDIKLAQICGTIAADEKRHETAYTKIVEKLFEIDPDGTVMAFADMMRKKISMPAHLMYDGRNDNLFDNFSSVAQRLGVYTAKDYADILEFLVGRWKIQDLTGLSGEGNKAQDYLCGLAPRIKRLDERAQARAKKGPKIPFSWIHDREVQL

SEQ ID NO: 1363 - DNA, 2301 bp, Arabidopsis thaliana
atggaagaatcagaacaagttcttcctctattaacaaacccaaaagatctgacaaacccatcatatgcgtcatcatcttcatcttcatctgaaccaagagatgaaacagaggatcttcttttaccaatctccgacgagaatgaggaggaagaagaagagaactcaccaatccgacaagtagcactcactgttccgacaacagatgatccttcattacctgtcttaacatttcgcatgtgggtcttaggaactctctcttgcatcctcttgtcgtttctcaatcagttcttctggtatagaacagaacctctcactatctctgccatctccgctcaaatcgccgtcgtaccacttggtcgtctcatggctgctaaaatcaccgatagagtcttcttccaaggatcaaagtggcagtttacgttgaatccaggtccgtttaatgtgaaagagcatgtgttgatcactattttcgctaacgcgggagctggatctgtttacgcaatacacgttgttaccgtggtcaaagcgttttacatgaagaacataacgttctttgtgtctttcatcgttatcgttaccacccaagtgttaggttttggatgggctggaatatttaggaaataccttgttgaaccggcggcgatgtggtggccggcgaatcttgttcaagtctcactatttagagctttgcacgagaaagaagaacggaccaaaggagggctgacacgtacacaattcttcgtgatagcattcgtttgcagtttcgcttattatgtctttccgggctacttatttcagatcatgacgtcgttgtcgtgggtttgttggttctttccatcatcagttatggcccaacagatcgggtctggtcttcacgggttaggtgttggggccataggacttgactggtcaaccatttcctcttacttgggtagtccactcgctagtccatggtttgctacggctaatgtgggtgtgggatttgtgctggtgatatatgtcttggtaccaatatgctattggctcgatgtgtacaaggccaagaccttccccatattttcgagctcacttttttcgagccagggttcaaagtacaacatcacatccattatagactctaatttccaccttgacctcccagcctacgagcgtcaaggccctttgtatctttgcactttcttcgccattagttacggtgttggttttgccgctttaagcgctaccatcatgcatgttgctctcttccacggaagggagatatgggagcagagtaaggagagttttaaagaaaagaaattggatgtacacgcgaggctaatgcaaaggtacaaacaagttccagagtggtggttttggtgcatactcgttaccaacgttggagccacaatctttgcttgtgagtattacaatgaccaacttcaattaccatggtggggtgttctattggcatgtaccgtcgccattatctttacacttcctatcggtatcatcaccgccatcaccaatcaggcgccaggattgaacattattacagaatatatcataggatatatctatccaggatatccagttgcaaatatgtgctttaaagtatatggatacataagcatgcaacaagccatcacgtttcttcaagactttaagcttggtcactacatgaagataccacctagaaccatgttcatggcacagattgttggaacactcatctcatgttttgtttacctcacaacggcttggtggctaatggagaccatccccaacatatgtgattcggttactaactcggtttggacatgtccatcggataaagtcttttatgatgcatcggtgatatggggacttattggacctcgtagaatctttggagatcttggtttatacaaatccgttaattggttcttccttgtgggcgctatagcccctattcttgtatggttagcttcaaggatgtttcctagacaagagtggatcaagcttataaacatgccggttcttataagcgcgacaagctcgatgccgcccgcaacagccgtgaactacacaacatgggttcttgctggattcttatccggatttgttgtgtttaggtacaggccaaatctatggcagaggtataattatgttttgtcaggagcattggatgctggattagcatttatgggtgtgttgctttatatgtgtttgggacttgagaatgtgagtttggattggtggggaaatgagcttgatggttgtcctttggcctcttgtccaaccgcgcctggtattattgttgaaggatgcccgctttatacgtaa

SEQ ID NO: 1364 - protein, 766 aa, Arabidopsis thaliana
MEESEQVLPLLTNPKDLTNPSYASSSSSSSEPRDETEDLLLPISDENEEEEEENSPIRQVALTVPTTDDPSLPVLTFRMWVLGTLSCILLSFLNQFFWYRTEPLTISAISAQIAVVPLGRLMAAKITDRVFFQGSKWQFTLNPGPFNVKEHVLITIFANAGAGSVYAIHVVTVVKAFYMKNITFFVSFIVIVTTQVLGFGWAGIFRKYLVEPAAMWWPANLVQVSLFRALHEKEERTKGGLTRTQFFVIAFVCSFAYYVFPGYLFQIMTSLSWVCWFFPSSVMAQQIGSGLHGLGVGAIGLDWSTISSYLGSPLASPWFATANVGVGFVLVIYVLVPICYWLDVYKAKTFPIFSSSLFSSQGSKYNITSIIDSNFHLDLPAYERQGPLYLCTFFAISYGVGFAALSATIMHVALFHGREIWEQSKESFKEKKLDVHARLMQRYKQVPEWWFWCILVTNVGATIFACEYYNDQLQLPWWGVLLACTVAIIFTLPIGIITAITNQAPGLNIITEYIIGYIYPGYPVANMCFKVYGYISMQQAITFLQDFKLGHYMKIPPRTMFMAQIVGTLISCFVYLTTAWWLMETIPNICDSVTNSVWTCPSDKVFYDASVIWGLIGPRRIFGDLGLYKSVNWFFLVGAIAPILVWLASRMFPRQEWIKLINMPVLISATSSMPPATAVNYTTWVLAGFLSGFVVFRYRPNLWQRYNYVLSGALDAGLAFMGVLLYMCLGLENVSLDWWGNELDGCPLASCPTAPGIIVEGCPLYT

SEQ ID NO: 1365 - DNA, 432 bp, Arabidopsis thaliana
atgacgacaatggcgacacaaggcgcttggctacgaatgacctcatcagccaagtccatgaccaagtcaaccgtgacttcaaaggagcttggattcctcacctcccagctcagcggcttaagaatctcatatactcccagtgacgtcatcaaccgtatctcccttccttcgttccccgggattcagccaatcgtcgcacgtagaatctgcccttttactgggaagaaagcaaacagagcaaacaaagtttcattctctaaccacaagaccaagaagttgcaattcgtcaacttacaatacaagagagtttggtgggaagctggcaaacgttttgtcaaacttcgtttatcaactaaggctttgaagaccattgagaagaacggactcgacgctgttgccaagaaagccggcattgatcttcgcaagaaatag

SEQ ID NO: 1366 - protein, 143 aa, Arabidopsis thaliana
MTTMATQGAWLRMTSSAKSMTKSTVTSKELGFLTSQLSGLRISYTPSDVINRISLPSFPGIQPIVARRICPFTGKKANRANKVSFSNHKTKKLQFVNLQYKRVWWEAGKRFVKLRLSTKALKTIEKNGLDAVAKKAGIDLRKK

SEQ ID NO: 1367 - DNA, 1110 bp, Arabidopsis thaliana
atggcgactaccatgaatgctgctgtttctctcacatcttcaaactcttcttcttttcccgctacaagttgtgccattgctcctgaaaggatcaggtttactaagggtgctttttactacaaaagcaacaatgtagtgacaggtaaaagagtgttttccataaaagcacaaatcacaacagaaacagatactcctactcctgcaaagaaagtagagaaagtgtcaaagaagaacgaggaaggtgtgattgttaacaggtacagaccaaaagagccttacactggaaaatgccttctcaacaccaaaatcacagctgatgatgctcctggagagacctggcacatggttttcagccatcaaggagaaatcccgtacagagaaggacaatctgttggtgtgattgcagatggaattgacaagaatggaaagcctcacaaggtcagactttactccattgcaagcagcgctcttggagatctcggcaattctgaaaccgtttctttgtgtgttaaaagacttgtttatactaatgaccaaggagagactgttaaaggagtttgctcaaatttcttgtgtgatttggcacccggaagtgatgttaagctgactggtcctgtaggcaaagaaatgcttatgccaaaggatccaaacgccaccgttattatgcttgccacagggacaggaattgctcctttcaggtctttcttatggaagatgttctttgagaaacatgatgactacaagttcaatggcttagcttggttgttcttgggtgtaccaaccactagctctttgctctaccaagaggagtttgataagatgaaagcaaaggcccccgagaacttcagggtggattacgcgataagcagagaacaagcgaacgataaaggagagaaaatgtatatccagactcggatggcgcaatacgcagctgagttatgggagttgttgaagaaagacaacacttttgtttacatgtgtggactcaagggaatggagaaaggaattgatgacattatggtctcattggctgcaaatgacggtattgactggtttgattacaagaagcagttgaagaaggcagagcaatggaacgttgaagtctactga

SEQ ID NO: 1368 - protein, 369 aa, Arabidopsis thaliana
MATTMNAAVSLTSSNSSSFPATSCAIAPERIRFTKGAFYYKSNNVVTGKRVFSIKAQITTETDTPTPAKKVEKVSKKNEEGVIVNRYRPKEPYTGKCLLNTKITADDAPGETWHMVFSHQGEIPYREGQSVGVIADGIDKNGKPHKVRLYSIASSALGDLGNSETVSLCVKRLVYTNDQGETVKGVCSNFLCDLAPGSDVKLTGPVGKEMLMPKDPNATVIMLATGTGIAPFRSFLWKMFFEKHDDYKFNGLAWLFLGVPTTSSLLYQEEFDKMKAKAPENFRVDYAISREQANDKGEKMYIQTRMAQYAAELWELLKKDNTFVYMCGLKGMEKGIDDIMVSLAANDGIDWFDYKKQLKKAEQWNVEVY

SEQ ID NO: 1369 - DNA, 1173 bp, Arabidopsis thaliana
atgtcgccggcagctacggagacggagcgatggtgcgttgttaccggcggtagaggattcgcggcgaggcatcttgttgaaatgctcgtacgctacgaaatgttttgcgtccgtatcgccgatttagctccggcgataatgcttgatcctcaggaagggaacggagttctcgacgaaggattaagatctggtcgtgttcaatatatctccgctgatcttcgagataaatctcaagtcgttaaagcttttcagggagcggaggtggtgtttcatatggcagctccagattcttctattaacaatcatcagcttcagtattcggtgaatgttcaagggacacaaaatgtgattgatgcttgtgttgatgttggagtaaagaggcttatttacactagctctcctagtgttgtgtttgatggtgttcatggtattttgaacggtactgaatcaatggcttacccaattaagcacaatgactcatattcagcaactaaagctgaaggagaagagttgatcatgaaggctaatggtagaaatggactactcacttgttgcatacgtccaagcagtatttttggtcccggtgatagattattggttccgtcgcttgttgctgctgctagggctgggaaatctaagtttattattggtgatgggaataatctctatgatttcacttacgttgagaatgttgctcatgcccatgtttgtgctgagcgtgctctagcttcaggaggagatgtttctacaaaagctgcaggacaggcatatttcattaccaacatggagccaattaaattttgggaatttatgtcacagctccttgatggacttggttacgagaggccaagcataaagatccctgcgtttatcatgatgccgattgcgcatctggttgaactgacatataaagtgttgggaccatatgggatgacagtaccacaactaacaccttcaagagttaggcttctctcatgcagcagaactttcgattccacgaaagcaaaggatcgactaggctatgctcctgtggtcccacttcaggaaggtatacggaggacgatagactcattctctcacctaacagctggaagtcaatccaaaagagagggcccatccaaggcttctaggattcttggaggcggaaagggtatgaccatatatttcaattag

SEQ ID NO: 1370 - protein, 390 aa, Arabidopsis thaliana
MSPAATETERWCVVTGGRGFAARHLVEMLVRYEMFCVRIADLAPAIMLDPQEGNGVLDEGLRSGRVQYISADLRDKSQVVKAFQGAEVVFHMAAPDSSINNHQLQYSVNVQGTQNVIDACVDVGVKRLIYTSSPSVVFDGVHGILNGTESMAYPIKHNDSYSATKAEGEELIMKANGRNGLLTCCIRPSSIFGPGDRLLVPSLVAAARAGKSKFIIGDGNNLYDFTYVENVAHAHVCAERALASGGDVSTKAAGQAYFITNMEPIKFWEFMSQLLDGLGYERPSIKIPAFIMMPIAHLVELTYKVLGPYGMTVPQLTPSRVRLLSCSRTFDSTKAKDRLGYAPVVPLQEGIRRTIDSFSHLTAGSQSKREGPSKASRILGGGKGMTIYFN

SEQ ID NO: 1371 - DNA, 1446 bp, Arabidopsis thaliana
atgtctctcaaggcgttagactacgagtccttgaatgaaaacgtgaagaattgtcagtatgcagtcagaggtgaactttatcttcgtgcttctgagcttcagaaagaaggcaaaaagattattttcacaaatgttggaaaccctcatgctttaggacagaaacctctgacttttcctcgtcaggtggtttctttatgccaagcaccatttctgttagatgatccaaatgttggtatgatattcccagcagatgctattgcaagagctaagcattatctttccttgacttctggtggtcttggtgcttacagtgactcaagaggtcttccgggagttcggaaagaagtcgctgagttcattgaacggcgtgatggatatccaagcgatccagaactcatatttctaactgatggagcgagcaaaggtgtgatgcaaatcttgaattgtgtcatacgcggtcagaaagacggaattctggttccagttccacagtatccactctactcggctactatatctctgttaggtggtactcttgttccttactatcttgaagagtctgaaaactggggacttgatgttaacaaccttcgccaatctgttgctcaagctcgctctcaaggaataacagtaagggcaatggtgattattaaccccggaaacccaactggccagtgtcttagcgaagctaacataagagagatactacggttctgttgtgatgagagattagttcttctcggagacgaagtgtatcagcaaaatatataccaagatgaacgtccctttatcagttccaagaaggttttgatggatatgggagcaccgatcagcaaggaagttcagctcatatctttccacaccgtttccaaaggatactggggcgaatgtgggcaacggggaggttactttgagatgacaaatatccctcccaggaccgttgaggagatatacaaggtggcctctatagctctcagccccaacgtctctgcgcagatatttatgggtttaatggttagcccaccaaagcctggagacatttcatatgaccaattcgttcgtgagagcaagggaatactagaatcactgagaagaagagcaaggatgatgactgatggattcaacagctgcaaaaacgtcgtctgtaatttcacagaaggtgctatgtattcattccctcaaataaagttgccgtcgaaagcaatccaagcagcaaaacaagccggaaaagtccctgacgttttctactgccttaagctcttagaagccacaggaatctccacagttccaggctctggatttggacaaaaagaaggggtgtttcatttaaggacaacaattctgccagcagaagaagaaatgccagagattatggacagtttcaaaaagttcaatgatgagtttatgtctcagtacgctgataactttggttactccagaatgtga

SEQ ID NO: 1372 - protein, 481 aa, Arabidopsis thaliana
MSLKALDYESLNENVKNCQYAVRGELYLRASELQKEGKKIIFTNVGNPHALGQKPLTFPRQVVSLCQAPFLLDDPNVGMIFPADAIARAKHYLSLTSGGLGAYSDSRGLPGVRKEVAEFIERRDGYPSDPELIFLTDGASKGVMQILNCVIRGQKDGILVPVPQYPLYSATISLLGGTLVPYYLEESENWGLDVNNLRQSVAQARSQGITVRAMVIINPGNPTGQCLSEANIREILRFCCDERLVLLGDEVYQQNIYQDERPFISSKKVLMDMGAPISKEVQLISFHTVSKGYWGECGQRGGYFEMTNIPPRTVEEIYKVASIALSPNVSAQIFMGLMVSPPKPGDISYDQFVRESKGILESLRRRARMMTDGFNSCKNVVCNFTEGAMYSFPQIKLPSKAIQAAKQAGKVPDVFYCLKLLEATGISTVPGSGFGQKEGVFHLRTTILPAEEEMPEIMDSFKKFNDEFMSQYADNFGYSRM

SEQ ID NO: 1373 - DNA, 3168 bp, Arabidopsis thaliana
atggctttgaaactcacttctccgccttcagttttctcacaatcaaggagattatcttcttcttcgttaattccgataaggtcaaaatccacattcaccggatttcgatcgagaaccggtgtttatttaagcaaaacgacggcgcttcagtcgtctacaaaactgagtgtggcggcggagagtcctgcggcgacaattgcgacggatgattgggggaaagtatcggcggttctgtttgatatggacggtgtgctttgtaacagtgaagatctttctagacgcgccgccgtggatgtttttacggagatgggagttgaagtcactgtggacgatttcgttccttttatgggaacaggtgaagccaagtttttaggaggtgttgcttcagtcaaagaagttaaaggatttgatccagatgcagctaaagagagattctttgaaatatatctcgataagtatgcgaagccagaatctgggattggatttccaggagcattggagcttgttactgagtgtaagaacaaaggccttaaagtcgctgttgcatctagtgctgaccgtatcaaagttgatgcgaatctgaaagctgctggtttgtctttgaccatgtttgatgccattgtttcagcagatgcctttgagaatttgaaaccagctccagatattttcctggctgctgcaaagatcttaggtgtgcctaccagcgagtgtgttgttattgaagatgcgcttgctggagtccaagccgcacaagctgcgaacatgagatgtatagccgtaaaaactactttatctgaagcaattcttaaggatgctggtccttctatgatacgagacgatattggaaacatctcaatcaatgacattctcactggtggctcagattctaccagaaattccacagcaatgcttgaagagaacacggtcagcgacaaaaccagcgctaacgggtttcagggctctcgacgagatatactgaggtatgggagtcttggcattgctctttcttgtgtctacttcgccgccaccaactggaaggcaatgcaatatgcttctccgaaagctttgtggaatgcattggttggagcaaaaagcccttcttttacacagaaccaaggtgaagggagagtgcaacagttcgtcgattacattgctgatctagagagcaagcaaacagctacaactgtgccagaattcccatctaaactcgactggctaaacactgcccctctccagtttcgccgggatttaaaagggaaagtggttatacttgatttttggacctattgctgcataaactgtatgcatgtattaccggatctagagtttcttgagaagaagtacaaggatatgccattcaccgttgtgggtgtacactcggctaagttcgacaatgagaaagatttagatgccatacgaaatgcagttcttcgctatgatattagccacccggttgtgaatgatggagacatgtacatgtggagagagcttggcatcaactcgtggcctacatttgctgttgtttctcctaatggcaaagtcattgcacaaattgccggagaaggtcaccgcaaagatcttgatgacgtggtggcggcagctctgacatattatggtggaaagaatgtattagacagtactccgcttccaacacgtttggagaaagacaacgatccacgtttggccacgtctccgttgaaatttccgggaaagttggctattgatactcttaataacaggctattcatctcagacagtaaccataaccgtattattgtaactgatctcgaaggaaatttcatagtccaaattggcagcagtggagaagaaggtttccaagatggttccttcgaagatgctgcatttaatcgtcctcagggactagcttataatgctaagaagaatcttctttatgttgctgacaccgagaatcatgctttgagagagattgattttgtcaacgagagagtacagactctggctggtaatggaactaaaggctcagactaccaaggtggaagaaaaggaaccaaacagcttttgaattctccttgggacgtatgctttgagccggtgaatgagaaggtatacattgcaatggcaggtcagcaccagatttgggaatacagtgtgcttgatggtattactcgagttttcagtggaaatggttatgaaagaaacctcaacggttccacccctcagactacatcatttgctcagccatcaggaatctcattaggccctgatttgaaagaagcatatattgctgatagcgagagcagttctattcgtgcccttgatcttcaaactggaggatcaagattacttgcgggtggtgatccgtatttctctgagaatcttttcaagtttggagacaatgatggcgtgggagcagaagttctcctacaacacccgctaggtgtattatgcgcaaatgatggtcaaatatatctaactgatagctataaccacaagattaagaagttggaccctgtaaccaaacgtgttgttactctcgctggaacgggaaaagccggttttaaggatgggaaggtcaagggtgctcagctttcagagcctgcaggacttgctataactgaaaacgggaggctgtttgtggcggatacaaataatagccttatccgatacatagatttgaacaaaggagaagactcagagattcttacattggagttaaaaggtgttcaaccaccaacgccaaaggcaaaatccctgaaacgtttgagaaaacgtgcctcggctgatacaaagattgtcaaagtggattctgtaacgtcccgtgaaggagatttgaatctcaaaatctcattaccagatggctaccatttctccaaggaagcgcggagtaagtttgtggttgatgtggagcctgaaaacgcagtagcaatcgatccaacggaaggaactctgagtcccgaaggttcaacaatgcttcattttatacaatcttcaacttcggcttctgttgggaaaatcagttgcaaggtgtactattgcaaagaagacgaggtttgcttgtatcagtctgtacagtttgaggtccctttcaaggtggaatcagaattatctgcttctccgacaatcacattcacggttacaccgagagcacccgatgctggtgggttacagcttcaaggtactcgctga

SEQ ID NO: 1374 - protein, 1055 aa, Arabidopsis thaliana
MALKLTSPPSVFSQSRRLSSSSLIPIRSKSTFTGFRSRTGVYLSKTTALQSSTKLSVAAESPAATIATDDWGKVSAVLFDMDGVLCNSEDLSRRAAVDVFTEMGVEVTVDDFVPFMGTGEAKFLGGVASVKEVKGFDPDAAKERFFEIYLDKYAKPESGIGFPGALELVTECKNKGLKVAVASSADRIKVDANLKAAGLSLTMFDAIVSADAFENLKPAPDIFLAAAKILGVPTSECVVIEDALAGVQAAQAANMRCIAVKTTLSEAILKDAGPSMIRDDIGNISINDILTGGSDSTRNSTAMLEENTVSDKTSANGFQGSRRDILRYGSLGIALSCVYFAATNWKAMQYASPKALWNALVGAKSPSFTQNQGEGRVQQFVDYIADLESKQTATTVPEFPSKLDWLNTAPLQFRRDLKGKVVILDFWTYCCINCMHVLPDLEFLEKKYKDMPFTVVGVHSAKFDNEKDLDAIRNAVLRYDISHPVVNDGDMYMWRELGINSWPTFAVVSPNGKVIAQIAGEGHRKDLDDVVAAALTYYGGKNVLDSTPLPTRLEKDNDPRLATSPLKFPGKLAIDTLNNRLFISDSNHNRIIVTDLEGNFIVQIGSSGEEGFQDGSFEDAAFNRPQGLAYNAKKNLLYVADTENHALREIDFVNERVQTLAGNGTKGSDYQGGRKGTKQLLNSPWDVCFEPVNEKVYIAMAGQHQIWEYSVLDGITRVFSGNGYERNLNGSTPQTTSFAQPSGISLGPDLKEAYIADSESSSIRALDLQTGGSRLLAGGDPYFSENLFKFGDNDGVGAEVLLQHPLGVLCANDGQIYLTDSYNHKIKKLDPVTKRVVTLAGTGKAGFKDGKVKGAQLSEPAGLAITENGRLFVADTNNSLIRYIDLNKGEDSEILTLELKGVQPPTPKAKSLKRLRKRASADTKIVKVDSVTSREGDLNLKISLPDGYHFSKEARSKFVVDVEPENAVAIDPTEGTLSPEGSTMLHFIQSSTSASVGKISCKVYYCKEDEVCLYQSVQFEVPFKVESELSASPTITFTVTPRAPDAGGLQLQGTR

SEQ ID NO: 1375 - DNA, 795 bp, Arabidopsis thaliana
atggattgtgttgaatcttatttatccggagataattctgatgaatctccggtgatgcatacttggttttctccgtctccgtctccgtctgactcttcctcttctccttcatcttctgcttcttcttccattgggaggaatagcgacgacggtgagaaatcgtcggaggacggtggagatgacgccggagagaatgaagttgagtctccgtataaaggtcctcttgaaatgatggaatctctcgaacaagtcttacctgttaggaaagggatatcgaagtattacagtggaaagtcaaagtcttttactaatttaacggcggaggcagcttcggcgttgacttcttcttcgtcgatgaaagatttagcgaagccggagaatccttacagtaggaggaggaggaatctcctctgccatcagatttgggaaaataacaagacgactccacgtggtgggatctcgaagaaacacgttatgagttctagcagaagcgctttgacgctagctatggctgttgcggctggtgtgatgaccggagaaggatcttcttccggaggtgactcgtcgccgggatcaagtccgacgacttctggatctcctccgaggcagctacatcatcatcaacatcagatgaagaagcttcctccgttgtatcctaggagtcaagggtcttttggtaatttgacttcgtctcagtcgtcgttgggtttttgtgcctggagatcgttttcggtggctgattttccgaggtgttttccggcgacggcgagtgggattgggtttaatgactcgtag

SEQ ID NO: 1376 - protein, 264 aa, Arabidopsis thaliana
MDCVESYLSGDNSDESPVMHTWFSPSPSPSDSSSSPSSSASSSIGRNSDDGEKSSEDGGDDAGENEVESPYKGPLEMMESLEQVLPVRKGISKYYSGKSKSFTNLTAEAASALTSSSSMKDLAKPENPYSRRRRNLLCHQIWENNKTTPRGGISKKHVMSSSRSALTLAMAVAAGVMTGEGSSSGGDSSPGSSPTTSGSPPRQLHHHQHQMKKLPPLYPRSQGSFGNLTSSQSSLGFCAWRSFSVADFPRCFPATASGIGFNDS

SEQ ID NO: 1377 - DNA, 327 bp, Arabidopsis thaliana
atggaagaagaaatattatcttttgtctctatccaaagccacgtgtcttctgctggagagaaaccaatacacgtactggatgagaatccaaagttttcccgacttcatccttcgccgtcaaacatcgactccggtgaagattcaacgtcgattaacaaatcaaacatggaatcttatgggttttcaccggtaaaaataatcgaagccctaattagagaaacaacagctcaaggtaatgttaatatgcaacggaaatcacttttttttccaactcaaatctctgatttgtttcctgcaattctaaactcaaaaagaaaaacaggttag

SEQ ID NO: 1378 - protein, 108 aa, Arabidopsis thaliana
MEEEILSFVSIQSHVSSAGEKPIHVLDENPKFSRLHPSPSNIDSGEDSTSINKSNMESYGFSPVKIIEALIRETTAQGNVNMQRKSLFFPTQISDLFPAILNSKRKTG

SEQ ID NO: 1379 - DNA, 420 bp, Arabidopsis thaliana
atggctaatgctgcgtcaggaatggcagtccatgatgactgcaagctaagatttctggaactgaaggcgaaaaggacacaccgtttcattgtctacaagattgaggagaagcagaagcaagtgattgttgagaaagttggtgaacctattctaacttacgaggactttgcagcaagtcttccagctgacgaatgccgatacgccatttatgatttcgactttgtcactgcagagaattgccagaagagcaagattttcttcattgcatggtgtcccgacgtagcaaaggtgagaagcaagatgatctatgcgagctctaaggacaggttcaagcgtgaacttgatggaattcaagtggagcttcaagcaactgatccaactgagatggatcttgatgttttgaaaagccgcgtcaactaa

SEQ ID NO: 1380 - protein, 139 aa, Arabidopsis thaliana
MANAASGMAVHDDCKLRFLELKAKRTHRFIVYKIEEKQKQVIVEKVGEPILTYEDFAASLPADECRYAIYDFDFVTAENCQKSKIFFIAWCPDVAKVRSKMIYASSKDRFKRELDGIQVELQATDPTEMDLDVLKSRVN

SEQ ID NO: 1381 - DNA, 276 bp, Arabidopsis thaliana
atggggataaactctaagcatgttgtggttgttattatggtgatgatggtcattataagctcatgtttggctgcaaggaatataattccccgggaaactaatcaagaaagcgaaaaagtgtcccgagagatgatcatagggaaagaagaagactctactgagaaaatagagcacccaagaagcagcgtggagaatcaccattatatcccaagacaagatttctacaactatggacctggaggcgaaaataatggaggaggtggtggtggtggataa

SEQ ID NO: 1382 - protein, 91 aa, Arabidopsis thaliana
MGINSKHVVVVIMVMMVIISSCLAARNIIPRETNQESEKVSREMIIGKEEDSTEKIEHPRSSVENHHYIPRQDFYNYGPGGENNGGGGGGG

SEQ ID NO: 1383 - DNA, 1863 bp, Arabidopsis thaliana
atggagcacaacaaggttgatacagaacctcaagattcatatgatgatcaacaaaaatgggttctcgattcttcgaccgatagtagaggagagattccgcttcgggctcaaaccggagcttggagagctgcactcttcatcattggtatcgaattcagcgagaggctaagttactttgggatctccacgaacttagtggtctacttgactaccattcttcaccaagatctcaagatggctgtaaaaaatacgaactactggtctggtgtcactactttgatgcctcttcttggaggcttcgtcgcagatgcttatctcggccgttatggaactgtcctacttgcaaccaccatttaccttatgggcttgattctgttaacattgtcttggtttataccgggattgaaagcatgtcatgaagacatgtgtgttgagccaaggaaagcccacgagatagccttcttcattgcaatctacttgatctccataggcactggaggtcataagccatcccttgagagctttggagctgaccaattcgaagatggccatccggaagaacgaaaaatgaaaatgtcttactttaactggtggaatgctggtctatgcgctggtattttaaccgcggtgactgtaattgtctatatcgaagaccggattggttggggtgtggctagcatcatactcacaatagttatggctacttcgttttttatcttccgtatcggcaaaccgttttaccgttatagagcaccttctggtagcccattgaccccaatgttgcaagtctttgtcgccgccattgccaaaagaaatcttccttgtcccagtgattcttctcttcttcatgagttaactaatgaagagtatactaaaggccggcttctttccagctcaaagaatcttaaatttctagacaaagcagcagttattgaggaccgaaacgagaacactaaagccgagaagcagagtccatggcgactcgcaacggttacgaaagtggaagaagttaagctactcatcaacatgattccaatctggttctttacattagcctttggagtatgcgccactcaaagctcaacactctttatcaaacaagccataataatggaccgacacatcacagggacaagcttcatagttcctccagcttcattgttctctctcatagctctctccataatcatcaccgtaacaatctacgagaaactcctcgttcctcttttgagacgtgccacaggaaacgaaagaggcattagcattctacaaagaatcggggtcggtatggttttctccttattcgctatgatcattgctgctctgattgagaagaaaagattagattatgctaaggaacaccacatgaataagaccatgaccttgagtgctatatggttagctcctcaattcctagtcttaggagttgcggatgcttttacccttgtcggtcttcaagaatatttctacgaccaagtcccagattctatgagaagcttaggcatagcgttttacctcagcgtgcttggagcggctagctttgtcaacaatcttttgataacggttagtgatcatttagccgaggaaatttccgggaagggctggtttgggaaagaccttaatagcagccgcttggaccgcttttactggatgctagccgccttgaccgctgcaaatatatgctgctttgtgatcgtggccatgagatacacttacaagactgtgcagccgagtctggctgttgttgctgacggcggtgatgacgttgagacagccacggggacgaataacacgtccaagtttacggctggttcgggaaagaccttaatagcagctgcatggaccgcttttactggatgctag

SEQ ID NO: 1384 - protein, 620 aa, Arabidopsis thaliana
MEHNKVDTEPQDSYDDQQKWVLDSSTDSRGEIPLRAQTGAWRAALFIIGIEFSERLSYFGISTNLVVYLTTILHQDLKMAVKNTNYWSGVTTLMPLLGGFVADAYLGRYGTVLLATTIYLMGLILLTLSWFIPGLKACHEDMCVEPRKAHEIAFFIAIYLISIGTGGHKPSLESFGADQFEDGHPEERKMKMSYFNWWNAGLCAGILTAVTVIVYIEDRIGWGVASIILTIVMATSFFIFRIGKPFYRYRAPSGSPLTPMLQVFVAAIAKRNLPCPSDSSLLHELTNEEYTKGRLLSSSKNLKFLDKAAVIEDRNENTKAEKQSPWRLATVTKVEEVKLLINMIPIWFFTLAFGVCATQSSTLFIKQAIIMDRHITGTSFIVPPASLFSLIALSIIITVTIYEKLLVPLLRRATGNERGISILQRIGVGMVFSLFAMIIAALIEKKRLDYAKEHHMNKTMTLSAIWLAPQFLVLGVADAFTLVGLQEYFYDQVPDSMRSLGIAFYLSVLGAASFVNNLLITVSDHLAEEISGKGWFGKDLNSSRLDRFYWMLAALTAANICCFVIVAMRYTYKTVQPSLAVVADGGDDVETATGTNNTSKFTAGSGKTLIAAAWTAFTGC

SEQ ID NO: 1385 - DNA, 963 bp, Arabidopsis thaliana
atggcttgccaaaacaatctcgttgtgaagcaaatcatcgacttgtacgaccaaatctcaaagctcaagagcttaaaaccttccaaaaatgtcgacactttgttcggacaactcgtgtccacgtgcttacccacggatacaaacatcgatgtcacaaatatgtgtgaagaagtcaaagacatgagagctaatctcatcaagctttgtggtgaagccgaaggttatttagagcaacacttctccacaattttgggatctttacaagaagaccaaaacccacttgaccatttacacatctttccttactactccaactacctcaagctaggcaagctcgagttcgatctcctgagccaacactcaagccatgtccccaccaagattgccttcgtgggttcgggtccgatgcctctcacatccatcgtattggccaagtttcacctccccaacacgacgttccacaactttgacatcgactcacacgcaaacacactcgcttcaaacctcgtctctcgcgacccggacctctcaaaacgcatgatcttccacacaacggacgtactaaacgcaaccgaaggccttgaccaatatgacgtcgttttcttagcggcgcttgtagggatggacaaagagtcaaaggtcaaagccatcgagcacttggagaaacacatggctcctggagctgttcttatgctaaggagtgctcatgctctcagagctttcttatatccaatcgttgactcgtctgatctcaaaggctttcaactcttgaccatctatcatccaaccgatgacgtggttaactcggttgtgatcgcacgtaagctcggtggtccgaccacgcccggggttaatggtactcgtggatgcatgtttatgccttgtaactgctccaagattcacgcgatcatgaacaaccgtggtaagaagaatatgatcgaggagtttagtgccatcgagtaa

SEQ ID NO: 1386 - protein, 320 aa, Arabidopsis thaliana
MACQNNLVVKQIIDLYDQISKLKSLKPSKNVDTLFGQLVSTCLPTDTNIDVTNMCEEVKDMRANLIKLCGEAEGYLEQHFSTILGSLQEDQNPLDHLHIFPYYSNYLKLGKLEFDLLSQHSSHVPTKIAFVGSGPMPLTSIVLAKFHLPNTTFHNFDIDSHANTLASNLVSRDPDLSKRMIFHTTDVLNATEGLDQYDVVFLAALVGMDKESKVKAIEHLEKHMAPGAVLMLRSAHALRAFLYPIVDSSDLKGFQLLTIYHPTDDVVNSVVIARKLGGPTTPGVNGTRGCMFMPCNCSKIHAIMNNRGKKNMIEEFSAIE

SEQ ID NO: 1387 - DNA, 1509 bp, Arabidopsis thaliana
atggaagatatcatcatcggcgtggtggctctcgccgcggttctccttttcttcctctaccaaaaaccgaaaaccaaacggtacaagctacctccagggccatcaccacttccggtgatcggaaacctccttcagcttcagaagcttaacccacaacgcttcttcgctggatgggccaaaaaatacggtccaatcttgtcatacaggataggaagcagaacaatggtggtgatatcttcagctgagctagctaaagagcttctcaagacgcaagatgtcaactttgcggaccggcctccacatcgtggccatgagttcatatcctacggcaggcgtgacatggcattaaaccactacacaccgtattaccgagagataaggaagatggggatgaaccacttgttctcaccaacacgtgtggccacctttaagcatgtacgagaggaagaggctaggaggatgatggataagatcaacaaggccgcggataaatccgaagtagtcgatataagtgagcttatgttgaccttcacgaactcggttgtgtgtagacaagcgttcgggaagaagtacaatgaagatggagaagagatgaagaggttcatcaagattctttatgggactcaaagcgttttggggaagatctttttctctgattttttcccatattgtggctttcttgatgatttatcaggcctcacagcttatatgaaagagtgtttcgaaagacaagacacttatattcaagaggttgtcaatgagacgcttgatcctaagagagtcaagcccgaaaccgagagcatgattgatctcttgatggggatctacaaagaacaacctttcgcttctgagtttactgtagataatgtcaaagccgtcatcttggatattgtagtggcgggaacagatactgcagctgcggcggttgtgtgggggatgacgtatctaatgaagtacccacaagtgttgaagaaagctcaagcagaagtgagagagtatatgaaagagaaaggttcaacgttcgttactgaagacgatgtcaagaaccttccttacttcagagccttagttaaagaaaccctaaggatcgaaccagtgattcctctccttatccctcgtgcttgcattcaagataccaagatcgccggttacgacatccccgcaggaacaacggtcaacgtcaacgcgtgggccgtgtcacgtgacgagaaagaatggggaccgaaccctgatgagtttaggcccgagaggtttcttgagaaggaagttgacttcaaaggcacggactacgagtttataccgttcgggtcaggccggagaatgtgcccgggaatgcgtcttggggccgcgatgcttgaggttccttatgcgaaccttctcctcagcttcaactttaaacttcctaatgggatgaaaccagatgatatcaatatggatgtcatgactggtcttgctatgcacaagtcgcagcatctcaagcttgttccagagaaagtgaacaagtattag

SEQ ID NO: 1388 - protein, 502 aa, Arabidopsis thaliana
MEDIIIGVVALAAVLLFFLYQKPKTKRYKLPPGPSPLPVIGNLLQLQKLNPQRFFAGWAKKYGPILSYRIGSRTMVVISSAELAKELLKTQDVNFADRPPHRGHEFISYGRRDMALNHYTPYYREIRKMGMNHLFSPTRVATFKHVREEEARRMMDKINKAADKSEVVDISELMLTFTNSVVCRQAFGKKYNEDGEEMKRFIKILYGTQSVLGKIFFSDFFPYCGFLDDLSGLTAYMKECFERQDTYIQEVVNETLDPKRVKPETESMIDLLMGIYKEQPFASEFTVDNVKAVILDIVVAGTDTAAAAVVWGMTYLMKYPQVLKKAQAEVREYMKEKGSTFVTEDDVKNLPYFRALVKETLRIEPVIPLLIPRACIQDTKIAGYDIPAGTTVNVNAWAVSRDEKEWGPNPDEFRPERFLEKEVDFKGTDYEFIPFGSGRRMCPGMRLGAAMLEVPYANLLLSFNFKLPNGMKPDDINMDVMTGLAMHKSQHLKLVPEKVNKY

SEQ ID NO: 1389 - DNA, 1122 bp, Arabidopsis thaliana
atggcggctcgaaaactagggtcgttgttacgtcaatactttttctctctatgcttcctcttcctcggttgcttcttcttccctaaagacgcagactataaacaaaagagaagaaagaagaagcttagaagagtttcttcttcttctggttcatctctatcctcttcttggacgtatttaaaacgagttttcttatccacgacaaggatatccaaatcccgtaaccaaacacatcctaacgttactttaacatccgcaagatcatctcaaaactccctcgtcactctcgtccaacccgataccacaaaccaacccgacccggaaacacgtattcatcagcaaaccgaattcgagatctcctcttccgacgagattttcccttgtaactcgtgtggcgagattttcccaaaaatcaatctcctcgagaatcacatcgcgatcaaacacgccgtgtcggagctaatcgccggagaatcaagcacgaacatcgtcaagatcatattcaaatctggttggccggagcaaggtaattacaaatctccggtgatcaatcgaatcttaaaaatccacaacagttcaaagattctcaccagattcgaagagtatcgtgagttcgtgaaagctaaagccgctcgtagcaacggcggtggaagacggtgggacgatgaacgttgcgtcgccgacggaaacgaacttttacgattttactgctcgacgtttatgtgtgatttagggcaaaacggtaaatcaaatctctgtggtcatcagtattgtagtatctgtggtatcatcggatctggattctcgccgaagctcgacgggatcgcgacgttggcgacggggtggagaggacacgtggcggttccggaggaggttgaagaagagtttgggtttatgaatgtgaaacgggccatgttggtttgtcgggttgtagcgggtcgggtcgggtgtgatttgattgatgatgatgacgtggataagagtgatggtggagggtatgattctctggttgggcagagtgggaacaagagtggggctctgttgaggatcgacgatgatgagcttttggtttttaatccaagggctgtgcttccttgttttgttattgtgtatactgtgtaa

SEQ ID NO: 1390 - protein, 373 aa, Arabidopsis thaliana
MAARKLGSLLRQYFFSLCFLFLGCFFFPKDADYKQKRRKKKLRRVSSSSGSSLSSSWTYLKRVFLSTTRISKSRNQTHPNVTLTSARSSQNSLVTLVQPDTTNQPDPETRIHQQTEFEISSSDEIFPCNSCGEIFPKINLLENHIAIKHAVSELIAGESSTNIVKIIFKSGWPEQGNYKSPVINRILKIHNSSKILTRFEEYREFVKAKAARSNGGGRRWDDERCVADGNELLRFYCSTFMCDLGQNGKSNLCGHQYCSICGIIGSGFSPKLDGIATLATGWRGHVAVPEEVEEEFGFMNVKRAMLVCRVVAGRVGCDLIDDDDVDKSDGGGYDSLVGQSGNKSGALLRIDDDELLVFNPRAVLPCFVIVYTV

SEQ ID NO: 1391 - DNA, 1953 bp, Arabidopsis thaliana
atggcgggtaaaggtgaaggtccagctatcggtatcgatctcggtacaacctactcttgcgtcggtgtttggcaacatgaccgcgtcgaaatcatcgccaacgatcaaggcaaccgcaccactccttcctacgttgctttcactgacagcgagcgtctcatcggggatgctgccaagaatcaagtcgccatgaaccctaccaacaccgtcttcgatgctaagcgtctaatcggaagaagatacagtgatccctctgttcaagcggataagagtcactggccttttaaggttgtttccggtccaggtgagaagcctatgattgtggttaaccacaagggagaggagaaacagttctctgctgaggaaatctcgtcgatggttcttattaagatgcgggagattgcagaagctttccttggttctcctgttaagaacgctgtcgttacagttcctgcttatttcaacgactctcagcgtcaagcgactaaggacgctggagttatctctggtctcaacgtgatgcgtatcatcaatgagccaactgctgctgctattgcttacggtcttgacaagaaggcgtcgagtgttggcgagaagaatgttttgatctttgatttgggaggtggtacttttgatgtgtctttgcttacgattgaggaaggtatctttgaagtcaaggcaactgctggtgacacgcatcttggtggtgaggacttcgacaacaggatggttaatcattttgttcaggagtttaagaggaagaacaagaaggatattactgggaacccgagagctttgaggaggcttaggacagcttgtgagcgggcgaagagaactctttcttcgactgctcagacgactatagagattgactctctttttgagggtattgatttctacactaccatcactcgtgctaggttcgaggagctcaacatggatttgtttaggaagtgtatggagccagtggagaagtgtttgagggatgctaagatggacaagagcagtgttcatgatgttgttcttgttggtggctctacaaggattcccaaagtgcagcagcttttgcaagacttcttcaatgggaaagagctctgtaaaagcattaacccggacgaggctgttgcttacggagcagctgtgcaagctgcaatcttgagcggtgaagggaatgagaaggtccaggacttgttacttcttgatgtcactcctctgtccttgggtttggaaactgccggtggtgttatgactgttttgattccgaggaacaccacaattccgaccaagaaagagcagatattctctacctattcagacaaccagcccggtgtactgatccaggtctacgaaggagagagggcacgaacaaaggacaacaaccttttgggaaagttcgagctcagtggtataccacctgctccacgaggtgtaccgcagattactgtctgtttcgacatcgacgccaatggtatcctgaatgtgtcggctgaggacaagacgactggtcagaagaacaagatcacaatcacaaacgacaagggaaggttatcaaaggaagagatcgagaagatggtacaagaggcagagaagtacaaggctgaggatgaagaacacaagaagaaggtggatgcaaagaacgctctcgagaactatgcatacaacatgaggaacacgatcaaggacgagaagatcgcatctaagcttgacgcagctgacaagaagaagattgaggatgcaatcgaccaagctattgaatggttagatgggaatcaactggctgaggcagatgagttcgaggataagatgaaggagctcgagtctctttgcaaccctattattgcaagaatgtaccaaggagctgggcctgatatgggtggtgcaggaggaatggatgacgacacacctgctggtggtagcggcggtgctggcccaaagattgaagaagttgattaa

SEQ ID NO: 1392 - protein, 650 aa, Arabidopsis thaliana
MAGKGEGPAIGIDLGTTYSCVGVWQHDRVEIIANDQGNRTTPSYVAFTDSERLIGDAAKNQVAMNPTNTVFDAKRLIGRRYSDPSVQADKSHWPFKVVSGPGEKPMIVVNHKGEEKQFSAEEISSMVLIKMREIAEAFLGSPVKNAVVTVPAYFNDSQRQATKDAGVISGLNVMRIINEPTAAAIAYGLDKKASSVGEKNVLIFDLGGGTFDVSLLTIEEGIFEVKATAGDTHLGGEDFDNRMVNHFVQEFKRKNKKDITGNPRALRRLRTACERAKRTLSSTAQTTIEIDSLFEGIDFYTTITRARFEELNMDLFRKCMEPVEKCLRDAKMDKSSVHDVVLVGGSTRIPKVQQLLQDFFNGKELCKSINPDEAVAYGAAVQAAILSGEGNEKVQDLLLLDVTPLSLGLETAGGVMTVLIPRNTTIPTKKEQIFSTYSDNQPGVLIQVYEGERARTKDNNLLGKFELSGIPPAPRGVPQITVCFDIDANGILNVSAEDKTTGQKNKITITNDKGRLSKEEIEKMVQEAEKYKAEDEEHKKKVDAKNALENYAYNMRNTIKDEKIASKLDAADKKKIEDAIDQAIEWLDGNQLAEADEFEDKMKELESLCNPIIARMYQGAGPDMGGAGGMDDDTPAGGSGGAGPKIEEVD

SEQ ID NO: 1393 - DNA, 348 bp, Arabidopsis thaliana
atgtctagcgcagaggatgtgaaagagcaaggaaacctcaccaacgaggcagagaagtcaatgccatcatcacagcaggaggaggctgttgtaaagaagaagtatggagggctcatgccaaagaaaccacctctcatttccaaggatcatgagcgagcatactttgactcagctgattgggctcttggaaagcaaggtgttgcgaagccaaagggacccctggaagcccttcgtcccaagttacagccaacgcagcagcagacacgttacaggaagtctccatgtgctccatctgagggtggtgaagatggaggagctgctcaggccgagggaggttcaggcaactga

SEQ ID NO: 1394 - protein, 115 aa, Arabidopsis thaliana
MSSAEDVKEQGNLTNEAEKSMPSSQQEEAVVKKKYGGLMPKKPPLISKDHERAYFDSADWALGKQGVAKPKGPLEALRPKLQPTQQQTRYRKSPCAPSEGGEDGGAAQAEGGSGN

SEQ ID NO: 1395 - DNA, 819 bp, Arabidopsis thaliana
atggcgaccacacttcattgtctctccacactccatcttcttcctcgcactcatcaccctaaaaccctaaactctctcaaaccaatcaccaccaaatcacaaccatgtaaaaccccagaaataccctccactcccaacgctcttcagctccttaaatcatcctctctccctctcgcagtcatcgcattgcctttcttcctcgacccacaggatgcagcagcagctggaggagaattcggaatattagaagggagatcatttgcgttgatacacccaattgtgatgggaggtttatttgcatacactctttggactggttacttaggttggcaatggagacgtgtccgtacgatacagagtgagattagtgatctcaagaaacagcttaaaccaactcctgtttcccctgatggttccacagccgttgattcttcgtcgcctccttctacgactgagcttcagatccaacggctaactgaagagaggaaagagttggtcaaagggtcttacagagacaaacactttgacgctggctctgttttgttaggtttcggtgttttggaagctgtctttggtggtgttaacacttatcttcgtactggtaaactcttccccggtcctcatctttacgccggtgcaggaataacggtgttgtgggcggcggcggcagcattggtgccggcaatgcagaaagggaacgatacggcgaggagtctacatatagcgttgaatgcagtaaatgttcttcttttcatttggcaaatcccaacaggtcttgatatcgttcttaaggtctttgagttcactaaatggccatag

SEQ ID NO: 1396 - protein, 272 aa, Arabidopsis thaliana
MATTLHCLSTLHLLPRTHHPKTLNSLKPITTKSQPCKTPEIPSTPNALQLLKSSSLPLAVIALPFFLDPQDAAAAGGEFGILEGRSFALIHPIVMGGLFAYTLWTGYLGWQWRRVRTIQSEISDLKKQLKPTPVSPDGSTAVDSSSPPSTTELQIQRLTEERKELVKGSYRDKHFDAGSVLLGFGVLEAVFGGVNTYLRTGKLFPGPHLYAGAGITVLWAAAAALVPAMQKGNDTARSLHIALNAVNVLLFIWQIPTGLDIVLKVFEFTKWP

SEQ ID NO: 1397 - DNA, 1077 bp, Arabidopsis thaliana
atgtctgcttttgtcggcaaatacgcagatgagctgataaagacggctaagtacattgccacaccgggaaagggcattttggcagcagacgagagcacgggaactattgggaaacgattcgccagcatcaatgttgagaacattgagtccaaccgccaagctctccgtgagctcctcttcacgtcccctggcactttcccttgcctctccggtgttatcctcttcgaggaaaccctctaccagaaaaccacggatggcaaacccttcgttgagctcctcatggaaaacggagttatccctggaatcaaagtggacaagggtgtggttgatctagcaggaaccaatggcgagaccactactcagggtctagattcacttggtgcacgttgccaggagtattacaaggcaggagctcggtttgcaaaatggcgtgcagtcctcaagattggggccaccgagccaagcgagctctctatccaagagaacgccaaggggctagcccgctatgccatcatctgccaggagaatggactcgtcccaatcgtcgagccagaggtactgaccgacgggagccatgacatcaagaaatgtgcagcggtgaccgagaccgttcttgctgccgtgtacaaggccttgaacgaccaccatgtcctcctcgaaggcactctgcttaaaccgaacatggtcactcccggctctgacagcccaaaggttgcaccggaagtgatagcggaatacacagtgactgctctgcgccgcacagtcccacctgcagttccaggaatcgtgttcctctcaggcggacagagtgaagaggaagcaacactaaatctgaacgcaatgaacaagctcgatgtgttgaagccatggactctcactttctcatttggccgagccctccaacaaagcactctcaaggcttgggcaggtaagacagagaatgtagccaaagctcaggccactttcctgaccaggtgcaagggtaactcggacgctaccctcgggaaatacaccggcggggcttctggtgactcggccgcctctgagagcttgtatgaggaaggatacaagtattag

SEQ ID NO: 1398 - protein, 358 aa, Arabidopsis thaliana
MSAFVGKYADELIKTAKYIATPGKGILAADESTGTIGKRFASINVENIESNRQALRELLFTSPGTFPCLSGVILFEETLYQKTTDGKPFVELLMENGVIPGIKVDKGVVDLAGTNGETTTQGLDSLGARCQEYYKAGARFAKWRAVLKIGATEPSELSIQENAKGLARYAIICQENGLVPIVEPEVLTDGSHDIKKCAAVTETVLAAVYKALNDHHVLLEGTLLKPNMVTPGSDSPKVAPEVIAEYTVTALRRTVPPAVPGIVFLSGGQSEEEATLNLNAMNKLDVLKPWTLTFSFGRALQQSTLKAWAGKTENVAKAQATFLTRCKGNSDATLGKYTGGASGDSAASESLYEEGYKY

SEQ ID NO: 1399 - DNA, 741 bp, Arabidopsis thaliana
atgagcaagaaacattgctcagaattattaccaaataagatgtttagaaaccaagactcgaaatacttgatcccggtgcagaaagaagcgccaccggtgacaactttaccgatgaaagcttcaacggtgaaatctccacacaactgtgaggccattctcagagacgcagatcctccgatctctctctcctctgttaatctctctgaacagctacggtctggtgttttcttgaaacccaagaaacagatcaaatattgggtggacgagagaaacagcaactgcttcatgctctttgcaaagaacctctctataacttggtctgatgacgtcaactattggacttggtttaccgaaaaagagtcaccaaacgagaatgtggaagctgtgggattgaaaaacgtttgttggctcgacatcacgggaaaattcgacacgaggaacctcactccggggattgtttacgaggtagtctttaaggtgaagctagaggatccggcctatggatgggacacgccggtgaacctaaagctagtcttgcctaacggtaaggagaaaccacaagagaaaaaggtgagtttgagggaacttccaaggtataaatgggtcgatgtcagagttggcgagttcgtacctgagaaatccgctgccggagagatcactttctcaatgtatgagcatgcggctggtgtttggaagaaagggctctccctcaaaggtgttgcaattcgtcccaaacagtaa

SEQ ID NO: 1400 - protein, 246 aa, Arabidopsis thaliana
MSKKHCSELLPNKMFRNQDSKYLIPVQKEAPPVTTLPMKASTVKSPHNCEAILRDADPPISLSSVNLSEQLRSGVFLKPKKQIKYWVDERNSNCFMLFAKNLSITWSDDVNYWTWFTEKESPNENVEAVGLKNVCWLDITGKFDTRNLTPGIVYEVVFKVKLEDPAYGWDTPVNLKLVLPNGKEKPQEKKVSLRELPRYKWVDVRVGEFVPEKSAAGEITFSMYEHAAGVWKKGLSLKGVAIRPKQ

SEQ ID NO: 1401 - DNA, 843 bp, Arabidopsis thaliana
atggcctcgcgtttgctatcgacgacgacactcgtcacaccgccggcttatttcaacaaatcgccggcgtttttaacggccagagttggggtgagaagaggaagggctaacgttaaggctgtgagcaatagttcgcaaggagccgtcgatggaaccgtttacaaaggtgtttacggtccttggaccattgaccaagccgatgtcaaagaggttattttgtacagatcaggactagtaactgctgctgcatcttttgtagctgcttcttctgctgcctttttaccaggagactcttggttaagtgaaacaatcaagcaaaaccatgatctgttttactttgttggtgctagtggtttggggctatctctgtttctaatacatatatatgttacggagattaagaggactcttcaagctttatgggcacttggttttgttggttctttcgctacttacgcagcccttgctagaccagctggtgataacttggttcattatgtcgttgatcatccatccgctgtttggtttgttggtcccctattcgcatctctcacaggactcgttttcaaagaaggtctttgttatggaaagctagaagctggccttcttacattcatcataccttcagttcttcttgggcatttgagtggtctgatgaatgatgaggtaaaactggtgttgctaggaacatggatggctctctttctagtatttgctggaagaaagtttactcagcctattaaggatgatatcggagataaatctgttttcacgttcatgtccctttctgatgatgaaaagaaggctatagttgaaaagctcgagcaagaaaagttggggtaa

SEQ ID NO: 1402 - protein, 280 aa, Arabidopsis thaliana
MASRLLSTTTLVTPPAYFNKSPAFLTARVGVRRGRANVKAVSNSSQGAVDGTVYKGVYGPWTIDQADVKEVILYRSGLVTAAASFVAASSAAFLPGDSWLSETIKQNHDLFYFVGASGLGLSLFLIHIYVTEIKRTLQALWALGFVGSFATYAALARPAGDNLVHYVVDHPSAVWFVGPLFASLTGLVFKEGLCYGKLEAGLLTFIIPSVLLGHLSGLMNDEVKLVLLGTWMALFLVFAGRKFTQPIKDDIGDKSVFTFMSLSDDEKKAIVEKLEQEKLG

SEQ ID NO: 1403 - DNA, 1920 bp, Arabidopsis thaliana
atgaaagtaattacttccctaatctcttctattttgcttaaattcatccacaaagacttccatgagatttatgcaagaatgtccctcctcgatcggtttcttcttcttatcgtgcatggagtggataagatggttccatggcataagcttccagtattcttggggttaacctatcttgaagtacgaagacatcttcaccaacaatacaatcttctcaacgtcggtcaaactccgactgggatccggtttgatcctgctaattatccgtaccggactgctgacggaaaattcaatgatccctttaatgaaggcgtcggcagtcaaaatagttttttcgggagaaattgtccccccgtcgatcagaaatcaaagttacggaggccagaccccatggtggtggcgacaaaactattaggaaggaaaaagtttatcgacacgggaaaacaattcaacatgattgcagcttcttggattcagttcatgatccatgattggattgatcatcttgaagacactcaccaaatcgaacttgtcgctccaaaagaagtagcgagcaagtgtcccttaagctcctttaggttcttaaagaccaaggaagtccctaccggtttcttcgaaatcaagactggctcgcaaaatatccgtacaccttggtgggattcgagcgtcatctatggaagcaactcgaaaacattggatagagtaagaacttacaaagacgggaaactaaagatatcggaggagacgggtctccttctccatgacgaagacggtttagctatctccggcgacattcgtaacagttgggctggtgtctccgctttgcaagctctcttcatcaaagagcacaacgccgtatgcgacgccctcaaggatgaggatgatgatttggaagacgaagatttgtaccggtacgctaggctagtgacctcagccgtggtagccaagattcacaccatagattggacagtccagcttctcaaaaccgacactttacttgctgggatgcgagcaaattggtacggactactaggaaagaagtttaaagattctttcggacatgcaggcagttcgatcttgggaggtgtcgtgggaatgaagaaaccgcaaaatcatggggtcccttactctctaactgaagatttcaccagcgtctatcgaatgcattctctcttacctgatcaactccatatacttgacattgatgatgtaccaggaactaataaatcactaccgttgattcaagagatttctatgagagatttgattggtcgcaagggagaagaaaccatgtctcacattggattcactaagctaatggtctcaatgggtcaccaagcaagtggtgcccttgaactgatgaattatccgatgtggttaagagacattgttccccacgaccccaacggccaagctcgtccagaccacgtcgacttagctgctttagagatctacagggacagggagaggagcgtcccacggtacaacgagttcaggagatctatgtttatgattccgataaccaagtgggaagatctaacggaggatgaggaagctattgaagtgttggatgacgtgtacgatggtgatgtggaggagcttgatcttctcgtgggacttatggcagagaagaaaatcaaaggttttgctatcagtgagactgctttttacattttcctcatcatggccacaaggcgattagaagcggataggtttttcacgagtgatttcaatgaaacgatttacacgaagaaggggcttgaatgggtgaatactacagagagtctcaaggatgtgattgatcgtcattatcctgatatgacagacaaatggatgaactctgaaagtgcattttcagtatgggattcacctccacttaccaaaaatccaatccctctctatctccgaattccctcttaa

SEQ ID NO: 1404 - protein, 639 aa, Arabidopsis thaliana
MKVITSLISSILLKFIHKDFHEIYARMSLLDRFLLLIVHGVDKMVPWHKLPVFLGLTYLEVRRHLHQQYNLLNVGQTPTGIRFDPANYPYRTADGKFNDPFNEGVGSQNSFFGRNCPPVDQKSKLRRPDPMVVATKLLGRKKFIDTGKQFNMIAASWIQFMIHDWIDHLEDTHQIELVAPKEVASKCPLSSFRFLKTKEVPTGFFEIKTGSQNIRTPWWDSSVIYGSNSKTLDRVRTYKDGKLKISEETGLLLHDEDGLAISGDIRNSWAGVSALQALFIKEHNAVCDALKDEDDDLEDEDLYRYARLVTSAVVAKIHTIDWTVQLLKTDTLLAGMRANWYGLLGKKFKDSFGHAGSSILGGVVGMKKPQNHGVPYSLTEDFTSVYRMHSLLPDQLHILDIDDVPGTNKSLPLIQEISMRDLIGRKGEETMSHIGFTKLMVSMGHQASGALELMNYPMWLRDIVPHDPNGQARPDHVDLAALEIYRDRERSVPRYNEFRRSMFMIPITKWEDLTEDEEAIEVLDDVYDGDVEELDLLVGLMAEKKIKGFAISETAFYIFLIMATRRLEADRFFTSDFNETIYTKKGLEWVNTTESLKDVIDRHYPDMTDKWMNSESAFSVWDSPPLTKNPIPLYLRIPS

SEQ ID NO: 1405 - DNA, 1947 bp, Arabidopsis thaliana
atggcgagcacggaagctctcttacccgtcacgtccctacaagatccattatctgagtcaagatccgaccagatcccggagacccgtcggagacgacccatcaaagttcatcttgcagtctattccggtttgctcttgatcgctttgtacgtcactctcatcgtcacacacgacggctccaaggctgaaatagcgacggagtcacgtcctcgtatggccggcgtgtcggagaagagcaacgacggggtttggatatcatccgatgatgggaaagttgaagcgttcccgtggaacaatactattttgtcgtggcaacgcacggcgtttcatttccagcctgagaaaaattggatgaacgatcctaatggtccattgttctataagggatggtaccatttcttctatcaatacaacccaaatgcagctgtgtggggtgacattgtttggggtcacgccgtgtcaaaagaccttatccactggctttatctcccaatagccatggttcctgaccaatggtacgatgcaaacggtgtctggaccggttcagccacttttctagatgatggctccattgtcatgctctacaccggttccactgacgaattcgtacaggttcaaaaccttgcctatcctgaagacccaagcgacccacttttgttgaaatgggtcaagttctccggtaaccctgtcctcgtaccgcctccaggtattggtgcaaaggacttccgtgacccaacaacagcctggaagacatcttctggaaaatggcgaatcaccatcggttccaaaatcaatagaaccggaatatctctcatttatgacactaccgatttcaaaacctacgagaaacacgaaaccttgttgcaccaagtccccaacaccggaatgtgggagtgcgttgatttttacccggtgtcgaagactcagctcaatgggctcgatacttcggtcaacggaccagatgtcaagcatgtcatcaaggctagcatggacgatactagaattgaccattatgccattgggacgtacgatgattcaaacgctacatgggtccccgataatccttctatcgatgtcggaatcagtaccggtttgagatacgattacgggaaatattatgcgtcaaagacgttttacgatcaaaataagggacgaagaatcttatggggttggatcggtgaatctgacagtgaagctgctgatgtacaaaagggttggtcttctgttcagggcatcccaagaactgttgtattggacacaaggacgcataaaaacttagtccagtggccagttgaggaaatcaaatcattgagactaagcagcaagaaatttgacatgactattggaccagggactgtggttccggtcgatgtgggttccgccactcagctagacatagaggctgagttcgagatcaagaccgatgatctcaagttattctttgatgatgactctgtggaggccgacaataaattcagctgcgaaacaaacggaggctccacagcgcgtggtgctttagggccttttggattctcggttctcgctgacgagggcttgtcagaacaaactccggtttacttctatgtgactaagggaaaacattcaaaactcaatactgtcttctgcactgacacctcaaggtcgactttggcaaacgatgtggtgaaaccaatctatggaagcttcgtaccggtcttaaaaggagagaaattgacaatgagaatcttggttgatcattcgatcgtagaaggattcgcacaaggtggaagatcatgtattacctcaagagtatatcccacaaaagctatctatggagctaccaagctcttcttgttcaataacgccattgatgcgaccgttacggcgtcgtttacggtctggcaaatgaacaatgcttttattcatccttactcttcagacgatctcggtgttccttccagcacctga

SEQ ID NO: 1406 - protein, 648 aa, Arabidopsis thaliana
MASTEALLPVTSLQDPLSESRSDQIPETRRRRPIKVHLAVYSGLLLIALYVTLIVTHDGSKAEIATESRPRMAGVSEKSNDGVWISSDDGKVEAFPWNNTILSWQRTAFHFQPEKNWMNDPNGPLFYKGWYHFFYQYNPNAAVWGDIVWGHAVSKDLIHWLYLPIAMVPDQWYDANGVWTGSATFLDDGSIVMLYTGSTDEFVQVQNLAYPEDPSDPLLLKWVKFSGNPVLVPPPGIGAKDFRDPTTAWKTSSGKWRITIGSKINRTGISLIYDTTDFKTYEKHETLLHQVPNTGMWECVDFYPVSKTQLNGLDTSVNGPDVKHVIKASMDDTRIDHYAIGTYDDSNATWVPDNPSIDVGISTGLRYDYGKYYASKTFYDQNKGRRILWGWIGESDSEAADVQKGWSSVQGIPRTVVLDTRTHKNLVQWPVEEIKSLRLSSKKFDMTIGPGTVVPVDVGSATQLDIEAEFEIKTDDLKLFFDDDSVEADNKFSCETNGGSTARGALGPFGFSVLADEGLSEQTPVYFYVTKGKHSKLNTVFCTDTSRSTLANDVVKPIYGSFVPVLKGEKLTMRILVDHSIVEGFAQGGRSCITSRVYPTKAIYGATKLFLFNNAIDATVTASFTVWQMNNAFIHPYSSDDLGVPSST

SEQ ID NO: 1407 - DNA, 465 bp, Arabidopsis thaliana
atgggtggctgcgtgggttgctacagagaacacagatcaactgccgccagtctgaaggatccaccttccaattccattgctcgaccgtgtaagaaaccgagtgtctctgaagatttctggtcaacaagcacagttgatatggacaacatcaccttcccttcacaggggagcttatcatcatccaatcagacttttgattctcaatctgctgctagaaactctaatgctcctcctgaatatgtaaatcaaggtcttcttctttggaatcagacacgggagcgttgggtgggaaaggataaacccaacaacccggtggatcacaatcaaggagccaagttaaattggaacacagcaacgtatgatagcttgctggggagcaacaagttatttccccaacccattcctctcaccgaaatggtggattttctagtggacatttgggaacaagaaggtctatatgactga

SEQ ID NO: 1408 - protein, 154 aa, Arabidopsis thaliana
MGGCVGCYREHRSTAASLKDPPSNSIARPCKKPSVSEDFWSTSTVDMDNITFPSQGSLSSSNQTFDSQSAARNSNAPPEYVNQGLLLWNQTRERWVGKDKPNNPVDHNQGAKLNWNTATYDSLLGSNKLFPQPIPLTEMVDFLVDIWEQEGLYD

SEQ ID NO: 1409 - DNA, 519 bp, Arabidopsis thaliana
atggcgttccctaaggtatacttcgacatgaccatcgacggccagcccgcgggaaggatcgtgatggagctgtacaccgataagactcccaggactgccgagaatttcagagctctctgcaccggagagaaaggtgttggcggtaccggaaaaccccttcacttcaagggatctaagtttcaccgtgtgatccctaacttcatgtgccagggaggagatttcaccgccgggaacggaacaggcggtgagtcgatctacgggagcaagttcgaggacgagaatttcgagaggaagcacaccggaccggggatcctgtcgatggcgaacgccggtgcaaacacgaacggatctcagttcttcatctgcaccgtgaagaccgattggcttgatgggaagcacgtggtgtttgggcaggtcgtggaaggcttagacgtggtaaaggccatcgagaaggttggatcatcatctggaaagccgacgaagcctgtggttgttgccgattgtggtcagctctcttag

SEQ ID NO: 1410 - protein, 172 aa, Arabidopsis thaliana
MAFPKVYFDMTIDGQPAGRIVMELYTDKTPRTAENFRALCTGEKGVGGTGKPLHFKGSKFHRVIPNFMCQGGDFTAGNGTGGESIYGSKFEDENFERKHTGPGILSMANAGANTNGSQFFICTVKTDWLDGKHVVFGQVVEGLDVVKAIEKVGSSSGKPTKPVVVADCGQLS

SEQ ID NO: 1411 - DNA, 567 bp, Arabidopsis thaliana
atggagccgccgagttcgagaccggaggaacctccgtcatgggaggacctttacaaaatcaatcttatgccatcggagctattccttaagttccgcaaagagcttcaaggccttcgcgtcggcgtcaatctcgagttatataacgaacccacgaatgattaccacgcaaagcttgttttgaagcctctatgtccagaaaggaagtggaagtttatatatgagccgctacaccaagaagttcgtgttttatcgaagaagattcctgtcaccagatttctaaacctccaggttggtgttggacataactttcaaatgaatgcaattggttggaaatggaagcttacttcatgtttgggtggagatggtgtgtctcggattcgaaataaaactactcttggtcttagtcctggtatcgatttccggtttggatggagagctgattttgtactcccagaggttactggggcccttggtactgaggaaccgttattcaacatgagctccgggcgtttagaggcatcactagacagagtagaggccattgtaacccattcagattatctatag

SEQ ID NO: 1412 - protein, 188 aa, Arabidopsis thaliana
MEPPSSRPEEPPSWEDLYKINLMPSELFLKFRKELQGLRVGVNLELYNEPTNDYHAKLVLKPLCPERKWKFIYEPLHQEVRVLSKKIPVTRFLNLQVGVGHNFQMNAIGWKWKLTSCLGGDGVSRIRNKTTLGLSPGIDFRFGWRADFVLPEVTGALGTEEPLFNMSSGRLEASLDRVEAIVTHSDYL

SEQ ID NO: 1413 - DNA, 1494 bp, Arabidopsis thaliana
atgagaccaatcattaggttatcatctctcagtagaattagatgggctctaaggaacaatcaagaacgttattcttcaactttctactccaaaagccgcaaacttttgatcggtgtcaatcaaaatcaagctctgctgaatacaaacactgataattcaagtttgtattcaaggtcaagtatctttagaggcttatcagcagaagcagtagaagcagctgatcctgctactactagggtcaccgtctcagatgtgaatagaacaggtcctcttgttgagtatgagagaagaatcagtaatggtgaactcatgactggtgatatctgccaaattagtgcattgagagagcttcagagactatatgatgagcttgtggattcagtagatacatgtcgtttagatcggtataatacttctgataaatcctcaagaagtcgttggttttggtctcggctcatgccacagacttcttactcacccgtcaaaggattatacctttatggaggtgtaggtacaggaaaaaccatgttgatggacttattctttgatcaactgccttgtacttggaagaagcagaggatacatttccatgatttcatgttgagtgttcatagccgcttgcaaaagcacaagggtttatcagatccacttgaagttgttgcccaagagatagctcatgatgcaatcttactatgtctagatgagttcatggtaactgatgttgcagatgctctaatactaaaccgactctttggacatctgtttagcaatggtgttattcttgttgctacatcgaatcggaatcctgataaactctatgaaggaggactccaaagagatctgttcctacctttcatttcttcattgaaggaacgaagtgtggttcatgagatcggttcagcggttgattaccggaaactaacttcggctgagcaaggattctacttcattggtaaagatctttcgacccttttgaaacagaagttccgacaattgattggagacaatgttgttgcccgtccacaggtagtagaagtggtgatgggaagaaaattacagattccattaggtgccaatggatgtgcatactttccttttgaagagctatgtgaccgacctcttggagctgcggattacttcggtttgttcaagaagtttcatactcttgccttggacgaaattccagtgtttgggcttcataaccgtactgctgcatatagattcgtcacgctagtcgatgtaatgtatgagaacagagcgaggttgttgtgtacagctgaagcaaatcctcaagaacttttggaaaagattataacaatctcagaggcgaaatcgatgggtccaagaacatcatcaagatcaagaaagaacgatgttactgagctctgcgtggataacgaattaggtttcgcaaaagacagaaccatcagtagattaacagaaatgaacagcaaagaatacttggagcaccatgccataacacacaatctgtaa

SEQ ID NO: 1414 - protein, 497 aa, Arabidopsis thaliana
MRPIIRLSSLSRIRWALRNNQERYSSTFYSKSRKLLIGVNQNQALLNTNTDNSSLYSRSSIFRGLSAEAVEAADPATTRVTVSDVNRTGPLVEYERRISNGELMTGDICQISALRELQRLYDELVDSVDTCRLDRYNTSDKSSRSRWFWSRLMPQTSYSPVKGLYLYGGVGTGKTMLMDLFFDQLPCTWKKQRIHFHDFMLSVHSRLQKHKGLSDPLEVVAQEIAHDAILLCLDEFMVTDVADALILNRLFGHLFSNGVILVATSNRNPDKLYEGGLQRDLFLPFISSLKERSVVHEIGSAVDYRKLTSAEQGFYFIGKDLSTLLKQKFRQLIGDNVVARPQVVEVVMGRKLQIPLGANGCAYFPFEELCDRPLGAADYFGLFKKFHTLALDEIPVFGLHNRTAAYRFVTLVDVMYENRARLLCTAEANPQELLEKIITISEAKSMGPRTSSRSRKNDVTELCVDNELGFAKDRTISRLTEMNSKEYLEHHAITHNL

SEQ ID NO: 1415 - DNA, 1230 bp, Arabidopsis thaliana
atggcggcgtttttgcaaacgaacatcagtctgaatgcgatcaagatcgtcccggggaaatacagttctctcaccgatcatcagtttcgtgcgccgtatcgaattaggtgcgccgccgcttcacctgggaaaaaacggtataacatcgctctgcttcccggagacggtatcggtccagaagttatctctgttgctaagaatgtgcttcagaaagctggatctctcgaaggactggagtttgatttcaaggagatgcctgtcggaggagcagccttggatttggttggagttccattgccggaggaaactttcacggctgcaaaactatctgatgccattcttcttggagctattggagggtacaaatgggacaagaatgagaaacatctgagacctgagatggctctgttttaccttagaagagatctcaaagtctttgctaatttgagacctgctacagttttgccacagctagttgatgcttccacactgaagaaagaagtagcagaaggtgttgatatgatgattgttagggagctcacaggaggtatttactttggagagccaagaggcattacgatcaatgaaaatggcgaagaagtcggcgttagtacagagatctacgctgctcacgagattgacagaattgctcgtgtagcattcgagactgctaggaaaaggcgtggcaaactttgttctgttgacaaagccaatgtgttggatgcatcaatattgtggaggaaaagagtaacagctttagcctctgaatatccagatgttgaactatcacatatgtatgtcgataatgctgcaatgcagcttattcgtgacccgaaacagtttgacacaatcgttaccaataacatttttggtgatatattgtctgatgaagcttcaatgatcactggaagcattggaatgcttccatctgctagtctcggtgaatcgggacctggactctttgaacctatacatggttcagcaccagatatagctggacaagacaaggcaaacccattggccaccattctcagcgcggcgatgcttctgaagtatggacttggagaagaaaaggctgcaaagaggattgaagacgctgtcgtggatgctctgaacaaagggttcagaaccggagacatctactcccctggaaataaactggtgggatgcaaggaaatgggtgaggaggttctcaaatcagtggaatccaaagttccagctactgtttaa

SEQ ID NO: 1416 - protein, 409 aa, Arabidopsis thaliana [sequence omitted]

SEQ ID NO: 1417 - DNA, 651 bp, Arabidopsis thaliana
atggctgccaccaacacaatcctcgcattctcatctccttctcgtcttctcattcctccttcctccaatccttcaactctccgttcctctttccgcggcgtctctctcaacaacaacaatctccaccgtctccaatctgtttccttcgccgttaaagctccgtcgaaagcgttgacagttgtttccgcggcgaagaaggctgttgcagtgcttaaaggtacttctgatgtcgaaggagttgttactttgacccaagatgactcaggtcctacaactgtgaatgttcgtatcactggtctcactccagggcctcatggatttcatctccatgagtttggtgatacaactaatggatgtatctcaacaggaccacatttcaaccctaacaacatgacacacggagctccagaagatgagtgccgtcatgcgggtgacctgggaaacataaatgccaatgccgatggcgtggcagaaacaacaatagtggacaatcagattcctctgactggtcctaattctgttgttggaagagcctttgtggttcacgagcttaaggatgacctcggaaagggtggccatgagcttagtctgaccactggaaacgcaggcgggagattggcatgtggtgtgattggcttgacgccgctctaa

SEQ ID NO: 1418 - protein, 216 aa, Arabidopsis thaliana
MAATNTILAFSSPSRLLIPPSSNPSTLRSSFRGVSLNNNNLHRLQSVSFAVKAPSKALTVVSAAKKAVAVLKGTSDVEGVVTLTQDDSGPTTVNVRITGLTPGPHGFHLHEFGDTTNGCISTGPHFNPNNMTHGAPEDECRHAGDLGNINANADGVAETTIVDNQIPLTGPNSVVGRAFVVHELKDDLGKGGHELSLTTGNAGGRLACGVIGLTPL

SEQ ID NO: 1419 - DNA, 1533 bp, Arabidopsis thaliana
atgttcatcgagagcttcaaagtagagagtccaaatgtcaaatacacagagaatgagatcaattcggtgtacgattacgaaacaacagaggtcgtccacgagaatcgtaacggtacatatcaatgggtcgtgaagccaaagactgtcaaatacgatttcaaaacagacactcgtgtccccaaattaggggttatgcttgttggttggggaggaaacaatggatcaacactaaccgctggtgtcattgctaacaaagaaggaatatcgtgggcgactaaagacaaagtgcaacaagctaattactttggttcacttactcaagcttcatcgattcgtgttggctcttacaatggtgaagagatctatgctcctttcaagagtcttcttccaatggtgaatccagaggatgttgtgtttggtggttgggatataagtgacatgaatttagcagacgctatggctagagctagagttcttgatattgatctgcagaaacaacttagaccttacatggagaacatgatcccacttcctggtatctatgaccctgatttcatcgctgctaatcaaggttcacgtgctaatagcgtgatcaaaggtaccaagaaggaacaagttgatcacatcatcaaggacatgagggagtttaaggagaagaacaaagtggataagttggttgtgttatggactgcaaacacagagcgttatagcaatgtgattgtaggacttaacgatacgacggagaatctattggcttctgttgaaaaggacgagtctgagatctcgccgtctacgttgtatgcgattgcttgtgttcttgaaggcattcctttcatcaatgggagtcctcagaatacttttgtccccggtcttatcgaattggctatatcgaagaattgtttgattggtggggatgatttcaagagtggtcagactaagatgaaatccgttttggttgatttccttgttggagctggcattaagcctacttcgattgtgagctataatcatttgggaaacaacgacgggatgaacctctcagcgccacagactttccgctctaaggagatttcaaagagcaatgttgtagacgacatggtagctagtaatggcatcctctttgagcctggtgaacaccctgaccatgtcgttgtcatcaagtatgtgccatatgttgcggatagtaaaagagcaatggatgagtacacgtctgagatattcatgggagggaggaacactatagtgttgcataacacttgtgaggactctctcttggctgcaccaattatcttggatcttgtccttctcgctgaactcagcaccagaatccaatttaaagctgaaggagaggggaagtttcactctttccacccggtagctaccatactcagttacctcacaaaggcacctcttgtaccgcccggaacaccggtggttaacgctctgtcgaagcagcgggcaatgctggaaaacattcttagggcatgtgttgggcttgcgccagagaacaacatgatcatggagtacaagtga

SEQ ID NO: 1420 - protein, 510 aa, Arabidopsis thaliana
MFIESFKVESPNVKYTENEINSVYDYETTEVVHENRNGTYQWVVKPKTVKYDFKTDTRVPKLGVMLVGWGGNNGSTLTAGVIANKEGISWATKDKVQQANYFGSLTQASSIRVGSYNGEEIYAPFKSLLPMVNPEDVVFGGWDISDMNLADAMARARVLDIDLQKQLRPYMENMIPLPGIYDPDFIAANQGSRANSVIKGTKKEQVDHIIKDMREFKEKNKVDKLVVLWTANTERYSNVIVGLNDTTENLLASVEKDESEISPSTLYAIACVLEGIPFINGSPQNTFVPGLIELAISKNCLIGGDDFKSGQTKMKSVLVDFLVGAGIKPTSIVSYNHLGNNDGMNLSAPQTFRSKEISKSNVVDDMVASNGILFEPGEHPDHVVVIKYVPYVADSKRAMDEYTSEIFMGGRNTIVLHNTCEDSLLAAPIILDLVLLAELSTRIQFKAEGEGKFHSFHPVATILSYLTKAPLVPPGTPVVNALSKQRAMLENILRACVGLAPENNMIMEYK

SEQ ID NO: 1421 - DNA, 1428 bp, Arabidopsis thaliana
atgtctgtgcaagagtatttagacaagcatatgctttctcggaaaatcgaagacgccgttaatgccgccgtaagggctaaaacctcagatcccgttctcttcatcgctaatcatctgaagaaagctgtatcatctgtgataacgaaggttaaagcacgacagatccttgacagcagaggaattccaacagttgaagttgatctgcacacgaacaaaggcgtttttcgtgcttctgttcccagtggtgattcttctggaacgtatgaagctattgagctacgtgatggagacaaaggaatgtatcttggaaacagtgtggctaaagctgttaagaacataaatgaaaaaatttctgaggcgttgattggtatggacccaaaacttcagggtcagatagatcaggctatgatagatttggataaaactgaaaagaagagtgaacttggtgctaatgctatacttgctgtgtcaattgcggcatgcaaggctggagctgctgagaaagaggtccctttgtgcaagcatctttctgatcttagtggcagagcaaacatggtgttacctgtacctgcgttcactgttttgagtggtgggaagcatgcttcgaatacttttgccattcaggaaattatgattctcccaattggagcaagtagatttgaggaggccctgcaatggggatctgagacatatcatcatttaaaggctgtcatttcagaaaagaatggtggtttgggatgtaatgttggtgaagatggtggtcttgctccagatatctcgagcctcaaggaaggtttggagcttgtaaaagaagctatcaaccgaacagggtacaatgataagataaagatagccattgatattgccgccactaatttttgtttaggtaccaagtatgatttagatatcaagtctccaaataaatctgggcaaaatttcaagtcagcggaagatatgatagatatgtacaaagaaatttgtaatgattatccaattgtgtctatagaagacccttttgacaaggaggactgggaacacaccaagtatttttcgagtcttggaatatgtcaggtggtaggtgacgatttgttgatgtcaaattcaaaacgagttgagcgtgccatacaggagtcttcttgtaatgctcttcttctcaaggtgaatcagattggtacagtaacagaagccattgaagtagtgaaaatggcaagggatgcccagtggggtgtggtgacatctcatagatgtggagaaacagaggactctttcatctctgacttatctgtgggtctcgcaacaggtgtgattaaagctggtgctccttgcagaggagaacgtactatgaagtataaccagttgctacggatagaggaagagcttggggatcaagcagtgtatgctggagaagattggaagctatctctctaa

SEQ ID NO: 1422 - protein, 475 aa, Arabidopsis thaliana
MSVQEYLDKHMLSRKIEDAVNAAVRAKTSDPVLFIANHLKKAVSSVITKVKARQILDSRGIPTVEVDLHTNKGVFRASVPSGDSSGTYEAIELRDGDKGMYLGNSVAKAVKNINEKISEALIGMDPKLQGQIDQAMIDLDKTEKKSELGANAILAVSIAACKAGAAEKEVPLCKHLSDLSGRANMVLPVPAFTVLSGGKHASNTFAIQEIMILPIGASRFEEALQWGSETYHHLKAVISEKNGGLGCNVGEDGGLAPDISSLKEGLELVKEAINRTGYNDKIKIAIDIAATNFCLGTKYDLDIKSPNKSGQNFKSAEDMIDMYKEICNDYPIVSIEDPFDKEDWEHTKYFSSLGICQVVGDDLLMSNSKRVERAIQESSCNALLLKVNQIGTVTEAIEVVKMARDAQWGVVTSHRCGETEDSFISDLSVGLATGVIKAGAPCRGERTMKYNQLLRIEEELGDQAVYAGEDWKLSL

SEQ ID NO: 1423 - DNA, 639 bp, Arabidopsis thaliana
atggcaacggtcacgattctctcacccaaatcgattccaaaggtcactgattccaaattcggagctagggtttctgatcagatcgtcaatgtcgtaaaatgcggcaaatccggccggagattgaagttagcgaagctggtctcagcggctggattgtcacagatcgaaccagacatcaacgaagacccgattggtcaattcgagactaatagcattgaaatggaagatttcaagtatggatattacgatggagctcatacttactatgaaggagaagttcaaaagggaacattttggggagcaattgctgatgacattgctgctgtggatcaaactaatgggtttcaaggtttgatctcttgtatgtttcttcctgctatagctcttgggatgtattttgatgctccgggtgagtacttgttcataggtgcagcgttattcacggtagtgttctgtataatagagatggataaacctgaccagccacacaacttcgagcctcagatatacaaattggagagaggagctcgtgacaagctcattaatgactacaacacaatgagcatttgggactttaatgacaaatatggtgatgtatgggatttcaccattgagaaagatgatatcgccacacgataa

SEQ ID NO: 1424 - protein, 212 aa, Arabidopsis thaliana
MATVTILSPKSIPKVTDSKFGARVSDQIVNVVKCGKSGRRLKLAKLVSAAGLSQIEPDINEDPIGQFETNSIEMEDFKYGYYDGAHTYYEGEVQKGTFWGAIADDIAAVDQTNGFQGLISCMFLPAIALGMYFDAPGEYLFIGAALFTVVFCIIEMDKPDQPHNFEPQIYKLERGARDKLINDYNTMSIWDFNDKYGDVWDFTIEKDDIATR

SEQ ID NO: 1425 - DNA, 1314 bp, Arabidopsis thaliana
atggaccctgagagtatcatggctgctgatgggactgattctgctcctgcaaatggtggtttagcaatggaaaatgtatgtgttaaagaaaatggggctgtttctgtcgaaaccgtggacactacttcagaaagtcagaatgagaattcggcaaacagttccactttggatacaattgaacacgtcaaggaggcagctgagggcacacaagttgaacatgtagatgattcaaagtgtatgaaaggcgaaaaagctcaacggaagccaaggcatgagaaactatcaggtggtaagaataattcatcggttcacatcaaaaagagcaaagagggcaaaagtgcagatgctaaagtggcagcatcaaatggttctgttgctcctaatgtacagacaacaaatcctcttaagagcaaatcattcaatgggcgagaggcacaagtcacaaagcaagggaagcatgactctgcacctgctgaaagcgctgatggggagaaggtgaaaccaaagtctcaaaagaaacaagcccatgagacatctgaagatgatactcagtcttctaatagtccgaaagcagacgatggaaaacctcgtaaagttggtgcacttccaaattatggattcagtttcaaatgtgaccaacgggctgaaaagagaaaagagttctatgttaagcttgaggagaagactcatgcaaaagaagaggaaattaatagcatgcaagccaagtccaaggaaacacaagaagctgagcttaggatgctaaggaagagtttgaacttcaaagccacacctatgcctagcttttatcaagaacctcagccgcctaaaacagagttaaagaagataccaccaacgagaccaaaatctccaaaactcgggcgaaagaagactgcttctggagcagattctgaagaaactcaaacccctcgccttggtaggctaagcctagatgagagagcttctaaagataacccaactgcaaagggaattatgccaacagttgatctgaagaagcaacctgtgcgcaagtcacttccaagattgccatctcagaaaacagttctccccgatggaaaacccgccccagcaaaagctgccataatcccagcaaaggtaagacctgagaaaaagaaacttgaaaaagatgcagaaaccgtaaaccagacttcacatcccacagaagaggaagcacaagtgacagtatcatccaatgctgatgtagaagattcacatgagactgtatctccaaggatgaatgaagacagagccgacaagtccattgaggtatctgaagcggttgctgttgagcattaa

SEQ ID NO: 1426 - protein, 437 aa, Arabidopsis thaliana
MDPESIMAADGTDSAPANGGLAMENVCVKENGAVSVETVDTTSESQNENSANSSTLDTIEHVKEAAEGTQVEHVDDSKCMKGEKAQRKPRHEKLSGGKNNSSVHIKKSKEGKSADAKVAASNGSVAPNVQTTNPLKSKSFNGREAQVTKQGKHDSAPAESADGEKVKPKSQKKQAHETSEDDTQSSNSPKADDGKPRKVGALPNYGFSFKCDQRAEKRKEFYVKLEEKTHAKEEEINSMQAKSKETQEAELRMLRKSLNFKATPMPSFYQEPQPPKTELKKIPPTRPKSPKLGRKKTASGADSEETQTPRLGRLSLDERASKDNPTAKGIMPTVDLKKQPVRKSLPRLPSQKTVLPDGKPAPAKAAIIPAKVRPEKKKLEKDAETVNQTSHPTEEEAQVTVSSNADVEDSHETVSPRMNEDRADKSIEVSEAVAVEH

SEQ ID NO: 1427 - DNA, 441 bp, Arabidopsis thaliana
atgaatcttcaagctgtttcttgtagcttcggattcctttcgagtccacttggtgtcactcccagaacttcgtttcgtcgcttcgtaatccgagcgaaaacggaaccgtcggagaaatcagtagagattatgaggaaattctccgagcaatatgctcgtcgctctgggacttacttctgtgttgataaaggagttacttcagtcgttattaagggtttggctgagcataaagattcatatggtgcaccgctttgcccttgcagacactatgatgataaagctgctgaggttggacaaggcttttggaattgtccgtgtgttccaatgagagagaggaaggagtgccattgtatgcttttcttaactcctgataatgatttcgctggaaaagatcagacgattacatcggatgaaataaaagaaactacagctaacatgtga

SEQ ID NO: 1428 - protein, 146 aa, Arabidopsis thaliana
MNLQAVSCSFGFLSSPLGVTPRTSFRRFVIRAKTEPSEKSVEIMRKFSEQYARRSGTYFCVDKGVTSVVIKGLAEHKDSYGAPLCPCRHYDDKAAEVGQGFWNCPCVPMRERKECHCMLFLTPDNDFAGKDQTITSDEIKETTANM

SEQ ID NO: 1429 - DNA, 255 bp, Arabidopsis thaliana
atgtcacataacacaaaccttatgatcgctgccgcagccactaccactacgacctcttcgtcttcctcttcgtcctccggaggctcggggactaaccagctaagcaggtacgagaatcagaagagaagagattggaacactttcggacagtatctacgcaatcaccgtccaccactttctctctcccgttgcagtggtgctcatgttcttgaattcctcaggtacctcgaccaattcggcaagactaaggtataa

SEQ ID NO: 1430 - protein, 84 aa, Arabidopsis thaliana
MSHNTNLMIAAAATTTTTSSSSSSSSGGSGTNQLSRYENQKRRDWNTFGQYLRNHRPPLSLSRCSGAHVLEFLRYLDQFGKTKV

SEQ ID NO: 1431 - DNA, 2268 bp, Arabidopsis thaliana
atggcagattcaagttcttctctccctcctctttgcgagaagatctcatacaaaaactattttctaagagttgtggatctcacgattctaggctttctcttttctcttctcttgtaccgaattctacttatgaaccaaaacaactccgtttgggttgtggctttcctctgtgaatcctttttctctttcatatggcttcttattaccagcataaaatggagtcctgcttcatataaatcatatcctgaaagacttgatgaaagggttcatgaccttccatcggtagatatgtttgtgactactgcggatcctgttcgggagccgccgattcttgtagcaaacacgttgctttcgctgttagcagtgaattatccagcgaataaacttgcttgttatgtatcggatgatggatgctcacctctcacttacttctctctcaaggaagcttctaagttcgccaagatttgggttcccttctgcaaaaaatataacattaaagttagagctccttttagatattttttgaaccctccagccgcaacagaaagttctgaattcagtaaagactgggaaataaccaagagggagtacgagaaattaagcaggagggtggaagatgccactggagattcccattggttggatgcagaagatgactttgaagatttctcgaatacaaaaccaaatgatcattcaactatagtaaaggtggtatgggagaacaagggaggtgtcggagtcgagaacgaggttcctcattttgtatacatttcaagagagaaaagaccaaattatcttcatcattacaaagctggagccatgaactttctggtaagagtgtcagggttgatgacaaatgcaccatacatgttgaacgtagactgtgacatgtatgctaatgaagcagatgtggtgcgccaagcaatgtgtatatttctacaaaaatcaatgaattcaaaccattgtgcttttgttcaattccctcaagagttctatgattctaacgccgacgaactcaccgtcttacaatcatatttgggacgaggaattgcgggaatccaaggacctacatatgcaggttcaggatgcttccacactagaagagttatgtacggtctatcaatagatgatttagaagatgatggaagtctttcttcacttgcaacaaggaagtatttggctgaagagaatttagctagagaatttgggaactctaacgagatggtgacatcggtggtcgaggcattacaaagaaaaccaaatccgcaaaatacccttgcaaactccctcgaagcggctcaagaagtgggacattgtcattttgagtaccaaactagctggggcaaaactattggttggttatacgaatcaacagcggaagatgcaaacacgagtatcggaatccattcgagagggtggactagctcatatatatctccgaaaccaccagcgtttcttggggctatgccaccgggaggtccggaagcgatgctccagcagcggcgatgggccacaggactgctcgaagtccttttcaacaaacaaagtccgttgatcggaatgttttgtaggaaaataagatttcgacaaagcttggcttatttatacattttcacttggggtctaaggtcaatccctgagcttatttattgtctcttgcctgcttattgcctactccacaacgctgccttatttcccaagggagtttatttaggtatagtcgtcacacttgtgggaatgcattgtctttactctctatgggaatttatgagccttggtttctcagtacaatcgtggtttgcctcccaatcattttggaggataaaaaccacttgcagttggttatttagcatccctgatatcatactcaagctacttggaatctcgaaaactgttttcatagtcactaaaaagactatgcccaagacaatgtcaggatctggatccgaaaaatctcaacgagaagttgattgtccaaaccaagattccggtaaatttgaatttgatggctcgctttatttcttgcctggcacatttatccttttagtgaatctagccgctctagccggttgttcggtgggtctacaacgtcacagaggaggtggttcgggtttagcagaagcttgtggatgtattttggtggttatattgtttcttccatttctaaagggtatgtttgagaagggaaaatatggtatcccatggtctactctttctaaagctgcctttttagcagttttatttgttgttttctctgtgggaaactag

SEQ ID NO: 1432 - protein, 755 aa, Arabidopsis thaliana
MADSSSSLPPLCEKISYKNYFLRVVDLTILGFLFSLLLYRILLMNQNNSVWVVAFLCESFFSFIWLLITSIKWSPASYKSYPERLDERVHDLPSVDMFVTTADPVREPPILVANTLLSLLAVNYPANKLACYVSDDGCSPLTYFSLKEASKFAKIWVPFCKKYNIKVRAPFRYFLNPPAATESSEFSKDWEITKREYEKLSRRVEDATGDSHWLDAEDDFEDFSNTKPNDHSTIVKVVWENKGGVGVENEVPHFVYISREKRPNYLHHYKAGAMNFLVRVSGLMTNAPYMLNVDCDMYANEADVVRQAMCIFLQKSMNSNHCAFVQFPQEFYDSNADELTVLQSYLGRGIAGIQGPTYAGSGCFHTRRVMYGLSIDDLEDDGSLSSLATRKYLAEENLAREFGNSNEMVTSVVEALQRKPNPQNTLANSLEAAQEVGHCHFEYQTSWGKTIGWLYESTAEDANTSIGIHSRGWTSSYISPKPPAFLGAMPPGGPEAMLQQRRWATGLLEVLFNKQSPLIGMFCRKIRFRQSLAYLYIFTWGLRSIPELIYCLLPAYCLLHNAALFPKGVYLGIVVTLVGMHCLYSLWEFMSLGFSVQSWFASQSFWRIKTTCSWLFSIPDIILKLLGISKTVFIVTKKTMPKTMSGSGSEKSQREVDCPNQDSGKFEFDGSLYFLPGTFILLVNLAALAGCSVGLQRHRGGGSGLAEACGCILVVILFLPFLKGMFEKGKYGIPWSTLSKAAFLAVLFVVFSVGN

SEQ ID NO: 1433 - DNA, 564 bp, Arabidopsis thaliana
atggctctcgaggcatggtttatggatgatagcaatgaggaccagagacttcctcatcatcgtaacccgaaagaactcgtctcgttggattacttggcagagttgggagtgttgtactggaagttgaaccctgagaactacgagaatgattctgaacttagcaagattagagaagacaggggttacgattacatggatttgctggatctgtgtcccgagaaagtcagcaactacgaagaaaagctgaagaactttttcacagaacacattcacaaggacgaagagattcggtactgcctagcaggaagtggctactttgatgttagggacaaggatgatcgttggatccgtatctggatgcaacctggcgatctcattgtccttcctgccggaatctaccaccggttcacactcgacgccagcaactacatcaagctaatgaggctgttcgtgggggaaccggtttggacaccatataaccggccacaggaagaacatcctgttaggaaaaagtatatccacggcttaacctacaagtttggagaaaccgttaaagcacattaa

SEQ ID NO: 1434 - protein, 187 aa, Arabidopsis thaliana
MALEAWFMDDSNEDQRLPHHRNPKELVSLDYLAELGVLYWKLNPENYENDSELSKIREDRGYDYMDLLDLCPEKVSNYEEKLKNFFTEHIHKDEEIRYCLAGSGYFDVRDKDDRWIRIWMQPGDLIVLPAGIYHRFTLDASNYIKLMRLFVGEPVWTPYNRPQEEHPVRKKYIHGLTYKFGETVKAH

SEQ ID NO: 1435 - DNA, 699 bp, Arabidopsis thaliana
atgacccctaaatcgagaggcttcgttaggagaaggagaagcagaagagtgttggttctcgattgtcgatctcaacaatggcgtagtctccccaaaatgcgtcaacctcgagcttctcctgccgcgtatgttaaggatggtctgatcattgtgattggaggttgcaggtccaagaatatcgagacttggggagagatttatgatctaaagaccaatacttgggggcgaatactgctccaatcacatgatcccacagttcaaaatgcttacttgaatcgctttaaacctaacttgcagacgaatgcttgctatgtagagattgacaaggtgtcgtgcctgatatttttatccgatgggaagctattttggcgtgaaacaaagcaaggttttgagaggtgtagtgttatattgggagatgatgagcaagtgtcctcttatcaacttgtttcggtggcaaacgccgccggaggaggaagagtgacagtttggtggaagtcggggttaaaagttctggatctcttaagtggcactgagacttgggaatgttacacaaatattcggtgtgcagagatttcgtttgagagaagaggtttaagagagctttggggattcgttgaatggtctagagaggtgtttaccgttgatggatatgacgatacttacgatttctttttaaattctgctattgtgacctattga

SEQ ID NO: 1436 - protein, 232 aa, Arabidopsis thaliana
MTPKSRGFVRRRRSRRVLVLDCRSQQWRSLPKMRQPRASPAAYVKDGLIIVIGGCRSKNIETWGEIYDLKTNTWGRILLQSHDPTVQNAYLNRFKPNLQTNACYVEIDKVSCLIFLSDGKLFWRETKQGFERCSVILGDDEQVSSYQLVSVANAAGGGRVTVWWKSGLKVLDLLSGTETWECYTNIRCAEISFERRGLRELWGFVEWSREVFTVDGYDDTYDFFLNSAIVTY

SEQ ID NO: 1437 - DNA, 1068 bp, Arabidopsis thaliana
atgccgatgacggttgtttccggtcgattctcaacggcgttgctccctacttgcttttccttgtcgcggttgcattccgtcaagtacgccgctcaaagacgggttgttttcgtttccagatcagctcacgcctcttcagcctccgtctccgttgagacaaattcgaattcgaatgtggattttgttatcgagaagaaggataagaacagaggagagaagaagattctagcttgtcccatctgttataactccttagcatggattagtcaacctaatggattaatagaatctgctgcctctggtattcaagtacaatgcaatacatgtaaaaggagttactcgggtaatgagacgcatcttgatttggctgttgctagtggaagcaagagatacagtgaaccgatgcctctttccactgagttatttaggactccactggtctcgtttctctatgagaggggttggcgtcagaatttcatatggggaggttttccaggaccagagaaagagtttgaaatggctaaggcctatctgaagcctgttttgggaggcaatatcattgatgctagttgtggaagtgggatgttctcgaggttattcactagaagtgatctattttctctggttattgctctagattactcagagaatatgctgcgacaatgctatgaactcttaaataaagaagaaaactttcccaacaaagagaaacttgttctagtccgagctgacattgctagactccctttcctttcgggttcagttgacgctgtccatgctggtgctgctctgcattgctggccttcaccatcctcagccgttgctgagataagccgtgttcttagacctggaggagtatttgtggccaccacatttatctatgacggtccattcagttttatccccttcttgaagaatcttcgtcaggaaataatgagatattcaggttctcacattttcctaaatgaacgtgagcttgaagatatctgcaaagcctgtggtctcgttaacttcactcgtgttagaaacgggccatttataatgctatctgcaacaaaacccagctaa

SEQ ID NO: 1438 - protein, 355 aa, Arabidopsis thaliana
MPMTVVSGRFSTALLPTCFSLSRLHSVKYAAQRRVVFVSRSAHASSASVSVETNSNSNVDFVIEKKDKNRGEKKILACPICYNSLAWISQPNGLIESAASGIQVQCNTCKRSYSGNETHLDLAVASGSKRYSEPMPLSTELFRTPLVSFLYERGWRQNFIWGGFPGPEKEFEMAKAYLKPVLGGNIIDASCGSGMFSRLFTRSDLFSLVIALDYSENMLRQCYELLNKEENFPNKEKLVLVRADIARLPFLSGSVDAVHAGAALHCWPSPSSAVAEISRVLRPGGVFVATTFIYDGPFSFIPFLKNLRQEIMRYSGSHIFLNERELEDICKACGLVNFTRVRNGPFIMLSATKPS

SEQ ID NO: 1439 - DNA, 963 bp, Arabidopsis thaliana
atggaggtagagattgtgtggttggttaaagccgcttggatcaccgtttggatcgtctctatacttcctttggtgattgcttcaatacctagttcaaagcttaactcttttcgtgaactcgttttgagtttcgctggtagaggcaagattcttcacccatcctctcagaagtttacagttcctcagaagttctttggtcacttctatgttgtcggagtggtgtggacaactctcctgcttgctgcaacttggatgtatgcttgcaaaatggccggaggttcccacgttttctctttccatatgactcatgttgagcatcggtttaaagtggggcgagcggtgtttctacttcttctgatggagatccatgtcttgagacgtgttatagagtcattctatgtattcaaatatagcacttccgctcggatgcacattctcgcttatgttggcgcattgttttactatgtagcagcgcctttgtcactctgctccaatattgctccagaggtagcaagattcgtaggaagtcaagtggctgagttcattgctagtgggaaaagccatagtcatgattttaatttgttattatctataagtcctttgatgaagcttggatcactccagtggattggtggagccatttttctttggggatggatacatcaacgtcgctgtcacgccattcttggatcactccgggaatatcctagtcaagcaaaagagtacataattccatatggagattggtttgagatggtctcatgtccgcatttcctagcagaaatcgttttatatctaggtttacttatatcgagtggaggaacagatataagcatctggttactctttggtttcgtggctgctaatctgacatacgcagctggagaaacgcaccgttggtatctccaaaagtttgagaattatccggctagtcggcatgctattttccctcatgtctactaa

SEQ ID NO: 1440 - protein, 320 aa, Arabidopsis thaliana
MEVEIVWLVKAAWITVWIVSILPLVIASIPSSKLNSFRELVLSFAGRGKILHPSSQKFTVPQKFFGHFYVVGVVWTTLLLAATWMYACKMAGGSHVFSFHMTHVEHRFKVGRAVFLLLLMEIHVLRRVIESFYVFKYSTSARMHILAYVGALFYYVAAPLSLCSNIAPEVARFVGSQVAEFIASGKSHSHDFNLLLSISPLMKLGSLQWIGGAIFLWGWIHQRRCHAILGSLREYPSQAKEYIIPYGDWFEMVSCPHFLAEIVLYLGLLISSGGTDISIWLLFGFVAANLTYAAGETHRWYLQKFENYPASRHAIFPHVY

SEQ ID NO: 1441 - DNA, 1608 bp, Arabidopsis thaliana
atggagtcgataacgttagatatagagctgttgcagttaccagagacatcgccaatgtcgatgaaatctaatcaagattttgttaagaagctctttgatcaatggcttgctcttcctgaaaccaatcgtttggttacatctttggtaaatgatgcaaaggcaggagtggctttgaatgttatgtgtggaggaggctcttctggcacgaattcagggtcgaatagtccattagcttcaatgtttccggcacgcaatgggcctcctctttctccaaggaattcaactggttctcctcggatcgccagacaaagaactggactatcaaatcttagttctcctctcaaagtagtttctgatcatgttaaagaactcattcctcagttttactttgaagatggtcggccaccaccaaatgatctaaaagagcagtgcatagctaagatcaatagtcttttctatggccacgaggatggtttgcaactccaagaatttaaattagtcactactgaaatatgcaaagttccatcatttttttccacctccattttcaagaaagttgataccaataacactggttttgtgaaaagagaagacttcattgattattgggttaagggaaatatgttaacaaaggagataacaagtcaagtatttacaatattgaagcagccagatcacaactaccttgtccaggatgatttcaagccagtgcttcaagaattattggcaacacaccctggtcttgaattcttgcaaggcacaccggaatttcaggatagatatgctgaaactgtaatatacagaatatattactacataaataggagtggaaatgggcatcttaccttgagagagcttaagcgaggaaatttagttgacgcaatgcagcatgccgatgaagaagaggacatcaataaggtgttgaggtacttctcgtatgaacatttctatgtcatatactgcaagttctgggagttggatacagatcatgatttcttaatcgacaaagagaatctcatccgatatagtaaccatgcgctcacctataggattgtcgatcgaatcttttcacaggtaccgaggaagtttactagtaaaaccgaaggaaagatgggttatgaggattttgtttacttcatattggctgaagaagacaagtcatcagaacctagtcttgagtattggttcaagtgcattgatttggatgcaaatggagttttgacgcggaacgagctgcaattcttttacgaggagcagctacatagaatggaatgcatggcgcaagaggcggtgttgtttgaggatattttgtgccaattattcgacatggtcaaaccagaggacgaagggttcatttgtctaaatgatttgaagggttctaaactttctggaaatgtcttcaacatactttttaacctcaacaagtttatggcgtttgaaacgcgtgatcccttcctcatccgccaggagcgcgcaaatccgacatggacagagtgggatcgttttgctcatagagaatatattaggctatcaatggaagaagatgtcgaagatgcttctaatggaagtgctgaagcatgggacgactcacttgaggtccccttttga

SEQ ID NO: 1442 - protein, 535 aa, Arabidopsis thaliana
MESITLDIELLQLPETSPMSMKSNQDFVKKLFDQWLALPETNRLVTSLVNDAKAGVALNVMCGGGSSGTNSGSNSPLASMFPARNGPPLSPRNSTGSPRIARQRTGLSNLSSPLKVVSDHVKELIPQFYFEDGRPPPNDLKEQCIAKINSLFYGHEDGLQLQEFKLVTTEICKVPSFFSTSIFKKVDTNNTGFVKREDFIDYWVKGNMLTKEITSQVFTILKQPDHNYLVQDDFKPVLQELLATHPGLEFLQGTPEFQDRYAETVIYRIYYYINRSGNGHLTLRELKRGNLVDAMQHADEEEDINKVLRYFSYEHFYVIYCKFWELDTDHDFLIDKENLIRYSNHALTYRIVDRIFSQVPRKFTSKTEGKMGYEDFVYFILAEEDKSSEPSLEYWFKCIDLDANGVLTRNELQFFYEEQLHRMECMAQEAVLFEDILCQLFDMVKPEDEGFICLNDLKGSKLSGNVFNILFNLNKFMAFETRDPFLIRQERANPTWTEWDRFAHREYIRLSMEEDVEDASNGSAEAWDDSLEVPF

SEQ ID NO: 1443 - DNA, 2265 bp, Arabidopsis thaliana
atggcggaggatttcgctagagcggtagacgatgggcttaaactcgcgaaacggatttatttcggcaaagaccgagccgttgcggcgccgagaccacctgctccgatggacagatcttccactacgcagccttaccttcctacagcacctatggtttacgccgttatacccgacccgggaattgtggataacccggatttgcctagctatcagcctcacgtgcacggcaggtgcgacccaccggctttgattcctctgcagatgaattcgattgagctggatgttgattgttatctcgacacggctcttgttactgtcaccggatcgtggcgggttcattgtgttatgggaagcaagagatgtgattgccgaattgctattcccatgggagaacagggatcaatactaggtgttgaggttgagattcctagaaaatcgtacacaacgcagttgatcacagcagaagatggaaacgaatttgagaaaacggcactacctgaaactggtggctttttgaaacctaacattttcactcttactataccacaggttgatggaggtaccaatctctctatcaagatgacttggtctcagaagttgacgtataaccaagggcagttttttcttgatattcctttcaactttcctgagtatgtgactcctgcggtaaagaaaatctcaaaaagagaaaagatttacttgagtgttaatgctggtactggaacagaagttctctgcaaaggatgcagtcatcaactaaaggagaaattgcggagtgcagggaagttgaggtttgcatatgaagcagatgttttgaagtggtcgaacactgactttagcttttcttatacggcctcctcaagtaatatagttggtggacttttccttcaatctgcgcctgttcacgatgttgatcagagggacatattttctttctatctttttccaggaaagcagcaaaaaactaaggcattcaagcgggaggtagtatttgttgttgacataagtaaaagtatgactggaaaacctctcgaggatgtaaaaaatgcgatatctacagctctatctaagcttgatcctggagattctttcaatattatcactttcagcaatgatactgctctattttcgacatcaatggagtcagtcacttctgatgctgttgaaagaggcattgagtggatgaacaagaactttgtcgtcgcagatggtacaaacatgctccctcccctagagaaggctgtggaaatgctttcaaatactcgtggctctattcctatgatcttcttcgtaacagatgggtctgttgaagatgagagacacatttgtgatgtaatgaagaaacatctagctagtgctggatcagtgtttcctcggatacacacttttgggttaggtgtattctgtaatcactacttcctgcaaatgcttgcaaatatatcctgtggccagcacgaatcagtttataatacagatcacattgaggaaagaatggacaaactgtttacaaaggctttatccaccattcttgttaatatagcaattgagccccttcagagtctagatgaagttgaggtatacccttcaaatattccggatctgacgtctgcaagtccattgatgatatatggaagataccgaggaaagttccccgagaatgtgatagccaaaggtctgctaggagatttgagcagcttttcgacagacttgactgtacagagtgcaaaagacatgcctcttgataaagtatttgcaaagaatgttattgacttgcttactgctgaggcatggttttctgaagataaacagctaaaagagaagattgctaaactaagcatccaaaccggcgtactatccgagtatactcgaatgatccaattagagaacacagaagaattgaaacccagcgaaactggcggaaagaaaaagacaacaagcaacggcgagaaacagaagatgatatcaagaacgatcccgctacaaagccttgggataggatttggggataaaacagccaccagagagaatgttccgccaggatttggcgagcagaaagctcctgatgctgctgagaagttcgtcaaggctgcttcgagctgttgtgtctccttgtgcaacaaatgttgctgcatgtgttgtgtccaatgctgctctaagctcaatgatcaatgtgtccttgtcttcacacagctcttcacagcgattgcttgcatcgcctgctttgaatgttgctcaactgtttgctgttctggagacgatgggtag

SEQ ID NO: 1444 - protein, 754 aa, Arabidopsis thaliana
MAEDFARAVDDGLKLAKRIYFGKDRAVAAPRPPAPMDRSSTTQPYLPTAPMVYAVIPDPGIVDNPDLPSYQPHVHGRCDPPALIPLQMNSIELDVDCYLDTALVTVTGSWRVHCVMGSKRCDCRIAIPMGEQGSILGVEVEIPRKSYTTQLITAEDGNEFEKTALPETGGFLKPNIFTLTIPQVDGGTNLSIKMTWSQKLTYNQGQFFLDIPFNFPEYVTPAVKKISKREKIYLSVNAGTGTEVLCKGCSHQLKEKLRSAGKLRFAYEADVLKWSNTDFSFSYTASSSNIVGGLFLQSAPVHDVDQRDIFSFYLFPGKQQKTKAFKREVVFVVDISKSMTGKPLEDVKNAISTALSKLDPGDSFNIITFSNDTALFSTSMESVTSDAVERGIEWMNKNFVVADGTNMLPPLEKAVEMLSNTRGSIPMIFFVTDGSVEDERHICDVMKKHLASAGSVFPRIHTFGLGVFCNHYFLQMLANISCGQHESVYNTDHIEERMDKLFTKALSTILVNIAIEPLQSLDEVEVYPSNIPDLTSASPLMIYGRYRGKFPENVIAKGLLGDLSSFSTDLTVQSAKDMPLDKVFAKNVIDLLTAEAWFSEDKQLKEKIAKLSIQTGVLSEYTRMIQLENTEELKPSETGGKKKTTSNGEKQKMISRTIPLQSLGIGFGDKTATRENVPPGFGEQKAPDAAEKFVKAASSCCVSLCNKCCCMCCVQCCSKLNDQCVLVFTQLFTAIACIACFECCSTVCCSGDDG

SEQ ID NO: 1445 - DNA, 1578 bp, Arabidopsis thaliana
atggaggagaaatccaagtcaagaggttggtgcggttggttcatcgccattattgtgctagcttctgttatcctcgccgtcgtttacactgttaaattgagaacgaagaaatccggtgacgatgacggtggcggtcccgttcctggacctcccggcgccattgataagaaatacgccgacgctcttaagctcgctttgcagttcttcgatatccagaaatctggtaaattggagaacaataagataccttggagaggagattcaggtcttaaagatggaagtgaagataatctggatctttccaaaggcttatatgatgctggagatcatataaagtttggttttccaatggctttcactgctacagttttgtcatggtcgattcttgagtatggtgatcaaatgaatgcagtgaaccaattggatcctgctaaagactctctccggtggatcactgactatcttatcaaagctcatccttctgacaatgtcctctatatccaggtgggagatccaaaagtagatcatccatgctgggagagaccagaggatatgaaagagaagagaccacttactaaaattgatgtagatactccagggacagaggttgctgctgaaactgctgcagctatggcttcagcgtctttggtgtttaaggatagtgatcctacatattcagcaacgcttctgaaacatgcgaagcagttgtttaattttgcagatacaaagagaggctcttacagtgttaacatacctgaggttcagaagttttacaattcgactggatatggtgatgagctactatgggcagctagttggttgtatcatgcaacagaggataaaacttaccttgattatgtgtctaatcatggaaaagaatttgctagttttggaaatcctacttggtttagttgggacaacaagcttgcaggaacacaggtactattatcaagattactcttctttaagaaagatttatcaggaagcaagggacttggaaattacaggaacacagctaaagctgtcatgtgtggacttctaccaaagtctccaacatctacagctagtagaacaaacggtggtcttatatgggttagtgaatggaactcgatgcaacaatccgtttcgtcagcgtttttagcctcgcttttcagtgattacatgctcacttcccgtatccataaaatatcttgcgacgggaaaatcttcaaagcaacagagcttagagatttcgccaaatcgcaggctgattacatgctggggaagaatccgttgggaacgagcttcgtggtgggttatggagacaaatacccacaatttgtgcatcatagaggagcttcgatcccggcagatgcaacaacgggttgcttagatggattcaaatggtttaactcgacgaaaccaaacccaaacatagcatatggtgcactcgtaggtggacctttcttcaatgagacgttcactgactcacgagagaacccaatgcagaacgagccaaccacttacaacaatgcactcctcgttggtctcttgtctagtcttgtcactacatcttctactttacagtcgttgaagtga

SEQ ID NO: 1446 - protein, 525 aa, Arabidopsis thaliana
MEEKSKSRGWCGWFIAIIVLASVILAVVYTVKLRTKKSGDDDGGGPVPGPPGAIDKKYADALKLALQFFDIQKSGKLENNKIPWRGDSGLKDGSEDNLDLSKGLYDAGDHIKFGFPMAFTATVLSWSILEYGDQMNAVNQLDPAKDSLRWITDYLIKAHPSDNVLYIQVGDPKVDHPCWERPEDMKEKRPLTKIDVDTPGTEVAAETAAAMASASLVFKDSDPTYSATLLKHAKQLFNFADTKRGSYSVNIPEVQKFYNSTGYGDELLWAASWLYHATEDKTYLDYVSNHGKEFASFGNPTWFSWDNKLAGTQVLLSRLLFFKKDLSGSKGLGNYRNTAKAVMCGLLPKSPTSTASRTNGGLIWVSEWNSMQQSVSSAFLASLFSDYMLTSRIHKISCDGKIFKATELRDFAKSQADYMLGKNPLGTSFVVGYGDKYPQFVHHRGASIPADATTGCLDGFKWFNSTKPNPNIAYGALVGGPFFNETFTDSRENPMQNEPTTYNNALLVGLLSSLVTTSSTLQSLK

SEQ ID NO: 1447 - DNA, 2100 bp, Arabidopsis thaliana
atggtggcttttgggaaatacttgcagcggaaacaaatcgaagaatggagtggctattatatcaattacaaattgatgaagaagaaagtgaagcaatatgctgaacaaatccaaggcggatctcaacatcctcgccatgttctcaaagatttctcgaggatgctcgatactcagattgagacaactgtccttttcatgttggaacaacaagggttgctttcagggcgattagccaaattgagggaatctcatgatgctatacttgagcagcctgacatatcaagaattttcgagctacgtgaagcatacagagatgttggacgagaccttcttcagctcctgaaattcgttgagttgaacgccattggtctgcgcaagatacttaagaaattcgacaaaaggtttggatatagattcgctgattattacgtgaagacccgcgctaatcacccttactctcagcttcaacaagtttttaagcatgtgggtgttggagctgttgttggagcaatttcccgcaatcttcatgagcttcaagaaaatgaaggaagcttttattcaatttatgaccaacccgttcttccggctcaggatccagtggttgaggcaataaataacgcggtggacaagttaaccttctcgacgaatttcctcaacttcttggcacaacatgctcttatcatgcaagatgatttggtgactccttcagaggatacaatcgatgagcggtcttaccattttaattcgttactcctgaatctaggaaacacatttttgtacatggtcaacacttatatcatcgtccctacagcggatgactattcgatgagccttggagctgcagcaacggtttgtggtgttgtcatcggatctatggctgtggctcaagtattttcatcggtttatttcagcgcatggtccaacaaatcttacttcaaacctcttgtgtttagcagcatcgcactctttatcggaaatttgatgtatgcgttggcatatgatgccaattccatagcgcttcttttactcggccgtgtctgttgtgggttgggatcagcaagagctgttaaccggagatatatcagcgattgtgtgcctttgagaatccgaatgcaggcatcggcgggttttgtgagtgcaagtgctcttggaatggcttgtggccctgcgcttgccggtttactccaaatcaaattcaagttttacaagtttacatttaaccaatctactttgccgggatgggttatggctgtggcttggctgttctatttggtatggctatgcatttcattcagagagccgttgcgtgacacagaggatggagaaaaaaacaatcgaaatgaaacaacatcagcgacagatagagtagaaagtagcagagtcgaggaaggtcttcgattgccgttgctgatcacttcaggaatcaagccagaagatgaagaggaatgcgatgaaagtgaagaatccccagaagattctcacaaacctgcaaattctttcatagaagcataccgactccttactccatctgttaaggttcaactgttgatctacttcatgctcaaatattcgatggaaatattactgtcagaatcaagtgtcattacttcatactactttagttggacaacaagctctgttgccatcttcctggcctgccttggcctcacggtgctaccaatcaacattttggtcggaagttacatcagtaatatgtttgaagacaggcaaatccttctaacatctgagatcatcgtcttccttgggattctcttcagtttcaatttgtttgttccatacactgtacctcaatacgtaatctctggtctcataatgtttgttgctgctgaagtactcgaaggtgtgaatctatcgttgttatcgcgggtaatgtcatcaaggctatcgaaaggaacgtacaacggaggattgctctcaacagaagctggaacgttggctcgtgttgtggcagatgcaaccataacattgggaggatatttgggaagaggccatctcctgaatgccactcttctaccatcacttgtcatctgcattggctccatcgttgctacttgttgtacttataactcactctattga

SEQ ID NO: 1448 - protein, 699 aa, Arabidopsis thaliana
MVAFGKYLQRKQIEEWSGYYINYKLMKKKVKQYAEQIQGGSQHPRHVLKDFSRMLDTQIETTVLFMLEQQGLLSGRLAKLRESHDAILEQPDISRIFELREAYRDVGRDLLQLLKFVELNAIGLRKILKKFDKRFGYRFADYYVKTRANHPYSQLQQVFKHVGVGAVVGAISRNLHELQENEGSFYSIYDQPVLPAQDPVVEAINNAVDKLTFSTNFLNFLAQHALIMQDDLVTPSEDTIDERSYHFNSLLLNLGNTFLYMVNTYIIVPTADDYSMSLGAAATVCGVVIGSMAVAQVFSSVYFSAWSNKSYFKPLVFSSIALFIGNLMYALAYDANSIALLLLGRVCCGLGSARAVNRRYISDCVPLRIRMQASAGFVSASALGMACGPALAGLLQIKFKFYKFTFNQSTLPGWVMAVAWLFYLVWLCISFREPLRDTEDGEKNNRNETTSATDRVESSRVEEGLRLPLLITSGIKPEDEEECDESEESPEDSHKPANSFIEAYRLLTPSVKVQLLIYFMLKYSMEILLSESSVITSYYFSWTTSSVAIFLACLGLTVLPINILVGSYISNMFEDRQILLTSEIIVFLGILFSFNLFVPYTVPQYVISGLIMFVAAEVLEGVNLSLLSRVMSSRLSKGTYNGGLLSTEAGTLARVVADATITLGGYLGRGHLLNATLLPSLVICIGSIVATCCTYNSLY

SEQ ID NO: 1449 - DNA, 432 bp, Arabidopsis thaliana
atgaggaagaaacgagaggctaaagatgaaaatgaagaagaagaagaggagaagaagaagagactagagttgatgaaggcagctgcgcaggcttggctcagccactcccaaacctcaaaacatactgttttagagttcgatgcgcagagaaagcatgcttttgtcaaagggaaggcatcacgtttcaaaacggaagccttgtccgcaaagcatcatccgtcgtttttggattgggaattcggacagtcgctgtgggatccctacgagattctttcggtctctaagaaactggaacgcgaactcactttagaagaacaaaccttctcttcttcagataatgatggcctcaagaagatgaagaagaagaaaactagagacagcagaaacagccttaggagtttgttcactcgttcgtcttcaaagagattctaa

SEQ ID NO: 1450 - protein, 143 aa, Arabidopsis thaliana
MRKKREAKDENEEEEEEKKKRLELMKAAAQAWLSHSQTSKHTVLEFDAQRKHAFVKGKASRFKTEALSAKHHPSFLDWEFGQSLWDPYEILSVSKKLERELTLEEQTFSSSDNDGLKKMKKKKTRDSRNSLRSLFTRSSSKRF

SEQ ID NO: 1451 - DNA, 771 bp, Arabidopsis thaliana
atgggttcgtcttcttctttctcctcttcttcctcgaagcttctctttcgtcaactctttgagaacgaatcttccacctttacttatcttctcgccgacgtttctcatcctgataaacctgctttgttgattgatccggtggacaagactgtggatagagacttgaaactgattgatgagttaggactaaagcttatctatgctatgaacactcatgttcatgctgatcatgtcactggtactggacttcttaagacgaagctcccgggtgtgaaatccgttatttcgaaagcaagtggttccaaagctgatttgtttcttgaacctggtgacaaagtatctattggtgatatataccttgaggttcgtgctacacctggacacactgcaggatgtgttacatatgtgactggtgaaggagctgatcagccccaaccaagaatggcttttaccggggatgctgtactcatccgtggttgtgggaggactgactttcaggaaggaagctcagatcaactctacgagtctgtacattcacagatatttacattgccaaaggacacattgatctatcctgctcacgactacaaaggtttcgaggtaagtacagttggagaagagatgcaacacaacccgcgtctaactaaagataaagaaacattcaaaaccattatgtcaaatctgaatctgtcgtatccgaagatgattgatgttgcagtaccagcaaatatggtctgtgggttacaagatgtgccttctcaagccaactaa

SEQ ID NO: 1452 - protein, 256 aa, Arabidopsis thaliana
MGSSSSFSSSSSKLLFRQLFENESSTFTYLLADVSHPDKPALLIDPVDKTVDRDLKLIDELGLKLIYAMNTHVHADHVTGTGLLKTKLPGVKSVISKASGSKADLFLEPGDKVSIGDIYLEVRATPGHTAGCVTYVTGEGADQPQPRMAFTGDAVLIRGCGRTDFQEGSSDQLYESVHSQIFTLPKDTLIYPAHDYKGFEVSTVGEEMQHNPRLTKDKETFKTIMSNLNLSYPKMIDVAVPANMVCGLQDVPSQAN

SEQ ID NO: 1453 - DNA, 1311 bp, Arabidopsis thaliana
atggatgatctctccaagcttctcttcttcctcctcctcactatctccattaccaccgcattacccgataaacccgggtcgggtcaaataaactcaaactccgtcctcgttgctcttcttgactcacactacacagaactagcagagctcgtcgaaaaagctcttcttctccaaaccttagaagaagctgttggtcaacacaacatcacaatctttgctcctcgtaacgatgccttagaaaaaaatcttgatcctgaattcaaatctttcttactccaaccgaaaaacctcaaatcattacaatctttattaatgtttcacattcttcccaaaagaatcacttctccacaattctcctccgccgtcgttagccaccgtactctctccaacgaccacctccatttcaccaacggaaaagtcaactccgctgaaataaccaaacccgatgatttaactcgtcccgatggaatcatccacggaatcgaacgtcttttaatcccacgttctgttcaagaagatttcaaccgccgtcgtagtctccgttcaatcgctgccgtattaccggaaggagcaccggaggttgatccaagaactcaccgtctcaagaaaaagccagcaccaattcccgccggagctccaccggttcttccggtttacgacgcaatgtcacctggtccgtcactagctccggctccggcaccaggaccgggtgggccacgccaccatttcaacggagaggctcaagttaaagattttatccacacgcttcttcattacggtggctacaatgaaatggcagatattctcgttaatctcacttctttagccaccgagatgggtcggctcgtgtcggaaggttacgttttaaccgttttagcaccaaacgacgaagctatggctaaattgaccacggaccaattgagcgaaccgggagctccagagcaaattatgtattatcacatcataccggaataccaaaccgaagagagtatgtacaattctgtacgccggtttgggaaaatccggtacgattcactccggtttcctcataaagtagaggctcaggaggcagatggttcggttaagttcggtcatggtgatggttcggcttatttgttcgatcctgatatttataccgatggacggatttcggttcaagggattgacggtgttttgttcccggaggaaaaaactccggtcgagaagaaaaccggcgttccagttgtcaagaaagcacctaaaccaagaagaggtaaattgatggaagtagcatgtacaatgctgggatcacaatttccaacatgtcaatga

SEQ ID NO: 1454 - protein, 436 aa, Arabidopsis thaliana
MDDLSKLLFFLLLTISITTALPDKPGSGQINSNSVLVALLDSHYTELAELVEKALLLQTLEEAVGQHNITIFAPRNDALEKNLDPEFKSFLLQPKNLKSLQSLLMFHILPKRITSPQFSSAVVSHRTLSNDHLHFTNGKVNSAEITKPDDLTRPDGIIHGIERLLIPRSVQEDFNRRRSLRSIAAVLPEGAPEVDPRTHRLKKKPAPIPAGAPPVLPVYDAMSPGPSLAPAPAPGPGGPRHHFNGEAQVKDFIHTLLHYGGYNEMADILVNLTSLATEMGRLVSEGYVLTVLAPNDEAMAKLTTDQLSEPGAPEQIMYYHIIPEYQTEESMYNSVRRFGKIRYDSLRFPHKVEAQEADGSVKFGHGDGSAYLFDPDIYTDGRISVQGIDGVLFPEEKTPVEKKTGVPVVKKAPKPRRGKLMEVACTMLGSQFPTCQ

SEQ ID NO: 1455 - DNA, 1944 bp, Arabidopsis thaliana
atggggaaaggttggttcatggtagagaaagctagaagatgcttaaggacggtgttcttcatggttgcgatgcttgtctcgctgttagtttcttcgttgcctgtgcttgtagccatcggcgacgttttggttccgacctttttgctttcaagctttacctgtttgacgtgttacggcttcaaggagcatctgagtcgatacgctttcaagagctctttgactgatattcctctcgtctccctcgtcagatctttccttgtcatctgtgtctactctctatccgatgctcctgcactttcgcatggcccttaccttggaactgtatcgctgtgttctgttgtttctgttgttcttctatcagtaaaagcttgcgtttttactgcaaattctcaacttaacgaccaagcctcgtcctctccgtcaaggcaaagactccatctgaaaaagtcttgggggatgccagttttgttcctttcatctgttgtttttgctcttggtcatatggttgttgcttatagaacaagttgcagagctaggaggaaactcttgtatcacagagttgaccctgaagctgttctttcttgcaaaagtgtcttctctggttaccagaaagtcccacgttctccaattcctttggtaggaaaggcctccaaggttgatggcgaggcaagacgaaagctgcatccttcagtatccaacgatgacggagagctacctgcgagattgcttgctgatcttgacagcttattcattacagtcagagggctcactgtgcattacaagatttgcacacctgcttctcctcgccactctatctcctcctcagttgaagccaactctatgcttaatatgccagaggcgatggtgggaaggttgaagcttgacaggaatatattgagcatggtcacgagaaacaagctcaaccatcaccaccataggagctacagcagtctgtttaacaattcttcttccttgcacgaccctctccttgatggtcttcctacttctcctcgtcttttcaaagatattcaggaagaatcgtgccgagaggatggcatcaatgtgtccaattttggtgccacggaacagcaagatgttggtggaaacggccaatttggtgtagtgttggtccatggatttggcggaggagtgttttcttggagacatgtgatgagttctcttgcccatcaacttggctgtgttgtcactgcatttgataggcctggttggggattaaccgccagacctcataaaaaggatttggaagaaagagagatgccaaacccttacactctggataatcaggtagacatgcttcttgccttttgccacgaaatgggatttgcttctgtagtcttggttggccatgatgatggaggtttgcttgctctcaaggctgcacaaagattgctagaaacaaaagatcccatcaaagtcaaaggagtggttttgcttaatgtaagcttgacgagggaagtagtgccagcttttgcaagaatacttctgcacacatcactaggaaagaaacaccttgttcgtccgcttttacgcactgaaatagctcaggtggtgaatcgcagagcttggtatgatcctgccaagatgacaaccgatgtcttaaggctatacaaggcaccacttcatgtggaaggctgggatgaggcacttcacgagataggcagactctcatccgagatggtgcttccaactcaaaatgcattgtcacttctcaaggcagtggaaaacttaccagtattagtcgttgctggagccgaagacgcacttgttcccctcaagtcctcccaagtcatggcttcaaaactcgaaaactctaggctagtagcaatctcaggatgcggacatctgccacatgaggagtgtcccaaggcacttcttgcagccatgtgcccattcataagcagacttgtatttagtgaggactga

SEQ ID NO: 1456 - protein, 647 aa, Arabidopsis thaliana
MGKGWFMVEKARRCLRTVFFMVAMLVSLLVSSLPVLVAIGDVLVPTFLLSSFTCLTCYGFKEHLSRYAFKSSLTDIPLVSLVRSFLVICVYSLSDAPALSHGPYLGTVSLCSVVSVVLLSVKACVFTANSQLNDQASSSPSRQRLHLKKSWGMPVLFLSSVVFALGHMVVAYRTSCRARRKLLYHRVDPEAVLSCKSVFSGYQKVPRSPIPLVGKASKVDGEARRKLHPSVSNDDGELPARLLADLDSLFITVRGLTVHYKICTPASPRHSISSSVEANSMLNMPEAMVGRLKLDRNILSMVTRNKLNHHHHRSYSSLFNNSSSLHDPLLDGLPTSPRLFKDIQEESCREDGINVSNFGATEQQDVGGNGQFGVVLVHGFGGGVFSWRHVMSSLAHQLGCVVTAFDRPGWGLTARPHKKDLEEREMPNPYTLDNQVDMLLAFCHEMGFASVVLVGHDDGGLLALKAAQRLLETKDPIKVKGVVLLNVSLTREVVPAFARILLHTSLGKKHLVRPLLRTEIAQVVNRRAWYDPAKMTTDVLRLYKAPLHVEGWDEALHEIGRLSSEMVLPTQNALSLLKAVENLPVLVVAGAEDALVPLKSSQVMASKLENSRLVAISGCGHLPHEECPKALLAAMCPFISRLVFSED

SEQ ID NO: 1457 - DNA, 1305 bp, Arabidopsis thaliana
atggaggaagtatctccggcgatcgcaggtcctttcaggccattctccgaaacccagatggatttcaccgggatcagattgggtaaaggttactgcaataaccaatactcaaatcaagattccgagaacggagatctaatggtttcgttaccggagacttcatcatgctctgtttctgggtcacatggttctgaatctaggaaagttttgatttctcggatcaattctcctaatttaaacatgaaggaatcagcagctgctgatatagtcgtcgttgatatctccgccggagatgagatcaacggctcagatattactagcgagaagaagatgatcagcagaacagagagtaggagtttgtttgaattcaagagtgtgcctttgtatggttttacttcgatttgtggaagaagacctgagatggaagatgctgtttcgactataccaagattccttcaatcttcctctggttcgatgttagatggtcggtttgatcctcaatccgccgctcatttcttcggtgtttacgacggccatggcggttctcaggtagcgaactattgtagagagaggatgcatttggctttggcggaggagatagctaaggagaaaccgatgctctgcgatggtgatacgtggctggagaagtggaagaaagctcttttcaactcgttcctgagagttgactcggagattgagtcagttgcgccggagacggttgggtcaacgtcggtggttgccgttgttttcccgtctcacatcttcgtcgctaactgcggtgactctagagccgttctttgccgcggcaaaactgcacttccattatccgttgaccataaaccggatagagaagatgaagctgcgaggattgaagccgcaggagggaaagtgattcagtggaatggagctcgtgttttcggtgttctcgccatgtcgagatccattggcgatagatacttgaaaccatccatcattcctgatccggaagtgacggctgtgaagagagtaaaagaagatgattgtctgattttggcgagtgacggggtttgggatgtaatgacggatgaagaagcgtgtgagatggcaaggaagcggattctcttgtggcacaagaaaaacgcggtggctggggatgcatcgttgctcgcggatgagcggagaaaggaagggaaagatcctgcggcgatgtccgcggctgagtatttgtcaaagctggcgatacagagaggaagcaaagacaacataagtgtggtggtggttgatttgaagcctcggaggaaactcaagagcaaacccttgaactga

SEQ ID NO: 1458 - protein, 434 aa, Arabidopsis thaliana
MEEVSPAIAGPFRPFSETQMDFTGIRLGKGYCNNQYSNQDSENGDLMVSLPETSSCSVSGSHGSESRKVLISRINSPNLNMKESAAADIVVVDISAGDEINGSDITSEKKMISRTESRSLFEFKSVPLYGFTSICGRRPEMEDAVSTIPRFLQSSSGSMLDGRFDPQSAAHFFGVYDGHGGSQVANYCRERMHLALAEEIAKEKPMLCDGDTWLEKWKKALFNSFLRVDSEIESVAPETVGSTSVVAVVFPSHIFVANCGDSRAVLCRGKTALPLSVDHKPDREDEAARIEAAGGKVIQWNGARVFGVLAMSRSIGDRYLKPSIIPDPEVTAVKRVKEDDCLILASDGVWDVMTDEEACEMARKRILLWHKKNAVAGDASLLADERRKEGKDPAAMSAAEYLSKLAIQRGSKDNISVVVVDLKPRRKLKSKPLN

SEQ ID NO: 1459 - DNA, 999 bp, Arabidopsis thaliana
atggcagcctctctccaatccaccgctacattcctccagtcggcgaagatcgccaccgctccttctcgcggaagttctcacctccgatcgactcaagccgtcggcaaatcttttgggctcgaaacttcctcggctcgcctcacttgctccttccagtctgactttaaggacttcaccggtaaatgctccgacgctgtcaaaatcgccggattcgctcttgccacctctgctctcgtcgtctcgggagcaagtgcggagggagctccaaagagattgacctatgatgagattcagagcaagacatacatggaagtgaaaggaactggaacggctaaccagtgccctactattgacggtggctctgagactttctcgttcaaacccggaaagtatgcaggaaagaagttctgcttcgagcctacttccttcaccgtcaaggcagacagtgtaagcaagaacgctcctccagagttccagaacacaaagctcatgacccgtcttacctacacccttgacgagatcgaaggacccttcgaggttgcttcagacggaagcgtcaatttcaaggaagaagatggaatcgactatgctgcagtcacagtccaacttccaggaggtgaacgtgtgccattccttttcacagtcaaacagcttgacgcctcaggcaaaccagacagcttcaccggaaaattcttggttccatcgtaccgtggctcttccttcttggacccaaagggccgtggtggatccacaggatatgacaacgccgtggcattgccagctggaggcagaggagacgaggaggagcttgtaaaggagaacgtgaagaacactgccgcttcagtgggagagatcactctgaaagtgacaaagagcaagccggagacaggagaggtgatcggagtgttcgagagtcttcagccgtcggatactgacttgggtgctaaggtaccaaaggatgtgaagatccaaggggtgtggtatggtcaacttgagtga

SEQ ID NO: 1460 - protein, 332 aa, Arabidopsis thaliana
MAASLQSTATFLQSAKIATAPSRGSSHLRSTQAVGKSFGLETSSARLTCSFQSDFKDFTGKCSDAVKIAGFALATSALVVSGASAEGAPKRLTYDEIQSKTYMEVKGTGTANQCPTIDGGSETFSFKPGKYAGKKFCFEPTSFTVKADSVSKNAPPEFQNTKLMTRLTYTLDEIEGPFEVASDGSVNFKEEDGIDYAAVTVQLPGGERVPFLFTVKQLDASGKPDSFTGKFLVPSYRGSSFLDPKGRGGSTGYDNAVALPAGGRGDEEELVKENVKNTAASVGEITLKVTKSKPETGEVIGVFESLQPSDTDLGAKVPKDVKIQGVWYGQLE

SEQ ID NO: 1461 - DNA, 2355 bp, Arabidopsis thaliana
atgggctcttcttctccattaacaaggagaaacagagcaccaccatcctctgtttcctctgtttatctaatctttctctgtttcttcctctactttttaaatttctcaaacgctcaatcatcgccggttttcgcctgcgacgtagctgcaaacccttctctcgccgcctatggtttctgcaacaccgttttgaagatcgaataccgagtcgctgatctggtcgcgaggctcacgttgcaagaaaagatcgggtttttagtgagtaaagctaacggcgtgactcgtcttgggattccaacgtatgaatggtggtctgaagcacttcacggcgtttcttacatcggacccggcacgcatttttctagccaagttcccggagctacgagtttcccgcaggttatactcaccgccgcttctttcaacgtatctctgtttcaagccattggcaaggtcgtctcaacggaagcgagggcaatgtacaacgtgggattagccggactaacgtattggtcaccgaacgtgaacatattccgagatccaagatggggaagagggcaagagactccaggagaagatccattgctcgctagtaagtatgcttcagggtacgttaagggtcttcaagagactgacggtggcgattctaaccgtctcaaagtcgccgcctgctgcaaacactataccgcttacgatgtcgataattggaaaggcgtagaacgttacagtttcaacgccgtggtgactcaacaagatatggatgatacgtatcaaccaccgttcaagagttgtgtggttgatgggaatgtggcgagtgttatgtgttcttacaatcaagttaacggcaaaccgacatgcgctgatccagatctgctctctggtgttatccgcggtgaatggaaattaaatgggtacattgtttcagattgtgattcagtagatgtcttgtataagaaccaacactatacaaagactccagctgaagctgcagccatatctatattggcaggtttggatttaaactgtggttcattcttgggtcaacatacagaggaagcagttaagtcgggtttggtaaacgaggcagctatcgataaagcgatttcgaacaactttttgacccttatgcgtttaggattctttgatggaaacccaaagaaccaaatctatggcgggttaggtcctaccgacgtttgcacgtctgcgaatcaagagctagcagcagatgcagcaagacaaggcattgttctactcaagaatactggatgcttaccgctttctcctaaatcgatcaaaacactagccgtgattggaccaaacgcgaatgtcaccaaaacaatgattggaaactacgaaggcacgccgtgtaaatacacaacaccactacaaggactagccgggacggtatctacaacatatctaccaggctgctccaatgtagcttgtgctgtagcggatgtagccggcgccacgaaactagcagccactgcagatgtgtctgtgcttgtgatcggtgccgatcaatcaatcgaggcagagagccgagacagagtcgacctgcatcttcctggacagcaacaagagctggtgatccaagtggctaaagcagcaaaaggaccggtcttgctcgtcattatgtccggtggaggtttcgatattacattcgctaagaatgacccaaagatcgccggaattttgtgggttggttatcccggagaagccggtggtatcgccattgctgatatcatctttggccgttataatccaagtgggaaattaccgatgacgtggtatccacagtcgtatgtagagaaagttccgatgacaataatgaacatgagacccgataaagcaagcgggtatccgggtcggacttaccgattctacaccggagaaacagtatacgcattcggagatggactcagctacaccaaattcagtcacactttagtcaaagctccaagtctcgtttctctcggtctcgaagagaatcacgtttgccgatcatcggaatgtcaatcgctagacgcgatcggaccgcactgcgaaaacgctgtctccggcggtggatcggcgtttgaagttcatatcaaggtacgaaacggaggagatagagaagggattcacacggtgtttctattcacgacgccgccggcgattcacggatcgccgaggaagcatttggtaggattcgagaagattcgattggggaagagggaagaagcggtggttaggtttaaggtagagatatgtaaagatctgagtgtggttgatgagattgggaagaggaagattggtttgggaaagcatcttcttcatgtcggagatttaaaacattccttaagcattagaatctga

SEQ ID NO: 1462 - protein, 784 aa, Arabidopsis thaliana
MGSSSPLTRRNRAPPSSVSSVYLIFLCFFLYFLNFSNAQSSPVFACDVAANPSLAAYGFCNTVLKIEYRVADLVARLTLQEKIGFLVSKANGVTRLGIPTYEWWSEALHGVSYIGPGTHFSSQVPGATSFPQVILTAASFNVSLFQAIGKVVSTEARAMYNVGLAGLTYWSPNVNIFRDPRWGRGQETPGEDPLLASKYASGYVKGLQETDGGDSNRLKVAACCKHYTAYDVDNWKGVERYSFNAVVTQQDMDDTYQPPFKSCVVDGNVASVMCSYNQVNGKPTCADPDLLSGVIRGEWKLNGYIVSDCDSVDVLYKNQHYTKTPAEAAAISILAGLDLNCGSFLGQHTEEAVKSGLVNEAAIDKAISNNFLTLMRLGFFDGNPKNQIYGGLGPTDVCTSANQELAADAARQGIVLLKNTGCLPLSPKSIKTLAVIGPNANVTKTMIGNYEGTPCKYTTPLQGLAGTVSTTYLPGCSNVACAVADVAGATKLAATADVSVLVIGADQSIEAESRDRVDLHLPGQQQELVIQVAKAAKGPVLLVIMSGGGFDITFAKNDPKIAGILWVGYPGEAGGIAIADIIFGRYNPSGKLPMTWYPQSYVEKVPMTIMNMRPDKASGYPGRTYRFYTGETVYAFGDGLSYTKFSHTLVKAPSLVSLGLEENHVCRSSECQSLDAIGPHCENAVSGGGSAFEVHIKVRNGGDREGIHTVFLFTTPPAIHGSPRKHLVGFEKIRLGKREEAVVRFKVEICKDLSVVDEIGKRKIGLGKHLLHVGDLKHSLSIRI

SEQ ID NO: 1463 - DNA, 1086 bp, Arabidopsis thaliana
atgaaggcactcattcttgttggaggcttcggcactcgcttgagaccattgactctcagtttcccaaagccccttgttgattttgctaataaacccatgatccttcatcagatagaggctcttaaggcagttggagttgatgaagtggttttggccatcaattatcagccagaggtgatgctgaacttcttgaaggactttgagaccaagctggaaatcaaaatcacttgctcacaagagaccgagccactaggtaccgctggtcctctggctctagcgagagacaaattgcttgatggatctggagagcccttctttgttcttaacagtgatgtgattagtgagtaccctcttaaagaaatgcttgagtttcacaaatctcacggtggggaagcctccataatggtaacaaaggtggatgaaccgtcgaaatatggagtggttgttatggaagaaagcactggaagagtggagaagtttgtggaaaagccaaaactgtatgtaggtaacaagatcaacgctgggatttatcttctgaacccatctgttcttgataagattgagctaagaccgacttcaatcgaaaaagagactttccctaagattgcagcagcgcaagggctctatgctatggtgctaccagggttttggatggacattgggcaaccccgtgactacataacgggtttgagactctacttagactcccttaggaagaaatctcctgccaaattaaccagtgggccacacatagttgggaatgttcttgttgacgaaaccgctacaattggggaaggatgtttgattggaccagacgttgccattggtccaggctgcattgttgagtcaggagtcagactctcccgatgcacggtcatgcgtggagtccgcatcaagaagcatgcgtgtatctcgagcagtatcatcgggtggcactcaacggttggtcaatgggccaggatcgagaacatgacgatcctcggtgaggatgttcatgtgagcgatgagatctatagcaatggaggagttgttttgccacacaaggagatcaaatcaaacatcttgaagccagagatagtgatgtga

SEQ ID NO: 1464 - protein, 361 aa, Arabidopsis thaliana
MKALILVGGFGTRLRPLTLSFPKPLVDFANKPMILHQIEALKAVGVDEVVLAINYQPEVMLNFLKDFETKLEIKITCSQETEPLGTAGPLALARDKLLDGSGEPFFVLNSDVISEYPLKEMLEFHKSHGGEASIMVTKVDEPSKYGVVVMEESTGRVEKFVEKPKLYVGNKINAGIYLLNPSVLDKIELRPTSIEKETFPKIAAAQGLYAMVLPGFWMDIGQPRDYITGLRLYLDSLRKKSPAKLTSGPHIVGNVLVDETATIGEGCLIGPDVAIGPGCIVESGVRLSRCTVMRGVRIKKHACISSSIIGWHSTVGQWARIENMTILGEDVHVSDEIYSNGGVVLPHKEIKSNILKPEIVM

SEQ ID NO: 1465 - DNA, 993 bp, Arabidopsis thaliana
atggatattcgtagtgatgatgcaaaaaaacctatgatgatgtggttcttagggatgctgttgttttccatggtggccgagtcaaatgctcaactgtcagagaattactacgcctcgacatgtcctagcgtagagctcatcgttaagcaggcggttactacaaaattcaaacaaactgtcacaacggctcctgcaacgttgcggatgttctttcacgactgcttcgtcgagggatgtgatgcgtctgtgtttatagcatctgagaatgaagacgcagagaaagacgcagatgacaataaatctctcgccggagacggatttgacaccgtgattaaagctaaaaccgctgtagaatctcaatgtcccggagttgtgtcatgtgccgatatactagctctcgccgctagagacgtcgtcgtgctcgttggagggccagagtttaaggtggagctagggagacgagacgggctcgtgtcgaaagcgtctagagtgaccggcaagttacctgaaccagggcttgacgtgagaggtctagtccagatcttcgctagtaacgggctttcattgaccgacatgatcgctctttcaggcgcacatacaattggatcctctcactgcaaccgtttcgccaaccgtctccacaatttctcgacgttcatgccagtggaccctacgatggacccggtctacgctcagcagctgatacaagcctgctctgaccccaacccagatgctgtagtagacattgacctaacgtccagagataccttcgacaatagctactaccagaacctcgtggctcggaaaggacttttcacctccgatcaagctctgtttaacgatctctcgtctcaggctacggtggtcaggtttgctaacaacgctgaagaattctacagcgcttttagctctgctatgaggaatcttggccgcgttggggttaaggttgggaatcaaggcgagattcgaagggactgctctgcttttaactag

SEQ ID NO: 1466 - protein, 330 aa, Arabidopsis thaliana
MDIRSDDAKKPMMMWFLGMLLFSMVAESNAQLSENYYASTCPSVELIVKQAVTTKFKQTVTTAPATLRMFFHDCFVEGCDASVFIASENEDAEKDADDNKSLAGDGFDTVIKAKTAVESQCPGVVSCADILALAARDVVVLVGGPEFKVELGRRDGLVSKASRVTGKLPEPGLDVRGLVQIFASNGLSLTDMIALSGAHTIGSSHCNRFANRLHNFSTFMPVDPTMDPVYAQQLIQACSDPNPDAVVDIDLTSRDTFDNSYYQNLVARKGLFTSDQALFNDLSSQATVVRFANNAEEFYSAFSSAMRNLGRVGVKVGNQGEIRRDCSAFN

SEQ ID NO: 1467 - DNA, 663 bp, Arabidopsis thaliana
atggcgaacgaccaagtgattcttcttgattactggccaagcatgttcgggatgaggacgaagatggctttggctgagaaaggagtcaagtatgagtacaaggaaacagatccatgggttaagactcctttactcatagagatgaacccgattcacaagaagattccggttctcatccacaacggtaaaccgatttgtgaatctcttattcagcttgagtacattgatgaggtttggtccgatgcatccccaatccttccctctgatccttaccagaagtctcgagctagattttgggctgaattcatcgacaaaaagttttacgacccatcatggaaggtatgggcaacaatgggcgaagaacatgcagcagtgaagaaggaattgttggaacatttcaagacacttgagacagagctcggagacaaaccttattacggtggtgaagtatttggatacctagacattgcattaatgggatactacagctggttcaaggccatggagaaatttggtgaattcagtatcgaaacagagtttcctatattgactacgtggaccaagaggtgtttggaaagagagagtgtggtcaaggcattggctgattctgataggatcattgagtatgtttatgtcctgaggaagaaatttggagcagcgtaa

SEQ ID NO: 1468 - protein, 220 aa, Arabidopsis thaliana
MANDQVILLDYWPSMFGMRTKMALAEKGVKYEYKETDPWVKTPLLIEMNPIHKKIPVLIHNGKPICESLIQLEYIDEVWSDASPILPSDPYQKSRARFWAEFIDKKFYDPSWKVWATMGEEHAAVKKELLEHFKTLETELGDKPYYGGEVFGYLDIALMGYYSWFKAMEKFGEFSIETEFPILTTWTKRCLERESVVKALADSDRIIEYVYVLRKKFGAA

SEQ ID NO: 1469 - DNA, 387 bp, Arabidopsis thaliana
atggctcctctcaagaactcctttgtaacatctctggtcattgcactaacattcacaagcttcttcaccagcctatccgctcatcgtcaccttctccaatcaacaccagtgactcagcctccagctttaacattcccacctctgcccaaaaccactatgccaccggttccttctctaccaactccaggacaacaaacgttgccacagccacaaccaactctgccacagcccactgggttgccaccgatgccgagcacacagataccatcattgcccaaccaggtgcagcccacaatccctaacattccacagatcaacttccctagcaactttcccttcaactttcctttcaacattcctttccttactccaccaccttcaaagtaa

SEQ ID NO: 1470 - protein, 128 aa, Arabidopsis thaliana
MAPLKNSFVTSLVIALTFTSFFTSLSAHRHLLQSTPVTQPPALTFPPLPKTTMPPVPSLPTPGQQTLPQPQPTLPQPTGLPPMPSTQIPSLPNQVQPTIPNIPQINFPSNFPFNFPFNIPFLTPPPSK

SEQ ID NO: 1471 - DNA, 2904 bp, Arabidopsis thaliana
atgggaaattttgtgtgtatagaaatttctggtgatcaaatgctggatcgtatcattagatgcttatgtggtaaaggttatattcgaaacctcgagaagaatctcagagctctgcagagggaaatggaagatctaagagcaactcaacatgaggtacagaacaaggtagcgagagaggagtcacgccatcaacaaaggcttgaagctgtccaggtatggcttgaccgtgtcaatagcattgatatagagtgcaaagatctgctaagtgttagtcccgttgagcttcaaaagttgtgtctctgcggtttatgttcaaaatatgtatgttcaagctacaaatatgggaaaagggtgtttttgttattggaagaggttacgaaactaaaatcggagggaaattttgacgaggtttctcagccgcctccaagatctgaagttgaagagaggcctactcagcctacgattggtcaagaagaaatgctcaaaaaggcatggaaccgccttatggaagatggagtcggaatcatgggtctgcacggtatgggtggtgtaggcaaaacaacccttttcaagaaaatccacaataagttcgctgaaacaggtggtacgtttgacattgtgatctggatcgtggtgtctcaaggcgcaaagctttcaaagcttcaagaagatattgcagagaaattacacctttgtgacgacctgtggaagaacaagaatgaaagtgataaggccaccgatatacacagagttttaaagggaaagagatttgttttgatgctagatgatatatgggagaaagtggatttagaggccattggtattccctatccgagtgaagtaaataaatgcaaagtagcattcaccacccgagatcaaaaagtttgtgggcagatgggggatcataagccgatgcaagtcaaatgtttggaaccagaggatgcatgggagttgttcaaaaacaaggtcggagacaacacattacgtagtgatcctgttattgtggggttggcaagagaggtcgctcaaaaatgtcgtggtctgccattggcgctcagttgcattggtgagacaatggcatctaaaactatggtacaagaatgggagcatgcaatcgatgttttgactagatccgctgcagagttttctgacatgcaaaacaaaattcttccgattctcaagtacagctacgatagcttggaggatgaacatatcaagtcgtgtttcctatattgtgctctgtttcccgaagatgataagatagataccaaaaccttgataaacaaatggatctgcgaaggattcatcggagaagaccaagttataaaaagagcgaggaataagggttatgagatgctcggtacccttatccgtgctaatttactaacaaatgatcgtgggttcgtgaaatggcatgttgtgatgcatgacgtggttcgtgaaatggctttgtggattgcatccgattttgggaaacagaaagagaattatgttgtgcgagcaagagtcgggttacatgaaataccaaaagtcaaggattggggagctgtaagaagaatgtcactaatgatgaatgaaattgaagagataacatgcgagtccaagtgttctgaacttacaactttgttccttcaaagtaatcaattgaagaatctatcaggtgaattcattcggtatatgcaaaagctagttgttttggatctttcacataatcctgacttcaatgaacttccagagcagatatcggggctggtctcgttgcagtatcttgacttgtcgtggacaagaatagagcaactgcctgttggtctcaaagagttgaaaaagctaatttttctgaatttatgtttcaccgagcgactttgtagtatcagtgggatatcaaggttgttgagtttaagatggttgagtctgcgagagtctaatgttcatggagatgctagcgtattgaaggagctgcagcaattggagaatctacaagatctacgcataactgaatccgcggagttaattagtttggatcaaaggttggcgaagttaatctctgttctgcgtattgaggggtttcttcaaaagccattcgatttatcattcctggcgagtatggagaatctttatgggctactggtggaaaatagttatttctcggagattaatataaagtgcagagaaagcgagacagaatcgtcttatttacacatcaatccgaaaattccatgctttaccaacctcacaggactgattataatgaagtgccatagcatgaaggatctgacttggatattgtttgctccaaatcttgtcaacctagacattcgtgattcaagagaagtgggagaaataataaacaaagagaaagcaatcaatcttacaagtattattacaccatttcagaaactagaaaggttgtttttgtatggtttgccgaagctggagagtatctactggagtcctctcccctttccgcttttgtcgaacatagttgttaaatactgtccaaagctgagaaagcttccattaaatgctacaagtgtcccactagttgaagaatttgaaatacgtatggatcctccagaacaggaaaatgagcttgaatgggaggacgaagataccaaaaatcgattcttgccttcaatcaaaccgctagtacgtcgtctaaagatccattactcaggaatgggattcctcaatgtcaaaaatcagaatccacgcttcttcttctattgctttatctatcttcttgtagtgcatttggattgtataattgatttgcattctgacacttctggaatgtgttgtgttgttcacttggattatgtttttcattttccttttgtattccctaaaacgttttgcatccttttcagactacatttttacacaatcaaaagtttatgcgtttag

SEQ ID NO: 1472 - protein, 967 aa, Arabidopsis thaliana
MGNFVCIEISGDQMLDRIIRCLCGKGYIRNLEKNLRALQREMEDLRATQHEVQNKVAREESRHQQRLEAVQVWLDRVNSIDIECKDLLSVSPVELQKLCLCGLCSKYVCSSYKYGKRVFLLLEEVTKLKSEGNFDEVSQPPPRSEVEERPTQPTIGQEEMLKKAWNRLMEDGVGIMGLHGMGGVGKTTLFKKIHNKFAETGGTFDIVIWIVVSQGAKLSKLQEDIAEKLHLCDDLWKNKNESDKATDIHRVLKGKRFVLMLDDIWEKVDLEAIGIPYPSEVNKCKVAFTTRDQKVCGQMGDHKPMQVKCLEPEDAWELFKNKVGDNTLRSDPVIVGLAREVAQKCRGLPLALSCIGETMASKTMVQEWEHAIDVLTRSAAEFSDMQNKILPILKYSYDSLEDEHIKSCFLYCALFPEDDKIDTKTLINKWICEGFIGEDQVIKRARNKGYEMLGTLIRANLLTNDRGFVKWHVVMHDVVREMALWIASDFGKQKENYVVRARVGLHEIPKVKDWGAVRRMSLMMNEIEEITCESKCSELTTLFLQSNQLKNLSGEFIRYMQKLVVLDLSHNPDFNELPEQISGLVSLQYLDLSWTRIEQLPVGLKELKKLIFLNLCFTERLCSISGISRLLSLRWLSLRESNVHGDASVLKELQQLENLQDLRITESAELISLDQRLAKLISVLRIEGFLQKPFDLSFLASMENLYGLLVENSYFSEINIKCRESETESSYLHINPKIPCFTNLTGLIIMKCHSMKDLTWILFAPNLVNLDIRDSREVGEIINKEKAINLTSIITPFQKLERLFLYGLPKLESIYWSPLPFPLLSNIVVKYCPKLRKLPLNATSVPLVEEFEIRMDPPEQENELEWEDEDTKNRFLPSIKPLVRRLKIHYSGMGFLNVKNQNPRFFFYCFIYLLVVHLDCIIDLHSDTSGMCCVVHLDYVFHFPFVFPKTFCILFRLHFYTIKSLCV

SEQ ID NO: 1473 - DNA, 597 bp, Arabidopsis thaliana
atggcaaccatgtctgctcttcagagctcttttacttctctttctctatctcccagctcttccttcctcggccagcgtttaatttccccgatttccctctccgtcacttctccggtcaagcccgctgagaacccatgtcttgttcttgcaaagctcaagcgttgggaacgaaaagaatgcaaaccaaacagtcttccgattctccacaaaatgcatgtcaagtttggagatacagtcaaagtaatatctggacgcgacaagggtaaaatcggagaggttactaagattttcactcacaacagtaccattgtgatcaaagatgtgaacctcaaaacaaaacacatgaagagccgagaagagggagagcctggtcaaattgtcaagatagaagcacctatccacagctcaaatgtgatgttgtattcaaaagaaaaagacgtagtaagccgggtgggtcacaaggtacttgaagatggacagaaggtaagatatctgatcaaaacaggggaactcatcgacaccattgagaagtggaagctacttaaggaggctaaggataaggaaaccacccaagttgcagttacctccgcatcttag

SEQ ID NO: 1474 - protein, 198 aa, Arabidopsis thaliana
MATMSALQSSFTSLSLSPSSSFLGQRLISPISLSVTSPVKPAENPCLVLAKLKRWERKECKPNSLPILHKMHVKFGDTVKVISGRDKGKIGEVTKIFTHNSTIVIKDVNLKTKHMKSREEGEPGQIVKIEAPIHSSNVMLYSKEKDVVSRVGHKVLEDGQKVRYLIKTGELIDTIEKWKLLKEAKDKETTQVAVTSAS

SEQ ID NO: 1475 - DNA, 573 bp, Arabidopsis thaliana
atgtttcttcaggttaccggcacggcgactccggctatgcctgcggtagtgtttctcaattcatggagacgaccacttagtattcctctccggagcgtaaaaaccttcaagcctctagcattcttcgatctcaaaggaggcaaaggaatgagtgagttccatgaggttgaactcaaagttcgtgattatgaattggatcagtttggtgttgtgaacaatgctgtttacgcaaactactgtcaacacggtcgacatgagtttctagagagtatcggtatcaactgcgacgaagtagcacgttctggggaagccttagcaatttcagagttgacaatgaagttcctttcacctttacgtagcggagacaaattcgtggtgaaagcgaggatatcggggacatctgctgcgcgtatttacttcgatcatttcatctttaaacttccaaatcaagagcctatattggaggcaaaaggaatagctgtgtggctcgacaacaagtaccgtcctgttcgcatcccatcttctatacgttctaaatttgttcacttcctacgccaagacgacgccgtttga

SEQ ID NO: 1476 - protein, 190 aa, Arabidopsis thaliana
MFLQVTGTATPAMPAVVFLNSWRRPLSIPLRSVKTFKPLAFFDLKGGKGMSEFHEVELKVRDYELDQFGVVNNAVYANYCQHGRHEFLESIGINCDEVARSGEALAISELTMKFLSPLRSGDKFVVKARISGTSAARIYFDHFIFKLPNQEPILEAKGIAVWLDNKYRPVRIPSSIRSKFVHFLRQDDAV

SEQ ID NO: 1477 - DNA, 2334 bp, Arabidopsis thaliana
atggctaagctctctctttcctccatcttcttcgtcttccctctcctcctctgtttcttttccccttcttcttcttcatcggatggcttagaatcctacatcgtccatgtgcagagatctcataagccttccctcttctcctcccacaacaactggcacgtctctctccttcgctctctcccttcttctccccaaccagcaacgctgctctactcttattcacgcgccgttcatggcttctccgctcgtctctcccctatccaaaccgccgccctccgccgtcatccttcagtcatctccgttatacctgatcaagcgcgtgagatccacacaactcacacgcctgccttcctcggtttctcccaaaactctggactctggagcaactcaaattacggggaagacgtgatcgtcggcgttttagatactggaatctggccggaacatccaagtttctcggattcaggtctcggtccaattccatctacctggaaaggcgagtgcgagatcggacctgattttcctgcctcatcttgcaatcggaagcttatcggagctcgagcgttttacaggggatatttaacgcaacggaatggaacaaaaaagcatgcagccaaggaatcgagatcgccgcgtgatacagaaggtcatggcacgcacacggcatctacggcagctggatcggtggttgctaacgcgagtttgtaccagtacgcgcgcggaacagctactgggatggcgtcaaaggcgagaatcgccgcttacaaaatctgttggaccggcggatgttacgattccgatatcctcgccgccatggatcaggcggttgccgacggtgttcacgttatctctctctccgtcggagccagcggttccgccccggagtatcacacggactctatagcgatcggagcatttggagccacgcggcacggcatcgtcgtttcttgctccgctgggaattctggtcctaatcctgaaaccgcgacgaacatcgctccatggatcttaaccgttggtgcgtccaccgtcgatagagaattcgccgcaaacgcaatcacgggagacgggaaagtcttcacgggaacatcactgtacgcaggcgaatctctaccggattctcaactttctctggtatattccggcgattgcggaagcagattgtgttaccctgggaaattgaattcatcattggttgaaggcaaaatcgtgctctgtgacagaggaggcaacgcaagagttgagaaaggaagtgcagtcaagctagccggtggtgctggtatgattctggcgaacacagctgaaagcggtgaagaattaaccgccgattcgcatctcgtcccggcgacaatggttggagctaaagctggagatcaaatccgcgactacatcaaaacatcagactctcccactgcaaaaatcagtttcctaggcactttgatcggaccatctcctccttctcccagagtcgccgctttctccagccgtggaccgaatcacttgacaccggttattcttaaaccggacgtgattgctcctggagtcaacattttagccggttggaccgggatggttggtcctaccgatttagatatcgatccaagacgggttcaattcaacatcatctccggtacatcgatgtcgtgcccacacgttagtggactcgccgctctcctccgtaaagctcatcccgattggtcacctgcagcaatcaaatccgcccttgtaaccaccgcttacgatgtcgaaaactccggcgaaccaatcgaggatctcgccaccggtaaatcatcgaactcattcatccacggagctggacacgtcgatccaaacaaagctttgaatcctggtttggtttacgacatcgaggtcaaagagtacgtagctttcctctgcgccgtgggatacgagtttccggggattctagtctttcttcaagatccaactctttacgacgcatgtgaaacgagcaagctaagaaccgccggcgatctcaattacccatctttctccgtggttttcgcatcgaccggggaagttgtgaaatacaaaagggttgtcaaaaacgtgggaagcaatgtcgacgctgtgtacgaagtcggagttaaatctccggcgaatgttgagattgatgtttctccaagcaagcttgcgttcagcaaggagaagagcgtgttggagtatgaagtcacatttaagagcgttgtgctcggcggaggagtcggatccgtgccgggtcatgaattcgggtcgatcgaatggacagacggtgaacacgttgttaagagtccggtggccgtccaatggggtcagggatcagttcagtccttctga

SEQ ID NO: 1478 - protein, 777 aa, Arabidopsis thaliana
MAKLSLSSIFFVFPLLLCFFSPSSSSSDGLESYIVHVQRSHKPSLFSSHNNWHVSLLRSLPSSPQPATLLYSYSRAVHGFSARLSPIQTAALRRHPSVISVIPDQAREIHTTHTPAFLGFSQNSGLWSNSNYGEDVIVGVLDTGIWPEHPSFSDSGLGPIPSTWKGECEIGPDFPASSCNRKLIGARAFYRGYLTQRNGTKKHAAKESRSPRDTEGHGTHTASTAAGSVVANASLYQYARGTATGMASKARIAAYKICWTGGCYDSDILAAMDQAVADGVHVISLSVGASGSAPEYHTDSIAIGAFGATRHGIVVSCSAGNSGPNPETATNIAPWILTVGASTVDREFAANAITGDGKVFTGTSLYAGESLPDSQLSLVYSGDCGSRLCYPGKLNSSLVEGKIVLCDRGGNARVEKGSAVKLAGGAGMILANTAESGEELTADSHLVPATMVGAKAGDQIRDYIKTSDSPTAKISFLGTLIGPSPPSPRVAAFSSRGPNHLTPVILKPDVIAPGVNILAGWTGMVGPTDLDIDPRRVQFNIISGTSMSCPHVSGLAALLRKAHPDWSPAAIKSALVTTAYDVENSGEPIEDLATGKSSNSFIHGAGHVDPNKALNPGLVYDIEVKEYVAFLCAVGYEFPGILVFLQDPTLYDACETSKLRTAGDLNYPSFSVVFASTGEVVKYKRVVKNVGSNVDAVYEVGVKSPANVEIDVSPSKLAFSKEKSVLEYEVTFKSVVLGGGVGSVPGHEFGSIEWTDGEHVVKSPVAVQWGQGSVQSF

SEQ ID NO: 1479 - DNA, 753 bp, Arabidopsis thaliana
atggcgacttcttcgatcactatcccgaccattagaactccgattcatcgatcaaaatttctaggccaaacacatcaattttcaactgtaaaccggtcggttttcccgcctccaaaacagcagtcaaaactgtatcaagtaaaggccatgggtaaattcaatctatgggaagtgatgggaggaagaggattatgcaacggagagaaaggtattgagaaggagctccagaggaacattgaagacgagcaagagacatcaaaggctgagaacaacgagacagagagagagagcgatgacagtaacttgtcttttaaagtacctgaagatggtttcgagaaagagatgatgggtctcacaggaggatttcccggtggcgaaaagggtttaaaaacgtttatcgaaaaaaatccaccacctcctccaccaccaccacctgcaaaacaaggaagcgatgcatccgcggttgctacagataagaagccgaaagcgcccaagctaccccttctcatgccggggatgattgctatagtcaagaaccagaacagtccgtatcacatgtattgtggaattgtgcagaggatcactgatggaaaagctggtgtcttgttcgaaggaggaaactgggaccgtctcattactttcaggcttgaagagcttgaacgaagagaaaaaggtccaccgggtaagaatccaaagtcttgtattctcgagcctcttatcgaacagatgcaaaaggaagaggcagcaccataa

SEQ ID NO: 1480 - protein, 250 aa, Arabidopsis thaliana
MATSSITIPTIRTPIHRSKFLGQTHQFSTVNRSVFPPPKQQSKLYQVKAMGKFNLWEVMGGRGLCNGEKGIEKELQRNIEDEQETSKAENNETERESDDSNLSFKVPEDGFEKEMMGLTGGFPGGEKGLKTFIEKNPPPPPPPPPAKQGSDASAVATDKKPKAPKLPLLMPGMIAIVKNQNSPYHMYCGIVQRITDGKAGVLFEGGNWDRLITFRLEELERREKGPPGKNPKSCILEPLIEQMQKEEAAP

SEQ ID NO: 1481 - DNA, 1086 bp, Arabidopsis thaliana; identical to SEQ ID NO: 889

SEQ ID NO: 1482 - protein, 361 aa, Arabidopsis thaliana; identical to SEQ ID NO: 890

SEQ ID NO: 1483 - DNA, 522 bp, Arabidopsis thaliana
atgggttttagagcactgcctcttcaacacagcagtgggttcatctccacgaccaaagtatccatctcaagaacctcgcccaggattttccggaaccctagatgggtcgttgtctcagcaaagcaagagaaagatgaggataagaagaagaatgaagaggagacttcgttgtttactcaattaacggatgccttggacttctcacaagttcgatcggagaaagacgctgagcttctctacgaggctcgagaagccaccaaatctggtcgcaagatgacccaagaacagtatggggcattgaggagaaaaatcggaggaacatacaaggacttttttaaatcctacgttgaagtggatgggcaatatgtggaggagggatgggtggacaaaacatgtaagatatgcaaaaaggacacaaagggtgaggcaagacaagtggacaagttagggagatatgctcatgtctcttgtcttcaaaatcctccctctggaaatttcttcaccagactcttctctagatga

SEQ ID NO: 1484 - protein, 173 aa, Arabidopsis thaliana
MGFRALPLQHSSGFISTTKVSISRTSPRIFRNPRWVVVSAKQEKDEDKKKNEEETSLFTQLTDALDFSQVRSEKDAELLYEAREATKSGRKMTQEQYGALRRKIGGTYKDFFKSYVEVDGQYVEEGWVDKTCKICKKDTKGEARQVDKLGRYAHVSCLQNPPSGNFFTRLFSR

SEQ ID NO: 1485 - DNA, 1185 bp, Arabidopsis thaliana
atggttgagccagctagtccagattccgacgaagggatctcgctgctcgagtttcacggtaacggtgaccgttcctggcagttaaatttcgatgatttccaggtttcaccggaacacaaggagaagaaatctccgagtaaactacacaactgtcttggttgtttgggtccggaagacaatgtggcagattattaccagcagcaagtagagatgcttgagggctttactgaaatggatgaacttgcagaacgtggctttgttcctggaatgtcaaaggaagagcaggataatttggctaaaagcgagacattggcgattagaatatcaaacattgcaaacatgcttctttttgctgctaaagtctatgcttctgtcactagtggctctttagctatcattgcctctacattggactctcttcttgatcttctttctggcttcatcctctggtttaccgccttctccatgcagacacccaacccgtatcagtatcccattggcaagaaacgcatgcaaccactgggaatcctagtctttgcatcagtgatggcaacacttggattgcagattatcttggaatctcttcgcacaatgttatccagccacaaggagttcaacctaacaaaagagcaagagagttgggtagttgggatcatgctttctgttacattggtcaaactgcttctggttctttactgcagatccttcactaacgagatcgttaaagcttatgctcaagatcatttcttcgacgtcatcacaaacatcattggactcattgcagtaatcctggccaattacattgattattggattgatccagttggagctatcattcttgcattatacacaatacggacatggtcaatgacggtcttggagaacgttaactctcttgttgggaaatcagctagaccagagtatctgcagaaactaacttacctgtgttggaaccaccataaagccattaggcacattgacacagtgagggcatacacatttggctctcattattttgtggaggttgatattgttctcccagctgacatgcctctgcaagtggctcacgacattggagaatcgctgcaagagaagctcgagctactagaggagatcgaacgggcttttgtgcatcttgattatgagtacactcacaaacctgagcacgctagatcccactgttag

SEQ ID NO: 1486 - protein, 394 aa, Arabidopsis thaliana
MVEPASPDSDEGISLLEFHGNGDRSWQLNFDDFQVSPEHKEKKSPSKLHNCLGCLGPEDNVADYYQQQVEMLEGFTEMDELAERGFVPGMSKEEQDNLAKSETLAIRISNIANMLLFAAKVYASVTSGSLAIIASTLDSLLDLLSGFILWFTAFSMQTPNPYQYPIGKKRMQPLGILVFASVMATLGLQIILESLRTMLSSHKEFNLTKEQESWVVGIMLSVTLVKLLLVLYCRSFTNEIVKAYAQDHFFDVITNIIGLIAVILANYIDYWIDPVGAIILALYTIRTWSMTVLENVNSLVGKSARPEYLQKLTYLCWNHHKAIRHIDTVRAYTFGSHYFVEVDIVLPADMPLQVAHDIGESLQEKLELLEEIERAFVHLDYEYTHKPEHARSHC

SEQ ID NO: 1487 - DNA, 348 bp, Arabidopsis thaliana; identical to SEQ ID NO: 1393

SEQ ID NO: 1488 - protein, 115 aa, Arabidopsis thaliana; identical to SEQ ID NO: 1394

SEQ ID NO: 1489 - DNA, 1047 bp, Arabidopsis thaliana
atggtcgagggagagtccaaggcattgtggattattttggccaccgtgtttgcagtcgcggcggtggcaccagcggtgcatggacagcaaacgccgtgttacttcgtgtttggagactctgtcttcgacaacggtaacaacaatgccttgaacaccaaggccaaggtcaactatttaccttatggtatagattactttcaaggtccaaccggtcggtttagcaacggtcggaatattccagacgttatcgctgaactagcgggtttcaataacccaattccaccatttgccggagcatcacaggcacaagctaacatcggactcaactatgcttccggtgccggcggtatccgcgaagaaaccagcgaaaatatgggtgagagaatcagtttgagacagcaagtaaacaaccacttttccgctatcataaccgcggcggtgccactgagtcggttaaggcaatgtctatacacaatcaacatcggaagcaacgattacctcaacaactacttcttgtcgcctcctactctagctcgtcgtctatttaatcctgaccagtacgctcgatctctcataagcctctaccgtatctatctgacgcaattgtacgtactaggagcgaggaatgtagcgttgttcggtatcggtaagatcggatgtacaccacggattgttgctaccctcggtggcggcactggctgcgcagaagaagtgaaccaagccgtgatcatcttcaacactaaactcaaagccctagtcacagatttcaacaacaaaccgggagctatgttcacttatgttgatctcttctctggaaatgctgaagatttcgccgctctagggattacggttggtgataggagttgctgtacggttaatccgggtgaagaactttgtgcggcgaacggaccggtttgtccagacagaaacaaattcatattctgggataacgtgcatactacggaagtgataaatactgtggtggctaacgcagcgtttaacggacctatagctagtccgttcaacatatcccagttagtgaattaa

SEQ ID NO: 1490 - protein, 348 aa, Arabidopsis thaliana
MVEGESKALWIILATVFAVAAVAPAVHGQQTPCYFVFGDSVFDNGNNNALNTKAKVNYLPYGIDYFQGPTGRFSNGRNIPDVIAELAGFNNPIPPFAGASQAQANIGLNYASGAGGIREETSENMGERISLRQQVNNHFSAIITAAVPLSRLRQCLYTINIGSNDYLNNYFLSPPTLARRLFNPDQYARSLISLYRIYLTQLYVLGARNVALFGIGKIGCTPRIVATLGGGTGCAEEVNQAVIIFNTKLKALVTDFNNKPGAMFTYVDLFSGNAEDFAALGITVGDRSCCTVNPGEELCAANGPVCPDRNKFIFWDNVHTTEVINTVVANAAFNGPIASPFNISQLVN

SEQ ID NO: 1491 - DNA, 546 bp, Arabidopsis thaliana
atggcttcctctatgctctcctccgccgctgtggttacatccccggctcaggccaccatggtcgctccattcaccggcttgaagtcatccgctgcattcccggtcacccgcaagaccaacaaggacatcacttccatcgcaagcaacgggggaagagttagctgcatgaaggtgtggccaccaattggaaagaagaagtttgagactctatcttacctccctgaccttagtgacgtcgaattggctaaggaagttgactaccttctccgcaacaagtggattccttgtgttgaattcgagttagagcacggatttgtgtaccgtgagcacggaaacactcccggatactacgatggacggtactggacaatgtggaagcttccattgttcggatgcaccgactccgctcaagtgttgaaggaagttgaagaatgcaagaaggagtacccgggcgccttcattaggatcatcggattcgacaacacccgtcaagtccaatgcatcagtttcattgcctacaagcccccaagcttcaccgaagcttaa

SEQ ID NO: 1492 - protein, 181 aa, Arabidopsis thaliana
MASSMLSSAAVVTSPAQATMVAPFTGLKSSAAFPVTRKTNKDITSIASNGGRVSCMKVWPPIGKKKFETLSYLPDLSDVELAKEVDYLLRNKWIPCVEFELEHGFVYREHGNTPGYYDGRYWTMWKLPLFGCTDSAQVLKEVEECKKEYPGAFIRIIGFDNTRQVQCISFIAYKPPSFTEA

SEQ ID NO: 1493 - DNA, 771 bp, Arabidopsis thaliana
atgatgcaagaggagggaaaccgaaaaggtccatggacagaacaggaagacatacttctggtaaattttgttcacttatttggagatcgacgatgggattttatagcaaaagtatcaggtttgaacagaacaggaaagagttgcaggctaagatgggttaattacctacatcctggtctcaaacgtggcaagatgacgcctcaagaagagcgcctcgtccttgagcttcacgctaagtggggaaacaggtggtcgaaaatagcccgaaaattgccgggacgaacggataacgagataaagaactactggaggactcatatgaggaagaaagctcaagaaaagaagcgtcctgtttccccaacttcctcattttccaactgcagctcgtcatctgtgaccactaccaccaccaatactcaagatacatcgtgccactcgcgtaaatcttcaggggaagtgagcttttacgacactggaggttcccgatccactagagagatgaatcaagaaaacgaagacgtgtactcgttggatgatatatggagagagattgatcactcagcagtaaacataataaaaccggttaaagacatctactcagaacaaagccattgcttaagttacccaaatctagcttcaccatcatgggaaagctcattggattctatatggaacatggatgcagataaaagtaagatatcgtcttactttgcaaatgatcagtttcctttctgtttccaacacagtagatcaccatggtcgtcaggttaa

SEQ ID NO: 1494 - protein, 256 aa, Arabidopsis thaliana
MMQEEGNRKGPWTEQEDILLVNFVHLFGDRRWDFIAKVSGLNRTGKSCRLRWVNYLHPGLKRGKMTPQEERLVLELHAKWGNRWSKIARKLPGRTDNEIKNYWRTHMRKKAQEKKRPVSPTSSFSNCSSSSVTTTTTNTQDTSCHSRKSSGEVSFYDTGGSRSTREMNQENEDVYSLDDIWREIDHSAVNIIKPVKDIYSEQSHCLSYPNLASPSWESSLDSIWNMDADKSKISSYFANDQFPFCFQHSRSPWSSG

SEQ ID NO: 1495 - DNA, 801 bp, Arabidopsis thaliana
atggcgtctgttgcttcttcaactactctcatctcttctccctcttctagggtttttccagcaaagtcttcactttcctctccatctgtttctttccttcgaaccctttcttctccttccgcatctgcttctctccgctccggatttgctcgacgctcttccctcagctccacttctcgtcggagctttgctgtcaaagcccaggccgatgatcttccactggttggaaacaaggcgcctgattttgaggcagaggctgtgtttgatcaagagttcatcaaggttaagctctctgattacattggaaagaagtatgtgattctctttttctacccattggactttactttcgtctgcccaacagagattactgccttcagtgaccggcattcagaatttgagaagttgaacaccgaagtattaggtgtttctgtcgatagtgtgttctctcaccttgcatgggtccaaacagacaggaaatctggagggcttggtgatctgaactatccccttatttcagatgtcactaaatcaatctcaaagtcgttcggagtgctcatccatgatcagggaatagcactgagaggacttttcataatcgacaaggaaggagtgatccaacattccaccatcaacaatcttggtattggccgaagcgttgatgagacaatgagaaccctccaggcattacagtacatccaggaaaacccggatgaagtctgcccagcaggatggaagccgggtgagaagtcaatgaaacccgacccaaaactcagcaaagagtacttctcagctatttag

SEQ ID NO: 1496 - protein, 266 aa, Arabidopsis thaliana
MASVASSTTLISSPSSRVFPAKSSLSSPSVSFLRTLSSPSASASLRSGFARRSSLSSTSRRSFAVKAQADDLPLVGNKAPDFEAEAVFDQEFIKVKLSDYIGKKYVILFFYPLDFTFVCPTEITAFSDRHSEFEKLNTEVLGVSVDSVFSHLAWVQTDRKSGGLGDLNYPLISDVTKSISKSFGVLIHDQGIALRGLFIIDKEGVIQHSTINNLGIGRSVDETMRTLQALQYIQENPDEVCPAGWKPGEKSMKPDPKLSKEYFSAI

SEQ ID NO: 1497 - DNA, 648 bp, Arabidopsis thaliana
atgacaaaaactaccaaaaccatgaatcctaagttttacttggttcttgccttaaccgcggttctggcctcaaacgcatatggtgcggttgtagacatcgatggaaacgccatgttccacgaaagttactacgttctccctgtcatccgtggccgaggcggaggcctgactctagcaggccgcggtgggcagccatgtccttacgatatcgtgcaggaatcttcagaagttgatgagggcattcccgtaaaattctcaaactggaggcttaaggttgcgttcgttcccgaatcacagaacctcaacatcgaaacagacgtcggagccacgatctgcatccagtcaacctactggcgggtcggtgagtttgaccacgagaggaagcagtacttcgtggttgctggtccaaagccagaagggttcggacaagattcgttgaagagtttcttcaagatcgagaaatctggagaggatgcttacaagtttgtgttctgtcctcggacttgcgactctggcaatccaaaatgcagcgatgtcgggatattcatagatgaacttggcgttcgtcgtttggctttaagcgataagccgttcttggttatgttcaaaaaagctaatgtgaccgaagtttcgtccaagactatgtga

SEQ ID NO: 1498 - protein, 215 aa, Arabidopsis thaliana
MTKTTKTMNPKFYLVLALTAVLASNAYGAVVDIDGNAMFHESYYVLPVIRGRGGGLTLAGRGGQPCPYDIVQESSEVDEGIPVKFSNWRLKVAFVPESQNLNIETDVGATICIQSTYWRVGEFDHERKQYFVVAGPKPEGFGQDSLKSFFKIEKSGEDAYKFVFCPRTCDSGNPKCSDVGIFIDELGVRRLALSDKPFLVMFKKANVTEVSSKTM

SEQ ID NO: 1499 - DNA, 1092 bp, Arabidopsis thaliana
atgggttcaacggcagagacacaattaactccggtgcaagtcaccgacgacgaagctgccctcttcgccatgcaactagccagtgcttccgttcttccgatggctttaaaatccgccttagagcttgaccttcttgagattatggccaagaatggttctcccatgtctcctaccgagatcgcttctaaacttccgaccaaaaatcctgaagctccggtcatgctcgaccgtatcctccgtcttcttacgtcttactccgtcttaacctgctccaaccgtaaactttccggtgatggcgttgaacggatttacgggcttggtccggtttgcaagtatttgaccaagaacgaagatggtgtttccattgctgctctttgtcttatgaaccaagacaaggttctcatggaaagctggtaccatttgaaggatgcaattcttgatggtgggattccattcaacaaggcttatggaatgagcgcgttcgagtaccacgggactgaccctagattcaacaaggtctttaacaatggaatgtctaaccattccacaatcaccatgaagaagattcttgagacctataagggttttgaaggattgacttctttggttgatgttggtggtggcattggtgctacactcaaaatgattgtctccaagtaccctaatcttaaaggcatcaactttgatctcccacatgtcatcgaagatgctccttctcatcctggtattgagcatgttggaggagatatgtttgtaagtgtccctaaaggtgatgccatattcatgaagtggatatgtcatgactggagtgacgaacattgcgtgaaattcttgaagaactgctacgagtcacttccagaggatggaaaagtgatattagcagagtgtatacttccagagacaccagactcaagcctctcaaccaaacaagtagtccatgtcgattgcattatgttggctcacaatcccggaggcaaagaacgaaccgagaaagagtttgaggcattagccaaagcatcaggcttcaagggcatcaaagttgtctgcgacgcttttggtgttaaccttattgagttactcaagaagctctaa

SEQ ID NO: 1500 - protein, 363 aa, Arabidopsis thaliana
MGSTAETQLTPVQVTDDEAALFAMQLASASVLPMALKSALELDLLEIMAKNGSPMSPTEIASKLPTKNPEAPVMLDRILRLLTSYSVLTCSNRKLSGDGVERIYGLGPVCKYLTKNEDGVSIAALCLMNQDKVLMESWYHLKDAILDGGIPFNKAYGMSAFEYHGTDPRFNKVFNNGMSNHSTITMKKILETYKGFEGLTSLVDVGGGIGATLKMIVSKYPNLKGINFDLPHVIEDAPSHPGIEHVGGDMFVSVPKGDAIFMKWICHDWSDEHCVKFLKNCYESLPEDGKVILAECILPETPDSSLSTKQVVHVDCIMLAHNPGGKERTEKEFEALAKASGFKGIKVVCDAFGVNLIELLKKL

SEQ ID NO: 1501 - DNA, 372 bp, Arabidopsis thaliana
atggttattagggaagctcttctatacatagccatgctcaaactcgagatagaagctttgcagagagaatatgaagatctcaagattaccaaaaaagaatctttgcaccaatttcaggaggtgaaggtagagaagattggggaaatgtttcaagtaaaaataaaaagtccacggggagaaaacaatcttgtgaatattcttgaagcatttgaagaaatggggttgaatgtggctcaagcaagggcatcatgcctagattcatttgccatggaagccattgttgcacctcaatccaaagacaagctttgtagtgtggatgatttgactcaaactcttgtcaaagctcttgtcaagccaagtgtcccactgtaa

SEQ ID NO: 1502 - protein, 123 aa, Arabidopsis thaliana
MVIREALLYIAMLKLEIEALQREYEDLKITKKESLHQFQEVKVEKIGEMFQVKIKSPRGENNLVNILEAFEEMGLNVAQARASCLDSFAMEAIVAPQSKDKLCSVDDLTQTLVKALVKPSVPL

SEQ ID NO: 1503 - DNA, 594 bp, Arabidopsis thaliana
atggcttcttcgacagctttgtctctctcatggagctcctctccttgttggtcacacagcttcaatggcggtgcaaatgaaaccctaaaagtatctgagcgaaggttcaattttgaagttgtttcccagaagaaagctaagaaacttcgcaaggtaattttgaaagaggatgtgacggatttgggtaagcaagggcaattacttgatgtgaaagctggatttttcagaaacttcctcttgcctactggaaaggctcagcttatgactccacttctgctcaaggaattgaagatggaagacgaacggattgaggcagagaagcaaagggtgaaagaagaggcacaacaactggcgatggtattccaaaccgttggtgctttcaaggttaaacgcaaaggcggtaaaggcaaactgatatttggatctgtcacagctcaagacctcgtcgacatcatcaaatcacagctccaaaaggacatcgacaaacgccttgtctctctcccagaaatccgtgaaaccggagaatacatagccgaactcaagcttcaccccgatgtcactgctcgagttaagatcaatgttttcgctaactaa

SEQ ID NO: 1504 - protein, 197 aa, Arabidopsis thaliana
MASSTALSLSWSSSPCWSHSFNGGANETLKVSERRFNFEVVSQKKAKKLRKVILKEDVTDLGKQGQLLDVKAGFFRNFLLPTGKAQLMTPLLLKELKMEDERIEAEKQRVKEEAQQLAMVFQTVGAFKVKRKGGKGKLIFGSVTAQDLVDIIKSQLQKDIDKRLVSLPEIRETGEYIAELKLHPDVTARVKINVFAN

SEQ ID NO: 1505 - DNA, 906 bp, Arabidopsis thaliana
atgaacactaatccagtgactaatgggtttgttaaacctgttcctactgaagaagaacaagcaaagattgaggaagtgaggaagctattaggtccattaccggagaagctttcgagtttttgttccgatgatgcagttttaaggtatctaagggcaaggaattggcatgtcaagaaagctactaagatgcttaaagaaactttgaaatggagagttcaatacaaacctgaggagatttgttgggaggaagtagctggtgaagcagagacagggaagatatatagatcgagttgtgtcgataaacttggacgacctgttctcattatgagaccgagtgttgagaattctaaatcggtgaaaggccagattagataccttgtgtattgtatggagaatgcagtacaaaatttgccaccaggggaagaacagatggtgtggatgatagattttcacggttatagtttggcgaatgtatcgttacgaacaacgaaagaaaccgctcatgtattacaagaacattaccctgagagattagcttttgctgttctctacaatcctcctaagttctttgaacctttctggaaggtggcgcggcccttcttagagccgaagacacggaacaaagtgaagtttgtttactcggatgatccaaacactaaggtgataatggaggagaactttgatatggagaaaatggagttagcgtttggtggtaacgatgactcgggttttaacatagagaaacattcagagagaatgaaagaggacgacaagaaaagattggcttcgttggagggcattgtttccgcttctctagactcgctcagcattttatcggtctctgatggtaccgcctctaacagtgctcaccctagctctcatgatgtctctgaggatgagcattaa

SEQ ID NO: 1506 - protein, 301 aa, Arabidopsis thaliana
MNTNPVTNGFVKPVPTEEEQAKIEEVRKLLGPLPEKLSSFCSDDAVLRYLRARNWHVKKATKMLKETLKWRVQYKPEEICWEEVAGEAETGKIYRSSCVDKLGRPVLIMRPSVENSKSVKGQIRYLVYCMENAVQNLPPGEEQMVWMIDFHGYSLANVSLRTTKETAHVLQEHYPERLAFAVLYNPPKFFEPFWKVARPFLEPKTRNKVKFVYSDDPNTKVIMEENFDMEKMELAFGGNDDSGFNIEKHSERMKEDDKKRLASLEGIVSASLDSLSILSVSDGTASNSAHPSSHDVSEDEH

SEQ ID NO: 1507 - DNA, 1068 bp, Arabidopsis thaliana
atgggagaggaagagaagaaaccagaagcagcagaggaaaagaaaatggaagagaagaaaccagaagagaaaaaagaaggagaagacaagaaagtggatgctgagaaaaaaggagaagattctgacaagaagcctcaagaaggagaatctaacaaagattccaaagaagattctgctccggcggcgcctgaggctccagcaccgcctcctccgccgcaagaggttgttcttaaggtttacatgcactgtgaaggatgtgctagaaaagtccgccgttgtctcaaaggcttcgaaggagtggaagatgtgatgactgattgtaaaacggggaaagtggtggtgaaaggtgagaaagctgatccattgaaagtattagctagagttcagaggaagacccaccgtcaagttcagcttctgtctccgattcctcctccgcctccgccgccggagaagaaagcagaggaggataaacccattgtggaagagaagaaagtggagcctccggtggttgtgacggtggttcttaaggttcacatgcactgtgaagcttgtgcgacagagatcaagaaacggatcatgagaatgaaaggagtggaatctgctgaatccgacttaaagagttctcaagtgacggtgaaaggagtttttgaaccacaaaagcttgtagaatacgtttataagcgaaccggaaaacatgctgcgatcatgaaaatcgacccaccgcctccaccaccacctgaggaggcggctgcggcagcggaaggagagaagaaggaagaagaaaagggagaaggagaatccaaaggcgaagaagggaaggatgataaggcgaagacggacgaagaaaagaaagaaggggatggtggtaaaggggaaggcgaagcagcggataatggcggtggggaggaagaaggcaaagttgtggaggtgagaaagatagagaatccttattactactactattaccaaccaccgcgtgtggcgattccgcctatggaaatgccgccacacgcttatccgcctcaattgttcagcgacgagaatccaaatgcatgtactgtaatgtaa

SEQ ID NO: 1508 - protein, 355 aa, Arabidopsis thaliana
MGEEEKKPEAAEEKKMEEKKPEEKKEGEDKKVDAEKKGEDSDKKPQEGESNKDSKEDSAPAAPEAPAPPPPPQEVVLKVYMHCEGCARKVRRCLKGFEGVEDVMTDCKTGKVVVKGEKADPLKVLARVQRKTHRQVQLLSPIPPPPPPPEKKAEEDKPIVEEKKVEPPVVVTVVLKVHMHCEACATEIKKRIMRMKGVESAESDLKSSQVTVKGVFEPQKLVEYVYKRTGKHAAIMKIDPPPPPPPEEAAAAAEGEKKEEEKGEGESKGEEGKDDKAKTDEEKKEGDGGKGEGEAADNGGGEEEGKVVEVRKIENPYYYYYYQPPRVAIPPMEMPPHAYPPQLFSDENPNACTVM

SEQ ID NO: 1509 - DNA, 921 bp, Arabidopsis thaliana
atgaaggagacgagaaagctgaagaagagtaatctccctaaagaagaaactgttgggaaaaaaattcagaggaagaagaatgagaaagtgagcaatgtcgaattaagcgaggatcctcaggctgcacagcttcaagctaaatcaagtgagaaacccaatagaaagaagattcagaagggtaaggaaataaaaagctctccagctgatggtaagctgagtgggaagatgaagaagagaaaagagaaagtaggcaatgttgatataagcgaaccgattctggaagctatttcaactgagaaagtaaaagaaaagaagggcaaaatgaacaagactaagaagaaaaggaaggccgaggaaataactagatcttcagtcgaagatctgaaaagagaaagcaagtttaagaaatcaaataagaagaaaaagatggacatgacctctaagaaagagaacaaaattgaagaggaggaagatgtttatcaaatttcttcaggcgatgaggattgcacaaggggaatgaaaaagtgggttagtgattactatgagggtagacctggtttagacgagctccaaaagagaatcgatgacttcatgactgctcatgaagaacgccttgaacaggagaaacaagacaaagaagctaaagctgcagaaggtggatggactgtggtcgtgcatcacaaaggaaggaaaaagacaacagaatctgaaaccggaacagccgttggatctttttctcaggctgctttggaggataagatcgctaaaaagaaacagagtgagcctgtcgctcatggtttctaccgtttccaaaggcgagatgcacaacgcaatgaactcttggcgcttcagagtaagttcgaggaagacaagaagaggatacaacaacttcgagctgctcgtaggtttaagcctttctaa

SEQ ID NO: 1510 - protein, 306 aa, Arabidopsis thaliana
MKETRKLKKSNLPKEETVGKKIQRKKNEKVSNVELSEDPQAAQLQAKSSEKPNRKKIQKGKEIKSSPADGKLSGKMKKRKEKVGNVDISEPILEAISTEKVKEKKGKMNKTKKKRKAEEITRSSVEDLKRESKFKKSNKKKKMDMTSKKENKIEEEEDVYQISSGDEDCTRGMKKWVSDYYEGRPGLDELQKRIDDFMTAHEERLEQEKQDKEAKAAEGGWTVVVHHKGRKKTTESETGTAVGSFSQAALEDKIAKKKQSEPVAHGFYRFQRRDAQRNELLALQSKFEEDKKRIQQLRAARRFKPF

SEQ ID NO: 1511 - DNA, 771 bp, Arabidopsis thaliana
atgggtcacttgccacagagcctctactccgccgctggaccaaagtttccatatcctggaagctccggtctaggagtagatcaacggaagctgacgtggagccgcttcccggtgttcctacggtgcgcgtcgacggagtcgttaacgagtttgactcagaataatgcggcggagatagagttgaagtatctggtgagtcaacacgggtgggacgtgaggagattgaatagagacgacgaggatgagatcaggagagtgtctcttgttcaagccgaagctttccacatccctcttgctctttttgatgattttttcttcatgttttttcaggcagaggttctatcagcacttctttacaaactaaagaattcaccacctgacagatatgcatgtctcgtggcggagcaaacaagtgaaactgaaactttgtcgagctcaagtgttgtcggagtagttgatgtaacagctcaaactgaaagttcagtacttcgctattttccgggcgtcgaagaatatctatacgtctcgggtttagctgtctcaaaatctcaaaggagaaagaagatggcaagtacattgttaaaggcatgtgatgttttgtgttacttgtggggtttcaagcttcttgctctaagagcttatgaagacgatgcagctgctagaaatctttactcgaatgccggctacagtgtggtcgagactgacccgttgtggacctctacttggataggcagaaaacgtcgcgttcttatgagtaaacgcttttcttag

SEQ ID NO: 1512 - protein, 256 aa, Arabidopsis thaliana
MGHLPQSLYSAAGPKFPYPGSSGLGVDQRKLTWSRFPVFLRCASTESLTSLTQNNAAEIELKYLVSQHGWDVRRLNRDDEDEIRRVSLVQAEAFHIPLALFDDFFFMFFQAEVLSALLYKLKNSPPDRYACLVAEQTSETETLSSSSVVGVVDVTAQTESSVLRYFPGVEEYLYVSGLAVSKSQRRKKMASTLLKACDVLCYLWGFKLLALRAYEDDAAARNLYSNAGYSVVETDPLWTSTWIGRKRRVLMSKRFS

SEQ ID NO: 1513 - DNA, 261 bp, Arabidopsis thaliana
atgcagcaagagagagatcacaaaagagattgttgcaagctcatgcctcaaactgtcaaggctttcttcaagtgtctgagattcagacgttcttcttcttcttcttcagacatggtgaaagctagagcaagaaatgaagagaaagaagaaccttcatctatcgaaacttcaactaggagtctcaacgtaatgaggaaagggataaggaaacaaccagttagctcgggaaaacgaggtggagttaacgactacgacatgtaa

SEQ ID NO: 1514 - protein, 86 aa, Arabidopsis thaliana
MQQERDHKRDCCKLMPQTVKAFFKCLRFRRSSSSSSDMVKARARNEEKEEPSSIETSTRSLNVMRKGIRKQPVSSGKRGGVNDYDM

SEQ ID NO: 1515 - DNA, 507 bp, Arabidopsis thaliana
atggttgcgagaagtgaggaaattgtgatagtggaagaagatacgactgcgaaatgtttgatgttgttatcaagagtcggagaatgcggcggcggctgcgggggagatgaacgtgttttccgatgcaagacttgtcttaaagagttctcatcgtttcaagctttgggaggtcatcgtgcaagccacaagaaacttatcaacagtgacaatccatcacttcttggatccttgtccaacaagaaaactaaaacgtctcatccttgtccgatatgtggagtgaagtttccgatgggacaagctcttggtggtcacatgaggagacataggaacgagaaagtctcaggctcgttggttacacgttcttttctaccggagacgacgacggtgacggctttgaagaaatttagtagtgggaagagagtggcttgtttggatttggacttagattcgatggagagtttggtcaattggaagttggagttgggaagaacgatttcttggagttaa

SEQ ID NO: 1516 - protein, 168 aa, Arabidopsis thaliana
MVARSEEIVIVEEDTTAKCLMLLSRVGECGGGCGGDERVFRCKTCLKEFSSFQALGGHRASHKKLINSDNPSLLGSLSNKKTKTSHPCPICGVKFPMGQALGGHMRRHRNEKVSGSLVTRSFLPETTTVTALKKFSSGKRVACLDLDLDSMESLVNWKLELGRTISWS

SEQ ID NO: 1517 - DNA, 1140 bp, Arabidopsis thaliana
atggaaactcttttccacactcttcttagattattactattcgtagccatctctcatactctgtcccctctcgccggttctttccggatttctaatgactttccggcggttttcaacttcggagactctaactctgacaccggagaacttagctcgggtcttggattccttccacaaccttcctatgaaataaccttctttagatctccaacttccggaagattctgcaatggacgtcttatcgtcgattttctaatggaagcaattgatcgaccatatttgaggccttatttagattcgataagtcgacaaacttaccgaagaggctgcaattttgctgcggctgcgtcaacgattcagaaggcaaatgctgcatcctatagcccctttggttttggtgttcaagtctctcaattcatcacctttaagtccaaagtccttcaattgatacaacaagatgaagagctccaaagatacttaccgtccgaatatttttttagtaatggattgtatatgtttgatatcggacaaaatgatattgccggagcattttacaccaagacagtagatcaagttcttgctctggttcctataatcttagatatatttcaagatggaataaagagattatatgcagagggggcaagaaactattggatacacaacacaggaccacttgggtgtttagcacaagttgtgtcaatttttggggaagacaaatcaaagcttgatgagtttggttgtgtcagtgaccataaccaagctgctaagcttttcaatttgcagcttcatggtcttttcaaaaaactccctcaacaatatcccaattcccgtttcacatacgtagatatcttctctatcaaatccgacctcatcctgaatcattccaaatatggttttgatcattcgataatggtatgttgtggaaccggaggaccaccactgaactacgatgatcaggttggttgcggtaagacagcaagatcaaatggtacgatcataaccgccaaaccttgttatgatagttccaaatatgttaactgggacggcattcattacactgaagctgcaaatcggtttgttgcactacacattctcaccggtaaatactctgagacggcgtcatctttgaatctttag

SEQ ID NO: 1518 - protein, 379 aa, Arabidopsis thaliana
METLFHTLLRLLLFVAISHTLSPLAGSFRISNDFPAVFNFGDSNSDTGELSSGLGFLPQPSYEITFFRSPTSGRFCNGRLIVDFLMEAIDRPYLRPYLDSISRQTYRRGCNFAAAASTIQKANAASYSPFGFGVQVSQFITFKSKVLQLIQQDEELQRYLPSEYFFSNGLYMFDIGQNDIAGAFYTKTVDQVLALVPIILDIFQDGIKRLYAEGARNYWIHNTGPLGCLAQVVSIFGEDKSKLDEFGCVSDHNQAAKLFNLQLHGLFKKLPQQYPNSRFTYVDIFSIKSDLILNHSKYGFDHSIMVCCGTGGPPLNYDDQVGCGKTARSNGTIITAKPCYDSSKYVNWDGIHYTEAANRFVALHILTGKYSETASSLNL

SEQ ID NO: 1519 - DNA, 141 bp, Arabidopsis thaliana
atgatctatgatgtgaactctggtctattcagatccttcctgagccagaagggtagctcgtccgacaaaaggaaaatggaagataagccaagagaacagaagcccaaagccagcgacaacaaacctgttatgaatgaatga

SEQ ID NO: 1520 - protein, 46 aa, Arabidopsis thaliana
MIYDVNSGLFRSFLSQKGSSSDKRKMEDKPREQKPKASDNKPVMNE

SEQ ID NO: 1521 - DNA, 1257 bp, Arabidopsis thaliana
atgatcaagctttgcttcatgacttctcatggttattcaatccctggccttggtcttcctcaagacctctgcaacaccgaaatcatcaagaatagccggtctcatctggtgaatcccggagcaagacaagagatcatacctgcaagctccttcaatctgaatacagaactcttggaaccatggaaaccggtttcttcatttagccaattcgtggagattgattcagccatgatgaaacctctgctcatggatgttcatgagacggcaccagaatctctgattttgagctttggaatcgctgataagtttgcaagacaagaaaaggtgatggagtttcttctgtctcagtcagaggagttcaaggaaaaaggattcgatatgtcgctgttaaatgaattgatggagtttgagtctatgaaatccagttctcagctacgaccgtatgatacttcctctgttctttacttgaatcaagaattagggaaaccggttttggatctcgttagggatatgatggagaatccagagttctctgtgcgatcgaatggtcatgttctgttctcttcaagtagcaatcctgagttgaatgatctactttctattgcttccgagttcaatttgtcaaggaattcaacaacaaaatggagacagctctcaccgcttatcccacactttcagaggtttgaaagtgacgtatttacaccggctaagctgaaagcagttacagtgctagcacctttgaagagtcctgagaaaagcaggctcaagtcaccaaggaaacacaacacgaagcgaaaagctaaagagagggacctatacaaaagaaatcatctccacgcttacgagagccttctctctttaatgataggcaatgatcatcgacacaaacacacaacagtactctctttacagaaatcatgtggagagctctcagagcttctgactcagttctctatcactgctgctggaactggaatcgctgtgctcttttctgtcgtatgtagccttgcttcaaggcgtgtacccttttgcgcaaataagttcttcgacactgggcttggtttgagtttggtaatactgtcatgggctgtgaatagactcagggaggtgattgttcatgtcaataggaaagcgaacaagccatgttcaagtttgaaagatgacgaaatcataaacagtgtggagagaagtatgaaggaggtttactacagagctgcaacggtaatcgcggtgtttgcgcttaggtttgcatgttga

SEQ ID NO: 1522 - protein, 418 aa, Arabidopsis thaliana
MIKLCFMTSHGYSIPGLGLPQDLCNTEIIKNSRSHLVNPGARQEIIPASSFNLNTELLEPWKPVSSFSQFVEIDSAMMKPLLMDVHETAPESLILSFGIADKFARQEKVMEFLLSQSEEFKEKGFDMSLLNELMEFESMKSSSQLRPYDTSSVLYLNQELGKPVLDLVRDMMENPEFSVRSNGHVLFSSSSNPELNDLLSIASEFNLSRNSTTKWRQLSPLIPHFQRFESDVFTPAKLKAVTVLAPLKSPEKSRLKSPRKHNTKRKAKERDLYKRNHLHAYESLLSLMIGNDHRHKHTTVLSLQKSCGELSELLTQFSITAAGTGIAVLFSVVCSLASRRVPFCANKFFDTGLGLSLVILSWAVNRLREVIVHVNRKANKPCSSLKDDEIINSVERSMKEVYYRAATVIAVFALRFAC

SEQ ID NO: 1523 - DNA, 1554 bp, Arabidopsis thaliana
atgcttcctgtctcaaatccttccagtcctgaacatctcctcaaaaaatccagaaccccagactccaccacctccattgatcgtaagaactcatttaactcgcttcactcggtcggaaaccgctcttcctacatcgccgcttctcgtagccactgcacatggctgatcctctctcttctatctctccaactgatcctcttcctcactctccgatccatcccttttcctcaccgtcacatccccgaaaacttcccttctcccgccgccgtcgtcaccaccaccgtcacaaccaccgtcatttctgccgcctcttccaatccccctctctcatcctcctcatctgacgaacgatgcgattcaggtcgagtcttcgtctacgacatgccaaagatcttcaacgaagtgattctacaacagtgtgataatctcaatccatggagctctcgctgcgacgcactttctaacgacgggtttggtcaagaagcgacgtcgttaagcaacgtgatccctaaagatttggttcaatcatggttttggactgaccaattcgtaaccgaaattattttccataaccggattttaaaccaccggtgtcggactttggatccggaatcagctacggcgttttatataccgttctacgctggactcgcagttggtcaatatttatggtcaaattacgcagcggctgatcgtgaccgtcattgtaagatgatgacacagtgggtcaaaaatcaaccttattggaatagatccaacggttgggatcatttcattactatgggacgcatcacatgggattttcgcaggtctaaagacgaagattggggatctaactgtatttatatccctggtatgcgtaacatcacgcgcctccttattgagcgtaactcttgggatcattttgacgtcggtgtaccgtaccctaccggattccaccctagatcggactccgacgtcgtgaattggcaagattttgttcggaatcgacgtcgtgagacgttgttctgtttcgctggagctccacgcgccgggattgtgaatgattttagaggattgcttctccgtcactgtgaggaatcgcgtgggaagtgtcggacggtggattgtaccgtcgggaaatgctcgaatggttcgtcggcgattttggagacgtttctcgggtctgatttttgtctccagccacgaggagatagcttcacacgccggtcgatatttgattgtatgttggccggttcgattccggttttcttttggagacgaagcgcttacatgcagtatcagtggtttttaccggataaaccggatagttattcggtttttatagaccggaacgaggtaacaaacggcacgacgtctataaaggaagtgttggaacggtatagcaaagaagatgtgaggaagatgagagaaagagtgattgatttgataccgaatttggtttacgctaagtctccgaatgggttagagactttcaaagacgcttttgatgtggcgatagatggagtttttaggagattcaaggagcaagagaaatggtacaaatggagatga

SEQ ID NO: 1524 - protein, 517 aa, Arabidopsis thaliana
MLPVSNPSSPEHLLKKSRTPDSTTSIDRKNSFNSLHSVGNRSSYIAASRSHCTWLILSLLSLQLILFLTLRSIPFPHRHIPENFPSPAAVVTTTVTTTVISAASSNPPLSSSSSDERCDSGRVFVYDMPKIFNEVILQQCDNLNPWSSRCDALSNDGFGQEATSLSNVIPKDLVQSWFWTDQFVTEIIFHNRILNHRCRTLDPESATAFYIPFYAGLAVGQYLWSNYAAADRDRHCKMMTQWVKNQPYWNRSNGWDHFITMGRITWDFRRSKDEDWGSNCIYIPGMRNITRLLIERNSWDHFDVGVPYPTGFHPRSDSDVVNWQDFVRNRRRETLFCFAGAPRAGIVNDFRGLLLRHCEESRGKCRTVDCTVGKCSNGSSAILETFLGSDFCLQPRGDSFTRRSIFDCMLAGSIPVFFWRRSAYMQYQWFLPDKPDSYSVFIDRNEVTNGTTSIKEVLERYSKEDVRKMRERVIDLIPNLVYAKSPNGLETFKDAFDVAIDGVFRRFKEQEKWYKWR

SEQ ID NO: 1525 - DNA, 2175 bp, Arabidopsis thaliana
atgggtttcctgatagggggctcttgcttcgtcccttctgttcctctacactctcgattcctttcatctccttcttcttcttcttcttcttctccttcttcgtctcagtttgggcttctgtgttcgagtaatgtcgccaagttcaagcgccgacgaccaacattggcttctttaaaccaggaagatgggtacgagtatgacgttgcttccgccaaaaggagggctttccttcttgtgggtatctctgttcttccctttttgcagcttcgatcacccgctttggctgatgaaagtgagtttttttattgcttagatgagatttgttcaaatgttgcagtagttagtgaaggaacatccccaaatccatttctggctctcctgaatggtcttggaatttttagtgctggcgttcttggtgcactttatgcactggctcggcaagatacaaaagctgctgaggaaaccatcgaatctctaaagaaccagttgaaagacagagaaagagcattggttttgaaggagaaagatttcgaggcaaaactgcagcatgagcaggaagagcggaaaaaggaagtagaaaaggcaaaagaggaacagttgtcattgatcaaccagttgaattctgcaaaggacttggtgacagaattaggccgggagctaagtagcgagaagaaattatgtgagaagcttaaagatcaaatcgaaagtctggaaaatagtctgtcaaaggctggcgaagacaaagaggcactagaaacaaagctcagagaaaagcttgatttggttgaaggactacaagatcggatcaacttgcttagtttggagctgaaagatagtgaagaaaaagctcaacgttttaatgcatcgttggcaaaaaaggaagcagaattgaaggaactcaactctatttacactcaaactagccgagatcttgctgaagcgaagttagagatcaaacagcagaaggaagaactcataagaactcagagtgaattggactcgaagaactctgcgattgaggagttaaacacaagaataacaactttagtggctgagaaagagagttatatccagaagcttgatagtatttcaaaagattatagtgctttgaaattgacttctgagacgcaagcagctgcagatgcagagctcatcagcaggaaagagcaggagattcagcagctaaatgaaaatctggatcgtgcgctagatgatgttaataaaagtaaagacaaagttgctgacttaactgagaagtacgaagactcgaagagaatgctggatatagaactgactacagtaaaaaatttgagacatgaacttgaaggaacaaagaaaacactgcaggcatctagagatcgggtctctgacctggaaacgatgcttgatgagtcaagagctttgtgttcaaagttagaatcagagcttgctatagttcacgaagaatggaaggaagctaaggaaagatatgaaaggaacctcgatgctgaaaaacaaaagaatgagatttctgctagcgaacttgcactggagaaagatcttcggaggagagttaaagacgagcttgagggagtaactcatgaactcaaagagtcttctgtcaagaaccagagcctccagaaggaacttgtggagatttacaagaaagttgaaaccagtaacaaggaattggaagaggagaaaaagactgttttgtcgttgaacaaagaggtgaaaggaatggaaaagcagatcttgatggaaagggaggcgagaaaatcccttgaaacagatctcgaagaagctgtaaagtctttagatgagatgaacaagaacacatcaatactgtcacgagagcttgagaaggtgaatacccatgcttcaaacttggaggacgagaaagaagtacttcaacgatcactaggagaggcaaagaatgcatcaaaagaagctaaggaaaatgtggaagatgcacatatcctcgtgatgagtctaggaaaagaaagggaagtgctagagaagaaagtgaagaagctcgaggaggacttgggctctgcaaagggcgagatactgcgcatgaggagccaaccggattctgtaaaagctgtgaatagtacagacaacaaagagaagagcgacaacacggttactgtgaagaaagttgtcaggaggagaaagagcagtaccagttcttga

SEQ ID NO: 1526 - protein, 724 aa, Arabidopsis thaliana
MGFLIGGSCFVPSVPLHSRFLSSPSSSSSSSPSSSQFGLLCSSNVAKFKRRRPTLASLNQEDGYEYDVASAKRRAFLLVGISVLPFLQLRSPALADESEFFYCLDEICSNVAVVSEGTSPNPFLALLNGLGIFSAGVLGALYALARQDTKAAEETIESLKNQLKDRERALVLKEKDFEAKLQHEQEERKKEVEKAKEEQLSLINQLNSAKDLVTELGRELSSEKKLCEKLKDQIESLENSLSKAGEDKEALETKLREKLDLVEGLQDRINLLSLELKDSEEKAQRFNASLAKKEAELKELNSIYTQTSRDLAEAKLEIKQQKEELIRTQSELDSKNSAIEELNTRITTLVAEKESYIQKLDSISKDYSALKLTSETQAAADAELISRKEQEIQQLNENLDRALDDVNKSKDKVADLTEKYEDSKRMLDIELTTVKNLRHELEGTKKTLQASRDRVSDLETMLDESRALCSKLESELAIVHEEWKEAKERYERNLDAEKQKNEISASELALEKDLRRRVKDELEGVTHELKESSVKNQSLQKELVEIYKKVETSNKELEEEKKTVLSLNKEVKGMEKQILMEREARKSLETDLEEAVKSLDEMNKNTSILSRELEKVNTHASNLEDEKEVLQRSLGEAKNASKEAKENVEDAHILVMSLGKEREVLEKKVKKLEEDLGSAKGEILRMRSQPDSVKAVNSTDNKEKSDNTVTVKKVVRRRKSSTSS

SEQ ID NO: 1527 - DNA, 849 bp, Arabidopsis thaliana
atgaggcctaaagcaaatcaaaaccacaagctgaaggttctccttgtttttcttcttgccaccttaattctcatcttcatcgtgagatcaactctgacatcttcacaggaacaccagactccacaagagacaagatcaacgcgttgctctggtgcctgcaataagctaccacgttccctcgcacaagccctgatccattactcgacctcagttatcacaccacaacaaacgctcaaagagatagcggtaagcagtagagtactcggcaagaagtcaccctgcaatttcttggtgtttggtctaggccatgacagcctcatgtggagctctctcaactatggaggccggactgtgtttcttgaagaagatgaagcatggataaaacagatcaagagacggtttccgatgctggaatcgtaccatgtaacatatgacagtaaagtcaatcaagccgataatctcatagaagtcggaaaaggacctgaatgcacagccattggagatccaaggtactcaatgtgtcaactagcactcaagggtttgcctgcagaaatttatgagaccggttgggatctaatcatggttgatgcaccgactggctactacgatgaggctcctgggagaatgacagcaatttacactgcgggaatgatggcaaggaacaggaaacagggaggagagactgatgtgtttgtgcatgatgttaacagggaaatagaagacaagttttctaaggctttcttgtgtgaagggtacatgaagaaacaggaagggagactaaggcattttattatccctagctatagagatggatcagaatcagaatcaaatagacccttttgtccatag

SEQ ID NO: 1528 - protein, 282 aa, Arabidopsis thaliana
MRPKANQNHKLKVLLVFLLATLILIFIVRSTLTSSQEHQTPQETRSTRCSGACNKLPRSLAQALIHYSTSVITPQQTLKEIAVSSRVLGKKSPCNFLVFGLGHDSLMWSSLNYGGRTVFLEEDEAWIKQIKRRFPMLESYHVTYDSKVNQADNLIEVGKGPECTAIGDPRYSMCQLALKGLPAEIYETGWDLIMVDAPTGYYDEAPGRMTAIYTAGMMARNRKQGGETDVFVHDVNREIEDKFSKAFLCEGYMKKQEGRLRHFIIPSYRDGSESESNRPFCP

SEQ ID NO: 1529 - DNA, 741 bp, Arabidopsis thaliana
atggctacttcaagaacattcattttctctaatctcttcatcttcttcctcgttatagccactacttatggtcaggctccagctccaggcccttcaggtccaacgaacataaccgcaatcctagaaaaggctggtcaattcacattgttcataagacttcttaaaagcactcaagcctcagaccaaatcaacactcagctcaattcttcctcgagtaatggcttaaccgtgtttgccccgactgataacgccttcaacagcctcaaatccggaaccttaaactcattgtctgaccaacaaaaagttcagcttgttcagttccatgtcttacctacactcataaccatgcctcagtttcaaaccgttagtaaccctttacgcacgcaagctggagatggccaaaacggtaaattccctcttaacatcactagctccggtaaccaagttaacatcaccactggagttgtcagcgccaccgtggctaactctgtctacagcgataagcagctggccgtttatcaggttgatcaagttttgctgccattagccatgtttggatcaagcgtggctcctgctccggcccctgagaaaggcggctctgtttcaaaaggctcagcttccggtggcgatgatggaggagattctactgattcatctgatgcagagaggactggattcgggtttgggatcagaatcactaccgttgcagccattgctgcttcttcttctctgtggatataa

SEQ ID NO: 1530 - protein, 246 aa, Arabidopsis thaliana
MATSRTFIFSNLFIFFLVIATTYGQAPAPGPSGPTNITAILEKAGQFTLFIRLLKSTQASDQINTQLNSSSSNGLTVFAPTDNAFNSLKSGTLNSLSDQQKVQLVQFHVLPTLITMPQFQTVSNPLRTQAGDGQNGKFPLNITSSGNQVNITTGVVSATVANSVYSDKQLAVYQVDQVLLPLAMFGSSVAPAPAPEKGGSVSKGSASGGDDGGDSTDSSDAERTGFGFGIRITTVAAIAASSSLWI

SEQ ID NO: 1531 - DNA, 843 bp, Arabidopsis thaliana
atggcgtcttcgtcgttctcagtcacatctccagctgctgctgcttccgtctatgcagtcactcaaacctcctcgcacttcccaatccaaaaccgctctcgcagagtttctttccgtctctctgctaagcccaagcttcgctttctctccaagcctagtcgcagtagctaccctgtggtgaaagcacaatctaacaaggttagtactggtgcatcatcaaatgctgccaaagttgatgggccatcatcagctgaaggaaaggagaaaaactcattgaaggagtcgtctgcttcttctcctgaattagctacagaagagtctatttctgagttccttacccaagtaacaactcttgtcaagcttgtggattcaagagacattgttgagttgcagttgaaacaactcgactgtgaactagtcattcgaaaaaaagaagccttacctcaacctcaagctcctgcatcttatgttatgatgcagcaaccaaatcaaccatcttatgcccagcaaatggctcctcctgctgcacctgctgctgccgcaccagccccttctacgccagcctctctgcctccaccatccccacctactccagccaaatcgtcacttcctactgttaaaagccccatggctggcacattctaccgtagtcctgcacctggtgaaccaccctttattaaggttggagacaaagtgcagaaggggcaagttctatgcattgttgaagccatgaagttaatgaatgaaatagagtctgaccataccggaaccgtagtcgatattgtcgcagaagacggcaagcctgtcagcctcgacactcctctgtttgtggttcaaccgtag

SEQ ID NO: 1532 - protein, 280 aa, Arabidopsis thaliana
MASSSFSVTSPAAAASVYAVTQTSSHFPIQNRSRRVSFRLSAKPKLRFLSKPSRSSYPVVKAQSNKVSTGASSNAAKVDGPSSAEGKEKNSLKESSASSPELATEESISEFLTQVTTLVKLVDSRDIVELQLKQLDCELVIRKKEALPQPQAPASYVMMQQPNQPSYAQQMAPPAAPAAAAPAPSTPASLPPPSPPTPAKSSLPTVKSPMAGTFYRSPAPGEPPFIKVGDKVQKGQVLCIVEAMKLMNEIESDHTGTVVDIVAEDGKPVSLDTPLFVVQP

SEQ ID NO: 1533 - DNA, 510 bp, Arabidopsis thaliana
atgtcgagtatatacagaactgtttcgagaaaagagaaaccgagacgtcatcatggattgacgacacagaagaagcaagagattaaggaagcttttgagctatttgacactgatggttctggtaccattgatgctaaagagcttaatgttgctatgagggcgcttggttttgaaatgacggaagagcaaatcaacaaaatgatagctgatgtggataaagatggaagtggagctatagattttgatgagtttgttcatatgatgactgctaagattggtgaaagagacacaaaagaagagctcactaaagcattccagatcattgatcttgacaaaaatgggaagatatctccggatgatatcaaacgcatggcaaaggacttgggtgagaatttcactgatgctgagatacgagagatggttgaagaagcagaccgagaccgtgatggtgaagttaacatggatgaattcatgaggatgatgaggagaactgcttatggtggtaactag

SEQ ID NO: 1534 - protein, 169 aa, Arabidopsis thaliana
MSSIYRTVSRKEKPRRHHGLTTQKKQEIKEAFELFDTDGSGTIDAKELNVAMRALGFEMTEEQINKMIADVDKDGSGAIDFDEFVHMMTAKIGERDTKEELTKAFQIIDLDKNGKISPDDIKRMAKDLGENFTDAEIREMVEEADRDRDGEVNMDEFMRMMRRTAYGGN

SEQ ID NO: 1535 - DNA, 813 bp, Arabidopsis thaliana
atgaaaatcctctcactttcactactcttgctcttggccgctacggtctcccacgtccagtcttcggcatccgttccagggctcatcgaactcctcgaatcgaacaccatctttgggaacgaagccgaactcttagagaaagagggactgtccatcaactaccccaactgcagaagctggcaccttggtgttgagacctctaacatcataaacttcgacacggtgcccgcaaattgcaaagcctatgttgaagactacttgatcacttccaaacagtaccaatacgactccaaaactgtaaacaaagaggcatatttttacgccaaaggacttgccctaaagaacgataccgtcaatgtttggatctttgacctagacgacactctcctctctagtattccctactacgctaaatatggatatgggaccgagaacacagccccgggggcgtactggtcgtggttagagtccggagaatcaactccaggactcccggagaccttgcatctatacgaaaacctcttggaactcgggattgaacccatcataatctctgacagatggaaaaaattgtcagaagtcactgtcgagaatctcaaggctgttggtgtaacaaaatggaagcatctcatactcaagccaaacggatcgaagttgacgcaagtggtgtacaagtcaaaggttaggaatagccttgtgaagaaagggtacaacatcgttgggaatattggagaccaatgggctgatttggttgaggatactcctggaagggtttttaagctcccaaatccactctactacgtaccttcttaa

SEQ ID NO: 1536 - protein, 270 aa, Arabidopsis thaliana
MKILSLSLLLLLAATVSHVQSSASVPGLIELLESNTIFGNEAELLEKEGLSINYPNCRSWHLGVETSNIINFDTVPANCKAYVEDYLITSKQYQYDSKTVNKEAYFYAKGLALKNDTVNVWIFDLDDTLLSSIPYYAKYGYGTENTAPGAYWSWLESGESTPGLPETLHLYENLLELGIEPIIISDRWKKLSEVTVENLKAVGVTKWKHLILKPNGSKLTQVVYKSKVRNSLVKKGYNIVGNIGDQWADLVEDTPGRVFKLPNPLYYVPS

SEQ ID NO: 1537 - DNA, 1659 bp, Arabidopsis thaliana
atggagctgaagtgggtttcttgtcggaaacaatctctgttcttgatctcttgtctggctctgctttgtctcgcgtccttggatactatatcatgtgaatcaactcagaatgctactgacttcaagaaacgatctcagacagtttcttgccctcctgattggatcattggaccgaaccaaaccaagtgctatgcttactttaaaaactctacttcatgggagaagtcagaaatgttctgtagaacttatggtggtcacttagcatcgcttgcatcgagcaaagaactcagctttgttcaaaaactatgcaatggaaatgttagcagttgttggattggaggacgaagtatgaattcttctacctcaggtttccgttggagctggtctgatcctaagactcctcaatggaaccaatccatgtttcctaaagttccaattcgcacccgctgtggcaatggcaacggcagttcatcgtgtcgtgctaatatatgtatagccgtgacaaatggttcatcatcaatattcggtgaaagatgtaatgcgtctcatgcttttgtttgcgctgttgattctgatatcaaatgtcgcaattgtcacaaatatctagttatcctcgctgttgtcagcggtttgattctcttcacgacattcgccattatattatggctccttgtctataagcgaagcaagaaacgccgaaaatcacgaaaagtatctaatccagcttcatcatcatcagtagttcctccttcatggaagatcttcactagtgaagaactgagatcaatgacgaagaacttcagtgaagcaaaccgtctagctggggacgcgaaaaccggtggaacctatagcggtggtttatcagacgggactaaagtggcggttaagagattgaaaaggtctagttttcagaggaagaaagagttctactccgagattagaagagcagctaaactttatcacccgaatgtagttgctataaaaggttgttgctatgatcatggagaacgtttcattgtttatgagttcatagctagtggacctctcgatagatggctacaccatgtgcctagaggtggtagaagcttggactggaacatgagattgaacatcgccacaactcttgctcaaggaatcgcgtttctacacgacaaggtcaagccacaagtggtgcaccgcgacatccgagctagcaacgtgctacttgatgaggagtttggagctcatttaatgggtgttggtctctcaaaattcgttccttgggaagtaatgcaagagagaaccgtaatggcgggtggaacctacggttacctcgcacccgaatacgtttacagaaacgagctaaccacgaagagcgatgtctacagtttcggagtccttttgcttgagattgtgagcggtcgtagaccaactcaggctgttaattcttcagttgggtggcagagcatattcgaatgggcaacaccattggttcaagctaaccgttggttagagattcttgatccggttattacatgcggtttaccggaagcatgtgtggttcagaaagttgttgacttggtttattcttgtactcagaatgtgccatcaatgcgtccaaggatgtcacatgtggttcatcagcttcagcaattggtccaacctttagaggttaagtag

SEQ ID NO: 1538 - protein, 552 aa, Arabidopsis thaliana
MELKWVSCRKQSLFLISCLALLCLASLDTISCESTQNATDFKKRSQTVSCPPDWIIGPNQTKCYAYFKNSTSWEKSEMFCRTYGGHLASLASSKELSFVQKLCNGNVSSCWIGGRSMNSSTSGFRWSWSDPKTPQWNQSMFPKVPIRTRCGNGNGSSSCRANICIAVTNGSSSIFGERCNASHAFVCAVDSDIKCRNCHKYLVILAVVSGLILFTTFAIILWLLVYKRSKKRRKSRKVSNPASSSSVVPPSWKIFTSEELRSMTKNFSEANRLAGDAKTGGTYSGGLSDGTKVAVKRLKRSSFQRKKEFYSEIRRAAKLYHPNVVAIKGCCYDHGERFIVYEFIASGPLDRWLHHVPRGGRSLDWNMRLNIATTLAQGIAFLHDKVKPQVVHRDIRASNVLLDEEFGAHLMGVGLSKFVPWEVMQERTVMAGGTYGYLAPEYVYRNELTTKSDVYSFGVLLLEIVSGRRPTQAVNSSVGWQSIFEWATPLVQANRWLEILDPVITCGLPEACVVQKVVDLVYSCTQNVPSMRPRMSHVVHQLQQLVQPLEVK

SEQ ID NO: 1539 - DNA, 804 bp, Arabidopsis thaliana
atggctggagaggagttgttgaaactgttcgagcaaaactggtcagagaggccaatcttcaagaaagacaaagagaatctgaatggaaaaagtagagagaagcgtggagaaaaagagattctagaggaacgacgagaagaagaagcactgaagaattttccggtgagctttcttgtagagagggctatgagtgacgagacgatgatgacgacgagttccaagacaagtttgtttagttcttcatcagatgatttgttcttgtctcctagatcggtcttacccgttaaaccaacgccgatgaagcttcagacgatcctctccggaaaagaagtcaacgcgttcacgattgcggaaagagagagactactttcagagaaggaagagcagaggaagaagaagaagaagaagagtaatgtgagaacaagaaagggaaagagtatgtcggatttggagtacgaggagcttaaagggtttatggatctaggttttgtcttttccgaggatgaccataaagactccgatctagtttcgattcttcctgggttacagagattggtgaagaaagatgatggagtaacaaaagaagaagaagaagaagaagaagaagacaaaatcggtggaaacagagcagcgagaccgtatttgtcggaagcgtgggatcattgtggaggaagaaaaggaaaaaaacaaatcacgccggagattaagtggagagttccggcgccggcggcggctagcgaagttgacttaaaagataatctaaggctttgggctcatgctgtggcctcgactattcgaagttaa

SEQ ID NO: 1540 - protein, 267 aa, Arabidopsis thaliana
MAGEELLKLFEQNWSERPIFKKDKENLNGKSREKRGEKEILEERREEEALKNFPVSFLVERAMSDETMMTTSSKTSLFSSSSDDLFLSPRSVLPVKPTPMKLQTILSGKEVNAFTIAERERLLSEKEEQRKKKKKKSNVRTRKGKSMSDLEYEELKGFMDLGFVFSEDDHKDSDLVSILPGLQRLVKKDDGVTKEEEEEEEEDKIGGNRAARPYLSEAWDHCGGRKGKKQITPEIKWRVPAPAAASEVDLKDNLRLWAHAVASTIRS

SEQ ID NO: 1541 - DNA, 2178 bp, Arabidopsis thaliana; identical to SEQ ID NO: 1351

SEQ ID NO: 1542 - protein, 725 aa, Arabidopsis thaliana; identical to SEQ ID NO: 1352

SEQ ID NO: 1543 - DNA, 1368 bp, Arabidopsis thaliana
atgggtggtttgaagtttcatgtacttatgtatccatggttcgcaacaggccatatgaccccgttcctttttcttgccaacaaattggctgagaaaggtcatacggtcacttttttgattcccaagaaagctctgaaacagttggaaaatctcaatctgtttccacacaacattgtctttcgctctgtcaccgtccctcatgtggatggtctccccgttggcacagagacagtctctgagatccccgtgacatcagctgatctcttgatgtctgctatggatctcacacgtgatcaagttgaaggtgtggtccgagccgtggaaccggacctgatcttctttgacttcgctcattggattccagaggtagctagagactttggccttaagactgtaaagtacgtcgtggtatctgcatcgactatagctagtatgcttgttccaggtggtgagttaggtgttcctccgccgggatatccttcatcgaaggtgctgcttcgtaaacaagatgcttacaccatgaagaatctggagtctacaaatacaatcaatgtcggaccaaacttattggaaagagtcactacaagtcttatgaactctgatgtcattgcgataaggacagccagagaaatcgaaggaaacttttgcgactatatcgaaaaacattgcaggaaaaaggttctcttgacaggtccggtgttccctgagccagacaagactagagagctagaggaacgatgggttaagtggctaagtgggtatgaaccagactcagtggtgttttgtgcgttgggctcacaagtcattttagagaaagatcaattccaagaactctgcttaggaatggagctaacaggttcaccgtttcttgtagcggttaagccacctagaggctcatcaacgattcaagaagcacttcctgaaggattcgaggagagggttaaaggaagaggagttgtttggggagaatgggttcaacaaccattgctattgtctcatccatcagtcgggtgctttgtgagccattgtgggtttggatcaatgtgggagtctttgctgagtgattgtcagatagtcttggtaccacagttgggtgatcaggtcctcaacacaagattgctgagtgacgaactcaaggtttcggttgaagtggcaagagaggaaacaggatggttctcgaaagagagcttgttcgatgctatcaatagtgtgatgaaaagggacagtgagatcgggaatctggtgaagaagaatcacaccaagtggagggagacactaactagtcctggacttgtgaccggttatgtcgataatttcatagagtcattgcaggatcttgtctctgggaccaaccatgtttcgaagtag

SEQ ID NO: 1544 - protein, 455 aa, Arabidopsis thaliana
MGGLKFHVLMYPWFATGHMTPFLFLANKLAEKGHTVTFLIPKKALKQLENLNLFPHNIVFRSVTVPHVDGLPVGTETVSEIPVTSADLLMSAMDLTRDQVEGVVRAVEPDLIFFDFAHWIPEVARDFGLKTVKYVVVSASTIASMLVPGGELGVPPPGYPSSKVLLRKQDAYTMKNLESTNTINVGPNLLERVTTSLMNSDVIAIRTAREIEGNFCDYIEKHCRKKVLLTGPVFPEPDKTRELEERWVKWLSGYEPDSVVFCALGSQVILEKDQFQELCLGMELTGSPFLVAVKPPRGSSTIQEALPEGFEERVKGRGVVWGEWVQQPLLLSHPSVGCFVSHCGFGSMWESLLSDCQIVLVPQLGDQVLNTRLLSDELKVSVEVAREETGWFSKESLFDAINSVMKRDSEIGNLVKKNHTKWRETLTSPGLVTGYVDNFIESLQDLVSGTNHVSK

SEQ ID NO: 1545 - DNA, 1191 bp, Arabidopsis thaliana
atgggattctggtcgttgttggaggtggcttctatgccggttattcaagttcttttcatgagtcttgtgggagctttcatggcctctgatcgttgcaagctcttccctgttgaagcccgtaattccatgaacaaggtggtgtttgtactatttgcaccggctctcatgtttgccaatctagctcagacggttacacttgaagacatcatctcatggtggtttatgccggtgaacatgggacttacatttctaatcggaggacttcttgggtggttggttgttaagattttgaaaccacctccttatcttgaaggtcttattgttgcaacttgttctgcaggaaatatggggaacctaccaatcatacttgtcccagcaatctgcgatgaggacaaaagtccttttggtaaccgaagtgtatgtagaaccgtcgggctctcttacgcgtctttctccatggcgctagggggtttctacatatggacatacacattccggctgattaaagggtccgcaatgaaagttcaagccatagaagaatctgagaaaatagcaattaaatcatccaatagtgacttagaagctgatcataagacccatctcctcggtgcaccggaagacaaggaaaacaaagtggtaaaggaaaagacagggttttggagaaaaggagtagacttcctccatgagatattggaggagcttcttgcaccacctacacttggtgcaattatcggtttcattttcggtgcagtaagatggctcagaaatcttatcataggtgatgatgctcctttacgaatagtacaaagcactgcaaaacttcttggagatgggaccattccctgtatgactattatactagggggaaacctcatacaaggtttacgttcttcggcagtcaaaccgatggttgtacttggaatagtctgtgttcggtacatagctatgccaattatcggtataggcattgtactaacagctgcaaatctcggatttcttccagctgatcctttgtttcagtatgttttgatgcttcagttcaccctcccgcctgccatgaatatcggtaccatgacacagctgtacaatgttgctcaagacgaatgctcagtgctcatgctttggacctacttggtcgcgatactggccctcactgtatggtccaccatcttccttcacttgttagtctaa

SEQ ID NO: 1546 - protein, 396 aa, Arabidopsis thaliana
MGFWSLLEVASMPVIQVLFMSLVGAFMASDRCKLFPVEARNSMNKVVFVLFAPALMFANLAQTVTLEDIISWWFMPVNMGLTFLIGGLLGWLVVKILKPPPYLEGLIVATCSAGNMGNLPIILVPAICDEDKSPFGNRSVCRTVGLSYASFSMALGGFYIWTYTFRLIKGSAMKVQAIEESEKIAIKSSNSDLEADHKTHLLGAPEDKENKVVKEKTGFWRKGVDFLHEILEELLAPPTLGAIIGFIFGAVRWLRNLIIGDDAPLRIVQSTAKLLGDGTIPCMTIILGGNLIQGLRSSAVKPMVVLGIVCVRYIAMPIIGIGIVLTAANLGFLPADPLFQYVLMLQFTLPPAMNIGTMTQLYNVAQDECSVLMLWTYLVAILALTVWSTIFLHLLV

SEQ ID NO: 1547 - DNA, 870 bp, Arabidopsis thaliana
atgtcagaattattacagttgcctccaggtttccgatttcaccctaccgatgaagagcttgtcatgcactatctctgccgcaaatgtgcctctcagtccatcgccgttccgatcatcgctgagatcgatctctacaaatacgatccatgggagcttcctggtttagccttgtatggtgagaaggaatggtacttcttctctcccagggacagaaaatatcccaacggttcgcgtcctaaccggtccgctggttctggttactggaaagctaccggagctgataaaccgatcggactacctaaaccggtcggaattaagaaagctcttgttttctacgccggcaaagctccaaagggagagaaaaccaattggatcatgcacgagtaccgtctcgccgacgttgaccggtccgttcgcaagaagaagaatagtctcaggctggatgattgggttctctgccggatttacaacaaaaaaggagctaccgagaggcggggaccaccgcctccggttgtttacggcgacgaaatcatggaggagaagccgaaggtgacggagatggttatgcctccgccgccgcaacagacaagtgagttcgcgtatttcgacacgtcggattcggtgccgaagctgcatactacggattcgagttgctcggagcaggtggtgtcgccggagttcacgagcgaggttcagagcgagcccaagtggaaagattggtcggccgtaagtaatgacaataacaatacccttgattttgggtttaattacattgatgccaccgtggataacgcgtttggaggaggagggagtagtaatcagatgtttccgctacaggatatgttcatgtacatgcagaagccttactag

SEQ ID NO: 1548 - protein, 289 aa, Arabidopsis thaliana
MSELLQLPPGFRFHPTDEELVMHYLCRKCASQSIAVPIIAEIDLYKYDPWELPGLALYGEKEWYFFSPRDRKYPNGSRPNRSAGSGYWKATGADKPIGLPKPVGIKKALVFYAGKAPKGEKTNWIMHEYRLADVDRSVRKKKNSLRLDDWVLCRIYNKKGATERRGPPPPVVYGDEIMEEKPKVTEMVMPPPPQQTSEFAYFDTSDSVPKLHTTDSSCSEQVVSPEFTSEVQSEPKWKDWSAVSNDNNNTLDFGFNYIDATVDNAFGGGGSSNQMFPLQDMFMYMQKPY

SEQ ID NO: 1549 - DNA, 447 bp, Arabidopsis thaliana
atggcgtcgaaaagaattaacaaagagcttagggacttgcaaagagatcctcctgtgtcctgcagtgcaggtcctacgggagatgatatgttccaatggcaagcaactatcatgggtccagcagatagcccgtttgccggaggtgtgtttcttgttaccattcacttcccaccagattaccctttcaagccaccaaaggttgccttccggaccaaggtttatcacccaaacatcaacagtaatggaagtatctgtcttgacattctgaaagagcagtggagccctgcacttaccgtatccaaggttcttctgtcgatatgctcattgctgacggatccaaaccctgacgatcctttggttcctgaaatagcgcacatctacaagacagaccgagtcaagtacgagtccacagctcaatcctggactcagaagtatgcaatgggatga

SEQ ID NO: 1550 - protein, 148 aa, Arabidopsis thaliana
MASKRINKELRDLQRDPPVSCSAGPTGDDMFQWQATIMGPADSPFAGGVFLVTIHFPPDYPFKPPKVAFRTKVYHPNINSNGSICLDILKEQWSPALTVSKVLLSICSLLTDPNPDDPLVPEIAHIYKTDRVKYESTAQSWTQKYAMG

SEQ ID NO: 1551 - DNA, 870 bp, Arabidopsis thaliana
atggctgcttcagcttcgtctctcgctctctcttccttcaaccctaaatctcttcctttcggcgtctccagacctgcctccgtttccctcttatctccttccctctcctttaaactcaattccgactccgtttccttctccatcgccgccaaatggaactctcccgcttctcgcttcgcccgtaacgttgcgattacctcagagttcgaggtggaagaagatggtttcgctgacgtcgctccgccaaaagagcaatctttctctgctgaccttaaactcttcgttggtaaccttcctttcaacgttgacagtgctcagctcgctcagctctttgagagtgccggaaatgttgagatggttgaggtaatctatgacaaaattacaggaagaagcagaggttttggattcgtgactatgtcttcagtttctgaagttgaggcagctgctcagcagttcaatggctatgagttggatggtagacctttgagagtcaatgctggtcccccaccaccaaagagggaagatggtttctccagaggacctaggagcagctttggaagctcaggttctggatatggaggaggtggtggttctggtgctggttcaggaaaccgtgtttatgtgggtaacctctcttggggagttgatgacatggctcttgagagtttgttctcggagcaaggaaaggttgttgaggccagagtcatctacgacagggacagtggtcgatccaagggttttggatttgtgacatacgactcttctcaagaggtccaaaatgccatcaagtccttggatggtgctgatttggacggtagacaaattagagtctcggaagctgaggctaggcctccaaggcgccaatattga

SEQ ID NO: 1552 - protein, 289 aa, Arabidopsis thaliana
MAASASSLALSSFNPKSLPFGVSRPASVSLLSPSLSFKLNSDSVSFSIAAKWNSPASRFARNVAITSEFEVEEDGFADVAPPKEQSFSADLKLFVGNLPFNVDSAQLAQLFESAGNVEMVEVIYDKITGRSRGFGFVTMSSVSEVEAAAQQFNGYELDGRPLRVNAGPPPPKREDGFSRGPRSSFGSSGSGYGGGGGSGAGSGNRVYVGNLSWGVDDMALESLFSEQGKVVEARVIYDRDSGRSKGFGFVTYDSSQEVQNAIKSLDGADLDGRQIRVSEAEARPPRRQY

SEQ ID NO: 1553 - DNA, 2010 bp, Arabidopsis thaliana
atggcttcgtacactcccaagaacattctcatcaccggagctgctggtttcattgcgtctcatgtcgccaacagactcatacgaagctatcctgattacaaaatcgttgtgcttgacaagcttgattactgttcaaatctcaagaatctcaatccttctaagcactctccgaacttcaagtttgtcaaaggtgatatcgctagtgctgacttggtgaatcatcttctcatcactgaaggtattgacaccatcatgcatttcgctgctcagactcacgtcgacaattccttcggtaacagtttcgagtttactaagaataatatctatggaactcatgtccttcttgaggcttgtaaagttactggtcagattaggaggtttattcatgttagtactgatgaagtttatggtgaaactgatgaggatgctcttgttggtaaccatgaggcttctcagctgcttccgacgaatccttactctgccacgaaagctggtgctgagatgcttgttatggcttatggtagatcttatggtttgcctgttattaccactcgtgggaataacgtctatggaccgaatcagtttcctgagaagttgattcctaagttcattttgctggcaatgagagggcaggttcttcccattcatggagatggatcaaatgtcaggagctacctctactgtgaagacgttgctgaggcttttgaagttgttcttcacaagggagaagttggccatgtttacaatattgggacgaagaaggagaggagagtgaatgatgttgccaaagacatctgcaaactcttcaacatggaccctgaggcgaacatcaagtttgtcgacaacagaccttttaacgatcagaggtacttccttgacgatcagaagctcaaaaagttgggatggtcagagagaaccacgtgggaagaagggttgaagaaaactatggattggtacacacagaacccggagtggtggggtgatgtttctggagcattgcttcctcatccaaggatgctgatgatgcctggtgggcgacactttgatggctccgaggacaattcgctggcagctactttatctgaaaaaccaagtcaaacccatatggttgttccaagccaaaggagcaacggcacacctcaaaagccttcgctgaagttcctgatatatggaaagaccggatggatcggtggtctgcttggaaagatatgtgataagcaaggaattgcttacgagtatgggaaaggtcggttggaggatcgatcttctcttctgcaggatattcagagtgttaagccaacccatgttttcaattccgctggtgtgactgggagacccaatgttgactggtgtgagtctcacaagaccgagactatccgtgccaatgtagctggcacattgactctagctgatgtctgcagagagcacggactcctaatgatgaatttcgctactggttgtatattcgaatatgacgacaagcatccggaaggttcaggaattggcttcaaggaggaagacacacccaacttcactggctctttctactcgaaaaccaaagccatggtcgaggagctgctaaaggagtatgacaacgtatgcacattgagggtaaggatgccgatctcctcggatctaaacaacccgcgcaacttcatcaccaagatctccaggtacaacaaagtagtgaacatcccaaacagcatgactgtgttggacgagttattaccaatctccatcgagatggcgaaaagaaacttgaaaggaatctggaacttcacaaacccaggtgtggtgagccacaacgagatcctagagatgtacagagactacatcaaccctgaattcaaatgggcaaacttcacattagaggagcaagctaaagtcattgtggctccaagaagcaacaacgagatggatgcttccaagctcaagaaagagttccctgagctactctctatcaaggagtctctgattaagtatgcatacgggccaaacaagaaaacctga

SEQ ID NO: 1554 - protein, 669 aa, Arabidopsis thaliana
MASYTPKNILITGAAGFIASHVANRLIRSYPDYKIVVLDKLDYCSNLKNLNPSKHSPNFKFVKGDIASADLVNHLLITEGIDTIMHFAAQTHVDNSFGNSFEFTKNNIYGTHVLLEACKVTGQIRRFIHVSTDEVYGETDEDALVGNHEASQLLPTNPYSATKAGAEMLVMAYGRSYGLPVITTRGNNVYGPNQFPEKLIPKFILLAMRGQVLPIHGDGSNVRSYLYCEDVAEAFEVVLHKGEVGHVYNIGTKKERRVNDVAKDICKLFNMDPEANIKFVDNRPFNDQRYFLDDQKLKKLGWSERTTWEEGLKKTMDWYTQNPEWWGDVSGALLPHPRMLMMPGGRHFDGSEDNSLAATLSEKPSQTHMVVPSQRSNGTPQKPSLKFLIYGKTGWIGGLLGKICDKQGIAYEYGKGRLEDRSSLLQDIQSVKPTHVFNSAGVTGRPNVDWCESHKTETIRANVAGTLTLADVCREHGLLMMNFATGCIFEYDDKHPEGSGIGFKEEDTPNFTGSFYSKTKAMVEELLKEYDNVCTLRVRMPISSDLNNPRNFITKISRYNKVVNIPNSMTVLDELLPISIEMAKRNLKGIWNFTNPGVVSHNEILEMYRDYINPEFKWANFTLEEQAKVIVAPRSNNEMDASKLKKEFPELLSIKESLIKYAYGPNKKT

SEQ ID NO: 1555 - DNA, 1431 bp, Arabidopsis thaliana
atggaggagccatttcttctgagagacgagcttctagtcccttctcaagtcacatggcatacaaatccattaaccgtcgagctaaagagagtgagccgcttggccgctcctatggccactgtgaccattgctcagtacttattgcctgtcatctcggtcatggtcgctggccacaacggcgagctccagctctccggtgtcgctcttgcaaactccttcacaaacgtcaccggttttagcattatgtgtggattagtgggtgcacttgaaactctttgtggccaagcttatggagccaaacaatatgaaaaaatcggaacttacgcatactctgctattgcttccaacataccaatttgtttcctcatatcaattctctggctttacatcgaaaagatcttgatttctctcggacaagaccctgaaatttcaagaatcgctggctcctacgccttttggcttataccggctttatttggccaagcgattgtcataccactgtcccggtttctgctaacacaagggttggttattcctctgctcttcactgccgtgaccacccttttgttccacgttttggtttgttggactttggttttcttgtttggtctgggatgtaatggacctgccatggctacaagtgtgtctttctggttttacgctgtgatactctcatgttatgtgagattctccagctcttgcgagaagactcgcggatttgtatcccgagattttgtgtcttctatcaagcagttcttccaatacggaatcccatcagctgcaatgatttgtctagaatggtggctatttgagatactcatactctgctcaggtcttctccctaacccgaaactcgagacctctgttctttcaatttgtcttacaatagaaactttgcactatgtgatttcagctggagtcgccgcggctgtgagcacacgtgtatcaaacaatttgggagctgggaatcctcaagttgctagggtttcagtattagcagggctttgtctctggatagtagagtcagctttctttagcatacttctattcacctgcaggaacatcataggatacgcattcagcaacagcaaagaagttttggactatgtagctgacctaactcctttgctctgcctctcctttatcctcgacggcttcacagcagttctaaatggagttgctaggggaagtggttggcaacacattggagcttggaacaatactgtttcttattatcttgtaggagctcctgttggaatttacttagctttcagtcgtgagttgaacggaaaaggactgtggtgcggtgttgtggttggatctactgtgcaagccactatactggctattgtcacagcttccataaattggaaggaacaggctgagaaggcaaggaagagaattgtctcaactgaaaacagattggcttaa

SEQ ID NO: 1556 - protein, 476 aa, Arabidopsis thaliana
MEEPFLLRDELLVPSQVTWHTNPLTVELKRVSRLAAPMATVTIAQYLLPVISVMVAGHNGELQLSGVALANSFTNVTGFSIMCGLVGALETLCGQAYGAKQYEKIGTYAYSAIASNIPICFLISILWLYIEKILISLGQDPEISRIAGSYAFWLIPALFGQAIVIPLSRFLLTQGLVIPLLFTAVTTLLFHVLVCWTLVFLFGLGCNGPAMATSVSFWFYAVILSCYVRFSSSCEKTRGFVSRDFVSSIKQFFQYGIPSAAMICLEWWLFEILILCSGLLPNPKLETSVLSICLTIETLHYVISAGVAAAVSTRVSNNLGAGNPQVARVSVLAGLCLWIVESAFFSILLFTCRNIIGYAFSNSKEVLDYVADLTPLLCLSFILDGFTAVLNGVARGSGWQHIGAWNNTVSYYLVGAPVGIYLAFSRELNGKGLWCGVVVGSTVQATILAIVTASINWKEQAEKARKRIVSTENRLA

SEQ ID NO: 1557 - DNA, 2190 bp, Arabidopsis thaliana
atggccaccgccgacgaattctccgacgaagatacatcaccgattgaagaagtccgtttaacggtaacaaacaccgacgatccaacactaccggtttggacattcaggatgtggttcttgggtctaatctcatgttctctcctctctttccttaaccaattcttctcgtaccgaaccgaaccgctcgtaatcactcaaatcacggttcaggtggctacactacctatcggtcatttcttggccaaggtgcttcccaaaacccggtttgggttacccggttgtggatcggcccggttctcgctgaacccgggtccgtttaacatgaaagagcatgttttgatatcgatatttgcgaatgcgggtagtgctttcggatccgggtcggcttatgcggttggtatcatcacaattattaaagctttttatggccggagtatctcttttattgccggctggctcctcatcatcactacacaggtattgggatatggctgggccggtttactgaggaaatatgtggtcgaaccggctcatatgtggtggcctagcactctggttcaagtgtcactgtttagggcattgcatgagaaggacgaccaaaggatgacgagagcaaaattctttgtgatagcattagtctgtagttttggatggtacatagtccctggctatctcttcacaacactcacaagcatctcatgggtttgttgggcatttccaagatcagtcactgctcaacagattggttctggaatgagaggtcttggtcttggagcctttacactagactggaccgcggttgcctctttcttgtttagtccacttatcagccccttcttcgccatcgctaatgttttcatcggttatgttcttttgatctacttcgtcttgcctttagcctattggggatttgattcttataacgctacgaggtttcctatattttcgtcgcatcttttcacatcggttggtaatacatatgatattcctgcgatcgtgaatgataactttgagctcgatttagctaagtatgagcaacaaggaaggattaacttgagcatgttctttgctcttacctatgggcttggtttcgccaccattgcttctacgctcactcatgtagctctcttctatggcaaggaaatttctgagaggtttcgagtttcatacaaaggcaaggaagatatacacactaggttaatgaagagatataaagacataccttcatggtggttttactcaatgttggctgcgacactacttatctctcttgcattatgtgttttcttgaacgatgaggttcaaatgccttggtggggacttgtgttcgcaagcgcgatggctttcgtcttcacactcccgataagcatcataaccgcaacaactaaccaaacaccgggattgaatataataacagagtacgcaatgggactcatttacccgggacgacctatcgcaaacgtatgcttcaaagtctatggatacatgagtatggcacaagcagtctctttcttaaatgacttcaaacttggtcattacatgaagatcccacctagatccatgttcttggttcaattcatcggtacaattcttgccggaacaatcaacataacggtcgcatggtggcagttaaactctatcaaaaacatatgtcaagaggaacttctacctcccaacagtccatggacatgtccgggtgaccgtgttttcttcgatgcatcggtcatttggggattggtcggaccaaaacggatttttggttctcagggaaactatgcggccatgaactggtttttcctcggaggtgcattaggaccagtcatagtgtggtcattgcacaaagcgttcccaaaacgttcttggattccacttgtaaatctccctgttcttctaggagcaaccgcaatgatgccacctgcgaccgcggtgaactacaactcgtggatattggtggggacgatattcaacttgtttgtgttccggtacaggaaaagttggtggcagaggtataactacgttctctcagccgctatggatgccggtgtagctttcatggcggttttgttgtacttctcggtggggatggaggaaaagagtttggactggtggggaacaagaggtgaacattgtgatctagctaaatgtccaaccgctagaggagtaattgttgatggttgtccggttaaataa

SEQ ID NO: 1558 - protein, 729 aa, Arabidopsis thaliana
MATADEFSDEDTSPIEEVRLTVTNTDDPTLPVWTFRMWFLGLISCSLLSFLNQFFSYRTEPLVITQITVQVATLPIGHFLAKVLPKTRFGLPGCGSARFSLNPGPFNMKEHVLISIFANAGSAFGSGSAYAVGIITIIKAFYGRSISFIAGWLLIITTQVLGYGWAGLLRKYVVEPAHMWWPSTLVQVSLFRALHEKDDQRMTRAKFFVIALVCSFGWYIVPGYLFTTLTSISWVCWAFPRSVTAQQIGSGMRGLGLGAFTLDWTAVASFLFSPLISPFFAIANVFIGYVLLIYFVLPLAYWGFDSYNATRFPIFSSHLFTSVGNTYDIPAIVNDNFELDLAKYEQQGRINLSMFFALTYGLGFATIASTLTHVALFYGKEISERFRVSYKGKEDIHTRLMKRYKDIPSWWFYSMLAATLLISLALCVFLNDEVQMPWWGLVFASAMAFVFTLPISIITATTNQTPGLNIITEYAMGLIYPGRPIANVCFKVYGYMSMAQAVSFLNDFKLGHYMKIPPRSMFLVQFIGTILAGTINITVAWWQLNSIKNICQEELLPPNSPWTCPGDRVFFDASVIWGLVGPKRIFGSQGNYAAMNWFFLGGALGPVIVWSLHKAFPKRSWIPLVNLPVLLGATAMMPPATAVNYNSWILVGTIFNLFVFRYRKSWWQRYNYVLSAAMDAGVAFMAVLLYFSVGMEEKSLDWWGTRGEHCDLAKCPTARGVIVDGCPVK

SEQ ID NO: 1559 - DNA, 771 bp, Arabidopsis thaliana
atgaagtttggtaagagtctcagcaatcagatcgagcaaactcttcctgaatggcaagacaagttcttgtcttacaaagaactcaaaaaacgactcaaactcatcggttccaaaaccgccgatcgtcccgttaaacgactccgtttagatgagttttccgtcggaatatcgaaagaagagatcaatttcatccaattgttagaagacgagttggagaaattcaacaatttcttcgttgagaaggaagaagaatatatcatcagactaaaggaatttagagatagaattgcgaaagctaaggattcaatggagaagatgataaaaatcaggaaggagattgttgatttccatggagaaatggttcttcttgagaattacagtgctcttaattacactggattggttaagatactgaagaagtatgacaaaagaactggtgatctcatgcgtttacctttcatccagaaagttcttcagcaacctttttacactactgacttattgttcaagcttgtcaaggaatctgaggcaatgcttgatcagatcttccctgctaacgaaactgagtctgagattatccaagcagagttatcagagcataagttcatggagagtcttcatatgaagagcacaatcgctgccttgcgggttttgaaggagatcaggagtggaagttctactgttagtgtgttttcattgccgcctctacagttaaatggcttagatgagacatggaagaagattccattgttggagcaagaagccaaatag

SEQ ID NO: 1560 - protein, 256 aa, Arabidopsis thaliana
MKFGKSLSNQIEQTLPEWQDKFLSYKELKKRLKLIGSKTADRPVKRLRLDEFSVGISKEEINFIQLLEDELEKFNNFFVEKEEEYIIRLKEFRDRIAKAKDSMEKMIKIRKEIVDFHGEMVLLENYSALNYTGLVKILKKYDKRTGDLMRLPFIQKVLQQPFYTTDLLFKLVKESEAMLDQIFPANETESEIIQAELSEHKFMESLHMKSTIAALRVLKEIRSGSSTVSVFSLPPLQLNGLDETWKKIPLLEQEAK

SEQ ID NO: 1561 - DNA, 783 bp, Arabidopsis thaliana
atggcctgttacatcgttccttattaccaccatcctgttttgtctcatcccaatagagaaatcttcagtcaccgtcaccaccaccaccaccgtttctgcaacaatctcttgaatagaagaattagtgttcctcgaagctccgctattagtgacggtggtgtctcctacaatactctagtctccgaggcggtgaggcttttggttccacaagcaaactttgattcttcaaagcttaaagttgagttcttaggagagttattggagaacaagagtaacggaggaattattacgccgcggacttatattctttcgcattgtgacttcactgctaacttaacgttaacaatctcaaacgttatcaatctggatcaactagaaggctggtacaagaaagatgatgtggttgctgagtggaagaaggtgaatgatgagctgcgtttacatattcattgttgtgtgagtggtatgagtttattgcaggatgttgctgctgagcttaggtatcatattttctccaaggaattgcctttggtacttaaagctgtggtgcatggagattcagttatgtttagagagaatcctgagctaatggatgcttatgtatgggtttatttccattcaagcacacctaagtacaatcggatcgagtgttggggacctcttaaggatgctgcgaagggaaagcagcagggcaatcatcaaggcttcttgagttcgacgacttcgaggaaattgattcgacataagtctatcttccataccttatttacgtttcttctgtga

SEQ ID NO: 1562 - protein, 260 aa, Arabidopsis thaliana
MACYIVPYYHHPVLSHPNREIFSHRHHHHHRFCNNLLNRRISVPRSSAISDGGVSYNTLVSEAVRLLVPQANFDSSKLKVEFLGELLENKSNGGIITPRTYILSHCDFTANLTLTISNVINLDQLEGWYKKDDVVAEWKKVNDELRLHIHCCVSGMSLLQDVAAELRYHIFSKELPLVLKAVVHGDSVMFRENPELMDAYVWVYFHSSTPKYNRIECWGPLKDAAKGKQQGNHQGFLSSTTSRKLIRHKSIFHTLFTFLL

SEQ ID NO: 1563 - DNA, 906 bp, Arabidopsis thaliana
atggcggatcgtgttaaaggtccatggagtcaagaagaagatgagcagctacgaaggatggttgagaaatacggaccgaggaattggtctgcgattagcaaatcgattccaggtcgatctggtaaatcgtgtagattacgttggtgtaatcagttatctccggaggttgagcatcgtcctttctcgccggaggaagatgagactattgtaaccgcccgtgctcagtttggtaacaagtgggcgacgattgctcgtcttcttaacggtcgtacggataacgccgttaaaaatcactggaactctacgcttaagaggaaatgcagcggaggtgtggcggttacgacggtgacggagacggaggaagatcaggatcggccgaagaagaggagatctgttagctttgattctgcttttgctccggtggatactggattgtacatgagtcctgagagtcctaacggaatcgatgttagtgattctagcacgattccgtcaccgtcgtctcctgttgctcagctgtttaaaccaatgccgatttccggcggttttacggtggttccgcagccgttaccggttgaaatgtcttcgtcttcggaggatccacctacttcgttgagtttgtcactacctggagctgagaacacgagttcgagccataacaataacaacaacgcgttgatgtttccgagatttgagagtcagatgaagattaatgtagaggagagaggagaaggacgtagaggtgagtttatgacggtggtgcaggagatgataaaagctgaagtgaggagttacatggcggaaatgcagaaaacaagtggtggattcgtcgtcggaggtttatacgaatccggcggcaatggtggttttagggattgtggagtaataacacctaaggttgagtag

SEQ ID NO: 1564 - protein, 301 aa, Arabidopsis thaliana
MADRVKGPWSQEEDEQLRRMVEKYGPRNWSAISKSIPGRSGKSCRLRWCNQLSPEVEHRPFSPEEDETIVTARAQFGNKWATIARLLNGRTDNAVKNHWNSTLKRKCSGGVAVTTVTETEEDQDRPKKRRSVSFDSAFAPVDTGLYMSPESPNGIDVSDSSTIPSPSSPVAQLFKPMPISGGFTVVPQPLPVEMSSSSEDPPTSLSLSLPGAENTSSSHNNNNNALMFPRFESQMKINVEERGEGRRGEFMTVVQEMIKAEVRSYMAEMQKTSGGFVVGGLYESGGNGGFRDCGVITPKVE

SEQ ID NO: 1565 - DNA, 1542 bp, Arabidopsis thaliana
atggcaggagggtcgtttggtccgaccggtgtggctaaggagagagcagaacaataccaagggaaagtcactagttatgttataatcgcttgccttgttgcagctattggtggatccatctttggatatgacattggaatctcaggaggagttacatcgatggatgagtttcttgaggagtttttccacacggtttatgagaagaagaagcaagctcatgaaagtaattactgcaaatatgataatcaaggcttagctgctttcacttcttcactctacttagctggtttggtttcgactctcgtggcttcacccatcactaggaactacggtaggcgtgcgagtattgtttgtggtggaatcagctttcttattggatctggtttgaatgctggagctgtgaacttagctatgcttcttgccggacggatcatgcttggtgttggtattggatttggaaatcaggcggttcctttgtatttatcagaagtggcaccaactcatctacgaggtggtttaaacatgatgtttcagctagctacaactatcgggatctttacagcgaacatggttaattacggtactcaacagcttaagccttggggatggagactctctcttggtttagctgcttttccagctctgcttatgacgcttggcgggtatttcttacccgagacaccaaacagtttggtcgaaagaggattaacagagagaggtcgacgagtcttagtgaagctaagaggaacagaaaacgtcaacgccgagcttcaagacatggtagatgcgagtgagcttgcgaattccatcaaacatccattcagaaacatcttgcagaaacgacacaggcctcagctagttatggctatttgcatgccaatgtttcagatactcacagggataaactccattctcttctacgcacctgttctgttccagacaatggggtttggaggaaacgcatctctctattcatcagctttaacaggagctgttcttgtcctatcaacatttatttccataggattagtagacagattgggacgaagagctcttctcataactggaggaatacaaatgataatctgtcaagtcatagtagcagtgatcttaggagtgaaatttggagacaaccaagagctatcaaaagggtactcagtgatcgtagtcatcttcatctgcctctttgttgtagcgttcggatggtcatggggtcctctaggttggaccatacctagcgaaatctttccgttagagactcgttcagcggggcagagtatcacagtagctgtaaatctcctcttcactttcatcatagctcaagctttccttggtctcctctgtgcattcaagtttggaatcttcctcttctttgctggttgggtgacagtaatgactatctttgtgtatttcctgttgcctgaaaccaaaggagttccaatagaagagatgacactcttatggagtaaacattggttctggaaaaaagtattacctgatgcaacaaatcttgaagatgagagcaagaatgtatctgtttaa

SEQ ID NO: 1566 - protein, 513 aa, Arabidopsis thaliana
MAGGSFGPTGVAKERAEQYQGKVTSYVIIACLVAAIGGSIFGYDIGISGGVTSMDEFLEEFFHTVYEKKKQAHESNYCKYDNQGLAAFTSSLYLAGLVSTLVASPITRNYGRRASIVCGGISFLIGSGLNAGAVNLAMLLAGRIMLGVGIGFGNQAVPLYLSEVAPTHLRGGLNMMFQLATTIGIFTANMVNYGTQQLKPWGWRLSLGLAAFPALLMTLGGYFLPETPNSLVERGLTERGRRVLVKLRGTENVNAELQDMVDASELANSIKHPFRNILQKRHRPQLVMAICMPMFQILTGINSILFYAPVLFQTMGFGGNASLYSSALTGAVLVLSTFISIGLVDRLGRRALLITGGIQMIICQVIVAVILGVKFGDNQELSKGYSVIVVIFICLFVVAFGWSWGPLGWTIPSEIFPLETRSAGQSITVAVNLLFTFIIAQAFLGLLCAFKFGIFLFFAGWVTVMTIFVYFLLPETKGVPIEEMTLLWSKHWFWKKVLPDATNLEDESKNVSV

SEQ ID NO: 1567 - DNA, 333 bp, Arabidopsis thaliana
atgagctcgtcgccgttatcttcatctctctttcatcctctgtcgaccttgtcgactcattgccatggtcggagacagaacctctgtttcaatcggaagcaacaacctttcgttgtcagagccgcaaaacttcctgaaggggtgatagtgccaaaagcacaacccaaatctcaacctgcgtttctgggattcacacaaacagctgagatatggaactcacgagcttgcatgattggtctcatcggtactttcatcgtcgaactgattctgaacaagggaatacttgaactgatcggtgtagagattgggaaaggactcgatcttcctctataa

SEQ ID NO: 1568 - protein, 110 aa, Arabidopsis thaliana
MSSSPLSSSLFHPLSTLSTHCHGRRQNLCFNRKQQPFVVRAAKLPEGVIVPKAQPKSQPAFLGFTQTAEIWNSRACMIGLIGTFIVELILNKGILELIGVEIGKGLDLPL

SEQ ID NO: 1569 - DNA, 1443 bp, Arabidopsis thaliana
atggtgaagatttgctgcattggagctggatatgttggtggtccaaccatggctgtcattgctctaaagtgtccatctgttgaagtagctgttgttgatatctctgtgccaaggatcaatgcctggaacagtgatcagttaccgatctatgagcctggtcttgatgatgtcgttaagcagtgccgtggaaagaatctcttcttcagcaccgatgttgagaaacatgtgagagaggctgacattgtttttgtgtctgtcaacacccctactaagacccgtggtcttggagctggcaaagctgcggatttgacttactgggagagcgctgctcgtatgattgccgatgtttcggtttccgacaagattgttgttgagaaatcaactgttcctgtcaaaaccgcagaggcaattgagaagattcttacacacaacagcaaaggaatcaaattccagattctgtcaaaccctgagttccttgctgaaggaaccgctattgaagaccttttcatgcctgaccgtgtcctcatcggtggtcgtgaaacaactgaaggctttgcagccgtcaaagccttgaaagacatttatgcccaatgggtccctgaagagagaatcctcaccaccaatctatggtctgccgagctttccaagcttgcagctaatgccttcctagcccagagaatctcatcagtcaatgcaatgtccgctctctgtgaggcaactggcgccaatgtctcagaggtctcttatgctgtgggcaaagactctcgtattggtcccaagttcttgaactctagtgttgggttcggaggatcttgtttccagaaagatattctcaacttagtctacatctgcgaatgcaacggcttacccgaagttgctgagtactggaaacaagtcatcaagatcaacgactaccagaaaacccgatttgttaaccgcattgtctcttcaatgtttaacacagtctccaacaaaaagattgcggttctcggcttcgctttcaagaaagacactggagacactagagagactccagccattgatgtctgcaaaggtctgttaggtgacaaggctcgtctcagcatctacgacccacaagtcactgaagagcagatccaaagagacttaaccatgaacaaattcgactgggaccacccacttcatctccagcccatgagccccaccactgtgaagcaagtctcagtcgcttgggacgcatacactgcaaccaaagacgcccacggtatctgcattttaaccgagtgggacgagttcaagaaacttgatttccagcggatctttgagaatatgcagaaaccggcttttgtttttgacggtagaaacgtggtcgacgctgataaactcagggagattgggtttattgtttactccattggtaagccattggaccagtggctcaaggacatgcctgctcttgcctaa

SEQ ID NO: 1570 - protein, 480 aa, Arabidopsis thaliana
MVKICCIGAGYVGGPTMAVIALKCPSVEVAVVDISVPRINAWNSDQLPIYEPGLDDVVKQCRGKNLFFSTDVEKHVREADIVFVSVNTPTKTRGLGAGKAADLTYWESAARMIADVSVSDKIVVEKSTVPVKTAEAIEKILTHNSKGIKFQILSNPEFLAEGTAIEDLFMPDRVLIGGRETTEGFAAVKALKDIYAQWVPEERILTTNLWSAELSKLAANAFLAQRISSVNAMSALCEATGANVSEVSYAVGKDSRIGPKFLNSSVGFGGSCFQKDILNLVYICECNGLPEVAEYWKQVIKINDYQKTRFVNRIVSSMFNTVSNKKIAVLGFAFKKDTGDTRETPAIDVCKGLLGDKARLSIYDPQVTEEQIQRDLTMNKFDWDHPLHLQPMSPTTVKQVSVAWDAYTATKDAHGICILTEWDEFKKLDFQRIFENMQKPAFVFDGRNVVDADKLREIGFIVYSIGKPLDQWLKDMPALA

SEQ ID NO: 1571 - DNA, 1140 bp, Arabidopsis thaliana
atggctacctcagagactcgagtcttgttcttatctttgtgtctcatccttggcaaagtagttttgtctcagtttgatgagttatggctagtaggggacgatgatccactcaacgccttgcagacgaggcgtgaaagaagagaggagaggtgtgattactcggtggggaaatggacgttcgatgaaacgtatccgctctatgattcaagctgtccatatctgagttctgcactaagttgccaaagaaatggaagacccgactcttattaccagaaatggagatggatccctaaggcttgttcactaccaaggtttgacgcattgaaatttcttgggaaaatgagaggaaaaagaataatgctggttggagattcaatgatgagaaaccagtgggaatctcttgtctgcttagtacagtctgttcttcccactcatcgtaagaagctcacttacaatggtcctacgatgtctttccattctctggattttgagacatcaattgagttttgttgggctcctctgcttgtggaactcaagagaggagttgaccgtaaaagggtgttacatttggactcaatcgaagacaatgctagatattggcgtggtgtagatgttcttgtattcgattccgctcactggtggactcactctcagagatggagttcgtgggattattacatggatgggaataagatcttcaaagctatggacccaatggttgcttatgagagaggactaaccacatgggctaaatgggttgagataaatcttgatccatccaaaacaaaagtcattttccgcactgtctcaccgagagagagtggtcagatgtgctacaaccagaaacatcccttgccttctttatcttcttccaccaaaccccacgtgcctcaacagtcaagagtgttgaacaaagtgctaaggacaatgaaataccgagtgtatttatacgatatcacaacaatgtctgcgtatagaagagacggtcatccttcggtgttcaagagagcaatgcacgaggaagagaagcaccatcgtatcgctggaccttcatcagattgcagtcattggtgcttgcccggtgtcccggatatttggaatgagatgctttcttcaattatcttaaccaatgctgtatga

SEQ ID NO: 1572 - protein, 379 aa, Arabidopsis thaliana
MATSETRVLFLSLCLILGKVVLSQFDELWLVGDDDPLNALQTRRERREERCDYSVGKWTFDETYPLYDSSCPYLSSALSCQRNGRPDSYYQKWRWIPKACSLPRFDALKFLGKMRGKRIMLVGDSMMRNQWESLVCLVQSVLPTHRKKLTYNGPTMSFHSLDFETSIEFCWAPLLVELKRGVDRKRVLHLDSIEDNARYWRGVDVLVFDSAHWWTHSQRWSSWDYYMDGNKIFKAMDPMVAYERGLTTWAKWVEINLDPSKTKVIFRTVSPRESGQMCYNQKHPLPSLSSSTKPHVPQQSRVLNKVLRTMKYRVYLYDITTMSAYRRDGHPSVFKRAMHEEEKHHRIAGPSSDCSHWCLPGVPDIWNEMLSSIILTNAV

SEQ ID NO: 1573 - DNA, 789 bp, Arabidopsis thaliana
atggcgtctccttcgcttctgcagtcttccgcttcttcgtttcacggacgtttctcaccattagcggctccatcctccgcacgaatgctctctccgccgctcagaaacgtggtgaaagtctcggcgtctggaactgtactggtcgagaaatctgaagccgagaaaactcaacgcctcaaaaccgcttacctcgagaggattatccctgcgctcaaagaagagttcaagtacgttaatattcaccaggttccaaaggtacagaagattgtagtgaattgtggtattggagatgcggcgcagaacgacaagggtttggaggctgcgatgaaggatatcgcgcttatcacagggcagaaacctattaagacacgagctagagcttccattgctactttcaagatcagggaagatcaacctcttgggattgctgtcactctcagaggagatgtaatgtactccttcttggatcgtcttatcaacttagcccttccgagaactcgagatttccaaggtgtgagtcccagtagctttgatgggaacggaaactacagtattggtgtgaaagaccaaggtgtattccctgaaatcaggtttgatgccgttggaaaaacgagaggaatggatgtatgcatcagcacaacggctaaaagcgatcaagaaggacagaaactattggctctaatgggaatgcctttcagggaaggaggtggtggcagcacaggcgcgatagtgcggaagaagaaactaaagtctcatcactttgatgctaaaggaaaaggaaagagatga

SEQ ID NO: 1574 - protein, 262 aa, Arabidopsis thaliana
MASPSLLQSSASSFHGRFSPLAAPSSARMLSPPLRNVVKVSASGTVLVEKSEAEKTQRLKTAYLERIIPALKEEFKYVNIHQVPKVQKIVVNCGIGDAAQNDKGLEAAMKDIALITGQKPIKTRARASIATFKIREDQPLGIAVTLRGDVMYSFLDRLINLALPRTRDFQGVSPSSFDGNGNYSIGVKDQGVFPEIRFDAVGKTRGMDVCISTTAKSDQEGQKLLALMGMPFREGGGGSTGAIVRKKKLKSHHFDAKGKGKR

SEQ ID NO: 1575 - DNA, 1752 bp, Arabidopsis thaliana
atgcagactccaaaacctaggccgggatcgttggaggtgcctcagaagaaatctcctgcatcaactcctaaaactgctcggaagctcaagacttcagaatccgaccctgtctcgtctcctaacacgaaaatcaggacaccgaaaactcaaagcccaaaagtagttgctgatcgccgttctccaagaacccctgtaaatgagattcagaagaaacggacaggaaaaacacccgaattggcatctcagatatctcagcttcaagaggagctaaagaaggcaaaggaacagctaagtgcttcagaagctctgaagaaggaagctcaagatcaagcagaggaaacaaagcagcagttaatggagattaacgcctctgaggattccaggatcgatgagcttcgcaagctctctcaagaacgagacaaagcgtggcagtctgaactcgaagcaatgcagagacagcatgccatggattccgctgctctatcatctaccatgaacgaggtccagaaactgaaagcacagctgtctgaatctgaaaatgttgagaacttaaggatggaacttaacgagacgttgtcacttgtcgagaagctcagaggtgagctgtttgatgcaaaggaaggggaagctcaggcgcatgaaattgtgtcgggaactgaaaagcaattagagatagccaacttgacgcttgagatgttacgttcagatggtatgaagatgtctgaagcttgtaattcactaacaactgagctagagcagtctaaatctgaggtaaggtcactagagcaacttgtgagacagcttgaggaagaagatgaagcccgaggaaatgctaacggggactcatcatcagtggaagagctcaaggaagagataaatgttgcaaggcaagagattagccagttgaaatctgcagtggaagtaacagagagaaggtaccatgaagagtatatccagagcacgttgcagatcagaactgcttatgaacaagtcgatgaagtaaaatccggatatgcacagagagaggctgagttgggggaagaactgaagaaaaccaaagctgaaagagattctttgcatgaacggttgatggataaggaagctaagctcaggatactcgtcgatgaaaacgagatactgaactcgaaaatcaaagaaaaagaagaagtatacttaaacttggagaacagcttgaaccagaacgagcctgaggataccggtgaactcaagaagctagaatccgatgtgatggagttgagagcaaatctaatggacaaggagatggagctacagagcgtaatgtcgcaatacgagagtctcaggagcgaaatggagacaatgcagagtgagaagaacaaggctatcgacgaggccttagcaaagctcgggagtctgacagaggaagcagataagagcgggaagagagccgaaaatgcgacagaacagctaggggcggcacaagtcaccaacaccgaactagaagctgagctgaggagactcaaggttcagtgtgatcaatggaggaaagcagctgaagccgcagctactatgctctctggtggtaacaacaacaataacagtaacgggaagtacgtggagagaacaggatcgttagagagtccgttgaggaggagaaacgtcaacatgtcgccttatatgggtgaaactgatgatgaattgtcatcaccaaagaagaagaatggaagtatgctgaagaaaattggtgtgttactgaagaaaagtcagaaatga

SEQ ID NO: 1576 - protein, 583 aa, Arabidopsis thaliana
MQTPKPRPGSLEVPQKKSPASTPKTARKLKTSESDPVSSPNTKIRTPKTQSPKVVADRRSPRTPVNEIQKKRTGKTPELASQISQLQEELKKAKEQLSASEALKKEAQDQAEETKQQLMEINASEDSRIDELRKLSQERDKAWQSELEAMQRQHAMDSAALSSTMNEVQKLKAQLSESENVENLRMELNETLSLVEKLRGELFDAKEGEAQAHEIVSGTEKQLEIANLTLEMLRSDGMKMSEACNSLTTELEQSKSEVRSLEQLVRQLEEEDEARGNANGDSSSVEELKEEINVARQEISQLKSAVEVTERRYHEEYIQSTLQIRTAYEQVDEVKSGYAQREAELGEELKKTKAERDSLHERLMDKEAKLRILVDENEILNSKIKEKEEVYLNLENSLNQNEPEDTGELKKLESDVMELRANLMDKEMELQSVMSQYESLRSEMETMQSEKNKAIDEALAKLGSLTEEADKSGKRAENATEQLGAAQVTNTELEAELRRLKVQCDQWRKAAEAAATMLSGGNNNNNSNGKYVERTGSLESPLRRRNVNMSPYMGETDDELSSPKKKNGSMLKKIGVLLKKSQK

SEQ ID NO: 1577 - DNA, 2907 bp, Arabidopsis thaliana
atggcgacggctacgacgactgctacggcggcgtttagtggtgtagtcagtgtaggaacggagactcgaaggatttattcgttttctcatcttcaaccttctgcggcttttccggcgaagcctagttccttcaaatctctcaaattaaagcagagcgcgaggctcacacggcggcttgatcatcggccgttcgttgtccgatgtgaagcttcttcttctaatggaaggcttacacagcaagaattcacagaaatggcgtggcaatcgatagtttcgtcaccagatgttgcaaaagagaataagcaacagattgtggagacagagcatctaatgaaagctcttttggagcagaagaatggtttagctcgtaggattttctctaagatcggtgtggataacacaaaggttctagaagcaacagagaagttcattcaacgccaaccaaaggtgtatggagatgctgctggttcgatgttggggcgtgatttggaagctctgttccagagagcaagacagtttaagaaagatttaaaggactcttatgtgtcagtggagcatttggttcttgcttttgctgatgataagcggtttgggaaacagttgtttaaggattttcagatatcagagaggagcttgaaatctgcaattgaatccattagagggaaacaatcagtcattgaccaagatccggaaggcaagtatgaggcgttggagaagtatggaaaagacttgacagcaatggcaagagagggaaaactagatcctgtgataggtagagatgacgagatccgaagatgcattcagattctctcaaggagaacaaagaacaaccctgtgttgatcggtgaaccaggtgttggtaaaactgcaatttcagaaggacttgctcagaggattgtgcaaggagatgtacctcaagcattgatgaacagaaagttgatatctcttgatatgggtgctctcattgctggagcaaagtatcggggagaattcgaagacagactaaaagctgtgcttaaggaagtcacagactcagaaggccaaatcattttgttcatcgatgagatccatacagttgttggtgcaggtgcgactaatggggccatggatgctggtaatctgctgaaaccgatgctgggccgaggcgagttacgttgtatcggtgcaaccacgcttgatgaatataggaaatacatagagaaagatccagccttggagcgtaggtttcaacaggtttatgttgatcaacctacggttgaagacacgatttctattctccgtggtttgcgggaaaggtatgaactacatcatggagttcgcatctcagatagtgctctagtggaagctgctatcctctcagaccgttacatcagtggccggtttctacccgataaagcaattgacttggtcgatgaagcggcagccaaattgaaaatggaaatcacttcgaaacctacagctcttgacgagcttgaccgttcggtaataaagcttgaaatggagaggctttcacttaccaatgatacagacaaagcttctagagagagattgaatcgaattgaaactgagttagtgctattaaaggagaaacaagctgagttaactgaacagtgggagcacgagaggtctgttatgtcccgtcttcagtcgattaaagaggagattgatcgagtaaacctcgagatccagcaggcggaacgtgaatacgatctcaaccgtgcagctgagctcaaatacggaagcttaaactcattgcagcgacagcttaatgaagcagagaaagagctgaacgagtacttaagctctgggaaatctatgttcagagaagaggttttgggtagcgatatcgccgagattgtgagtaaatggactggaatcccggtatcaaaacttcaacagtctgaacgagataagcttctacatttggaagaagaattgcataaaagagtagtcggtcaaaacccagcagtgactgcggtagctgaagcaatccaacgatcaagagctggtctttcggatccaggccgtcctatagctagtttcatgtttatgggaccaactggtgttggtaaaacagagctagccaaagcacttgcttcttatatgttcaacactgaagaagctttagtgagaattgacatgagtgaatacatggagaagcatgcggtgtctaggctcattggagctccacctggatatgttggttacgaagaaggaggacagttaacagaaacggttagaagaaggccttattcggtcattctatttgatgagattgagaaagctcatggagatgtcttcaatgtgtttctccaaatcttggacgatgggcgagtcacagattctcaaggacgtacagtgagtttcaccaataccgtcattattatgacctcaaatgttggttcgcagtttattctgaacaacacagatgatgatgctaatgagctctcttatgaaacgattaaagagagagtgatgaatgctgcaaggtcaatctttcgtcctgaattcatgaatagggttgatgagtatatagttttcaaacctcttgaccgcgagcagatcaaccgcattgtccggttacagctggcacgtgtgcagaagcgaattgcagacaggaaaatgaagataaacatcacggatgcagcagtcgatcttcttggaagcctagggtatgatccaaactatggagctagacctgttaagcgtgtgatacagcaaaacattgagaatgagcttgctaagggtatcttgagaggagatttcaaggaggaagatggcattttgatcgataccgaggtcacagcgttctccaatggccagttacctcagcaaaagctcacattcaagaagattgagtcagaaacagcagatgctgaacaagaagaagcagctttctcaaaatag

SEQ ID NO: 1578 - protein, 968 aa, Arabidopsis thaliana
MATATTTATAAFSGVVSVGTETRRIYSFSHLQPSAAFPAKPSSFKSLKLKQSARLTRRLDHRPFVVRCEASSSNGRLTQQEFTEMAWQSIVSSPDVAKENKQQIVETEHLMKALLEQKNGLARRIFSKIGVDNTKVLEATEKFIQRQPKVYGDAAGSMLGRDLEALFQRARQFKKDLKDSYVSVEHLVLAFADDKRFGKQLFKDFQISERSLKSAIESIRGKQSVIDQDPEGKYEALEKYGKDLTAMAREGKLDPVIGRDDEIRRCIQILSRRTKNNPVLIGEPGVGKTAISEGLAQRIVQGDVPQALMNRKLISLDMGALIAGAKYRGEFEDRLKAVLKEVTDSEGQIILFIDEIHTVVGAGATNGAMDAGNLLKPMLGRGELRCIGATTLDEYRKYIEKDPALERRFQQVYVDQPTVEDTISILRGLRERYELHHGVRISDSALVEAAILSDRYISGRFLPDKAIDLVDEAAAKLKMEITSKPTALDELDRSVIKLEMERLSLTNDTDKASRERLNRIETELVLLKEKQAELTEQWEHERSVMSRLQSIKEEIDRVNLEIQQAEREYDLNRAAELKYGSLNSLQRQLNEAEKELNEYLSSGKSMFREEVLGSDIAEIVSKWTGIPVSKLQQSERDKLLHLEEELHKRVVGQNPAVTAVAEAIQRSRAGLSDPGRPIASFMFMGPTGVGKTELAKALASYMFNTEEALVRIDMSEYMEKHAVSRLIGAPPGYVGYEEGGQLTETVRRRPYSVILFDEIEKAHGDVFNVFLQILDDGRVTDSQGRTVSFTNTVIIMTSNVGSQFILNNTDDDANELSYETIKERVMNAARSIFRPEFMNRVDEYIVFKPLDREQINRIVRLQLARVQKRIADRKMKINITDAAVDLLGSLGYDPNYGARPVKRVIQQNIENELAKGILRGDFKEEDGILIDTEVTAFSNGQLPQQKLTFKKIESETADAEQEEAAFSK

SEQ ID NO: 1579 - DNA, 1143 bp, Arabidopsis thaliana
atgtctttgctctctcctcttcctctgctccactcattctcctccaccgtcgccacaaaatccaccgcctctagaatcactgccacgccgtcgaaaatccgcttctctgtcataaacgccacgtcggagaatggaaacagcggtggtagtaaaaacgatcgtgatgaggatccatcttttaacccatttggtttcgttacagacaacccgtctagccggagtgcaattcagttaccagagtctccggcggaagacggcaatgtcggccaaatgctctacaggactgaagataaaggtaaagagtatggctcaactatcaaatctgggaagcttagatggtttgtgagagagactggatcaaaggagagtcgtcgaggaaccattgtatttgttcatggagctcctactcagtcttttagctacagaactgtcatgtctgagttgtcagatgctggatttcattgctttgcacctgactggataggattcggattcagtgacaaaccgcagcctggatacggttttaattacacagaaaaagagtaccatgaggcgtttgataaactgcttgaagtgctagaggtcaaatctcctttctttcttgttgttcagggatttcttgtaggttcatatggtttaacttgggctttgaaaaatccaagcaaggttgagaaactcgcgatccttaatagtccgctgaccgtttcatccccagttcccggattatttaagcagctgaggattcccctgtttggtgaattcacctgccaaaatgctatcttggccgagcggttcattgaaggaggtagcccctacgtcctgaagaatgagaaagctgatgtgtatcgtctaccatatttgtcaagcggagggcctggctttgccttgctcgagactgcgaagaagatcaactttggagacacattgagtcaaattgcaaatgggttttcatcaggcagctgggataaacctacgcttctggcttggggaatagctgataaatatctgcctcagtctatagcagaggaatttgagaaacagaacccccaaaatgttaagcttcgactcatcgaaggtgctgggcatttgcctcaagaagactggccagagaaagtagttgctgccctccgagcatttttctga

SEQ ID NO: 1580 - protein, 380 aa, Arabidopsis thaliana
MSLLSPLPLLHSFSSTVATKSTASRITATPSKIRFSVINATSENGNSGGSKNDRDEDPSFNPFGFVTDNPSSRSAIQLPESPAEDGNVGQMLYRTEDKGKEYGSTIKSGKLRWFVRETGSKESRRGTIVFVHGAPTQSFSYRTVMSELSDAGFHCFAPDWIGFGFSDKPQPGYGFNYTEKEYHEAFDKLLEVLEVKSPFFLVVQGFLVGSYGLTWALKNPSKVEKLAILNSPLTVSSPVPGLFKQLRIPLFGEFTCQNAILAERFIEGGSPYVLKNEKADVYRLPYLSSGGPGFALLETAKKINFGDTLSQIANGFSSGSWDKPTLLAWGIADKYLPQSIAEEFEKQNPQNVKLRLIEGAGHLPQEDWPEKVVAALRAFF

SEQ ID NO: 1581 - DNA, 1995 bp, Arabidopsis thaliana
atggcgagctccgatgctctcttgccaatctccgccagagaagaagaaccattatgtccttacacgagattaccaatggccgacccgaatcaagaaacccatggcccccggagaagaagaccctttaaaggtctcctcgccgtctcatttggtctcttgttcatcgccttttacgtcgctctcatcgccacacacgacggatctagatccaacgacgaagggatcgatgaaacagagacgataacgtcacgtgcacgtcttgctggtgtgtcggagaaacgtaacgatgggttatggaaactttccggtgatcggaacacgccggcgtttgaatggaacaatagtatgttgtcgtggcaacgaacggcgtttcattttcagcctgagcaaaattggatgaacgatcctaacggtccattgttctacaagggatggtaccatttcttctaccaatataacccaaacgcagccgtatggggtgacattgtttggggtcacgccgtgtctagggacctaatccattgggtccatttgcccatagccatggtcgctgatcaatggtacgactccaacggtgtgtggaccggctcagccacatttctccctgatggctctatagtcatgctctataccggttccaccgacaaagcggtgcaggtccaaaaccttgcctaccctgaagaccccaacgacccacttctgttgaaatgggtcaagttcccggggaacccggttctagtacctccgcccggtatcctccctaaggacttccgtgacccaacgactgcatggaagacatcagaaggaaaatggcggatcacgattggttccaagctcaacaaaactggaatctcactcgtgtacgacacaatcgactttaaaacatacgagaaacttgacacattgttgcaccgagttcccaacactggaatgtgggagtgtgttgacttttacccggtgtctaagactgcgggcaatgggcttgacacatcggtcaatggaccggatgtgaagcatatcgtgaaggctagcatggacgacacgaggttcgatcattatgctgtaggcacgtatttcgattcaaacggaacatggatccccgatgatcctactatcgatgttgggatgactgccagtttaagatatgattacggaaagttctatgcttcaaagtcgttttacgaccagaacaagggtcgaagagtcttgtggagttggattggtgagtctgatagtgaggcttctgatgtacaaaagggttggtcttctctccagggtatcccaagaaccgttgtcctcgacacaaagacaggaaagaacttggttcaatggccagtagaagaaatcaaatctcttagactaagcagcaagcaatttgatctcgaggtcggtcccgggtcagtggtaccggtcgatgtaggttccgcagctcagctagacatcgaagcagaattcgagattaacaaagaatctctagacaaaatcatcggaaacgcttcggtagtggctgaagccgaggaatttagctgcgaaaaaagcggaggctccaccgtccgtggtgctttagggccattcggattctcggtacttgccacagagagcttgtctgagcaaacaccggtttacttctatgtagctaagggaaaagattcagagctcaaaactttcttctgcacagacacctcaaggtcatctgttgcaaacgatgtcgttaaaccgatatacggtagcgtcgtaccggttctaaaaggggagaaactgaccatgagaattttggtggatcattcgatagtagaagcattcggacaaggtggaagaacatgtataacatcaagagtctatccaacaactgcaatctatggagcagccaagctcttcttgttcaataatgctcttgatgcgacggttacggcgtcgtttacagtttggcaaatgaacagtgcttttattcatccttactctgacgaagctgtccgtgctctctcccgtacctga

SEQ ID NO: 1582 - protein, 664 aa, Arabidopsis thaliana
MASSDALLPISAREEEPLCPYTRLPMADPNQETHGPRRRRPFKGLLAVSFGLLFIAFYVALIATHDGSRSNDEGIDETETITSRARLAGVSEKRNDGLWKLSGDRNTPAFEWNNSMLSWQRTAFHFQPEQNWMNDPNGPLFYKGWYHFFYQYNPNAAVWGDIVWGHAVSRDLIHWVHLPIAMVADQWYDSNGVWTGSATFLPDGSIVMLYTGSTDKAVQVQNLAYPEDPNDPLLLKWVKFPGNPVLVPPPGILPKDFRDPTTAWKTSEGKWRITIGSKLNKTGISLVYDTIDFKTYEKLDTLLHRVPNTGMWECVDFYPVSKTAGNGLDTSVNGPDVKHIVKASMDDTRFDHYAVGTYFDSNGTWIPDDPTIDVGMTASLRYDYGKFYASKSFYDQNKGRRVLWSWIGESDSEASDVQKGWSSLQGIPRTVVLDTKTGKNLVQWPVEEIKSLRLSSKQFDLEVGPGSVVPVDVGSAAQLDIEAEFEINKESLDKIIGNASVVAEAEEFSCEKSGGSTVRGALGPFGFSVLATESLSEQTPVYFYVAKGKDSELKTFFCTDTSRSSVANDVVKPIYGSVVPVLKGEKLTMRILVDHSIVEAFGQGGRTCITSRVYPTTAIYGAAKLFLFNNALDATVTASFTVWQMNSAFIHPYSDEAVRALSRT

SEQ ID NO: 1583 - DNA, 1560 bp, Arabidopsis thaliana
atggacgaaagacccgagacagagctaatatcaataccagccacaccacgagtttcaacaccggagattctaactccctccggtcaaagatcacctcgtccggccaccaaaccatcgtcggcgacatggactccgacttcgttcatatcaccgaggttcttgagtccgattggtacaccaatgaaacgagttcttgtgaacatgaaagggtatcttgaagaagttggtcatctcactaagctaaacccacaagatgcttggcttccaatcactgaatctcgtaatggaaacgctcattacgctgcttttcacaatctcaacgctggtgttggttttcaagcccttgttcttcccgtcgcgtttgcgtttcttggctggagttggggaatactgtctttaacaatagcatattgctggcaactctacacactgtggattctggttcagttgcacgaagctgtccccgggaaacgctacaatcgatatgtcgagcttgcacaagctgcttttggagaaaggttaggagtatggcttgcattgtttcctacggtttacttatcagcaggaaccgcgacagcgctgattctgatcggtggagagacaatgaaactcttcttccagatagtttgcggtccattatgcacctcgaatccgttaacaacagttgaatggtatttggtgtttacatctctctgcatcgttctgtctcagctaccaaacctcaattctattgcgggactctccttaataggagcagtgactgcaataacttactccacaatggtttgggttctctctgtgagccaaccaagaccagccactatctcatacgagcctctttctatgccttcgacttctggttcactcttcgctgttttgaatgctcttggcattatagcttttgccttcagaggtcacaacttggttttggaaattcagtcgacgatgccatcaacgtttaagcatcctgctcacgtaccaatgtggagaggagccaaaatctcttacttcctcattgctctgtgtatctttccaatctccatcggaggcttttgggcttatgggaaccttatgccttcaggaggtatgcttgctgctttgtatgcattccacattcacgatatcccgagaggcttattagcgacggcatttctcctagtagtcttcagctgcttgagcagttttcagatatactccatgcctgcctttgacagctttgaagctggctacacaagcagaaccaacaagccgtgttcgatttgggtcagatcaggtttccgagtcttttttggttttgtctcgtttttcatcggtgttgctctcccttttctgtctagtcttgcggggttgctcggtggactcactctcccggtcacatttgcttatccttgcttcatgtgggtcttgattaagaaaccggcgaaatacagtttcaattggtatttccattggggattaggttggttgggagttgcattcagcttggcattctccataggtgggatctggagtatggttaccaatggacttaagctcaagttcttcaagccgcctaactaa

SEQ ID NO: 1584 - protein, 519 aa, Arabidopsis thaliana
MDERPETELISIPATPRVSTPEILTPSGQRSPRPATKPSSATWTPTSFISPRFLSPIGTPMKRVLVNMKGYLEEVGHLTKLNPQDAWLPITESRNGNAHYAAFHNLNAGVGFQALVLPVAFAFLGWSWGILSLTIAYCWQLYTLWILVQLHEAVPGKRYNRYVELAQAAFGERLGVWLALFPTVYLSAGTATALILIGGETMKLFFQIVCGPLCTSNPLTTVEWYLVFTSLCIVLSQLPNLNSIAGLSLIGAVTAITYSTMVWVLSVSQPRPATISYEPLSMPSTSGSLFAVLNALGIIAFAFRGHNLVLEIQSTMPSTFKHPAHVPMWRGAKISYFLIALCIFPISIGGFWAYGNLMPSGGMLAALYAFHIHDIPRGLLATAFLLVVFSCLSSFQIYSMPAFDSFEAGYTSRTNKPCSIWVRSGFRVFFGFVSFFIGVALPFLSSLAGLLGGLTLPVTFAYPCFMWVLIKKPAKYSFNWYFHWGLGWLGVAFSLAFSIGGIWSMVTNGLKLKFFKPPN

SEQ ID NO: 1585 - DNA, 528 bp, Arabidopsis thaliana
atggaagaagaaaagagattggagctaaggctagctcctccttgtcaccaattcacttccaacaacaacatcaatggatctaaacaaaaaagctcgaccaaagaaacatcattcctttccaataacagggttgaggtagctccagtggtgggatggccgccggtgagatcatcccggagaaacctaacggcacaactaaaggaggagatgaagaagaaggagagtgatgaagagaaggaattgtacgttaagatcaacatggaaggagttccaataggaagaaaagtcaacctttcagcttataacaactaccaacagctttcacatgccgttgaccaactcttctctaagaaagattcgtgggatctaaacagacaatacactttggtctacgaagacactgaaggagataaagttctggtcggggatgttccttgggagatgtttgtatctactgtaaagaggttgcatgttttaaagacctcccacgccttctcactctcacctagaaaacatggcaaggaatag

SEQ ID NO: 1586 - protein, 175 aa, Arabidopsis thaliana
MEEEKRLELRLAPPCHQFTSNNNINGSKQKSSTKETSFLSNNRVEVAPVVGWPPVRSSRRNLTAQLKEEMKKKESDEEKELYVKINMEGVPIGRKVNLSAYNNYQQLSHAVDQLFSKKDSWDLNRQYTLVYEDTEGDKVLVGDVPWEMFVSTVKRLHVLKTSHAFSLSPRKHGKE

SEQ ID NO: 1587 - DNA, 2049 bp, Arabidopsis thaliana
atggagtcaatccactgcaatagtttactaaaccctaatttctccttaaaccagcgtcgtcggaggattaatcacgctgttcttaatcggagagatgctcttttgcgatccctcaacgccgtggagttgcggcggagcaggacgttctcggctgtacggacttctaatttctcagttactgcggcggcgacggatgttggtggtcggaattcgacggatgcatcggtaatgacaacggcgatgagcggggtggagagaggtgtgcgagtagggaaatcgagctccgcgcttgagcagctagatattgagcgaggcgtttgcgttccattccgaaagtattctccggagactgtgaggagtaaagtgctggaatcaagaggagcagtcgtgtctctagtttcaaggggtgtggagattgtttggactcttgggttgtattggtctaccttaacgtatgattttttggttggaagggatgaggaagttgtcccctttcgtgctaggcagcttaggaacctgttgtgcaatttgggaccttcatttatcaaagctggacaagttctcgcaaataggcctgatatcatccgtgaagactacatgaacgagctctgcatactccaagatgatgttcctccattcccaaacgaggttgctttcaatatcatcgaggaagagttaggccaacctcttgagaacatatttagcaagatttcttcacaaacaatagcagctgcaagcttaggacaagtttatcgagctactctacgtgccactggagaggatgttgctatcaaggtgcagagaccacaaatagagcctataatttaccgggatctctttcttttccgaaccctcgcctccttcttaaatggcttcagtctacagaaactgggttgcaacgcagagctaatagttgatgaatttggagaaaagcttttggaggagcttgactacaccttggaagccagaaacattgaagactttctggagaacttcaaagatgaccccacagtcaaaattcctggagtatacaagaatctttgtggtccgcgggttctggtaatggagtggattgatggtattcggtgcactgacccacaggccatcaaggatgcagggattgatttaaatggattcttgactgttggcgtaagtgctgctctaaggcagctgttggaatttggattgttccatggagatccacatcctggaaatatctttgcaatgcaagatgggcgtatcgcttatgtggacttcggtaatgttgctgtactgagtcagcaaaacaagcaaattttgattgatgctgttgttcatgcggttaatgaggactatggggagatggcaaatgatttcactaggcttgggttcttggccaaggataccgatgtttctcctatcgttccagctttagaagccatctggcagaactctgcagggaaaggacttgcagatttcaatttccgaagtgttacaggacaattcaacaagcttgtgtacgactttcccatccgtatcccagagcggttctctcttgttattcgttctctgcttacgcaggagggtatatgtttcacactgaagcctgattttaaatttctagaggttgcttatccatatgtagcaaaacggctcctaacggatccaaatcctgcacttcgggaacgcttgatacaggttctattcaaagatggtgttttccaatggaaaaggctagaaaaccttttatcacttgcaaaggaaaacgtcgccaagatgagtagcaatcctaatctacgagtaaagcgtgtggagagtaagcttgacttgacagataccattaaggacggagctcgtcttttcctccttgacgaaggcatccgcaggaaacttattcttgcactcacagaggactcgaagcttcatgtagaagagcttgtggacgtatacagattggttgaagacgaagtagatattcccacactggccatgcaagtcgtgcaagatttaccgaatgttttccgagattttgtgttgtcatggagcaactcagtattatccgacagatga

SEQ ID NO: 1588 - protein, 682 aa, Arabidopsis thaliana
MESIHCNSLLNPNFSLNQRRRRINHAVLNRRDALLRSLNAVELRRSRTFSAVRTSNFSVTAAATDVGGRNSTDASVMTTAMSGVERGVRVGKSSSALEQLDIERGVCVPFRKYSPETVRSKVLESRGAVVSLVSRGVEIVWTLGLYWSTLTYDFLVGRDEEVVPFRARQLRNLLCNLGPSFIKAGQVLANRPDIIREDYMNELCILQDDVPPFPNEVAFNIIEEELGQPLENIFSKISSQTIAAASLGQVYRATLRATGEDVAIKVQRPQIEPIIYRDLFLFRTLASFLNGFSLQKLGCNAELIVDEFGEKLLEELDYTLEARNIEDFLENFKDDPTVKIPGVYKNLCGPRVLVMEWIDGIRCTDPQAIKDAGIDLNGFLTVGVSAALRQLLEFGLFHGDPHPGNIFAMQDGRIAYVDFGNVAVLSQQNKQILIDAVVHAVNEDYGEMANDFTRLGFLAKDTDVSPIVPALEAIWQNSAGKGLADFNFRSVTGQFNKLVYDFPIRIPERFSLVIRSLLTQEGICFTLKPDFKFLEVAYPYVAKRLLTDPNPALRERLIQVLFKDGVFQWKRLENLLSLAKENVAKMSSNPNLRVKRVESKLDLTDTIKDGARLFLLDEGIRRKLILALTEDSKLHVEELVDVYRLVEDEVDIPTLAMQVVQDLPNVFRDFVLSWSNSVLSDR

SEQ ID NO: 1589 - DNA, 954 bp, Arabidopsis thaliana
atggcaagtgaaacagagaacatcaagtatgaagagagtttcatcaagaacactcgaggaatgaaactgttcacgtgcaaatgggtaccagcaaagcaagagccaaaggctttagtctttatttgccatggatatgcaatggaatgtagcatcaccatgaacagtactgcgaggaggctggtgaaagcaggatttgcggtatatggaattgattacgaagggcatggaaaatctgatgggcttagtgcttatgtcccaaactttgaccatctcgttgatgatgtctctactcactacacaagcatttgcgagaaagaagagaataaagggaagatgaggttcttgttaggagaatcaatgggaggagcagtgcttttgttgttacacagaaagaagcctcagttttgggatggggctgtcttggttgctccaatgtgtaagattgctgaagaaatgaaaccaagccctttggtaatttcgatattggccaaacttagtggagtgataccttcgtggaaaatcatccctggccaagatatcattgagactgcttttaagcagccagaaatcaggaaacaggttagggaaaatccctactgctacaagggacgtccacgtttgaagactgcttatgagcttttgagggttagcaccgatctcgagaagaggcttaatgaggtttcattaccgttcatagttttgcacggtgaagacgataaagtcacagataaagcggtgagtcgacaactgtatgaagttgcatctagttcggacaagactttcaagttgtaccctgggatgtggcatggtttactctatggagagacaccagagaatatcgagactgtttttgctgacatcattggctggttggataagaaagttgctgatgaaagtggaggctttgaatccgagcttaaacgtaaaaatgatggtattcctttgaaagggtag

SEQ ID NO: 1590 - protein, 317 aa, Arabidopsis thaliana
MASETENIKYEESFIKNTRGMKLFTCKWVPAKQEPKALVFICHGYAMECSITMNSTARRLVKAGFAVYGIDYEGHGKSDGLSAYVPNFDHLVDDVSTHYTSICEKEENKGKMRFLLGESMGGAVLLLLHRKKPQFWDGAVLVAPMCKIAEEMKPSPLVISILAKLSGVIPSWKIIPGQDIIETAFKQPEIRKQVRENPYCYKGRPRLKTAYELLRVSTDLEKRLNEVSLPFIVLHGEDDKVTDKAVSRQLYEVASSSDKTFKLYPGMWHGLLYGETPENIETVFADIIGWLDKKVADESGGFESELKRKNDGIPLKG

SEQ ID NO: 1591 - DNA, 2037 bp, Arabidopsis thaliana
atgactacgccggagggggcgatgtatgtggcgtgggaggatcttacggtggtgataccaaacttcggtgaaggagcaactaagagattactgaatggagtgaatggttgtggtgagccaaataggatcttagctattatgggtccttcaggttcaggcaaatctacgcttcttgatgctttagcaggaagattagcagggaatgttgtaatgagtggcaaagtacttgtcaatggcaagaagagaagacttgactttggtgctgccgcttatgtgacgcaagaagatgtgttgctaggaactttgacagtgagagaatccatatcttactcggctcatctcaggctcccttcaaagcttaccagagaagagatcagtgacattgtggaagctacaatcactgacatgggtcttgaagaatgttcagacaggaccattggaaactggcatttgcgtggaataagcggaggagagaagaaacggcttagtattgccctcgaggtcttaacaaaaccaagtctcctctttctagacgaaccaactagtggactggacagtgcttcagctttcttcgtggttcagattcttagaaacatagcaagcagtggcaaaactgtggtttcttcgatccatcagccgagtggtgaggttttcgccctctttgatgacctgctacttctgtctggaggagaaactgtttactttggcgaagcagaatctgcaacaaagttctttggtgaagcaggttttccttgtccaagtagacggaatccatcagaccacttccttcgctgtgtcaattccgatttcgataatgtcacagcggctttggttgaatctcggagaatcaacgattcatctttctctcttcaccaactacatgaaactacaaacacattagatcctctggatgatataccaactgcagaaattagaacaacacttgtcagaaaatttaagtgttcactttatgcagcagcttcaagagcaagaattcaagaaatagcatcgatagtggggattgtcacagaaaggaaaaaggggagccaaactaattggtggaaacaactcagaatacttactcagcgatctttcatcaacatgagtagagacttggggtactactggatgcggattgcagtctacatagtgttatccatttgtgtcgggtcaatcttcttcaacgtcgggagaaaccacacaaatgttatgagtactgcagcttgtggcggatttatggcaggctttatgacattcatgtcaataggaggattccaatccttcattgaagaaatgaaggtgttttctcgcgaaaggctcaatggacactatggggttgcagtatacactgtgtctaatttactctcctcattacctttcataatccttatgtgcctctccaccagctcaatcactatctacatggtgaggttccaatccggaggttctcatttcttctacaactgtctcgaccttatctgcgcgattacaactgtggagagttgcatgatgatgatagcttcagtagtccctaacttcttgatgggagtcatgttgggagctggttacattggaattatggtgttaagtgcggggtttttccgattcttccccgacttaccaatggtgttctggcgatacccggtgtcctacataaactatggtgcatgggcactacagggagcatacaagaatgagatgattggggtggagtatgattctccgttacccttggtaccaaaaatgaaaggagaactcattcttcaaactgttctaggcataaatccagaaagttcaaagtggttggatctagcagttgtgatgatgattctcattgggtataggattgccttcttcgccatcctcaagttccgggaaaaggttttcccagttattcacatgttatacacaaagagaactctgagccatatccagaaaaggccttctttcagaagaatgacacctttcccttccaggcgataccctgttcaccatgctctctcttctcaggaaggacttaactctccactgcattag

SEQ ID NO: 1592 - protein, 678 aa, Arabidopsis thaliana
MTTPEGAMYVAWEDLTVVIPNFGEGATKRLLNGVNGCGEPNRILAIMGPSGSGKSTLLDALAGRLAGNVVMSGKVLVNGKKRRLDFGAAAYVTQEDVLLGTLTVRESISYSAHLRLPSKLTREEISDIVEATITDMGLEECSDRTIGNWHLRGISGGEKKRLSIALEVLTKPSLLFLDEPTSGLDSASAFFVVQILRNIASSGKTVVSSIHQPSGEVFALFDDLLLLSGGETVYFGEAESATKFFGEAGFPCPSRRNPSDHFLRCVNSDFDNVTAALVESRRINDSSFSLHQLHETTNTLDPLDDIPTAEIRTTLVRKFKCSLYAAASRARIQEIASIVGIVTERKKGSQTNWWKQLRILTQRSFINMSRDLGYYWMRIAVYIVLSICVGSIFFNVGRNHTNVMSTAACGGFMAGFMTFMSIGGFQSFIEEMKVFSRERLNGHYGVAVYTVSNLLSSLPFIILMCLSTSSITIYMVRFQSGGSHFFYNCLDLICAITTVESCMMMIASVVPNFLMGVMLGAGYIGIMVLSAGFFRFFPDLPMVFWRYPVSYINYGAWALQGAYKNEMIGVEYDSPLPLVPKMKGELILQTVLGINPESSKWLDLAVVMMILIGYRIAFFAILKFREKVFPVIHMLYTKRTLSHIQKRPSFRRMTPFPSRRYPVHHALSSQEGLNSPLH

SEQ ID NO: 1593 - DNA, 705 bp, Arabidopsis thaliana
atggcgtctcttcaacaaactctattctctcttcaatccaaactcccaccatcctccttccaaatcgccagatctctcccactccgaaaaaccttcccaatccgaatcaacaacggtggaaacgccgccggagcaagaatgtcagccaccgcagcatcaagctacgcgatggcattagcagacgtcgcgaaaagaaacgacacaatggaattaacagtcacagacatcgagaagctcgaacaagtcttctcagatccacaagtactaaacttcttcgcgaatccaacaatcaccgtcgagaagaaacgtcaagtcatcgacgacatagtgaaatcgtcgtctcttcaatctcacacatctaacttcctcaacgtcctcgtcgacgcgaatcggatcaatatcgtgacggagatcgttaaggagtttgagttggtttacaataagctaacggatacacaattggcggaggttaggtcggtggtgaaattggaagcgccgcaattagctcagattgcgaaacaggttcagaagttaaccggagctaagaatgttcgggttaagacggttattgatgcgagtcttgtggctggttttacgattcggtatggtgaatccggttcgaagcttattgatatgagtgtgaagaaacagcttgaagatattgcttctcagcttgaacttggtgagattcaattagctacttga

SEQ ID NO: 1594 - protein, 234 aa, Arabidopsis thaliana
MASLQQTLFSLQSKLPPSSFQIARSLPLRKTFPIRINNGGNAAGARMSATAASSYAMALADVAKRNDTMELTVTDIEKLEQVFSDPQVLNFFANPTITVEKKRQVIDDIVKSSSLQSHTSNFLNVLVDANRINIVTEIVKEFELVYNKLTDTQLAEVRSVVKLEAPQLAQIAKQVQKLTGAKNVRVKTVIDASLVAGFTIRYGESGSKLIDMSVKKQLEDIASQLELGEIQLAT

SEQ ID NO: 1595 - DNA, 954 bp, Arabidopsis thaliana
atgtcaaaaacggctaattttctcagcctgagatccaatcctctacctccgattttctcctccaccggaaactctcctttcctccgagcttcctcggctctgaatcttccgacaactgcttcgaaacctttccacagttggattcgtgcttcttcacgtcgccggttggttctcggtggttttggcggcgcttctttgtggatgaacaacaatatgtccggtaaatttggcggtaaatctttcattgcttccgctaggcagaccaatccttctcccgtcgaacaggcgttgaataaggtggattggccagagactttccctttcaaagaagaagatttccagagatacgatgagtcgtctgattcaacattctacgaagctccaaggtttgtgacacacattgatgatccagctatagctgcattgacaaagtattactccaaggttttgcctcagagcgatactccaggagtgagcatactcgatatgtgtagcagttgggtcagtcattatccaccggggtataggcaagaacgaatagttggaatgggtatgaatgaagaagagcttaagcgaaatccggttctcaccgagtacatagtccaagacttaaatctcaattcaaatctgccttttgaagacaattctttccaagttataaccaatgtggtaagtgtggattatcttacaaagccgcttgaagtgttcaaggaaatgaacagaatccttaagcccggaggactcgctctaatgagcttctcgaaccgttgcttctttactaaagcaatctcgatatggacatcaactggcgacgcagatcatgctctcattgttggatcatactttcactacgccggaggatttgaagctcctcaggccgttgatatatctccaaatccagggcgttcagatcctatgtacgttgtttactctagaaaactccccatggtttaa

SEQ ID NO: 1596 - protein, 317 aa, Arabidopsis thaliana
MSKTANFLSLRSNPLPPIFSSTGNSPFLRASSALNLPTTASKPFHSWIRASSRRRLVLGGFGGASLWMNNNMSGKFGGKSFIASARQTNPSPVEQALNKVDWPETFPFKEEDFQRYDESSDSTFYEAPRFVTHIDDPAIAALTKYYSKVLPQSDTPGVSILDMCSSWVSHYPPGYRQERIVGMGMNEEELKRNPVLTEYIVQDLNLNSNLPFEDNSFQVITNVVSVDYLTKPLEVFKEMNRILKPGGLALMSFSNRCFFTKAISIWTSTGDADHALIVGSYFHYAGGFEAPQAVDISPNPGRSDPMYVVYSRKLPMV

SEQ ID NO: 1597 - DNA, 558 bp, Arabidopsis thaliana
atgggtttaattcctcaaccacaagaatcgatccaagaatctcattactacacacataaactcttcctcactgcaaactacgtcctcctcggtgcatcgtcaagctgcatcttcctcactctctctctccgtctaatcccttcactctgcggtttcttcctcatcctccttcacgccaccacgatcgcagccgccgtctcaggctgtgcagccgcatcttatggtaagaaccggtggtacgcagctcacatgatcgcaactgtccttaccgccattttccaaggctcagtctctgttctcatctttaccaacacttcgaatttcctcgagagccttaactcttacgtccgtgagaaagaagcgtctatgatcttgaaactagctggtgggctctgtgttgtaatcttttgccttgagtggatcgttcttgttctcgcctttttcttgaagtactacgcttatgtcgatggtgataacaatggagttgctatgaaaaggactggtaaggttcagagtgaagagactctcaaaaattccccatgggcgttccaagtttga

SEQ ID NO: 1598 - protein, 185 aa, Arabidopsis thaliana
MGLIPQPQESIQESHYYTHKLFLTANYVLLGASSSCIFLTLSLRLIPSLCGFFLILLHATTIAAAVSGCAAASYGKNRWYAAHMIATVLTAIFQGSVSVLIFTNTSNFLESLNSYVREKEASMILKLAGGLCVVIFCLEWIVLVLAFFLKYYAYVDGDNNGVAMKRTGKVQSEETLKNSPWAFQV

SEQ ID NO: 1599 - DNA, 2907 bp, Arabidopsis thaliana
atggcgggtcggaacatagagaagatggcatctattgatgctcagcttcggcaactcgttcctgctaaagtcagtgaagacgataagcttgttgagtacgatgctcttctccttgatcgctttctcgacattctccaggatttacacggcgaggatctccgtgaaacggttcaagagttatacgagctttctgctgagtatgaagggaagcgtgagcctagcaagcttgaggagctagggagtgtcctaacgagtttggatcctggtgactcaattgttatctccaaggctttctctcacatgcttaacttagccaatttggctgaggaggtgcagattgctcaccgtcgcaggatcaagaagctgaagaaaggtgatttcgttgatgagagttctgcaactactgaatccgatattgaagagacttttaagaggctcgtttcggatcttggtaagtctcctgaagagatctttgatgccttgaagaatcagactgtggatctggttttgactgctcatcctactcagtctgtgcgtagatcattgcttcagaagcatgggaggataagggactgtcttgctcaactctatgcaaaggacattactcctgatgacaagcaggagctagatgagtctctgcaaagagagattcaagctgcattccgaacagatgagattagaagaacacctccaaccccacaagatgaaatgagagctggaatgagttatttccacgagacaatctggaaaggtgtccccaagttcttgcgccgtgtggacacagctctgaaaaacattgggattgatgaacgtgttccttacaatgccccattgattcaattctcttcgtggatgggcggtgatcgtgatggtaatccgagggtcacacctgaggtcactagagatgtgtgcttgttggctagaatgatggctgccaatctctactataaccaaatcgagaatctgatgtttgagttatctatgtggcgttgcactgatgaattccgtgtgcgggcggatgaactgcacaggaactcaaggaaagatgctgcaaaacattacatagaattctggaagacaattcctccaactgagccataccgtgtgattcttggtgatgtgagggataagctgtatcacacacgtgagcgttcccgccaattgctgagtaatggaatctcggatattcctgaagaagctaccttcactaatgtggaacagttcttggagcctcttgagctctgttaccgatcactatgttcatgtggtgacagcccgatagctgatggaagccttcttgatttcttgaggcaagtctctacctttggactctcccttgtgagacttgacatcaggcaagagtctgaacgccacacagatgtcttggatgctatcaccaagcacttggacatcggttcctcctatagagactggtctgaagaaggccgacaggaatggcttcttgctgaactaagcggcaaacgtccacttttcggacctgatcttcccaaaaccgaagaaatttctgatgtcctggacacattcaaagtcatatctgagctgccttcagattgttttggagcttatattatctctatggcaacttcacctagtgatgtgcttgcggttgagcttttacagcgcgaatgccatgtgaaaaatccacttagagttgttccactctttgagaagctagctgatcttgaagcagctcctgccgctgttgcaagactcttttctatagactggtacaaaaaccgtattaacggtaaacaagaggttatgattggttactcagattcagggaaagatgcagggcgtctctcagctgcttgggagctatacaaagctcaagaagagcttgtgaaggttgctaagaaatatggagtgaagctaactatgttccatggccgtggtggcacagtcggaagaggaggtggtcctactcatcttgctatattgtctcagccaccagatacagttaatggctctcttcgagtcacggttcagggtgaagtcattgagcaatcatttggggaggcacacttatgctttagaacacttcaacgtttcacagcagctactctagagcacggaatgaaccctccgatttcaccaaaacccgagtggcgtgctttgcttgatgaaatggcggttgttgcaactgaggaataccgatctgtcgttttccaagaacctcgattcgtcgagtatttccgcctcgctactccggagctggagtatggacgtatgaatattggaagtagaccttcaaagcgaaaaccaagcggtgggatcgaatctctccgtgcaatcccatggatctttgcttggacgcaaacaagattccatcttcctgtatggttaggtttcggagcagcatttaggtatgcgatcaagaaggatgtgagaaaccttcacatgctgcaagatatgtataaacaatggccctttttccgagtcaccatcgatctaattgaaatggtgttcgccaagggagaccccgggatcgctgctttgtacgacaaacttcttgtctcagaagatttatgggcttttggagagaaactcagagccaactttgatgaaaccaagaacctcgtcctccagactgctggacataaagaccttcttgaaggagatccttacttgaaacagagactaaggctacgtgactcttacattacgaccctcaacgtttgccaagcctacacattgaagaggatccgtgatgcaaactacaatgtgactctgcgaccacacatttctaaagagatcatgcaatcaagcaaatcagcacaagagctcgtcaagcttaaccccacgagtgaatacgcgcctggacttgaggacacacttatcttaaccatgaagggtattgctgcaggattgcaaaacaccggttaa

SEQ ID NO: 1600 - protein, 968 aa, Arabidopsis thaliana
MAGRNIEKMASIDAQLRQLVPAKVSEDDKLVEYDALLLDRFLDILQDLHGEDLRETVQELYELSAEYEGKREPSKLEELGSVLTSLDPGDSIVISKAFSHMLNLANLAEEVQIAHRRRIKKLKKGDFVDESSATTESDIEETFKRLVSDLGKSPEEIFDALKNQTVDLVLTAHPTQSVRRSLLQKHGRIRDCLAQLYAKDITPDDKQELDESLQREIQAAFRTDEIRRTPPTPQDEMRAGMSYFHETIWKGVPKFLRRVDTALKNIGIDERVPYNAPLIQFSSWMGGDRDGNPRVTPEVTRDVCLLARMMAANLYYNQIENLMFELSMWRCTDEFRVRADELHRNSRKDAAKHYIEFWKTIPPTEPYRVILGDVRDKLYHTRERSRQLLSNGISDIPEEATFTNVEQFLEPLELCYRSLCSCGDSPIADGSLLDFLRQVSTFGLSLVRLDIRQESERHTDVLDAITKHLDIGSSYRDWSEEGRQEWLLAELSGKRPLFGPDLPKTEEISDVLDTFKVISELPSDCFGAYIISMATSPSDVLAVELLQRECHVKNPLRVVPLFEKLADLEAAPAAVARLFSIDWYKNRINGKQEVMIGYSDSGKDAGRLSAAWELYKAQEELVKVAKKYGVKLTMFHGRGGTVGRGGGPTHLAILSQPPDTVNGSLRVTVQGEVIEQSFGEAHLCFRTLQRFTAATLEHGMNPPISPKPEWRALLDEMAVVATEEYRSVVFQEPRFVEYFRLATPELEYGRMNIGSRPSKRKPSGGIESLRAIPWIFAWTQTRFHLPVWLGFGAAFRYAIKKDVRNLHMLQDMYKQWPFFRVTIDLIEMVFAKGDPGIAALYDKLLVSEDLWAFGEKLRANFDETKNLVLQTAGHKDLLEGDPYLKQRLRLRDSYITTLNVCQAYTLKRIRDANYNVTLRPHISKEIMQSSKSAQELVKLNPTSEYAPGLEDTLILTMKGIAAGLQNTG

SEQ ID NO: 1601 - DNA, 468 bp, Arabidopsis thaliana
atggggttgagtggtgttcttcatgtggaggttgaggttaagtctccggctgaaaagttctgggtagcccttggcgacggcatcaatctcttccccaaagctttccctaacgactacaaaaccatccaagttctagccggcgatggcaacgctcctggctccattcgcctcattacttatggagaaggatctccactggtgaagatatcggcggagaggatcgaagcagtggatttggagaacaaaagcatgtcgtacagcatcattggcggagaaatgttggagtactacaaaaccttcaaaggaaccatcaccgttatccctaaggatggtggtagccttctgaaatggtctggtgagtttgagaagaccgcccatgagatcgatgatccacatgtcatcaaggactttgctgtcaagaacttcaaagagatagatgagtatcttcttaagcaaactagtgcctaa

SEQ ID NO: 1602 - protein, 155 aa, Arabidopsis thaliana
MGLSGVLHVEVEVKSPAEKFWVALGDGINLFPKAFPNDYKTIQVLAGDGNAPGSIRLITYGEGSPLVKISAERIEAVDLENKSMSYSIIGGEMLEYYKTFKGTITVIPKDGGSLLKWSGEFEKTAHEIDDPHVIKDFAVKNFKEIDEYLLKQTSA

SEQ ID NO: 1603 - DNA, 1413 bp, Arabidopsis thaliana
atggcggcagagaaaatagagacagtggtcgcagggaattacttagaaatggagagggaagaagaaaacataagtggtaacaagaaatcttcaactaaaacaaaactctctaatttcttctggcatggtggttctgtctacgatgcttggtttagttgtgcttcaaatcaggtggcacaagttctgttgacattaccatactcgttctcacaacttgggatgatgtcgggaattttgtttcaactcttttatggattaatgggaagttggactgcttatctcattagtgttctttacgttgaatatcgaactcgtaaagaacgagaaaaattcgatttccgtaaccacgttattcagtggtttgaggtgttagatggattgttggggaaacattggaggaaccttggattgatctttaactgcacttttcttctctttggatctgttattcagctcattgcttgtgctagcaatatatattatattaatgacaaattggacaagaggacatggacatacatatttggggcgtgctgtgcaacaactgtttttattccttccttccacaattatagaatttggtcattcctcggactcgctatgaccacttacacttcttggtatctcaccattgcttcactccttcatggccaggctgaggatgtgaaacactctggtccaaccacaatggtgctttacttcaccggagccaccaacattctctacacctttggtggccacgccgtcacagtggagataatgcacgctatgtggaaaccgcaaaagttcaaggcgatatatctactagcgaccatatatgtactaacgctaacgctaccatccgcgtctgcggtttattgggcgtttggcgataagctactaactcattccaatgcgctctctcttctccctaagactggttttagagataccgcagtgatcctcatgctcattcatcaatttataacgttcggattcgcgtctacaccgttatattttgtgtgggagaaattgataggtgtgcatgagacgaagagcatgttcaaaagagccatggctagattacccgtggttgtacccatatggttcttagccattatcttcccctttttcggaccaatcaattccgcggtcggatctctcttagttagcttcactgtctacatcatccccgcattggctcatatgcttacctttgctcctgctccttcaagagagaatgcggtggagaggccaccgagagtggtaggaggatggatggggacttactgcataaacatatttgtggtggtttgggtattcgtagttgggttcgggtttggaggatgggcaagtatggtcaactttgttcgccagatcgacacttttggtctctttaccaaatgctaccaatgccctcctcacaagccatga

SEQ ID NO: 1604 - protein, 470 aa, Arabidopsis thaliana
MAAEKIETVVAGNYLEMEREEENISGNKKSSTKTKLSNFFWHGGSVYDAWFSCASNQVAQVLLTLPYSFSQLGMMSGILFQLFYGLMGSWTAYLISVLYVEYRTRKEREKFDFRNHVIQWFEVLDGLLGKHWRNLGLIFNCTFLLFGSVIQLIACASNIYYINDKLDKRTWTYIFGACCATTVFIPSFHNYRIWSFLGLAMTTYTSWYLTIASLLHGQAEDVKHSGPTTMVLYFTGATNILYTFGGHAVTVEIMHAMWKPQKFKAIYLLATIYVLTLTLPSASAVYWAFGDKLLTHSNALSLLPKTGFRDTAVILMLIHQFITFGFASTPLYFVWEKLIGVHETKSMFKRAMARLPVVVPIWFLAIIFPFFGPINSAVGSLLVSFTVYIIPALAHMLTFAPAPSRENAVERPPRVVGGWMGTYCINIFVVVWVFVVGFGFGGWASMVNFVRQIDTFGLFTKCYQCPPHKP

SEQ ID NO: 1605 - DNA, 546 bp, Arabidopsis thaliana
atggctcgtcgcgatgttctcctccctttcctcctccttctcgccaccgtctccgccgtagctttcgccgaagatgatccagactgtgtatacacattctacctcagaaccggatcgatctggaaagccggaaccgattcgatcatcagcgcaagaatctacgataaggacggtgactacatcggaatcaaaaaccttcaagcttgggctggattaatgggacctgattacaattacttcgagaggggtaatctcgacattttcagtggaagagcaccgtgtttacctagtccgatctgtgccttaaacctaacctccgatggctccggcgatcaccatggttggtacgttaattacgttgagatcacgacggctggtgttcacgcacagtgctcgacgcaggattttgagattgagcaatggctcgctactgatacttctccttatgagctcaccgccgtacggaacaattgtccggtcaagcttagggatagtgttagtcgggtcgggtctgagattcggaaaaagctttcttgggtcgtttaa

SEQ ID NO: 1606 - protein, 181 aa, Arabidopsis thaliana
MARRDVLLPFLLLLATVSAVAFAEDDPDCVYTFYLRTGSIWKAGTDSIISARIYDKDGDYIGIKNLQAWAGLMGPDYNYFERGNLDIFSGRAPCLPSPICALNLTSDGSGDHHGWYVNYVEITTAGVHAQCSTQDFEIEQWLATDTSPYELTAVRNNCPVKLRDSVSRVGSEIRKKLSWVV

SEQ ID NO: 1607 - DNA, 708 bp, Arabidopsis thaliana
atggaagaaggagattttttcaactgctgtttcagcgagattagtagtggcatgaccatgaataagaagaagatgaagaagagcaataaccaaaagaggtttagcgaggaacagatcaagtcacttgagcttatatttgagtctgagacgaggcttgagccgaggaagaaggttcaggtagctagagagctagggctgcaaccaagacaagtggctatatggtttcaaaacaagagggctcgatggaaaactaagcaacttgagaaagagtataacactcttagagccaattacaacaatttggcttcacaatttgaaatcatgaagaaagaaaagcaatctctggtctctgagctgcagagactaaacgaagagatgcaaaggcctaaagaagaaaagcatcatgagtgttgtggtgatcaaggactggctctaagcagcagcacagagtcgcataatggaaagagtgagccagaagggaggttagaccaagggagtgttctatgtaatgatggtgattacaacaacaacattaaaacagagtattttgggttcgaggaagagactgatcatgagctgatgaacattgtggagaaagctgatgatagttgcttgacatcttctgagaattggggaggtttcaattctgattctctcttagaccaatctagcagcaattaccctaactggtgggagttttggtcataa

SEQ ID NO: 1608 - protein, 235 aa, Arabidopsis thaliana
MEEGDFFNCCFSEISSGMTMNKKKMKKSNNQKRFSEEQIKSLELIFESETRLEPRKKVQVARELGLQPRQVAIWFQNKRARWKTKQLEKEYNTLRANYNNLASQFEIMKKEKQSLVSELQRLNEEMQRPKEEKHHECCGDQGLALSSSTESHNGKSEPEGRLDQGSVLCNDGDYNNNIKTEYFGFEEETDHELMNIVEKADDSCLTSSENWGGFNSDSLLDQSSSNYPNWWEFWS

SEQ ID NO: 1609 - DNA, 660 bp, Arabidopsis thaliana
atggctgcttcaagctccgttttcacagtatccccgtcgcgaaatcttgcagctattcctcttcatcagtccctatctccaccgttgcttagatccagctccgtcgcgtttcgtcccaaacgaagatccagctcactcgtcttatgctcaactgatgaatcaaagagcaccgcagagaaagagatcccaatcgaactaaggtatgaggcgtttccgacagtgatggacatcaataagatacaagagattttgcctcacagattcccatttctgttagttgatagagtgatagagtacacagctggtgtatctgcggtagctattaaaaacgttaccattaatgacaatttctttcctgggcatttccctgagagacctataatgcctggagttctcatggttgaggcaatggctcaagtgggaggtatagtgatgctacaaccagaagttggcggatctagaagcaacttcttctttgctggaatcgacaaagtcagattcaggaagccagtgattgcaggtgatacgctggtgatgaggatgacacttgtgaagttgcagaagcggtttgggatagcgaaaatggaagggaaagcatatgtagggaactctgtggtatgtgaaggagagttcttgatggctatgggaaaagaagagtga

SEQ ID NO: 1610 - protein, 219 aa, Arabidopsis thaliana
MAASSSVFTVSPSRNLAAIPLHQSLSPPLLRSSSVAFRPKRRSSSLVLCSTDESKSTAEKEIPIELRYEAFPTVMDINKIQEILPHRFPFLLVDRVIEYTAGVSAVAIKNVTINDNFFPGHFPERPIMPGVLMVEAMAQVGGIVMLQPEVGGSRSNFFFAGIDKVRFRKPVIAGDTLVMRMTLVKLQKRFGIAKMEGKAYVGNSVVCEGEFLMAMGKEE

SEQ ID NO: 1611 - DNA, 651 bp, Arabidopsis thaliana
atgagcttcactgcttctctcgtctcttatttgacgtctccctcactcgtctcgctcaaccatcttcctccttccttcttcctcccaaccaaacttgtcaagccaacaagcctcactcattcacagcctccgagattgtccgcatcctatggtccagctgcaaaagctgctacagccaacgacgttgttccagaaacagctccgacatcagcgtcggaggtcgtctccagcttctacgccgccgttaacgtccatgatttatcctctgtcacagacctcatcgctcaggactgcgtctacgaggatctcgtcttctcatctccctttgttggccgaaaggcaattcttgatttcttcggaaaattcattgaatcaacaagtacggatctccaattcgtgatagatgatatctcaacagaagactcttcagctgttggagtttcatggcatttagaatggaaaggaaagaacttcccatttagcaaaggttgcagcttttaccggttagaggtgattgatgggaagagacagatcgtatatggaagagactgcgttgagcctgcaatcaaacctggagaaacagttctggctgctataaagggagttacctggctgctgcagaaatttcctcaactggccgaccaattctga

SEQ ID NO: 1612 - protein, 216 aa, Arabidopsis thaliana
MSFTASLVSYLTSPSLVSLNHLPPSFFLPTKLVKPTSLTHSQPPRLSASYGPAAKAATANDVVPETAPTSASEVVSSFYAAVNVHDLSSVTDLIAQDCVYEDLVFSSPFVGRKAILDFFGKFIESTSTDLQFVIDDISTEDSSAVGVSWHLEWKGKNFPFSKGCSFYRLEVIDGKRQIVYGRDCVEPAIKPGETVLAAIKGVTWLLQKFPQLADQF

SEQ ID NO: 1613 - DNA, 1389 bp, Arabidopsis thaliana
atggcagtagctacacattgtttcacttcaccttgtcatgaccgtattcgatttttctcaagtgatgatggtattggtaggcttggcattacaagaaagaggatcaatggcactttcttgctcaagattttacctccaatccaaagtgctgatctcagaacaactggtgggagatcctcacgtcctttatctgcattcaggtcaggattctctaaggggatatttgacattgtgccattaccatcaaagaatgagctgaaagagctgaccgctccgctgttgctaaaactcgtgggtgttttagcttgcgcgttccttattgttccatctgcagatgcagttgatgcacttaaaacttgtgcatgcttattgaagggatgcaggatagaactcgcaaagtgcattgccaaccctgcctgtgcagccaatgtcgcgtgccttcagacctgcaataaccgtccagatgaaaccgagtgccagattaaatgtggggatctgtttgagaacagtgttgttgatgagttcaacgagtgtgctgtgtcgagaaaaaagtgtgttcctagaaaatctgatctcggagaatttcctgccccagacccttctgttcttgtacagaacttcaacatctcggactttaacgggaagtggtacattacaagtggcttgaatccaacctttgatgccttcgactgccagctgcatgagttccacacagaaggtgacaacaagcttgttggaaacatctcttggagaataaagaccctagacagtggattctttactaggtcagccgtacaaaaattcgtgcaagatcctaaccaacctggtgttctctacaatcatgacaacgagtaccttcactatcaagatgactggtatatcctgtcatcaaagatagagaataaacctgaagactatatatttgtatactaccgtgggcgaaacgatgcttgggatggatatggtggtgcagttgtatacacgagaagttctgtattacccaatagcattataccagaactcgaaaaagcagcaaaaagcataggcagagacttcagcacattcattagaacggataacacatgtggtcctgaacctgcgctcgtggagagaattgagaagacagtggaagaaggtgaaaggataatcgtaaaagaggttgaagagatagaagaagaggtagagaaggaagtggagaaggtcggtaggactgagatgaccttgttccagagattggctgaaggatttaatgaactgaagcaagacgaggagaatttcgtgagagagttaagtaaagaagagatggagtttttggatgagatcaaaatggaagcaagtgaggttgaaaaattgtttgggaaagctttgccaatcaggaaggtcaggtag

SEQ ID NO: 1614 - protein, 462 aa, Arabidopsis thaliana
MAVATHCFTSPCHDRIRFFSSDDGIGRLGITRKRINGTFLLKILPPIQSADLRTTGGRSSRPLSAFRSGFSKGIFDIVPLPSKNELKELTAPLLLKLVGVLACAFLIVPSADAVDALKTCACLLKGCRIELAKCIANPACAANVACLQTCNNRPDETECQIKCGDLFENSVVDEFNECAVSRKKCVPRKSDLGEFPAPDPSVLVQNFNISDFNGKWYITSGLNPTFDAFDCQLHEFHTEGDNKLVGNISWRIKTLDSGFFTRSAVQKFVQDPNQPGVLYNHDNEYLHYQDDWYILSSKIENKPEDYIFVYYRGRNDAWDGYGGAVVYTRSSVLPNSIIPELEKAAKSIGRDFSTFIRTDNTCGPEPALVERIEKTVEEGERIIVKEVEEIEEEVEKEVEKVGRTEMTLFQRLAEGFNELKQDEENFVRELSKEEMEFLDEIKMEASEVEKLFGKALPIRKVR

SEQ ID NO: 1615 - DNA, 1164 bp, Arabidopsis thaliana
atggcgactgctctggtttctcctcttacttcacaactcaaccatgaagctgtctgttccaagtttgtgttacccaaatcgccgttcatgtcgggatctaagctcttttcatcgaacatgccttgctctactgttcctagacgcacaagaagatcacactgctttgcttctgctaaagatatgagctttgaccatatccctaaacaatttcgtggagacaatctcaaagacggagtgatgcagaacttcaagaacgtaccacaatatttttacgggcttaattcagctcaaatggatatgttcatgacagaagatagccctgtccgtaggcaagcggaaaaagttacagaggaaagcatctcgtctagaaataactatttgaacaatggaggaatatggagtatgtccggtatgaatgcagcagatgctagaagatatagcatgagtgtccagatgtacagaggtggaggtggcggcggaggatctgaaagaccaagaactgctcctccagatttgccttctttgctattggatgctcgcatatgctaccttggcatgccaatcgtacctgcagttactgagttactcgttgctcaatttatgtggttagactatgataacccaacaaagcccatctacttatatataaattcacccgggacccagaatgagaagatggaaactgttggatcagaaacagaggcttatgccatagccgatactatttcttattgcaaatcagatgtatacactatcaattgtggcatggcttttggtcaagcagcaatgcttctttctctcgggaaaaaaggttatcgtgccgtacaaccacattcatcaacaaaattatatctgccaaaagtaaacagatcgagtggagctgccatagacatgtggataaaggccaaggaacttgatgcaaataccgagtactacatcgagctgttagctaagggaacagggaaatccaaagagcagatcaacgaggacatcaagcgacctaaatatctccaagctcaagcagccattgactatggaattgcagacaagatagctgactcgcaggacagttctttcgagaaacgggattacgatgggacccttgcccagagagctatgagacctggaggaggcagtccagcagctccagccggactaagatga

SEQ ID NO: 1616 - protein, 387 aa, Arabidopsis thaliana
MATALVSPLTSQLNHEAVCSKFVLPKSPFMSGSKLFSSNMPCSTVPRRTRRSHCFASAKDMSFDHIPKQFRGDNLKDGVMQNFKNVPQYFYGLNSAQMDMFMTEDSPVRRQAEKVTEESISSRNNYLNNGGIWSMSGMNAADARRYSMSVQMYRGGGGGGGSERPRTAPPDLPSLLLDARICYLGMPIVPAVTELLVAQFMWLDYDNPTKPIYLYINSPGTQNEKMETVGSETEAYAIADTISYCKSDVYTINCGMAFGQAAMLLSLGKKGYRAVQPHSSTKLYLPKVNRSSGAAIDMWIKAKELDANTEYYIELLAKGTGKSKEQINEDIKRPKYLQAQAAIDYGIADKIADSQDSSFEKRDYDGTLAQRAMRPGGGSPAAPAGLR

SEQ ID NO: 1617 - DNA, 993 bp, Arabidopsis thaliana
atggctctcaaagcttcacctgttaccggattattccctcctctccgtcctactgcttcttcttccccttcgacttcttctaatcgcccttgttccctcaggattctccctctcagaacatctttcttcggtaactcaagtggagcgctgagagtgaatgtgttgagattagcttgtgataatagactcaggtgcaatggtcatggtgctactatgaatctttttgaacgattttctagagtggtcaagtcatatgcaaatgcgctcataagctcttttgaagacccggagaaaatcctggagcaaactgtcattgaaatgaatagtgatttgacaaagatgcgtcaagccactgcacaggttttagcatcacaaaagcagttacagaacaaatataaagctgcacagcagtcttctgatgattggtacaaaagagcacaacttgctcttgcaaaaggagatgaggatcttgcacgtgaggcccttaaacgacgaaagtcttttgctgacaacgctactgctttgaaaactcaactagatcagcaaaaaggtgttgtcgacaatcttgtttcaaatacaaggctcttggagagtaagatacaagaggcaaaagcaaagaaagatacgctccttgcacgtgctcgcactgctaagactgcaaccaaagtgcaagagatgatagggacagtaaatacaagcggtgctctttcagcttttgagaaaatggaggagaaagttatggctatggagtctgaagcagatgcactaactcagattggaaccgatgaactcgaggggaagtttcaaatgcttgaaacttcatctgtggatgatgatcttgcagacttgaagaaagaattgtctggaagctcaaagaaaggagagcttcctccagggagaagcactgttgcagcaagcacgagataccctttcaaagactcagagatcgagaatgagttaaacgaactgcgaaggaaagctaacgacttttag

SEQ ID NO: 1618 - protein, 330 aa, Arabidopsis thaliana
MALKASPVTGLFPPLRPTASSSPSTSSNRPCSLRILPLRTSFFGNSSGALRVNVLRLACDNRLRCNGHGATMNLFERFSRVVKSYANALISSFEDPEKILEQTVIEMNSDLTKMRQATAQVLASQKQLQNKYKAAQQSSDDWYKRAQLALAKGDEDLAREALKRRKSFADNATALKTQLDQQKGVVDNLVSNTRLLESKIQEAKAKKDTLLARARTAKTATKVQEMIGTVNTSGALSAFEKMEEKVMAMESEADALTQIGTDELEGKFQMLETSSVDDDLADLKKELSGSSKKGELPPGRSTVAASTRYPFKDSEIENELNELRRKANDF

SEQ ID NO: 1619 - DNA, 261 bp, Arabidopsis thaliana
atggagagttcattaggtttcatggcggttttcgccgtctcaggaagcgttgtgttcttagcgagtcaatttcacaagcgtcttctctccgattacatggacaagttcgaattcgaaatccgagcgcagaaaaaaatggtgatgaagaagaaggtgagattcgcggcggatgtggtggagccgtcggggaataacaaagagtatcgccggagacattcttccaaggctaaatcgaattcgaagatggcggcaactatttga

SEQ ID NO: 1620 - protein, 86 aa, Arabidopsis thaliana
MESSLGFMAVFAVSGSVVFLASQFHKRLLSDYMDKFEFEIRAQKKMVMKKKVRFAADVVEPSGNNKEYRRRHSSKAKSNSKMAATI

SEQ ID NO: 1621 - DNA, 1056 bp, Arabidopsis thaliana
atggatagtcacaaatggagtctaggtttcacattacttgctttcctcttcatcacttcctcttccgctgagctcatcattaaacaggtcacacagggcagaggaatagagtacaacaactcttacagtctcacgtcgaatcttggagtgacgacaagagagttgagagacgagcgaccatcaagtaagatagtgacaatcacaagcttctctgtgattaaggacagaggagaaccctatgaatcatctatttttgaggctgccggttacaaatggagattagttttgtacgtgaagggtaatccgaaaggcggtataaataatcatatttcactttacgcgaggatagaagagacagaaactcttccaagagggtgggaagtgaatgttgatctcaaactctttgtccacaatcggaagttaaagaaatatttgtctgttacagatggaacagtgaagcgatacaacgatgcaaaaaaagagtggggattcacacaattgatttctcttccaacattctacaacgcgaacgaagggtaccttgtgcaggacacagcttcttttggtgctgagatcttcatcgttaacccgacagaaaaacaagagaaagtcacattcatatcaaaccctccagacaatgttttcacttggaagatacttcgtttctctaccttggaagataaattctattactctgatgattttcttgttggagaccgatactggagactaggatttaacccgaaaggatctggtggaggaagaccacatgcacttccaatcttcctatatgctcaaggccataaggcaaacgcagttgttacaaacacttggggagcggttaatctgcggttaaagaatcaacgaagctccaaccacaaacaattatattctgcagcttggtacccgattcgaagcgattatggtgtgggagtgaacaatataatattgatgtcagagctaaaagatgcatcaaaagggtatatggtgaatgatgccattatctttgaagctgaaatggttaaggtctctgtgacaaacatagtctccgtttaa

SEQ ID NO: 1622 - protein, 351 aa, Arabidopsis thaliana
MDSHKWSLGFTLLAFLFITSSSAELIIKQVTQGRGIEYNNSYSLTSNLGVTTRELRDERPSSKIVTITSFSVIKDRGEPYESSIFEAAGYKWRLVLYVKGNPKGGINNHISLYARIEETETLPRGWEVNVDLKLFVHNRKLKKYLSVTDGTVKRYNDAKKEWGFTQLISLPTFYNANEGYLVQDTASFGAEIFIVNPTEKQEKVTFISNPPDNVFTWKILRFSTLEDKFYYSDDFLVGDRYWRLGFNPKGSGGGRPHALPIFLYAQGHKANAVVTNTWGAVNLRLKNQRSSNHKQLYSAAWYPIRSDYGVGVNNIILMSELKDASKGYMVNDAIIFEAEMVKVSVTNIVSV

SEQ ID NO: 1623 - DNA, 651 bp, Arabidopsis thaliana
atggcggctcccgtagtggtcgctcctgcgataaatcttcagcatatggacctacctgaaggaaatgaagatgtagcagctgtgcttcaaacatcaacacagcgctggctcaacgctgctgagtggagcattctttataacaaccacaacctattcccagaatcaaactcatttaccatacctattgaagtagagggactttacagagttgacaaccgctttaatcaagacagcaatacgtggagaaacacaagtgctccctccacttgcaaaaatgctatcaacttctacaatgttaggatcgccactggcttgtacaggtttgatgatgatggggacattgtgatggacgctgaagttcaaggagggtgggtcctttgcagaaaaaccgtgaggaacagaggccattgtggtacacgtttgagtcatctctacaagcctgtcttcgatcgtcaattcaagatgctgaagattcatatgatggaagatatgattaaagatggtgaagagaagagtcttgacactttcgtgatatccaggcaacttaccactttcactgatctcacgggctgggcatttggctcatccgtgatagttgaatttaaagtgagacttgagcacttaagaggaaaatcaattcctatagcgtaa

SEQ ID NO: 1624 - protein, 216 aa, Arabidopsis thaliana
MAAPVVVAPAINLQHMDLPEGNEDVAAVLQTSTQRWLNAAEWSILYNNHNLFPESNSFTIPIEVEGLYRVDNRFNQDSNTWRNTSAPSTCKNAINFYNVRIATGLYRFDDDGDIVMDAEVQGGWVLCRKTVRNRGHCGTRLSHLYKPVFDRQFKMLKIHMMEDMIKDGEEKSLDTFVISRQLTTFTDLTGWAFGSSVIVEFKVRLEHLRGKSIPIA

SEQ ID NO: 1625 - DNA, 1206 bp, Arabidopsis thaliana
atggcgacgaagagaagcgttggaactttgaaggaagcggatctgaagggaaagagtgtgttcgtgagggttgatctcaacgttcctttggatgataactctaacatcaccgatgacaccaggattcgtgccgctgttcccaccatcaagtacttgatgggtaatggatctagggttgttctctgcagtcacttgggccgcccaaaaggtgttactcctaagtacagcttaaagcctcttgtgcccagattgtctgaacttcttggtgttgaggttgtaatggcaaatgactctattggtgaggaagtccagaagttggttgcaggactacctgaaggtggtgttttgctcttggagaatgtgaggttctacgccgaggaagagaagaatgatcctgaatttgcaaagaagcttgctgctcttgccgatgtttacgttaatgatgccttcggaactgctcacagagctcatgcttccactgagggagttgccaaattcttgaagccttcagttgctggtttcctcatgcagaaggaacttgattaccttgtcggagctgtggcaaaccccaagaagccttttgctgccattgttggaggctcaaaggtttcaacaaagattggtgtcattgagtctctcttgaacacagttgacatcctcctgctcggtggaggtatgatttttactttctacaaggcacaaggactctcagtcggatcttcccttgtggaggaggacaagcttgacttggcaaagtcactcatggagaaagcaaaggccaaaggtgtctctctcttgctcccaaccgatgtggttattgctgacaagtttgctcccgatgctaacagcaagatagtgccagccactgccatccctgatggctggatgggtctagatattggtccagactccatcaagacattcagcgaagctctggacacaaccaaaaccatcatctggaatggtcccatgggtgtgtttgaattcgataagtttgctgctggaactgaggccgtagcaaagcagcttgcagaactaagcggaaagggagtaaccacaatcattggaggaggtgactctgttgctgccgtcgagaaggttggtttggcagacaagatgagccacatctctaccggaggcggtgctagtttggagcttcttgagggtaagccacttccaggagtcctcgctctcgacgaagcttga

SEQ ID NO: 1626 - protein, 401 aa, Arabidopsis thaliana
MATKRSVGTLKEADLKGKSVFVRVDLNVPLDDNSNITDDTRIRAAVPTIKYLMGNGSRVVLCSHLGRPKGVTPKYSLKPLVPRLSELLGVEVVMANDSIGEEVQKLVAGLPEGGVLLLENVRFYAEEEKNDPEFAKKLAALADVYVNDAFGTAHRAHASTEGVAKFLKPSVAGFLMQKELDYLVGAVANPKKPFAAIVGGSKVSTKIGVIESLLNTVDILLLGGGMIFTFYKAQGLSVGSSLVEEDKLDLAKSLMEKAKAKGVSLLLPTDVVIADKFAPDANSKIVPATAIPDGWMGLDIGPDSIKTFSEALDTTKTIIWNGPMGVFEFDKFAAGTEAVAKQLAELSGKGVTTIIGGGDSVAAVEKVGLADKMSHISTGGGASLELLEGKPLPGVLALDEA

SEQ ID NO: 1627 - DNA, 1353 bp, Arabidopsis thaliana
atgcgtgagattcttcacatccagggtggtcaatgcggtaaccagatcggagccaagttctgggaagtggtttgcgccgagcacggcatcgatccaaccggaaggtacaccggagactcagatctgcaacttgagcgcatcaacgtttactacaatgaagcgagttgcggtagattcgttcctcgtgcagtgctcatggatttggagcctgggactatggatagtctcagatctggaccgtacggtcagacctttcgacctgataacttcgtctttggtcaatccggtgcgggtaacaactgggccaagggacactacactgaaggagctgaactaatcgattccgttctcgatgttgttcgtaaggaagctgagaactgtgactgcctccaagggttccaggtttgtcactcattgggaggaggaactggatctggtatgggaacattgttgatctctaagatccgtgaagagtacccagatcgcatgatgcttaccttctcggtgttcccttcaccaaaggtttctgatactgtggtggagccttacaacgctactttatctgttcatcagcttgttgagaatgctgatgagtgcatggttcttgataacgaggccttgtacgatatttgcttcaggactctcaaactcactacccccagctttggtgatttgaaccatttgatatctgccactatgtctggtgtgacttgctgtctgaggttccctggtcaactcaactctgacctccgtaagcttgctgtgaatctcatcccattccctcgtcttcacttcttcatggttggttttgctcctctcacctcaagaggttcacagcagtaccgctccctcacagtccctgagctcacccagcaaatgtgggactccaagaacatgatgtgtgctgcagacccaaggcacggacgctacctcacagcctctgccatgttccgtggcaagatgagcacaaaggaagttgacgagcagatgctgaatgttcagaacaagaactcgtcctactttgtggagtggatccccaacaacgtgaaatcaacagtctgtgatatcccacctactggtctgaagatggcttccactttcattggaaactcaacatcgatccaagagatgttcaggcgagtgagtgagcagttcacagctatgttcaggaggaaggctttcttgcattggtacacaggtgagggaatggacgagatggagttcacagaagcagagagcaacatgaacgatcttgtgtcagagtaccagcaataccaagatgcaacggctgatgaagaaggtgactacgaggatgaggaagaaggtgaataccaacaggaagaagagtactga

SEQ ID NO: 1628 - protein, 450 aa, Arabidopsis thaliana
MREILHIQGGQCGNQIGAKFWEVVCAEHGIDPTGRYTGDSDLQLERINVYYNEASCGRFVPRAVLMDLEPGTMDSLRSGPYGQTFRPDNFVFGQSGAGNNWAKGHYTEGAELIDSVLDVVRKEAENCDCLQGFQVCHSLGGGTGSGMGTLLISKIREEYPDRMMLTFSVFPSPKVSDTVVEPYNATLSVHQLVENADECMVLDNEALYDICFRTLKLTTPSFGDLNHLISATMSGVTCCLRFPGQLNSDLRKLAVNLIPFPRLHFFMVGFAPLTSRGSQQYRSLTVPELTQQMWDSKNMMCAADPRHGRYLTASAMFRGKMSTKEVDEQMLNVQNKNSSYFVEWIPNNVKSTVCDIPPTGLKMASTFIGNSTSIQEMFRRVSEQFTAMFRRKAFLHWYTGEGMDEMEFTEAESNMNDLVSEYQQYQDATADEEGDYEDEEEGEYQQEEEY

SEQ ID NO: 1629 - DNA, 723 bp, Arabidopsis thaliana
atggtggttacggattctccagtttcggggataatggctgatcagaacatcgatcctaacaccacgacgagccctagtcctaaagagaagcatgtttctgcgattaaggctatctccggcgacgagaaagctccgtcgaaggagaaaaagaactacgcgtcgaagaaatcaactaccgtaatccagaaatcgcactgtttccagaattcttggacattttggttcgataatccttcctccaaatcgaatcaagtcatatggggaagctctttgagatccttgtatacattcggtactatcgaagagttctggagtctctacaataacattcatcctccaaccaagtgggtttcgggggcggatctttactgcttcaaagataagattgaaccaaaatgggaagatcctatctgtgctaatggaggaaaatggagtatgatgttccctaaagctacactagaatgcaattggcttaacacgttacttgcgttggttggtgagcaatttgaccaaggagatgagatctgtggagcagttttgaacttcagagcgagaggggacaggatctctctatggacaaagaacgctgcaaatgaggaggctcagctaagcattgggaagcagtggaaggaacttcttggctacaatgagacaatcggatttatagttcatgaggatgcaaagactcttgatcgtgatgctaaacgtcgatatactgtatga

SEQ ID NO: 1630 - protein, 240 aa, Arabidopsis thaliana
MVVTDSPVSGIMADQNIDPNTTTSPSPKEKHVSAIKAISGDEKAPSKEKKNYASKKSTTVIQKSHCFQNSWTFWFDNPSSKSNQVIWGSSLRSLYTFGTIEEFWSLYNNIHPPTKWVSGADLYCFKDKIEPKWEDPICANGGKWSMMFPKATLECNWLNTLLALVGEQFDQGDEICGAVLNFRARGDRISLWTKNAANEEAQLSIGKQWKELLGYNETIGFIVHEDAKTLDRDAKRRYTV

SEQ ID NO: 1631 - DNA, 1734 bp, Arabidopsis thaliana
atgaattatttcccagacgaggttatagagcacgtgtttgacttcgtagcttctcacaaagacaggaactcgatatctctggtctgcaaatcatggcacaagatcgagaggtttagtaggaaggaagtgttcatcggaaactgctacgcgattaacccggagaggttgatcaggaggtttccatgtctcaaatccttaactttaaaagggaagcctcattttgcagacttcaacttggttcctcatgaatggggaggtttcgtgcatccttggattgaagctttggctagaagccgtgtgggacttgaggagctgaggttgaagcggatggttgtaacagatgaaagcttggaccttctttcacgttcttttgcaaatttcaagtctttggttcttgttagctgtgaagggtttaccactgatggcttagcttccattgccgctaattgcaggcatcttcgtgagctggacttgcaagagaatgagattgatgatcatagaggtcaatggctgaactgttttccagatagctgcactactcttatgtcgttgaatttcgcttgccttaaaggagagaccaatgttgctgctttagaaaggcttgttgctaggtcaccaaacctgaagagcttgaagttaaaccgtgcagtaccgcttgacgcactcgcaaggttaatgagttgtgcgccgcagctagtggacttaggagtagggtcttatgagaatgagccagatcctgaatcttttgcaaaactcatgactgccattaagaaatacacatcgttaaggagcttgtctggctttttagaggttgctccactctgcctcccagcgttctacccaatttgccaaaaccttatctctttgaacctcagctatgcagctgaaatccaaggcaaccacctcattaagcttattcagctttgcaagagacttcaacgattatggatattggatagtattggtgacaaaggacttgcggttgtcgctgccacatgtaaagagttacaagagcttagagtttttccctctgatgtacatggtgaagaagataacaacgcatctgtgactgaggttggactagtcgccatttccgcaggttgccctaaacttcattcgattctgtacttctgcaaacagatgacaaacgcagcgctcatagccgtggccaaaaactgtccaaacttcatccggttcaggctatgcattctcgagccacacaaacctgaccacattacatttcaatcactggacgagggctttggtgcaatcgtacaagcttgcaagggtctaagacggctctctgtctccggtctcttaaccgatcaagtctttctctacatcggtatgtacgcggaacagctcgagatgctttcgatagcttttgcgggggacactgacaaaggaatgctctatgtgttgaatggatgcaaaaaaatgaggaagctggagataagggacagtccttttgggaacgctgcgcttcttgctgacgtgggtaggtacgaaacaatgcgatccctttggatgtcgtcttgtgaagtaacactcggtggctgcaagaggctcgcgcagaattcgccacggcttaacgtagagatcatcaacgagaatgagaataatgggatggaacagaatgaagaagatgaaagagagaaggttgataaactttacctctaccgaacagtggttgggactagaaaagatgcaccaccatatgttaggattctttag

SEQ ID NO: 1632 - protein, 577 aa, Arabidopsis thaliana
MNYFPDEVIEHVFDFVASHKDRNSISLVCKSWHKIERFSRKEVFIGNCYAINPERLIRRFPCLKSLTLKGKPHFADFNLVPHEWGGFVHPWIEALARSRVGLEELRLKRMVVTDESLDLLSRSFANFKSLVLVSCEGFTTDGLASIAANCRHLRELDLQENEIDDHRGQWLNCFPDSCTTLMSLNFACLKGETNVAALERLVARSPNLKSLKLNRAVPLDALARLMSCAPQLVDLGVGSYENEPDPESFAKLMTAIKKYTSLRSLSGFLEVAPLCLPAFYPICQNLISLNLSYAAEIQGNHLIKLIQLCKRLQRLWILDSIGDKGLAVVAATCKELQELRVFPSDVHGEEDNNASVTEVGLVAISAGCPKLHSILYFCKQMTNAALIAVAKNCPNFIRFRLCILEPHKPDHITFQSLDEGFGAIVQACKGLRRLSVSGLLTDQVFLYIGMYAEQLEMLSIAFAGDTDKGMLYVLNGCKKMRKLEIRDSPFGNAALLADVGRYETMRSLWMSSCEVTLGGCKRLAQNSPRLNVEIINENENNGMEQNEEDEREKVDKLYLYRTVVGTRKDAPPYVRIL

SEQ ID NO: 1633 - DNA, 735 bp, Arabidopsis thaliana
atggcaaacctcttggtctctactttcatattttccgcacttttgctcatctccaccgcaacagccgccacattcgaaatcctaaaccaatgtagttacaccgtgtgggctgccgcaagccctggaggtggccgacgtctagatgctggccaatcatggaggctagatgtcgcggcgggcactaaaatggcacggatttggggtaggaccaattgtaactttgactcctcaggtcgtggccgatgccaaactggtgactgcagtggtggactccaatgtactggctggggacagccaccaaacacgttggctgagtacgctttgaaccaattcaacaacttagacttctacgatatctcacttgtcgatggatttaacatacctatggagtttagcccaactagttcgaactgccatcggatactatgtaccgcagacataaacggacaatgtccaaacgtgttgagagccccaggtggatgcaacaacccgtgtactgtatttcagacgaaccaatactgttgtacgaacggtcagggatcatgtagcgatactgagtactcaagattctttaagcagagatgccctgacgcttacagctatccacaagatgacccgactagcactttcacttgcaccaacactaactacagggtcgtgttttgtccaaggtctaggctcggtgctactggatcccaccagctcccgatcaagatggtcaccgaggagaattaa

SEQ ID NO: 1634 - protein, 244 aa, Arabidopsis thaliana
MANLLVSTFIFSALLLISTATAATFEILNQCSYTVWAAASPGGGRRLDAGQSWRLDVAAGTKMARIWGRTNCNFDSSGRGRCQTGDCSGGLQCTGWGQPPNTLAEYALNQFNNLDFYDISLVDGFNIPMEFSPTSSNCHRILCTADINGQCPNVLRAPGGCNNPCTVFQTNQYCCTNGQGSCSDTEYSRFFKQRCPDAYSYPQDDPTSTFTCTNTNYRVVFCPRSRLGATGSHQLPIKMVTEEN

SEQ ID NO: 1635 - DNA, 684 bp, Arabidopsis thaliana
atggcgaccgaggacgtgaagctgatcggctcatgggcgagtgtttacgtcatgagggcgaggatcgctctccacctcaaatctattagctacgaattccttcaggagacgtatggttcaaagagcgaattgctcctcaaatcaaacccggttcacaagaagatgccggttctgattcacgctgacaaaccggtgtgcgagtccaacatcatcgttcattatatcgacgaggcttggaactcttctggaccttccattctcccgtcccatccatacgaccgggccattgctcggttttgggctgcctacatagacgatcagtggtttatctctgtgagaagtatcctaacagctcaaggagacgaagagaagaaagcagccatagctcaagttgaagaaaggaccaagcttctggagaaagcattcaacgattgtagccaaggaaaaccgttcttcaacggtgaccatatcggttacctcgacattgccttggggagcttcttaggttggtggagagtcgtcgagttggatgccaatcataaatttcttgatgagaccaaaactccctctctagtcaaatgggcagagcggttctgtgatgatcccgctgtgaaacctataatgcccgagattacaaagctcgctgaattcgcaaggaagctctttcctaagcggcaagcataa

SEQ ID NO: 1636 - protein, 227 aa, Arabidopsis thaliana
MATEDVKLIGSWASVYVMRARIALHLKSISYEFLQETYGSKSELLLKSNPVHKKMPVLIHADKPVCESNIIVHYIDEAWNSSGPSILPSHPYDRAIARFWAAYIDDQWFISVRSILTAQGDEEKKAAIAQVEERTKLLEKAFNDCSQGKPFFNGDHIGYLDIALGSFLGWWRVVELDANHKFLDETKTPSLVKWAERFCDDPAVKPIMPEITKLAEFARKLFPKRQA

SEQ ID NO: 1637 - DNA, 1275 bp, Arabidopsis thaliana
atggcgtctcttcttggaacatcttcttctgcaatctgggcttctccttcactctcttctccttcctcaaaaccttcctcctcccccatttgcttcaggccaggaaaattgtttggaagcaagttaaatgcaggaatccaaataaggccaaagaagaacaggtctcgttaccatgtttcggttatgaatgtagccactgaaatcaactctactgaacaagtagtagggaagtttgattcaaagaagagtgcgagaccggtttatccatttgcagctatagtagggcaagatgagatgaagttatgtcttttgttgaatgttattgatccaaagattggtggtgttatgattatgggagatagaggaactggaaaatctacaactgttagatcattagttgatctgttacctgagattaatgtagttgcaggtgacccgtataactcggatccgatagatcctgagtttatgggtgttgaagtaagagagagagttgagaaaggagagcaagttcctgttattgcgactaagattaatatggttgatcttcctttgggtgcaacagaagatagagtttgtggaaccatcgatatcgaaaaggctttgacagaaggtgtaaaagcctttgagcctggtttgttggctaaagctaatagagggattctttatgttgatgaagttaatctcttggatgatcatttggttgatgttcttttggattcagctgcttctggttggaatacggttgagagagaagggatttcgatttctcacccggcgaggtttatcttgatcggttcaggaaatccggaagaaggagagcttaggccacagcttcttgatcggtttggtatgcatgcacaagtagggacggttagagatgctgatttacgggtcaagattgttgaagagagagctcgtttcgatagtaacccaaaggatttccgtgacacttacaaaaccgagcaggacaagcttcaagaccagatttcaactgctagggcaaacctttcctcggttcagattgatagggaattgaaggtgaagatctctagagtttgttcagagctcaatgttgatgggttgagaggagacatagtgactaacagagcagcaaaagcacttgcagctctcaaaggaaaagatcgagtaactccagatgatgttgcaaccgttatccctaactgcttaaggcaccgtctgaggaaagatccactggaatctattgattcaggagttctagtttccgagaagttcgccgagattttcagctga

SEQ ID NO: 1638 - protein, 424 aa, Arabidopsis thaliana
MASLLGTSSSAIWASPSLSSPSSKPSSSPICFRPGKLFGSKLNAGIQIRPKKNRSRYHVSVMNVATEINSTEQVVGKFDSKKSARPVYPFAAIVGQDEMKLCLLLNVIDPKIGGVMIMGDRGTGKSTTVRSLVDLLPEINVVAGDPYNSDPIDPEFMGVEVRERVEKGEQVPVIATKINMVDLPLGATEDRVCGTIDIEKALTEGVKAFEPGLLAKANRGILYVDEVNLLDDHLVDVLLDSAASGWNTVEREGISISHPARFILIGSGNPEEGELRPQLLDRFGMHAQVGTVRDADLRVKIVEERARFDSNPKDFRDTYKTEQDKLQDQISTARANLSSVQIDRELKVKISRVCSELNVDGLRGDIVTNRAAKALAALKGKDRVTPDDVATVIPNCLRHRLRKDPLESIDSGVLVSEKFAEIFS

SEQ ID NO: 1639 - DNA, 1161 bp, Arabidopsis thaliana
atggttgttgctatggaccaacgcaccaatgtgaacggagatcccggcgccggagaccggaagaaagaagaaaggtttgatccgagtgcacaaccaccgttcaagatcggagatataagggcggcgattcctaagcactgttgggttaagagtcctttgagatcaatgagttacgtcgtcagagacattatcgccgtcgcggctttggccatcgctgccgtgtatgttgatagctggttcctttggcctctttattgggccgcccaaggaacacttttctgggccatctttgttctcggccacgactgtggacatgggagtttctcagacattcctctactgaatagtgtggttggtcacattcttcattctttcatcctcgttccttaccatggttggagaataagccaccggacacaccaccagaaccatggccatgttgaaaacgacgagtcatgggttccgttaccagaaagggtgtacaagaaattgccccacagtactcggatgctcagatacactgtccctctccccatgctcgcatatcctctctatttgtgctacagaagtcctggaaaagaaggatcacattttaacccatacagtagtttatttgctccaagcgagagaaagcttattgcaacttcaactacttgttggtccataatgttcgtcagtcttatcgctctatctttcgtcttcggtccactcgcggttcttaaagtctacggtgtaccgtacattatctttgtgatgtggttggatgctgtcacgtatttgcatcatcatggtcacgatgagaagttgccttggtatagaggcaaggaatggagttatctacgtggaggattaacaacaattgatagagattacggaatctttaacaacattcatcacgacattggaactcacgtgatccatcatctcttcccacaaatccctcactatcacttggtcgacgccacgaaagcagctaaacatgtgttgggaagatactacagagaaccaaagacgtcaggagcaataccgatccacttggtggagagtttggtcgcaagtattaagaaagatcattacgtcagcgacactggtgatattgtcttctacgagacagatccagatctctacgtttacgcttctgacaaatctaaaatcaattaa

SEQ ID NO: 1640 - protein, 386 aa, Arabidopsis thaliana
MVVAMDQRTNVNGDPGAGDRKKEERFDPSAQPPFKIGDIRAAIPKHCWVKSPLRSMSYVVRDIIAVAALAIAAVYVDSWFLWPLYWAAQGTLFWAIFVLGHDCGHGSFSDIPLLNSVVGHILHSFILVPYHGWRISHRTHHQNHGHVENDESWVPLPERVYKKLPHSTRMLRYTVPLPMLAYPLYLCYRSPGKEGSHFNPYSSLFAPSERKLIATSTTCWSIMFVSLIALSFVFGPLAVLKVYGVPYIIFVMWLDAVTYLHHHGHDEKLPWYRGKEWSYLRGGLTTIDRDYGIFNNIHHDIGTHVIHHLFPQIPHYHLVDATKAAKHVLGRYYREPKTSGAIPIHLVESLVASIKKDHYVSDTGDIVFYETDPDLYVYASDKSKIN

SEQ ID NO: 1641 - DNA, 282 bp, Arabidopsis thaliana
atggcttcgtattactctggttttttgggttgtgaagagccacactttttggaatcgtgttctctttgccggaaacaccttggtcttaactccgatatcttcatgtacagaggagacaaggctttttgtagcaacgagtgtagagaagaacagattgaatctgatgaagctaaggagagaaagtggaaaaaatcttcaagatctctccggaaaaattcttctgaaactaaagaatccgccgccggaaacaccgtacggacaggaactctcgtcgtggcttag

SEQ ID NO: 1642 - protein, 93 aa, Arabidopsis thaliana
MASYYSGFLGCEEPHFLESCSLCRKHLGLNSDIFMYRGDKAFCSNECREEQIESDEAKERKWKKSSRSLRKNSSETKESAAGNTVRTGTLVVA

SEQ ID NO: 1643 - DNA, 693 bp, Arabidopsis thaliana
atggcttctctgaagctttcaccttcttctccaatctccatttctaaggttggtgtgattccttcctctaagaaaggactttcatttcttgtaaaagcagagcaccattcctcgtcttcttcttctcatcttcaagataaatgtcagagacgtctgattgtaacatttggtgttgttgctccttggatctcattgcttagtagagctccattatcatttgctgcagaaagcaaaaaaggattccttgctgtctctgacaataaagatgcttatgcgtttctctatccatttggttggcaggaagttgtgattgaaggtcaagataaggtatacaaagatgtgattgagcctttagaaagtgttagtgtgaatttggtcccaactagcaaacagactattaaagaatttggccctcccaagcagatagctgaaacactgataaagaaagttttggcacctccaaatcagaaaacaacccttattgatgcatcagagcatgatgtcgatgggaagacttattatcagtttgagttcactgttcaagctagaaactacactcgccatgctctgggtaccatcacggttttcaacggaaacttctacacactgacgacgggagcgaatgaaaggaggtgggagaagatgaaagataggcttcacactgtggtagattccttcaagatcactgtttga

SEQ ID NO: 1644 - protein, 230 aa, Arabidopsis thaliana
MASLKLSPSSPISISKVGVIPSSKKGLSFLVKAEHHSSSSSSHLQDKCQRRLIVTFGVVAPWISLLSRAPLSFAAESKKGFLAVSDNKDAYAFLYPFGWQEVVIEGQDKVYKDVIEPLESVSVNLVPTSKQTIKEFGPPKQIAETLIKKVLAPPNQKTTLIDASEHDVDGKTYYQFEFTVQARNYTRHALGTITVFNGNFYTLTTGANERRWEKMKDRLHTVVDSFKITV

SEQ ID NO: 1645 - DNA, 456 bp, Arabidopsis thaliana
atggcggatgctttcacagatgaacagatccaagagttttacgaagccttctgtctcatagacaaagattccgatgggttcatcacgaaggagaagctaacgaaagtgatgaagtcgatggggaagaatccaaaggcggaacaactgcaacagatgatgagcgatgttgacatctttggcaacggtggcatcacttttgatgatttcttgtatattatggctcaaaacacttctcaggaatcagcatcggatgagttaattgaggtattcagagtgttcgacagagacggagatggtctcatatctcaacttgagttgggagaaggaatgaaggacatggggatgaagataacagcagaagaagcggagcatatggtccgagaagccgaccttgatggcgatggttttctttctttccacgaattctctaaaatgatgattgctgcctcttattag

SEQ ID NO: 1646 - protein, 151 aa, Arabidopsis thaliana
MADAFTDEQIQEFYEAFCLIDKDSDGFITKEKLTKVMKSMGKNPKAEQLQQMMSDVDIFGNGGITFDDFLYIMAQNTSQESASDELIEVFRVFDRDGDGLISQLELGEGMKDMGMKITAEEAEHMVREADLDGDGFLSFHEFSKMMIAASY

SEQ ID NO: 1647 - DNA, 474 bp, Arabidopsis thaliana
atggcttccttatccacttccgttgtagcttcggcttcgtcgcgtttatggaatcctgctgcctccaacggcaagatttgcgttccttctgcttcgctttctctgcgtacgggttgtagacggagttcgtcctctctcacttcttccgcttcttcgcaattgcttcattgctcgtttctctcgtcgcctgtttccctagcgtctccattttctggtttgtccattgcgtttgatctcagcagtcaaactagtggactgaatggccagagacgcagaggccttgtggttagagctggaaaagctgctctgtgtcaaactaagagaagcagatcaagaaaatctctagctaggactcatggtttccgtagaaggatgaggaccactagcggtagagcaaccataaagcgtcgacgtgccaagggacgttggaacctctgtcccaagtccaaccctagcagcggcaaacgggcttga

SEQ ID NO: 1648 - protein, 157 aa, Arabidopsis thaliana
MASLSTSVVASASSRLWNPAASNGKICVPSASLSLRTGCRRSSSSLTSSASSQLLHCSFLSSPVSLASPFSGLSIAFDLSSQTSGLNGQRRRGLVVRAGKAALCQTKRSRSRKSLARTHGFRRRMRTTSGRATIKRRRAKGRWNLCPKSNPSSGKRA

SEQ ID NO: 1649 - DNA, 390 bp, Arabidopsis thaliana
atggcagcttcgtctctcaatctcctcctcattctctctcttctcactttcatttctctccagagatctgaatctctttccgataatccatctctcactcttctacccgacggattcgactggccgatctctcactccgatgaattcgatatcatcgacggtgaagaaagcttcgaagttacggaggaagacgacggcgtaacagatcgacggtcattgtactggcggaggacgaagtattacatatcgtacggtgcattgtcggcgaatagagtgccatgtcctcccagatctggaagatcgtactacactcataactgcttcagagctagaggtcccgttcatccgtatagccgaggctgctcgtcgatcactcgatgccggagatag

SEQ ID NO: 1650 - protein, 129 aa, Arabidopsis thaliana
MAASSLNLLLILSLLTFISLQRSESLSDNPSLTLLPDGFDWPISHSDEFDIIDGEESFEVTEEDDGVTDRRSLYWRRTKYYISYGALSANRVPCPPRSGRSYYTHNCFRARGPVHPYSRGCSSITRCRR

SEQ ID NO: 1651 - DNA, 615 bp, Arabidopsis thaliana
atgggaagtgtacagttgagtggttccggcctagtagcttctctacctccaaatcatagctttagccacaagaccaaacttaataagccaaattcgtacttctttcgctcaaaacacaatgccgcaagaaccaaaaccgtccgagccataagcaccgcaccagcgagccagcctccagccgctgatgagcccgacgaacctcctgctgtcgattttgcgttcgtccattcggtgttgttgccggacgggacaccggacgtacattggagaagagcgaacggtggacagaaactaagagacataatgttggattctaacatcgaactctatggtccttatagtaagcctttgtcaaactgcgcaggagtaggaacttgcgctacttgcatggtcgagattgtaaatggaaaggagcttctaaatccgcgaactgatattgagaaggagaaactcaaaaggaaaccaaaaaattggagactagcttgtcaaaccaacgtgggaaatccagattctaccggattggttgtcatacaacaattgccagagtggaaagctcatgagtggaacatccctaagaatatacctaatgacgatgatctcgaaacttctacttga

SEQ ID NO: 1652 - protein, 204 aa, Arabidopsis thaliana
MGSVQLSGSGLVASLPPNHSFSHKTKLNKPNSYFFRSKHNAARTKTVRAISTAPASQPPAADEPDEPPAVDFAFVHSVLLPDGTPDVHWRRANGGQKLRDIMLDSNIELYGPYSKPLSNCAGVGTCATCMVEIVNGKELLNPRTDIEKEKLKRKPKNWRLACQTNVGNPDSTGLVVIQQLPEWKAHEWNIPKNIPNDDDLETST

SEQ ID NO: 1653 - DNA, 1344 bp, Arabidopsis thaliana
atggccacacatgcagctctcgccgtctcaagaatcccggtcacacagcgactgcagtctaagagtgccattcactctttccctgctcaatgctcctccaagaggctagaagtcgctgaattctccggtctgcgtatgagtagtatcggtggggaagcatctttcttcgatgctgtagctgcacaaatcatccctaaggctgtgacaacatcaactcctgttagaggagagacagtggcgaaactgaaagttgcgattaacggttttggaaggattggtaggaactttcttaggtgttggcatggtcgtaaagactctcctctcgaagttgttgtacttaacgacagtggtggtgtcaagaatgcatcccacttgcttaagtatgactccatgcttggaaccttcaaggctgaagtgaaaattgtggacaatgaaactattagtgttgatggtaagctcatcaaagttgtctccaacagagaccctcttaagcttccatgggctgagctcggcattgacattgttatcgagggaacaggagtgtttgttgatgggccaggagcagggaagcatatccaagccggagcctcgaaagttatcatcactgcaccagccaaaggtgctgatatccctacctatgttatgggagtcaatgagcaagactatggtcacgatgtcgctaacattattagcaatgcatcttgcaccaccaactgtttggcaccttttgctaaagtcttggatgaagaatttggaattgtcaaggggacaatgacaaccacacactcctacaccggagaccaaaggcttctagatgcatcacacagggacctaaggcgtgcaagagccgcagcactgaacatagtgcctaccagcacaggagcagccaaggcggtgtcattagtgttgccgcagctgaagggtaaacttaacggcattgcactccgtgtgccaacaccaaacgtctcagtggttgaccttgttataaacgttgagaagaaaggtttgacagcagaggatgtgaacgaggcctttagaaaagccgctaatggaccgatgaaaggcattttagacgtttgcgatgcgcctcttgtctctgttgacttcaggtgctctgatgtctctaccaccattgactcgtccctcactatggttatgggtgatgatatggtcaaggtggttgcttggtatgataacgagtggggttacagccaaagagtggtggatttggctcacctagtggctagcaagtggccgggagcggaagctgttggaagtggagatcctttggaggatttctgcaagacaaacccggctgatgaggaatgcaaagtctatgactga

SEQ ID NO: 1654 - protein, 447 aa, Arabidopsis thaliana
MATHAALAVSRIPVTQRLQSKSAIHSFPAQCSSKRLEVAEFSGLRMSSIGGEASFFDAVAAQIIPKAVTTSTPVRGETVAKLKVAINGFGRIGRNFLRCWHGRKDSPLEVVVLNDSGGVKNASHLLKYDSMLGTFKAEVKIVDNETISVDGKLIKVVSNRDPLKLPWAELGIDIVIEGTGVFVDGPGAGKHIQAGASKVIITAPAKGADIPTYVMGVNEQDYGHDVANIISNASCTTNCLAPFAKVLDEEFGIVKGTMTTTHSYTGDQRLLDASHRDLRRARAAALNIVPTSTGAAKAVSLVLPQLKGKLNGIALRVPTPNVSVVDLVINVEKKGLTAEDVNEAFRKAANGPMKGILDVCDAPLVSVDFRCSDVSTTIDSSLTMVMGDDMVKVVAWYDNEWGYSQRVVDLAHLVASKWPGAEAVGSGDPLEDFCKTNPADEECKVYD

SEQ ID NO: 1655 - DNA, 582 bp, Arabidopsis thaliana
atggcgaacatgaacgctcttcaacaaatgatcttcccagacgagaacgctccaattcatcgcaaaaagtctgtcactgctgcttctgtgaaatccaaagggactgtacttggtcagaagaaacctggaggagctcgtaaggctctgaatgatattacaaacaagtctgggattcatgcgaaagctgctgcttcttcaaagaacaagcaaattgcttctgctgctgtgaaagagattgatatagctggggaaaggtttttacatgatcacagcaaatgcatcaaagaacagcaaaatctttgggatgatcactactctgctgatctcatgctacttcatcatggttccagcatcaaggagaagcatctcaattgggacattgaaaagatggatgctaaggacgatctgacttacgaagaaccagaagagatggcatcgcccaagttttctgattggctgaagaactcgactccatggcgctctccaatccgtcatggctctatgatgccttccactcctctggcttggcggttcgattcatgcgaattcacacttaaagaagactctgacgacctcttctga

SEQ ID NO: 1656 - protein, 193 aa, Arabidopsis thaliana
MANMNALQQMIFPDENAPIHRKKSVTAASVKSKGTVLGQKKPGGARKALNDITNKSGIHAKAAASSKNKQIASAAVKEIDIAGERFLHDHSKCIKEQQNLWDDHYSADLMLLHHGSSIKEKHLNWDIEKMDAKDDLTYEEPEEMASPKFSDWLKNSTPWRSPIRHGSMMPSTPLAWRFDSCEFTLKEDSDDLF

SEQ ID NO: 1657 - DNA, 783 bp, Arabidopsis thaliana
atgatggaaacagctctgctccggtactgcgtcaacttttccggtcacaagaaaatctctgctcatcaaagaagtaatagtgagattccgaaaacgagtccgggaggatgcgaagacgagtggtgtgctagggttttgagtagaagatcggtaatggcgtcagggttggtctcctcgacgacggctttagcatttccaagggaaggattggctgtcgttaaacaaggtcttctcgctgggagagttcctggtctgtccgaacctgatgaagaaggttggagaacataccgtagaccagacgagaagtcaggagggcatggtgttggttggagtcctattatcccttacgccttttcggttcctcaagattggaatgaggtacctgtatcgatcgctgatcttggtggcaccgagattgacttgagatttgctagtcctaaagaaggccgtttgtctgttattgtagctcctgttcttagatttgcagataacctcggggacgatgttaagattgaaaatattggacaaccagcgaaggtgattaacgcgtttggaccagaagttattggagaaaacgtagaagggaaggtgttaagttccaatgttgcagaacacgatggtagactctattaccaattcgagctagagccgcctcatgtactgataactgcaacagctgccggaaaccgcctttacttgttcagtgtcaccggaaacggtcttcaatggaagagacactacaaggatctgaagaggatagctagttcattccgcattgtttag

SEQ ID NO: 1658 - protein, 260 aa, Arabidopsis thaliana
MMETALLRYCVNFSGHKKISAHQRSNSEIPKTSPGGCEDEWCARVLSRRSVMASGLVSSTTALAFPREGLAVVKQGLLAGRVPGLSEPDEEGWRTYRRPDEKSGGHGVGWSPIIPYAFSVPQDWNEVPVSIADLGGTEIDLRFASPKEGRLSVIVAPVLRFADNLGDDVKIENIGQPAKVINAFGPEVIGENVEGKVLSSNVAEHDGRLYYQFELEPPHVLITATAAGNRLYLFSVTGNGLQWKRHYKDLKRIASSFRIV

SEQ ID NO: 1659 - DNA, 960 bp, Arabidopsis thaliana
atggccactgtgaaaatctctctttccttggcttcgctatcaccatcttcttcttcttcttcaattcaatctaagttatcaccatctttcattcccaatgcggcacctgcaaaggcggtgaagttgcgattcaatggaaagtccctgagagcaaaaccaatggtatacagatcatctcgctccgttggagtcacctgctctgcttcatcttctctgacgactcttccctctgctcttctcttcgattgcgatggcgttcttgttgataccgagaaggacggtcacaggatctccttcaacgacactttcaaagagagagatttgaatgttacgtgggatgttgatttatacggcgagttacttaaaatcggtggtggtaaagaaaggatgactgcgtattttaacaaggttggttggccagagaaagctcctaaagatgaagcagagaggaaagagttcatagctggacttcacaagcagaagactgagcttttcatggttcttatcgagaaaaagctgcttccgcttcgacccggtgttgcaaagttggttgatcaagctttaacaaacggagtcaaagtagctgtgtgcagtacttcaaatgagaaggcggtttctgctatagtttcatgcttgcttggaccagaacgagcagagaaaatcaagatattcgcaggagacgtagtccccaaaaagaaacctgatccagccatctacaacttagcagctgaaacccttggagttgatccctcaaaatgtgtagtggttgaagacagcgcgatcgggctagcagctgcaaaagctgcgggaatgacttgtatagttacaaagagtggatacacggctgatgaagatttcgagaacgcagatgcggttttcgactgcattggagaccctccagaagagagatttgatttggcattctgtggaagtcttctccggaaacagttcgttagttaa

SEQ ID NO: 1660 - protein, 319 aa, Arabidopsis thaliana
MATVKISLSLASLSPSSSSSSIQSKLSPSFIPNAAPAKAVKLRFNGKSLRAKPMVYRSSRSVGVTCSASSSLTTLPSALLFDCDGVLVDTEKDGHRISFNDTFKERDLNVTWDVDLYGELLKIGGGKERMTAYFNKVGWPEKAPKDEAERKEFIAGLHKQKTELFMVLIEKKLLPLRPGVAKLVDQALTNGVKVAVCSTSNEKAVSAIVSCLLGPERAEKIKIFAGDVVPKKKPDPAIYNLAAETLGVDPSKCVVVEDSAIGLAAAKAAGMTCIVTKSGYTADEDFENADAVFDCIGDPPEERFDLAFCGSLLRKQFVS

SEQ ID NO: 1661 - DNA, 1134 bp, Arabidopsis thaliana
atggctgatggtgaagacattcaacctcttgtttgcgacaatggaactggaatggttaaggctggttttgctggggatgatgcacctagagctgtgtttcctagtattgtgggtcgtcctcgtcacaccggtgtgatggttgggatggggcaaaaggatgcttatgttggcgatgaagctcaatccaaacgaggtattttaactctcaagtaccctattgagcatggaattgtcaacaattgggatgacatggagaagatttggcatcacactttctacaatgagctccgtgttgctcctgaggaacatcctattctacttaccgaggcaccgcttaacccgaaagctaatcgtgagaagatgactcaaatcatgtttgagactttcaatgcccctgctatgtatgtggctattcaggctgttctttctctttatgccagtggtcgtactaccggtattgtgctcgactctggagatggtgtgagccacactgttcctatctatgaggggtatgcacttccacatgctatcctacgtcttgatcttgctggtcgtgacctcacggatgcgctgatgaagatcctaaccgagcgtggttactctttcaccaccacagcagagcgtgaaattgtcagagacataaaggagaagctttgctacattgctcttgactacgagcaggaactcgagacagccaaaaccagctcatctgttgagaagaactacgagctacctgatgggcaagtgatcaccattggatcagagcgattccgttgtcctgaggttctttaccagccatctatgattggtatggagaatgctggtatccatgaaaccacctataactccataatgaagtgtgatgtcgacatcaggaaggacttgtacggtaacattgtgctcagtggtggaaccacaatgttccctggaatcgccgacagaatgagcaaagagatcactgctttggctccaagcagcatgaagatcaaagtcgttgcccctccagagaggaaatactctgtctggattggagggtccatcttggcctccctcagtaccttccagcagatgtggatcgcaaaggcagagtatgacgagtcaggtccatcgattgttcacaggaagtgcttctga

SEQ ID NO: 1662 - protein, 377 aa, Arabidopsis thaliana
MADGEDIQPLVCDNGTGMVKAGFAGDDAPRAVFPSIVGRPRHTGVMVGMGQKDAYVGDEAQSKRGILTLKYPIEHGIVNNWDDMEKIWHHTFYNELRVAPEEHPILLTEAPLNPKANREKMTQIMFETFNAPAMYVAIQAVLSLYASGRTTGIVLDSGDGVSHTVPIYEGYALPHAILRLDLAGRDLTDALMKILTERGYSFTTTAEREIVRDIKEKLCYIALDYEQELETAKTSSSVEKNYELPDGQVITIGSERFRCPEVLYQPSMIGMENAGIHETTYNSIMKCDVDIRKDLYGNIVLSGGTTMFPGIADRMSKEITALAPSSMKIKVVAPPERKYSVWIGGSILASLSTFQQMWIAKAEYDESGPSIVHRKCF

SEQ ID NO: 1663 - DNA, 351 bp, Arabidopsis thaliana
atgagaggactctccacaaaacccgttgcgataatcatcgcaattctcaccgtccacttcttattcgccgccgtaacctcccaatcctccggcgatttcgtaccgatcgagtcgaaatgcaacggtaccatcgccgagtgctccttatccacggcggaggaagagttcgagatggactctgagatcaacaggcgtattttagcaacaacgaagtatataagctacggtgcgctgaggagaaacacagttccttgctcacgacgcggcgcatcttactacaattgccgacgtggagctcaggctaatccttactctcgtggctgtagcgctattactcgttgcaggcgataa

SEQ ID NO: 1664 - protein, 116 aa, Arabidopsis thaliana
MRGLSTKPVAIIIAILTVHFLFAAVTSQSSGDFVPIESKCNGTIAECSLSTAEEEFEMDSEINRRILATTKYISYGALRRNTVPCSRRGASYYNCRRGAQANPYSRGCSAITRCRR

SEQ ID NO: 1665 - DNA, 618 bp, Arabidopsis thaliana
atgggatcttcttctgggcaaagtgggtatgatctatctttcaagatcttgttgattggagattctggtgttggtaaaagcagcttgcttctcagcttcatttccagctctgtcgaagatcttgctcccaccattggtgttgactttaagatcaaacagatgaaagtaagagggaaaaggctgaaacttacaatctgggacacagctggacaagaaaagttcagaacattgacaagttcttatttcagaggctcccaaggaatcattctcgtttatgatgtcacgaaaagagagacatttttgaacttggcagatatttgggctaaagagattgagctatattcgactaaccatgactgcattaagatgctcgttggcaacaaagttgatagagaatcagaaaggaaggttagccgggaagaaggaatggctctagcgaaagacctcaattgtttgtttcatgaatgtagcgcaagaacccgagaaaacgtgaacggatgcttcgaagagctagctttgaagataatggaggtacctagtcttttggaagaaggatcaagctctgtgaagagaaaaccggattaccgagctcatcaaggccggtgttgcagctcgtga

SEQ ID NO: 1666 - protein, 205 aa, Arabidopsis thaliana
MGSSSGQSGYDLSFKILLIGDSGVGKSSLLLSFISSSVEDLAPTIGVDFKIKQMKVRGKRLKLTIWDTAGQEKFRTLTSSYFRGSQGIILVYDVTKRETFLNLADIWAKEIELYSTNHDCIKMLVGNKVDRESERKVSREEGMALAKDLNCLFHECSARTRENVNGCFEELALKIMEVPSLLEEGSSSVKRKPDYRAHQGRCCSS

SEQ ID NO: 1667 - DNA, 1434 bp, Arabidopsis thaliana
atggcgcatctactttcagcttcatgcccttcagttatctcacttagcagcagcagcagcaagaattcagttaagccgtttgtttcagggcagaccttcttcaatgctcagcttctttcaagatcttctctcaaaggacttctcttccaagagaagaaaccgagaaaaagctgcgttttcagagcaactgctgtacctataacccaacaagcaccacccgaaacatctaccaataactcatcctctaaaccaaagcgtgttatggtcattggtggagatggttattgcggttgggctactgctctccacttgtccaagaagaattacgaagtttgcattgttgacaaccttgtaagacgtcttttcgaccaccagcttggacttgagtcattgactcctattgcctccattcatgaccgaatcagccgatggaaggctttgacagggaaatcaattgagttgtacgttggtgatatctgtgatttcgaattcttagctgagtctttcaagtcttttgagccggattcagttgtccactttggggaacagagatccgctccttactcgatgattgaccggtccagagcagtttatacacagcacaacaatgtgattgggactctcaacgttctctttgctataaaagagtttggagaggagtgtcatcttgtaaaacttgggacgatgggtgagtatggaactccaaatattgacatcgaggaaggttatataaccataacccacaacggtagaactgacactttgccataccccaagcaagctagctccttttatcatcttagcaaagttcatgattcgcacaacattgcttttacttgcaaggcttggggtattagagccactgatctcaaccaaggagttgtttatggagtgaagactgatgagacagagatgcatgaggaactccgtaaccgactggattacgatgctgtgtttggtacagcacttaaccggttctgtgtgcaagctgctgttggtcacccacttacagtttatggtaaaggtggtcagacgagaggctacctcgatataagagacacggttcaatgtgttgagatcgctatagcaaacccggcaaaagctggtgagttccgggtcttcaaccaatttacagaacagttttcagtcaatgaactggcttcactcgtcactaaagcgggttcaaagcttgggctagacgtgaaaaagatgacggtgcctaacccgagagtggaggcagaagaacattactacaacgcaaagcacactaagctgatggaacttggacttgagcctcactatctatctgactcacttcttgattcgttgctcaactttgctgttcagtttaaagatcgtgtggacacgaaacaaatcatgcctagtgtttcctggaagaagattggcgtcaagactaagtccatgaccacataa

SEQ ID NO: 1668 - protein, 477 aa, Arabidopsis thaliana
MAHLLSASCPSVISLSSSSSKNSVKPFVSGQTFFNAQLLSRSSLKGLLFQEKKPRKSCVFRATAVPITQQAPPETSTNNSSSKPKRVMVIGGDGYCGWATALHLSKKNYEVCIVDNLVRRLFDHQLGLESLTPIASIHDRISRWKALTGKSIELYVGDICDFEFLAESFKSFEPDSVVHFGEQRSAPYSMIDRSRAVYTQHNNVIGTLNVLFAIKEFGEECHLVKLGTMGEYGTPNIDIEEGYITITHNGRTDTLPYPKQASSFYHLSKVHDSHNIAFTCKAWGIRATDLNQGVVYGVKTDETEMHEELRNRLDYDAVFGTALNRFCVQAAVGHPLTVYGKGGQTRGYLDIRDTVQCVEIAIANPAKAGEFRVFNQFTEQFSVNELASLVTKAGSKLGLDVKKMTVPNPRVEAEEHYYNAKHTKLMELGLEPHYLSDSLLDSLLNFAVQFKDRVDTKQIMPSVSWKKIGVKTKSMTT

SEQ ID NO: 1669 - DNA, 576 bp, Arabidopsis thaliana
atggcgaatgtggatcgtgatcggcgtgtgcatgtagaccgtactgacaaacgtgttcatcagccaaactacgaagatgatgtcggttttggtggctatggcggttatggtgctggttctgattataagagtcgcggcccctccactaaccaaatcttggcacttatagcaggagttcccattggtggcacactgctaaccctagctggactcactctagccggttcggtgatcggcttgctagtctccatacccctcttcctcctcttcagtccggtgatagtcccggcggctctcactattgggcttgctgtgacgggaatcttggcttctggtttgtttgggttgacgggtctgagctcggtctcgtgggtcctcaactacctccgtgggacgagtgatacagtgccagagcaattggactacgctaaacggcgtatggctgatgcggtaggctatgctggtatgaagggaaaagagatgggtcagtatgtgcaagataaggctcatgaggctcgtgagactgagttcatgactgagacccatgagccgggtaaggccaggagaggctcataa

SEQ ID NO: 1670 - protein, 191 aa, Arabidopsis thaliana
MANVDRDRRVHVDRTDKRVHQPNYEDDVGFGGYGGYGAGSDYKSRGPSTNQILALIAGVPIGGTLLTLAGLTLAGSVIGLLVSIPLFLLFSPVIVPAALTIGLAVTGILASGLFGLTGLSSVSWVLNYLRGTSDTVPEQLDYAKRRMADAVGYAGMKGKEMGQYVQDKAHEARETEFMTETHEPGKARRGS

SEQ ID NO: 1671 - DNA, 1998 bp, Arabidopsis thaliana
atggcgactggtcgatacatcgttgaggttgagaagggaaagcaaggcgttgatggaggaagtccatcggtcggtccagtgtaccggagtatctatgctaaagacggttttcctgaaccgcctgatgatctcgtcagtgcatgggatattttccgtttatctgtggagaaatctccaaataatcctatgcttggtcgtagagaaatagttgatggaaaagctgggaaatatgtatggcaaacttacaaagaagtacataatgtagtgattaagcttggaaactctatcagaactattggagttggaaaaggagataaatgcggtatttatggcgccaatagtcctgaatggattataagcatggaggcttgcaatgctcatggactctactgtgtacctttatatgacactctaggtgctggagcaatagaattcatcatttgtcatgctgaggtctcacttgcttttgctgaggagaacaagatttctgagttattgaagacagctccaaaatcaactaaatatttgaagtatattgtgagctttggtgaggttacaaataatcagagagtagaagctgagaggcacagattaacaatatattcatgggaccaattcttgaagctaggcgagggtaaacattatgaattaccagagaagaggagaagcgatgtttgcaccataatgtatacaagtggcacaactggtgatcctaaaggagtattgcttacaaatgagagcattattcatctccttgaaggtgttaaaaaattgcttaaaactattgatgaagagttaaccagtaaagatgtatatctctcatatctacctctggctcatatcttcgatcgtgtgattgaggagctgtgtatttatgaagcagcctctatcggattctggcgaggggatgttaagatattgatagaagacattgctgcattgaaaccgactgttttctgcgctgttcctcgcgttctagagagaatatacaccggtcttcagcagaaactttctgatggtggttttgtaaagaagaaattattcaactttgcattcaaatacaaacataaaaacatggagaaagggcagcctcatgaacaagcatctccaatagctgacaaaattgtatttaaaaaggtaaaagaagggttgggaggaaacgtgcgtcttatcctctcaggagcagctcctcttgcagctcacatcgaatctttccttcgagttgtcgcgtgtgctcatgttttgcaaggatacggtctaacagagagttgtggtgggacttttgtgtccattccaaacgagctttcaatgcttggaacggttggtccaccggttccaaacgttgacataaggctagagtcagttccagagatgggttatgacgctcttgcaagcaatccacgtggagagatttgcatcaggggaaagactttgttctctggatactacaaacgtgaagatctcactcaagaagtcttcattgatggatggcttcacactggtgatgtcggtgagtggcaaccagatggagccatgaagatcatcgaccgtaagaagaacatctttaaactgtctcaaggagaatacgttgccgttgagaacttggagaacatatacagtcatgtcgccgccattgaatcgatatgggtatatggaaacagctatgagtcttacttagtggctgtggtatgtccaagcaagatccagatcgagcattgggccaaagaacacaaagtttcaggagactttgagtctatctgccgaaaccaaaagactaaagagtttgtccttggagagttcaacagagtagccaaagacaaaaagctgaagggatttgagctgatcaaaggtgttcatttggacacagtcccgttcgacatggaaagagatctcatcactccttcttacaagatgaaaagacctcagcttctcaagtactatcagaaagagattgatgaaatgtataagaaaaacagagaagtgcagctacgagtgtaa

SEQ ID NO: 1672 - protein, 665 aa, Arabidopsis thaliana
MATGRYIVEVEKGKQGVDGGSPSVGPVYRSIYAKDGFPEPPDDLVSAWDIFRLSVEKSPNNPMLGRREIVDGKAGKYVWQTYKEVHNVVIKLGNSIRTIGVGKGDKCGIYGANSPEWIISMEACNAHGLYCVPLYDTLGAGAIEFIICHAEVSLAFAEENKISELLKTAPKSTKYLKYIVSFGEVTNNQRVEAERHRLTIYSWDQFLKLGEGKHYELPEKRRSDVCTIMYTSGTTGDPKGVLLTNESIIHLLEGVKKLLKTIDEELTSKDVYLSYLPLAHIFDRVIEELCIYEAASIGFWRGDVKILIEDIAALKPTVFCAVPRVLERIYTGLQQKLSDGGFVKKKLFNFAFKYKHKNMEKGQPHEQASPIADKIVFKKVKEGLGGNVRLILSGAAPLAAHIESFLRVVACAHVLQGYGLTESCGGTFVSIPNELSMLGTVGPPVPNVDIRLESVPEMGYDALASNPRGEICIRGKTLFSGYYKREDLTQEVFIDGWLHTGDVGEWQPDGAMKIIDRKKNIFKLSQGEYVAVENLENIYSHVAAIESIWVYGNSYESYLVAVVCPSKIQIEHWAKEHKVSGDFESICRNQKTKEFVLGEFNRVAKDKKLKGFELIKGVHLDTVPFDMERDLITPSYKMKRPQLLKYYQKEIDEMYKKNREVQLRV

SEQ ID NO: 1673 - DNA, 873 bp, Arabidopsis thaliana
atgggcgcgaatatctcgggaggttcaccggagtttgaccggaacgatgacgtttactcgaggaaactcagattggtggatttacctgagaattgtgtagcgttgattatgacacggcttgatccacctgagatttgccggcttgctcgtctcaacaggatgttccgtcgcgcttcctcagctgatttcatttgggaatcaaagttgcctgcgaattatcgtgttattgcacacaaggtgttcgatgaaattactctgacgaaattaataaagaaagatctttatgcaaagcttagccagcctaatctcttcgacgatggcacaaaggaattgtggatagataagaacacgggtcgtctttgtttatctatttcttcaaaggcactaaggattactggaattgatgatcggagatactggagtcatatcccaactgatgaatccaggttccagtcagctgcttatgttcaacagatatggtggtttgaagtaggaggagagtttgagatccagtttccatctggaacatatagtctcttcttccgtatccagctcggtaaaacatcaaagaggcttggaaggaggatctgcaactctgaacacattcatggatgggacataaaacctgtaaggttccagctcgccacttcggacaaccaacaagctgtatcattgtgttatctgaacaacaaccctgggagctggagtcactatcacgttggagatttcaaagtgacaaatccagatgtatcaacaggaatcaaattctccatgactcaaatcgattgcactcacacgaaaggtgggctatgcatagactctgttcttatattacctaaagaatgtgcaaaagaagtcattggatcacaatag

SEQ ID NO: 1674 - protein, 290 aa, Arabidopsis thaliana
MGANISGGSPEFDRNDDVYSRKLRLVDLPENCVALIMTRLDPPEICRLARLNRMFRRASSADFIWESKLPANYRVIAHKVFDEITLTKLIKKDLYAKLSQPNLFDDGTKELWIDKNTGRLCLSISSKALRITGIDDRRYWSHIPTDESRFQSAAYVQQIWWFEVGGEFEIQFPSGTYSLFFRIQLGKTSKRLGRRICNSEHIHGWDIKPVRFQLATSDNQQAVSLCYLNNNPGSWSHYHVGDFKVTNPDVSTGIKFSMTQIDCTHTKGGLCIDSVLILPKECAKEVIGSQ

SEQ ID NO: 1675 - DNA, 465 bp, Arabidopsis thaliana
atggctatggcggcgtctattatccaatcttctccgctctccttcaatagcaacaacgcaaagccacggattcatagttcaggatcgctcggcggaatcaaaagccaaaatagagtctctccattgagtgcggttggattaagctcaggccttggaagtagaaggaaatctcttttgatatgtcactcagccattaacgcgaaatgcagtgaaggacaaacacagaccgttactcgggagtcaccgactataacacaggctcctgtacactctaaggagaaatcaccaagcctagacgatggaggagacgggttcccaccgcgagatgatggagatggtggtggaggaggagggggtggaggcaactggtcgggtgggttcttcttctttggttttctggccttcttgggtctattgaaggataaagagggcgaggaagattaccgagggagcagaaggcgataa

SEQ ID NO: 1676 - protein, 154 aa, Arabidopsis thaliana
MAMAASIIQSSPLSFNSNNAKPRIHSSGSLGGIKSQNRVSPLSAVGLSSGLGSRRKSLLICHSAINAKCSEGQTQTVTRESPTITQAPVHSKEKSPSLDDGGDGFPPRDDGDGGGGGGGGGNWSGGFFFFGFLAFLGLLKDKEGEEDYRGSRRR

SEQ ID NO: 1677 - DNA, 378 bp, Arabidopsis thaliana
atggcagcgaaatttcgaatttcttcttcttcgtttagccacagggctagtgattcctcaacttcatcatcttcttcatattcatcattgcttgctttacctcaattcttttgtccaccatcaccattaggattcccagaattcaagcttcatgccaaattaggtggaggagatggagaagtgaagcctaaagataagaaaaagtttataaccaaagaggaagaacctgaacagtattggcaaagcgttggagaaagagaaggagagaatccgatgaagacgcctcttccttacattatcatattcggtatgtcaactccattcgtcatcttagccattgcttttgccaatggttggatcaaagttcccattcgttga

SEQ ID NO: 1678 - protein, 125 aa, Arabidopsis thaliana
MAAKFRISSSSFSHRASDSSTSSSSSYSSLLALPQFFCPPSPLGFPEFKLHAKLGGGDGEVKPKDKKKFITKEEEPEQYWQSVGEREGENPMKTPLPYIIIFGMSTPFVILAIAFANGWIKVPIR

SEQ ID NO: 1679 - DNA, 999 bp, Arabidopsis thaliana
atgcttgtcgacgggaaactcgtctgcgtcaccggagccggcggctacattgcttcttggatcgttaagttactcttagagagaggctacaccgttagaggaaccgtaaggaacccaactgatcccaagaacaaccatctcagagagcttcaaggagccaaggaaagactcactcttcacagtgcagatcttctcgactacgaagctctctgtgccacaatcgacggttgcgatggcgttttccacactgcctctccgatgaccgacgatcccgagacaatgttggagccggcggtgaacggagccaagttcgtgattgacgcagcggctaaagccaaggtcaagcgcgtggttttcacgtcatcaattggtgcagtttacatgaaccctaaccgtgacactcaagccattgttgacgaaaactgctggagtgatcttgatttctgcaaaaacactaagaattggtattgctacgggaagatgttggcggaacaatcggcatgggagacggccaaagcaaaaggtgtggacttagtggtgctaaatccggttttggttctcggaccaccgctccagtcagcgatcaacgctagtctagtccatattctcaagtacctcaccggctcagccaagacctacgctaacttgactcaggtctacgtggacgtccgtgacgtggcactaggccatgttctggtctacgaagcaccctccgcctcaggccgttacatcctcgccgagaccgcacttcaccgcggagaggttgttgagattctggccaaattcttcccggagtatccacttcccaccaagtgttcggacgagaagaatccgagggctaagccatacaagtttactacccaaaagataaaagacttaggcttggaatttaaacccatcaagcaatctctttacgaatctgtcaagagcttgcaagagaaaggccatcttcctctacctcaagattcgaaccaaaacgaagtcatcatcgaatcttag

SEQ ID NO: 1680 - protein, 332 aa, Arabidopsis thaliana
MLVDGKLVCVTGAGGYIASWIVKLLLERGYTVRGTVRNPTDPKNNHLRELQGAKERLTLHSADLLDYEALCATIDGCDGVFHTASPMTDDPETMLEPAVNGAKFVIDAAAKAKVKRVVFTSSIGAVYMNPNRDTQAIVDENCWSDLDFCKNTKNWYCYGKMLAEQSAWETAKAKGVDLVVLNPVLVLGPPLQSAINASLVHILKYLTGSAKTYANLTQVYVDVRDVALGHVLVYEAPSASGRYILAETALHRGEVVEILAKFFPEYPLPTKCSDEKNPRAKPYKFTTQKIKDLGLEFKPIKQSLYESVKSLQEKGHLPLPQDSNQNEVIIES

SEQ ID NO: 1681 - DNA, 459 bp, Arabidopsis thaliana
atgagtcaacacatgaaccttctcctgccttcatttgaaacggacaaagaggaatacgatgaacgcaagacaacagaccacggaggcatcggtggcagcgtctggaggttcaaaggcaacaaagcggccaaggaagcggctagtgtctcaatgaaaggtacacttgctaggttattcgactgctgcagcaaagacgtcaaaaagactattttgcctctgggtcacggcgacccctccgtctacccttgcttccaaacgtccgttgacgctgaggaagcggtggttgaatccttacggtctggagctgcaaactcttacgcccccggggtcggtattttaccggccagaaggagaggtactaggactgaagaattgggtgagattctctatcggagtggagaggtctatgctggaagatgcattcatgaggctcaaaggcttcttcgctcgccatactaa

SEQ ID NO: 1682 - protein, 152 aa, Arabidopsis thaliana
MSQHMNLLLPSFETDKEEYDERKTTDHGGIGGSVWRFKGNKAAKEAASVSMKGTLARLFDCCSKDVKKTILPLGHGDPSVYPCFQTSVDAEEAVVESLRSGAANSYAPGVGILPARRRGTRTEELGEILYRSGEVYAGRCIHEAQRLLRSPY

SEQ ID NO: 1683 - DNA, 1254 bp, Arabidopsis thaliana
atgcttttgataccttccttcaccgcaaattctaacgaaccaccaccgtcgaagctttctctttccgatctttcaatggcgattctcaaatctcacttcttcttactcttccctcttcttcttctccactttcacactgtctcctttgctcagacgctctttgtgttcggagatggtctttacgacgccggaaacaaacagtttctctctcagaaccgagttgacgcaagctttcctccttatggagtcactgtaggacaagccaccggacggtggtccgatggttctatcgttcctgattatcttgctaaattcatgggaattcctaaaatctctccgattctcctaaccacggcggatttttctcacggagctaatttcgccatcgccgacgctaccgttcttggctctcctccggagacgatgactttgtcacaacaagtgaagaaattctcggaaaacaagaataagtggacaaatcaaacacgttctgaagctatctacttgatctacattggttctgatgattacttgagctatgctaagagtaatccaagtccatcagatactcagaaacaagcttttgttgatcaagtcatcactaccataaaagcagaaataaaggtggtttacgggtctggcggaaggaaattcgcattccagaacttggcaccgttaggttgcttaccggccgtgaaacaagcaagcggaaatgttcaagaatgtgtgaaattgccttcggaaatggctgctttgcataacaagaaacttttgcagctcttggttgaactatcaagagaactaaatggtttccagtactcgttttacgacttctttagctcgatccaaaacagagttatcaagtctaagacttatacattcgagacaggaaacgctgcttgttgtggaactggctctatcaacgggagtaattgctcagctaaaaatgtatgcgccaagcctgaagagtatatcttctttgatggtaagcatttgacgcaagaagccaaccttcaggtcgggcatttgatgtggggagcagatccggaagtgattggaccgaacaatatcagggagcttatggtccttcctctagacattacagtcatcttagctggtatacaagaagctatggctgccatgagaccgagacagagcaacattgagagtctctatgatatcaagaagatggagtcagagatggataatcattggctttatcaagttgacaaagctatctcctttatgatataa

SEQ ID NO: 1684 - protein, 417 aa, Arabidopsis thaliana
MLLIPSFTANSNEPPPSKLSLSDLSMAILKSHFFLLFPLLLLHFHTVSFAQTLFVFGDGLYDAGNKQFLSQNRVDASFPPYGVTVGQATGRWSDGSIVPDYLAKFMGIPKISPILLTTADFSHGANFAIADATVLGSPPETMTLSQQVKKFSENKNKWTNQTRSEAIYLIYIGSDDYLSYAKSNPSPSDTQKQAFVDQVITTIKAEIKVVYGSGGRKFAFQNLAPLGCLPAVKQASGNVQECVKLPSEMAALHNKKLLQLLVELSRELNGFQYSFYDFFSSIQNRVIKSKTYTFETGNAACCGTGSINGSNCSAKNVCAKPEEYIFFDGKHLTQEANLQVGHLMWGADPEVIGPNNIRELMVLPLDITVILAGIQEAMAAMRPRQSNIESLYDIKKMESEMDNHWLYQVDKAISFMI

SEQ ID NO: 1685 - DNA, 1119 bp, Arabidopsis thaliana
atgtttgtttccgataacaacaatccttcacgggacataaacatgatgatcggcgatgttacatcaaacggagatctacagccacaccagatcatcctcggagaaagcagtggaggagaggatcatgagatcatcaaagcaccaaagaaacgagcagagacatgggcacaagacgagactcgaaccttaatctcattacggagagaaatggacaatcttttcaacacttccaaatctaacaaacatctctgggaacagatttctaagaaaatgagagagaaagggtttgatcgatcaccatctatgtgtacggacaagtggaggaacatattgaaagagtttaagaaagctaagcaacatgaagataaagcaacaagtggaggatcaacgaagatgtcttattacaatgagattgaagatattttcagagaaagaaagaagaaagtggcattctataagagtcctgctactactacaccatcttctgctaaagttgattcctttatgcaatttacagataaaggttttgaagatactggtatttcatttacatctgttgaagctaatggcaggccaacgctaaatcttgaaacggagcttgatcatgatggtcttcctctccccattgctgctgatcccatcacagcaaatggagttcctccttggaattggagagacacccctggaaatggcgttgatggtcagccatttgctgggaggatcataacggtgaaatttggagattacacaagacgagttgggattgatggtactgctgaagcaattaaggaagctatcagatccgcgtttagattgagaacaagacgagctttttggctagaagatgaagaacaggttattcgctctcttgaccgagacatgcctttagggaactatatactccgcattgatgaagggatagccgttagagtgtgccactatgatgaatctgatccgttaccagtccatcaagaggagaagatattctacaccgaagaagattaccgagatttcttggctcgacgaggatggacatgtctgagagagtttgacgcgtttcaaaacatagacaatatggacgagcttcaatccggtcgcttatacagaggaatgagatga

SEQ ID NO: 1686 - protein, 372 aa, Arabidopsis thaliana
MFVSDNNNPSRDINMMIGDVTSNGDLQPHQIILGESSGGEDHEIIKAPKKRAETWAQDETRTLISLRREMDNLFNTSKSNKHLWEQISKKMREKGFDRSPSMCTDKWRNILKEFKKAKQHEDKATSGGSTKMSYYNEIEDIFRERKKKVAFYKSPATTTPSSAKVDSFMQFTDKGFEDTGISFTSVEANGRPTLNLETELDHDGLPLPIAADPITANGVPPWNWRDTPGNGVDGQPFAGRIITVKFGDYTRRVGIDGTAEAIKEAIRSAFRLRTRRAFWLEDEEQVIRSLDRDMPLGNYILRIDEGIAVRVCHYDESDPLPVHQEEKIFYTEEDYRDFLARRGWTCLREFDAFQNIDNMDELQSGRLYRGMR

SEQ ID NO: 1687 - DNA, 690 bp, Arabidopsis thaliana
atggaagggtttcttcgctttcttgtagcgaaagccatcttattggctttagcatcttcatttgtatcttgttacgacccaagtcctcttcaggacttttgtgttgccgtcgatgacgctagtggtgttttcgtgaatggaaaattctgcaaagacccaaaatacgtgaaagctgaagacttttttacttccggactaaacatcgccggaaacacaataaaccgcgttggctccaacgttacaaacgttaacgttgacaaaatccctggactcaacaccctcggagtgtctcttgtccgaattgactttgccccgggaggtcaaaacccgccacacacgcacccacgagccactgagatcctcgtggttgtcgaaggaacactcttagtcggttttgtaacatcgaaccaagacaacaacagattgttctcaaaggttctttacccgggagacgttttcgtgtttcccataggaatgatacattttcaagtgaacgttgggaggacgaacgcagttgcgtttgctggtcttggtagccaaaatcccggtacaatcacaatcgcagacgccgtttttggatcgaagccttcgattatgccggagattttagcaaaagcgtttcagctggatgtgaacgtggttaaatatctcgaggcaagattttcttccaattatgatcgtcattattaa

SEQ ID NO: 1688 - protein, 229 aa, Arabidopsis thaliana
MEGFLRFLVAKAILLALASSFVSCYDPSPLQDFCVAVDDASGVFVNGKFCKDPKYVKAEDFFTSGLNIAGNTINRVGSNVTNVNVDKIPGLNTLGVSLVRIDFAPGGQNPPHTHPRATEILVVVEGTLLVGFVTSNQDNNRLFSKVLYPGDVFVFPIGMIHFQVNVGRTNAVAFAGLGSQNPGTITIADAVFGSKPSIMPEILAKAFQLDVNVVKYLEARFSSNYDRHY

SEQ ID NO: 1689 - DNA, 678 bp, Arabidopsis thaliana
atggcgaagaaagaagagagtgtgaagcttctagggttttggataagcccttttagtcgtagagtcgagatggctctcaaacttaaaggcgtaccatacgagtacttggaagaagacttacccaaaaagagcactttacttcttgaactaaatccggttcacaagaaggttccggttcttgttcacaatgataaattattatccgagtcacatgtgatcctcgaatacatcgaccaaacttggaataacaatccaattctacctcacgatccctacgagaaggccatggttcggttctgggccaagttcgttgatgagcagatcctaccagttggcttcatgcccctagtaaaagcagagaagggaatagatgttgctattgaggagattcgagaaatgcttatgtttcttgagaaggaagtcactggaaaagatttctttggtggcaagacgatcggattcttggacatggttgcgggaagtatgatcccgttttgtcttgctcgggcttgggaatgtttggggattgatatgactccagaggatacgtttccagaattaaacagatggatcaagaacttgaatgaagttgagatcgtgagggaatgtatacctccaaaagagaaacatattgagcgtatgaagaaaattatagagagagctaagtctacgttctaa

SEQ ID NO: 1690 - protein, 225 aa, Arabidopsis thaliana
MAKKEESVKLLGFWISPFSRRVEMALKLKGVPYEYLEEDLPKKSTLLLELNPVHKKVPVLVHNDKLLSESHVILEYIDQTWNNNPILPHDPYEKAMVRFWAKFVDEQILPVGFMPLVKAEKGIDVAIEEIREMLMFLEKEVTGKDFFGGKTIGFLDMVAGSMIPFCLARAWECLGIDMTPEDTFPELNRWIKNLNEVEIVRECIPPKEKHIERMKKIIERAKSTF

SEQ ID NO: 1691 - DNA, 396 bp, Arabidopsis thaliana
atggctttttccaaatctctagtgtttgttcttctcgctgctcttttgatttcttccgcagtggctcaatctccggctccagctccatctaacgtcggaggtagacggatctcaccggctccttcacctaagaagatgactgctcctgctcctgcacctgaagtttctccttctccttctccggcagccgcattgactccagaatcctctgcttcaccaccatcgccgcctctagctgattctcctaccgctgactccccggctttgtctccatctgcgatctccgattctccgactgaagctcctggtcctgctcagggcggcgccgtttcgaacaaattcgccagtttcggatctgtggcggttatgttaactgctgccgttttggttatctag

SEQ ID NO: 1692 - protein, 131 aa, Arabidopsis thaliana
MAFSKSLVFVLLAALLISSAVAQSPAPAPSNVGGRRISPAPSPKKMTAPAPAPEVSPSPSPAAALTPESSASPPSPPLADSPTADSPALSPSAISDSPTEAPGPAQGGAVSNKFASFGSVAVMLTAAVLVI

SEQ ID NO: 1693 - DNA, 1113 bp, Arabidopsis thaliana
atggcactaatgaagaagagtctctctgctgctcttctctcatcaccacttctgatcatatgtcttatcgcattgctcgctgatccgttttcagtcggtgctcgccggttattggaggatcctaaaccggagataccaaaattgcctgagctacctaaattcgaagttcccaagttgccggagttccctaaaccagagttgcccaagttacccgaatttccaaagcctgagttgccaaagatcccggagattccaaagccagagttaccaaaggtaccggagattccaaagcctgaggaaactaaactgccagatattcccaagcttgaattgcccaagtttccggaaattccaaaacctgagctcccaaagatgccagagattccaaaacctgagttaccaaaggtaccggagattcagaagcccgagttaccaaaaatgccggagattccaaagcctgaattaccaaagtttccagagattccaaagcctgatttgccaaagtttccagagaattcaaagcctgaggtgcctaagctaatggagactgaaaagcctgaggctcctaaggtgccagagattccaaagcctgagttgccaaagttgccagaagttcccaagcttgaggctcctaaggtaccagagatccagaagccggagttgcccaaaatgccggagttacctaagatgccggagattcagaaacctgagttgccaaagttgccagaagttcccaagcttgaggctcctaaggtaccggagatccagaagccggagttgcccaaaatgccggagttacctaagatgccggagattcagaaacccgagttgcccaagatgccggagattcagaagcctgagttgccgaaggtgccagaggttccaaagcccgaattgccaacggttccagaggttccaaagtctgaggctcctaagtttccagagattccaaagcctgaactgccgaagattccagaagttccaaaacctgaactgcccaaggttccagaaattacaaaacctgcagttccagagattccaaagccagagctaccgacgatgcctcaacttcccaagttgccggaattcccaaaagttcccggaactccttaa

SEQ ID NO: 1694 - protein, 370 aa, Arabidopsis thaliana
MALMKKSLSAALLSSPLLIICLIALLADPFSVGARRLLEDPKPEIPKLPELPKFEVPKLPEFPKPELPKLPEFPKPELPKIPEIPKPELPKVPEIPKPEETKLPDIPKLELPKFPEIPKPELPKMPEIPKPELPKVPEIQKPELPKMPEIPKPELPKFPEIPKPDLPKFPENSKPEVPKLMETEKPEAPKVPEIPKPELPKLPEVPKLEAPKVPEIQKPELPKMPELPKMPEIQKPELPKLPEVPKLEAPKVPEIQKPELPKMPELPKMPEIQKPELPKMPEIQKPELPKVPEVPKPELPTVPEVPKSEAPKFPEIPKPELPKIPEVPKPELPKVPEITKPAVPEIPKPELPTMPQLPKLPEFPKVPGTP

SEQ ID NO: 1695 - DNA, 2004 bp, Arabidopsis thaliana
atgggttcaactccgttttgctactctatcaatccatctccatcaaagcttgatttcacgaggacccatgtgtttagtcctgtttctaaacagttttacttagatttatcatcgttttccggaaaacccggaggagtatctgggtttaggagccgtcgagctttgctcggagtaaaggcggcgacggcgttagttgagaaggaggagaagagagaggcggtgacggagaagaagaagaaatcgagggttttagttgccggaggtggaatcggaggattggtgtttgctttagcggctaagaagaaaggattcgatgtgttagtgtttgagaaagatttgagtgctataagaggagaaggaaaatacagaggcccgattcaaatacagagcaacgctttagctgctttggaagctattgatattgaagttgctgaacaagttatggaagctgggtgtatcactggtgatcggattaacggtctcgttgatggtatctctggtacttggtatgtaaagtttgatactttcactcctgcggcgtcacggggacttcctgtgactagagtaattagtagaatgactctgcagcagattctagcacgtgcggttggagaagatgtgattagaaacgagagtaatgttgttgattttgaagattctggagataaggttactgtggtactcgagaatggtcaacgctatgaaggtgatctgcttgtgggtgcagatggcatttggtctaaggtgagaaataatttgtttggccgtagtgaagctacttattcaggctacacttgttacacggggattgcagattttataccagcggatatcgagtctgttggctaccgggttttcttgggacacaaacagtactttgtttcttcggatgttggtggtggaaaaatgcaatggtatgcatttcacgaggaaccagctggtggggctgatgctccaaatggtatgaagaaaaggttgtttgaaatatttgacggttggtgcgacaatgtactcgacttgttgcatgcgactgaggaggaagccattctgagaagagatatttatgatagaagtcctggttttacttggggtaaagggcgtgttacgctgctcggggattctatccatgcgatgcagccaaatatgggtcaaggtggatgcatggccattgaggatagttttcaactagcattggagcttgatgaagcatggaaacagagtgttgaaacgactacacctgttgatgttgtttcctctttgaaaagatatgaggaatctagaagactgagagtcgctattatccatgcaatggcgaggatggctgcaattatggcttccacttacaaagcatacttaggtgttgggcttggtcctctgtctttcttgacaaagtttagagtaccacatccaggaagagttggtggtagattcttcgttgacattgctatgccatcgatgcttgactgggtccttggaggtaacagtgaaaaactccaaggaaggccacctagttgcagactcactgacaaagccgatgaccggcttcgagagtggtttgaagatgacgatgctcttgaacgtactataaagggagaatggtatctaattccacacggcgacgattgttgcgtttcggaaacattatgtctaaccaaagatgaagatcaaccttgcatcgtcggaagcgaaccagatcaagattttcctggaatgcgcattgtgatcccttcgtctcaggtttcgaagatgcatgctcgtgtgatttacaaagacggagctttcttcttgatggatcttcgaagcgaacacggaacctatgtgaccgataacgaaggaagaagatatagagcaacaccgaattttcccgcgcggtttagatcgtccgacatcatcgagtttggttcagataagaaggcggcgtttagggtgaaagtaatcaggaaaactccgaaatcgacgaggaagaatgagagtaacaacgataaattacttcagacagcttga

SEQ ID NO: 1696 - protein, 667 aa, Arabidopsis thaliana
MGSTPFCYSINPSPSKLDFTRTHVFSPVSKQFYLDLSSFSGKPGGVSGFRSRRALLGVKAATALVEKEEKREAVTEKKKKSRVLVAGGGIGGLVFALAAKKKGFDVLVFEKDLSAIRGEGKYRGPIQIQSNALAALEAIDIEVAEQVMEAGCITGDRINGLVDGISGTWYVKFDTFTPAASRGLPVTRVISRMTLQQILARAVGEDVIRNESNVVDFEDSGDKVTVVLENGQRYEGDLLVGADGIWSKVRNNLFGRSEATYSGYTCYTGIADFIPADIESVGYRVFLGHKQYFVSSDVGGGKMQWYAFHEEPAGGADAPNGMKKRLFEIFDGWCDNVLDLLHATEEEAILRRDIYDRSPGFTWGKGRVTLLGDSIHAMQPNMGQGGCMAIEDSFQLALELDEAWKQSVETTTPVDVVSSLKRYEESRRLRVAIIHAMARMAAIMASTYKAYLGVGLGPLSFLTKFRVPHPGRVGGRFFVDIAMPSMLDWVLGGNSEKLQGRPPSCRLTDKADDRLREWFEDDDALERTIKGEWYLIPHGDDCCVSETLCLTKDEDQPCIVGSEPDQDFPGMRIVIPSSQVSKMHARVIYKDGAFFLMDLRSEHGTYVTDNEGRRYRATPNFPARFRSSDIIEFGSDKKAAFRVKVIRKTPKSTRKNESNNDKLLQTA

SEQ ID NO: 1697 - DNA, 438 bp, Arabidopsis thaliana
atggcgatgacgtcagcagctaccggatttattctcacggccaacgtcccggcggcaataggcggtggttcttcaaagagcaccaccattgtgtctttcttgccgatgagaagcttcggttcaaggctagtagtcagagcggcggaagatacacctccggcaaccgcctcgtcggatagttcttccaccaccgctgctgctgctccggcgaaagttccggccgctaaggctaaacctcctccaattggcccaaagagaggatccaaggtcaagattctaaggaaagaatcatactggtacaagaacgttggatcagttgtggccgttgatcaggacccgaagacccgatatccggttgtggtccggttcgccaaggtgaattacgcgaatatatcgaccaacaactacgcattggacgaggtggaagaagtaaaatga

SEQ ID NO: 1698 - protein, 145 aa, Arabidopsis thaliana
MAMTSAATGFILTANVPAAIGGGSSKSTTIVSFLPMRSFGSRLVVRAAEDTPPATASSDSSSTTAAAAPAKVPAAKAKPPPIGPKRGSKVKILRKESYWYKNVGSVVAVDQDPKTRYPVVVRFAKVNYANISTNNYALDEVEEVK

SEQ ID NO: 1699 - DNA, 537 bp, Arabidopsis thaliana
atgggtggtttccggtttcaccagtatcaggtggttgggagagccctcccgacagagaacgatgagcaccctaagatctacaggatgaagctttggggtagaaatgaagtatgcgccaagtccaagttctggtacttcatgaggaaactgaagaaggtgaagaaaagcaacggacagatgcttgccatcaatgagattttcgagaagaacccaacgaccatcaagaactacgggatctggttgcgttatcagagccgaactgggtaccacaacatgtacaaggagtaccgtgacacaacactcaatggtggagtggagcagatgtacactgagatggcttctcgtcatagagtgaggttcccttgcattcagatcatcaagactgcgactgtccctgcaaagctttgcaagagagagatcaccaagcagttccataactcgaagatcaagttccctcttgttttcaggaaggtcagaccaccaagcaggaagcttaagactacatacaaggcatcaaaacctaaccttttcatgtag

SEQ ID NO: 1700 - protein, 178 aa, Arabidopsis thaliana
MGGFRFHQYQVVGRALPTENDEHPKIYRMKLWGRNEVCAKSKFWYFMRKLKKVKKSNGQMLAINEIFEKNPTTIKNYGIWLRYQSRTGYHNMYKEYRDTTLNGGVEQMYTEMASRHRVRFPCIQIIKTATVPAKLCKREITKQFHNSKIKFPLVFRKVRPPSRKLKTTYKASKPNLFM

SEQ ID NO: 1701 - DNA, 681 bp, Arabidopsis thaliana
atgagctcatctgattccgttaataacggcgttaactcacggatgtacttccgtaacccgagtttcagcaacgttatcttaaacgataactggagcgacttgccgttaagtgtcgacgattctcaagacatggctatttacaacactctccgtgatgccgttagctccggctggacaccctccgttcctcccgttacctctccggcggaggaaaataagcctccggcgacgaaggcgagtggctcacacgcgccgaggcagaaggggatgcagtacagaggagtgaggaggaggccgtgggggaaattcgcggcggagattagggatccgaagaagaacggagctagggtttggctcgggacttacgagacgccggaggacgcggcggtggcgtacgaccgagcggcgtttcagctcagaggatcgaaagctaagctgaattttccgcatttgattggttcttgtaagtatgagccggttaggattaggcctcgccgtcgctcgccggaaccgtcagtctccgatcagttaacgtcggagcagaagagggaaagccacgtggatgacggcgagtctagtttggttgtaccggagttggatttcacggtggatcagttttacttcgatggtagtttattaatggaccaatcagaatgttcttattctgataatcggatataa

SEQ ID NO: 1702 - protein, 226 aa, Arabidopsis thaliana
MSSSDSVNNGVNSRMYFRNPSFSNVILNDNWSDLPLSVDDSQDMAIYNTLRDAVSSGWTPSVPPVTSPAEENKPPATKASGSHAPRQKGMQYRGVRRRPWGKFAAEIRDPKKNGARVWLGTYETPEDAAVAYDRAAFQLRGSKAKLNFPHLIGSCKYEPVRIRPRRRSPEPSVSDQLTSEQKRESHVDDGESSLVVPELDFTVDQFYFDGSLLMDQSECSYSDNRI

SEQ ID NO: 1703 - DNA, 609 bp, Arabidopsis thaliana
atggctatggctacgcgagcgattcgataccagttaccgtcaccgagatttagagctcctagatgcgaatcatcggaaccgattaagcagattcagatccagcaacgaccaagaggtggcgatttagccgagaacgggaagatcgtgctccaaccaaggctttgcacgctgagatcttatggatctgatatggtcatcgctaaaaaggacggcggagatggtggaggaggaggatctgatgttgagttagcgtctccgttttttgagacgcttacggattacatagagagttcgaagaagagtcaggatttcgaaaccatctccggtagactcgccatgattgtatttgcggtgacggtgacggaggagattgttacggggaactcgttgtttaagaaactagatgtggaaggattgagtgaagctattggagctggtctcgccgcgatgggatgcgcggcgatgtttgcttggttaacgatttctcggaacagagtcggacggatctttacagtgagttgcaactcgttcattgactcgttggttgatcagatcgttgatggactgttctacgataccaagcctagtgattggtctgatgatctttaa

SEQ ID NO: 1704 - protein, 202 aa, Arabidopsis thaliana
MAMATRAIRYQLPSPRFRAPRCESSEPIKQIQIQQRPRGGDLAENGKIVLQPRLCTLRSYGSDMVIAKKDGGDGGGGGSDVELASPFFETLTDYIESSKKSQDFETISGRLAMIVFAVTVTEEIVTGNSLFKKLDVEGLSEAIGAGLAAMGCAAMFAWLTISRNRVGRIFTVSCNSFIDSLVDQIVDGLFYDTKPSDWSDDL

SEQ ID NO: 1705 - DNA, 990 bp, Arabidopsis thaliana
atgtcgtcagcttattgttcctccgccgtggctgtatccgccgcagccaccgcttcctccgccgctacctttaatccattactctcctcccactccaattcccaactcttctatcgctttacaccaaaatccttcaaactcgttgccaattgccctaatccactaatcctccactcaaatatccgccgccaccgcttcttctgcgccgccgaaaccgaagctagttccgccgatgatgaaatccaggcatcagtagaagaagaagaagaggtagaagaagaaggagatgaaggtgaagaagaagtagaggaagaaaaacagacgacgcaagcgagtggtgaagaagggaggctttacgttgggaatttaccttacacaatcacttcttctgagctctctcagatttttggagaagctggaactgtcgtcgatgttcagattgtttatgataaagttactgatagaagcagaggatttggatttgtaacaatgggaagcattgaagaagctaaagaagcgatgcagatgtttaacagctctcaaattggtggtagaacggtgaaagtgaacttcccggaggtgccgagaggcggtgagaacgaagtaatgagaaccaaaatccgtgataataaccggagttatgttgatagtcctcataaggtatatgcaggaaaccttggttggaatctaacctcacaaggtttaaaggatgcatttggtgatcaacctggtgtgcttggtgctaaagttatctatgaaagaaatactgggaggtctagggggtttggtttcatctcgttcgagtcagcggaaaatgttcagtctgctttggctacaatgaatggcgtggaagttgaaggacgagcgctgaggctaaatttggcttcagagagagagaaacccactgtgtctcctccttccgtagaagaaggagaaaccgaggaggccagtctagagagtaacgaggtgctttcgaatgttagtgcatga

SEQ ID NO: 1706 - protein, 329 aa, Arabidopsis thaliana
MSSAYCSSAVAVSAAATASSAATFNPLLSSHSNSQLFYRFTPKSFKLVANCPNPLILHSNIRRHRFFCAAETEASSADDEIQASVEEEEEVEEEGDEGEEEVEEEKQTTQASGEEGRLYVGNLPYTITSSELSQIFGEAGTVVDVQIVYDKVTDRSRGFGFVTMGSIEEAKEAMQMFNSSQIGGRTVKVNFPEVPRGGENEVMRTKIRDNNRSYVDSPHKVYAGNLGWNLTSQGLKDAFGDQPGVLGAKVIYERNTGRSRGFGFISFESAENVQSALATMNGVEVEGRALRLNLASEREKPTVSPPSVEEGETEEASLESNEVLSNVSA

SEQ ID NO: 1707 - DNA, 843 bp, Arabidopsis thaliana
atggcaacatctttgcttctcagacattcctcagctgtcttcttctctcagtcttccttcttcaccaagaacaaatcttttcgctcctttacttccatcaaaatggaaaaaggtgaagcagagaatgcagtgaagacaaagaaggtgtttgtcgcaggagcaactggacaaaccgggaagaggattgtggagcagttgttgtcccgtggctttgccgtcaaagctggtgttcgtgatgtagagaaagcaaaaacatctttcaaagacgacccgtctcttcagatagttagagcagacgtgacagaaggtcctgataagctagctgaagttataggtgatgattctcaagctgtgatttgtgctactgggtttcgtcccggatttgatatattcactccttggaaagtcgataatttcgggacagtgaatcttgtggatgcttgccgtaaacaaggagtggaaaagtttgttcttgtaagctccatcttggtgaatggagctgccatgggacagatactgaaccctgcttacctcttcctcaacctctttggactaactcttgtcgctaagcttcaagccgagaagtatatcaaaaaatctggcatcaactatactatagtaaggcctggtggtcttaaaaacgatcctccaactggaaatgttgtcatggagccagaggatactctatatgaagggagtatatcgagagacctggtcgcagaagttgcagtggaagctttacttcaagaggaatcatctttcaaggttgtggagatagttgctcgtgccgaagctccaaaacgttcctacaaagatctatttgcctctgttaaaggacaataa

SEQ ID NO: 1708 - protein, 280 aa, Arabidopsis thaliana
MATSLLLRHSSAVFFSQSSFFTKNKSFRSFTSIKMEKGEAENAVKTKKVFVAGATGQTGKRIVEQLLSRGFAVKAGVRDVEKAKTSFKDDPSLQIVRADVTEGPDKLAEVIGDDSQAVICATGFRPGFDIFTPWKVDNFGTVNLVDACRKQGVEKFVLVSSILVNGAAMGQILNPAYLFLNLFGLTLVAKLQAEKYIKKSGINYTIVRPGGLKNDPPTGNVVMEPEDTLYEGSISRDLVAEVAVEALLQEESSFKVVEIVARAEAPKRSYKDLFASVKGQ

SEQ ID NO: 1709 - DNA, 1068 bp, Arabidopsis thaliana
atgttgaaagtagagagtaactgggcacaagcctgtgatacatgccgatcagccgcctgcaccgtgtactgccgggctgattctgcctacttgtgctccagttgtgatgctcaagttcatgctgccaatcgtcttgcttcccgccatgaacgtgttcgagtctgtcaatcatgtgagcgagccccggctgcctttttctgcaaggcagatgctgcatctctatgcacaacctgtgattcagagattcattccgcaaacccacttgctagacgccatcaacgagttccaattctgcccatttctgagtactcttacagttccacggccactaaccattcatgtgagacaacagtgacagatccagagaacagacttgtgcttggtcaagaagaagaggatgaagatgaagcagaggcggcttcatggttgttgcctaattcagggaaaaacagtggtaacaacaatggcttctcgattggggatgagtttctgaaccttgttgattatagttcgagtgataagcaattcacagatcaatccaatcagtatcaactagactgcaacgtacctcagaggagctatggggaagatggagttgttccacttcaaattgaagtatcaaagggcatgtaccaagagcaacagaactttcagctgagtatcaactgtggctcctggggagctcttcgaagctccaatggttccctcagtcatatggtgaatgtttcatctatggacctgggagttgtgccggagtcaacaacgagtgacgcaacagtatcaaacccaagatcgcccaaagcggtaacagaccaaccaccttaccctccagctcagatgctcagtccaagggacagagaagctagagtcctgagatacagagagaagaagaagatgaggaaatttgagaagacgataagatatgcttcaaggaaagcgtatgcagagaaaagaccacggatcaagggccggtttgcaaagaagaaagatgtcgatgaagaggcaaaccaagctttctccacaatgataacatttgacaccggatatggaattgttccatcattctga

SEQ ID NO: 1710 - protein, 355 aa, Arabidopsis thaliana
MLKVESNWAQACDTCRSAACTVYCRADSAYLCSSCDAQVHAANRLASRHERVRVCQSCERAPAAFFCKADAASLCTTCDSEIHSANPLARRHQRVPILPISEYSYSSTATNHSCETTVTDPENRLVLGQEEEDEDEAEAASWLLPNSGKNSGNNNGFSIGDEFLNLVDYSSSDKQFTDQSNQYQLDCNVPQRSYGEDGVVPLQIEVSKGMYQEQQNFQLSINCGSWGALRSSNGSLSHMVNVSSMDLGVVPESTTSDATVSNPRSPKAVTDQPPYPPAQMLSPRDREARVLRYREKKKMRKFEKTIRYASRKAYAEKRPRIKGRFAKKKDVDEEANQAFSTMITFDTGYGIVPSF

SEQ ID NO: 1711 - DNA, 1956 bp, Arabidopsis thaliana
atgcagacattaccaagctcagaaaccgttcttttaggctccaactcagcaccacctgtgttgcgtagtcccggtggcgatgacgtggacatcgattttggtgacgtgtttggtggtcctcctaagagacgctctaaagttactagtaacgaagtcacacgacatagcttcagtgaatccgctctccggcgtcgtgacgtcatcgtcgacgtcggcgatctgcttccgcaagacgagaagcctgtattcggcgaagatacatcatctgtccggcgtcgtttcaccactgatgatttcttcgacgatattttcagagttaatgaatcatcatcacttccgggttctcggatccttagcccggctcacaaacccgaatcttcttcagggacttcgtctccatcccaattcagtcttcctgcaaaagcaacagagattccaacatttaatttagcagctactcgtagtttgaacaagaacaaagaaactgtttcgagctctcctttgtcaagaacttcaagcaaagcagatgtggtctctactgctaaatcatattcagatgattgtgatgatcctccacaagtttttgttactgggaaaggaaggcaatttcatttctctatctacaagtggcctaataaaggagttcctgttgttatttggggaagctctagattgagttctatgtctaaagctgaggagacaacacctgtaccattgagtgattatcgaaaaacttcagttgttgagaaattgggtaaaaatgaagaaggagatggaaaaagtggtttatctggtttgaaagatgtgaagaagacctcgctaaagcgtcctggtgtccagacaaaagaagagaaaacagaaacagatttgaagtctgaacaagccttctttggtgtctcaaaagcacgtgaggctaatgtgaagcctcttgattcagttgagtctgaacaggccttctctggtgtgtcaaaagcacatgaagctactactgtgaagcctcttcattcaatttttcatgaagaagatgagagacaagatgagaaaatagtatcagagagagaagtgagaaaaggtaaaagcaaagcgaagaacactcgaagttttaccgaagattcaagaaccaagaagaaatcacaaggcactaaaagttctttggatagtagcccgatacccgataaatccagcttcgcaagttcatcagcagcaccagaagttggcaaagatggagtcaaaggaaaagtgagtgacttcgttaagattttcagtaaaggagcttcagttggagcaggtggggaatctcttggacaaagctctagatggagagctaaagaaactcccaagactgatatcattcatgatggttctaatgccaaggaaactgtaaacattcctgatcaacaaaagaaatcgactccagatatccccgctatgaatcgggatcagaaaccttcacagtcaactcagaaaaaagattcagaccgggagagcatgaactataaggctcctggtgatactgtacaagaagagagacaagaacctagcacaacacatactacctcagaggatatagatgagcccttccatgtaaatttcgatgtggaggatataacacaagatgaaaacaaaatggaagaggccaataaggatgctgaagaaatcaagaacatcgatgctaaaatccgcaagtggtcaagcggaaagagtggaaacattcggtctcttctatccacgctgcaatatattctttggtctgggagcgggtggaagccggttcctctaatggatatgatcgaaggaaacgcggttcgaaaatcgtaccagagggcattactaatacttcatccagacaaactacaacaaaagggtgcttctgcaaaccagaaatacatggccgagaaagttttcgaattattacaggaagcatgggaccacttcaacactctcggaccggtttaa

SEQ ID NO: 1712 - protein, 651 aa, Arabidopsis thaliana
MQTLPSSETVLLGSNSAPPVLRSPGGDDVDIDFGDVFGGPPKRRSKVTSNEVTRHSFSESALRRRDVIVDVGDLLPQDEKPVFGEDTSSVRRRFTTDDFFDDIFRVNESSSLPGSRILSPAHKPESSSGTSSPSQFSLPAKATEIPTFNLAATRSLNKNKETVSSSPLSRTSSKADVVSTAKSYSDDCDDPPQVFVTGKGRQFHFSIYKWPNKGVPVVIWGSSRLSSMSKAEETTPVPLSDYRKTSVVEKLGKNEEGDGKSGLSGLKDVKKTSLKRPGVQTKEEKTETDLKSEQAFFGVSKAREANVKPLDSVESEQAFSGVSKAHEATTVKPLHSIFHEEDERQDEKIVSEREVRKGKSKAKNTRSFTEDSRTKKKSQGTKSSLDSSPIPDKSSFASSSAAPEVGKDGVKGKVSDFVKIFSKGASVGAGGESLGQSSRWRAKETPKTDIIHDGSNAKETVNIPDQQKKSTPDIPAMNRDQKPSQSTQKKDSDRESMNYKAPGDTVQEERQEPSTTHTTSEDIDEPFHVNFDVEDITQDENKMEEANKDAEEIKNIDAKIRKWSSGKSGNIRSLLSTLQYILWSGSGWKPVPLMDMIEGNAVRKSYQRALLILHPDKLQQKGASANQKYMAEKVFELLQEAWDHFNTLGPV

SEQ ID NO: 1713 - DNA, 2130 bp, Arabidopsis thaliana
atgatgatgcagagaaactgtttcggatttaacctaaagaaccgaggaggtgaaaagaagaaagcatccaaatctttcagggaaggagttaaaaaaatcagatcagaaggtctaataaccatcggtaaatccgttacaagagcggtttttccagaagacttaagaataacagagaagaaaatctttgatcctcaagacaaaacacttctcgtatggaacagattgttcgtcatttcgtgtattttagctgtctctgttgatcctttgttcttctatcttcccattgtcgataattccggaagcagctgtatagggattgatacgaaactagctgttacaacgacgactcttagaaccattgttgacgttttttacttaactagaatggctcttcagtttcgtacagcttatatagctccttcttctcgtgtgtttggtcgtggtgagcttgtgattgatcctgcaaagatcgctgaacgctatttaacccgttatttcgtcgtcgattttcttgcagtgctgcctttaccgcagattgcagtgtggaagtttcttcacgggtctaaaggatcggatgtgttaccaacgaaaacggcattgttgaacattgtaattgtgcagtatattccgagattcgtgaggtttattccgttaacatcagagttgaagaaaactgcaggagcttttgccgaaggagcttgggctggtgctgcttattatcttctctggtatatgcttgcaagccacataactggagcgttttggtacatgttgtcagtggagcgtaacgatacttgttggagatttgcgtgtaaagttcagccagatccgcgactctgtgttcagattctgtattgtgggactaaatttgtgagcagtggagaaactgaatggatcaaaacagtccctgagcttcttaagagcaattgttctgctaaagcagatgattcaaagtttaactatgggatatacggtcaggctatatcttcaggcattgtatcatcaacaacatttttctccaagttctgttattgtctatggtggggtcttcaaaatctcagcacgttaggtcaagggctgcagacaagtacatttccaggagaggttttgttttccattgcgattgctatagctgggcttcttcttttcgcgcttctcatcgggaatatgcagacttatcttcagtcacttactgttcgtctcgaggaaatgaggatcaaaagacgtgactcagaacagtggatgcatcacaggtcacttccacaaaatttgagggaaagagtcagacgctatgatcaatacaaatggttagagacaagaggtgtagacgaagaaaacatagttcagagtttacctaaggatctcagaagagacatcaaacgccatctctgtctgaatttagttaggagggttcctctgtttgctaatatggatgaaagattacttgacgcaatctgtgagagattaaagccgagtcttttcacggaaagcacttacattgtgcgtgaaggagaccccgttaacgaaatgatgttcataatccgaggccggttagaaagtgtaacaacagatgggggaagaagcggtttcttcaacagagggttgttaaaagaaggagacttttgtggtgaagagcttctgacatgggctcttgaccctaaagcaggctcaaacttaccttcttccacaagaacagtgaaggctctgactgaagtagaggctttcgctcttgaagctgaagagctgaagtttgtagcaagtcagtttaggagacttcatagtcgacaggttcaacaaacatttaggttttactctcagcaatggagaacttgggcttcttgcttcatccaagctgcttggcgtcgctattcaagaaggaaaaacgctgaattgagacggattgaagaaaaagaagaagaattgggttatgaagatgaatatgatgatgagagtgacaagaggcctatggttatcacaagaagtgagtcttcttctagactgcgttcaacgatatttgcatcaagatttgctgctaatgcattgaaagggcacagacttaggagctcagagagttcaaagaccttgataaatctgcaaaagcctccggaacctgattttgatgctgaataa

SEQ ID NO: 1714 - protein, 709 aa, Arabidopsis thaliana
MMMQRNCFGFNLKNRGGEKKKASKSFREGVKKIRSEGLITIGKSVTRAVFPEDLRITEKKIFDPQDKTLLVWNRLFVISCILAVSVDPLFFYLPIVDNSGSSCIGIDTKLAVTTTTLRTIVDVFYLTRMALQFRTAYIAPSSRVFGRGELVIDPAKIAERYLTRYFVVDFLAVLPLPQIAVWKFLHGSKGSDVLPTKTALLNIVIVQYIPRFVRFIPLTSELKKTAGAFAEGAWAGAAYYLLWYMLASHITGAFWYMLSVERNDTCWRFACKVQPDPRLCVQILYCGTKFVSSGETEWIKTVPELLKSNCSAKADDSKFNYGIYGQAISSGIVSSTTFFSKFCYCLWWGLQNLSTLGQGLQTSTFPGEVLFSIAIAIAGLLLFALLIGNMQTYLQSLTVRLEEMRIKRRDSEQWMHHRSLPQNLRERVRRYDQYKWLETRGVDEENIVQSLPKDLRRDIKRHLCLNLVRRVPLFANMDERLLDAICERLKPSLFTESTYIVREGDPVNEMMFIIRGRLESVTTDGGRSGFFNRGLLKEGDFCGEELLTWALDPKAGSNLPSSTRTVKALTEVEAFALEAEELKFVASQFRRLHSRQVQQTFRFYSQQWRTWASCFIQAAWRRYSRRKNAELRRIEEKEEELGYEDEYDDESDKRPMVITRSESSSRLRSTIFASRFAANALKGHRLRSSESSKTLINLQKPPEPDFDAE

SEQ ID NO: 1715 - DNA, 999 bp, Arabidopsis thaliana
atgattgcattagctgcttcttcgttggggaatacaccgattgcttcgtttaaccgtcattttagattccggttacatccacgaaaccctctgatacaagcagcggtttcaccttcgtcttcttcttcttctcctactgcttcatctggctttgatttgagttctctcgaatccgccattaacaagaaagatagtaatggtgttaaggaagctctcgataaattgagtgaagaaggttgggctaagaaatggagctcccagccgtatctttcgcgccgtacgacatcactgcgggagctgacaactctcggtatcaagaatgcagagactctggccatccctagtgtcaggaacgatgcggcttttcttttcacagtagtcggatcaactgggttcatagctgtacttgccggccaacttcccggggactggggattctttgtgccttacttagttgggagcatttcgttggtagttttagccgtgggaagcgtttcaccagggcttcttcaagctgcgatttccgggttttcgacgttcttccctgattatcaagaacgaattgctgcacatgaagcagcccacttcttagtggcttacttaatcgggcttccaatcctcgggtactcgttagacatcggtaaagaacatgtcaatctcattgacgagagactagctaaactaatatacagcggcaagcttgactcaaaggagctcgataggttggctgctgttgcaatggctggacttgccgccgagggtctgaagtatgacaaagtaattggccaatctgcagatctcttctctcttcagagattcataaacagaagccaacccaaaatcagcaacgagcagcagcaaaatctaacaagatgggctgttctttactctgcttctcttctcaaaaacaacaagaccatccatgaagctctaatggctgcaatgtccaaaaatgcatctgttcttgaatgcattcaaaccattgagacagcttcctag

SEQ ID NO: 1716 - protein, 332 aa, Arabidopsis thaliana
MIALAASSLGNTPIASFNRHFRFRLHPRNPLIQAAVSPSSSSSSPTASSGFDLSSLESAINKKDSNGVKEALDKLSEEGWAKKWSSQPYLSRRTTSLRELTTLGIKNAETLAIPSVRNDAAFLFTVVGSTGFIAVLAGQLPGDWGFFVPYLVGSISLVVLAVGSVSPGLLQAAISGFSTFFPDYQERIAAHEAAHFLVAYLIGLPILGYSLDIGKEHVNLIDERLAKLIYSGKLDSKELDRLAAVAMAGLAAEGLKYDKVIGQSADLFSLQRFINRSQPKISNEQQQNLTRWAVLYSASLLKNNKTIHEALMAAMSKNASVLECIQTIETAS

SEQ ID NO: 1717 - DNA, 1254 bp, Arabidopsis thaliana
atggctcttaacgtgagcaaggttgttcccaatagtccaattttagttaagagtgttaatgcttcaagatctcgaagagttctgttggcgtatgttcatcatcctttagctgctaataagggttcatctattgaagagttaaagcaaggtctttgttgtacaaagactgtcacttttgttagttctcggagatgttctacattgtgctttgttggaaagtctcaagacactgaaactaattcccaagttgtacaaaaagaaggtgagaagcaagtgatgccgaggaggaaaagtagtaactcaagccaacttttggtggaatatgtgtctaatgatgctaagtttgtgaatgaaagagctcgtaatgactttgttcttctatctcgtggtattatgagacttgatgctcgtgcacgacaggatgttgccattcttggttccgggttccttaaactcgatgctcgggcaagagaagatacagagaaaatagaccgtgatgtcaagagaaaagccgagcgccttcatcatattgctactatatttaaaaacatagctgagtctaagttgaaaaatgccgctgataagcattggagcgatggcgctttagaggctgatttaaggcgagcagatttccgtgctaaacaacgggccatggaagacgcattaatggctttagagtttattaagaacatccacgacatgatggtgaacaaaatggttgacagcttggtgacatctgaaactggtaccacggatcgcatatcgcttgagaagaatggaatagctctcgggtttttccctggggaagtttcatctgatcgcatatctgctattgaggaagcttacaagagtatggcatcagcgctctcagaagccgatggaattgactacactgaccctgaagaactcgagttgttagtcacgactctgattgaccttgatgcaatggatggtaaaagtagtgcatctctcttggctgaatgctcaagctctccagatgtcaatacaagaaaagcgttggctaatgctttagcagcggcaccatcaatgtggacactaggaaatgcaggaatgggagcattacagagactcgctgaagacagtaacccggcgattgcagcagctgcttcgagagcgatcaatgcgctgaagaagcaatgggaagtagaggaaggagactcactgaggtttatgatgaacttcgagaggccgaatgatgatgatgatgtagacagtgaccttgatgagatctga

SEQ ID NO: 1718 - protein, 417 aa, Arabidopsis thaliana
MALNVSKVVPNSPILVKSVNASRSRRVLLAYVHHPLAANKGSSIEELKQGLCCTKTVTFVSSRRCSTLCFVGKSQDTETNSQVVQKEGEKQVMPRRKSSNSSQLLVEYVSNDAKFVNERARNDFVLLSRGIMRLDARARQDVAILGSGFLKLDARAREDTEKIDRDVKRKAERLHHIATIFKNIAESKLKNAADKHWSDGALEADLRRADFRAKQRAMEDALMALEFIKNIHDMMVNKMVDSLVTSETGTTDRISLEKNGIALGFFPGEVSSDRISAIEEAYKSMASALSEADGIDYTDPEELELLVTTLIDLDAMDGKSSASLLAECSSSPDVNTRKALANALAAAPSMWTLGNAGMGALQRLAEDSNPAIAAAASRAINALKKQWEVEEGDSLRFMMNFERPNDDDDVDSDLDEI

SEQ ID NO: 1719 - DNA, 2292 bp, Arabidopsis thaliana
atgggggaagatacaaaggcaaccattgagccaaccgcaaacaagactacttctcttgaaaagccatcagaggctatggctggaaaggagaatgctgggggtaaggaaacacaagaactggcgaaagatgaggatatggctgagccagacaatatggagatagatgctcagattaagaaagatgatgaaaaagctgagacggaagataaagagtcagaggttaagaaaaatgaagacaatgctgagactcaaaaaatggaagagaaggttgaggtcaccaaagatgagggacaagcagaggctaccaacatggatgaagatgccgatggaaagaaagagcaaactgatgatggtgtttcagtggaagatactgtaatgaaggaaaacgtggaatctaaagacaataactatgccaaagatgatgaaaaagagaccaaagagacagatattactgaggcagaccacaaaaaagctgggaaggaggacatacaacatgaagctgacaaagcaaatggaacaaaagatggcaatacaggagacatcaaagaggaagggacactggtagatgaagacaaagggacagatatggatgaaaaagtggagaatggggatgaaaataaacaagtggagaatgttgaaggaaaagaaaaggaagataaggaagaaaataaaacaaaggaagttgaggcggcaaaggctgaggtggatgagtcaaaggtagaagatgaaaaagaagggagtgaggatgagaacgacaatgaaaaagtggagagcaaagatgcaaaggaagatgagaaagaggagacaaatgatgataaagaagatgaaaaagaagagagcaagggttctaaaaagcgtgggaaagggacgagttctggaggaaaggttcgcgagaagaataaaaccgaggaagtaaaaaaggatgcagagcctaggactcctttctctgatcgccctgtgcgtgagcggaaatctgttgagaggcttgttgcattgattgataaagactcctcgaaagaattccgtgttgaaaaggggcgaggtgcatatctcaaagatattcccaatgttgctaacaaggtaatgaggaagaggtctgatgaaactttgaagctgcttcacccaattctatttggtgggaggagagggaaggctgctcagatcaagacaaacatattgggcttctctggtttcgtttggcatggagatgagaagaaagcaaaagaaaaagtaaaagaaaagcttgagaaatgcaccaaagagaaactgtgggagttttgtgatgtgttggacatacacattaccaaggctacaacaaagaaggaagatattattacaaaactgtttgagtttttggagaaacctcatgtgacaggtgatgtgaccggtgacactacagtttctgagaaagagaagtcaagtaagggagcaaaacgcaagagaactcccaagaaaacttcacctacagctgggagttcatcctccaaacgatcagcaaagagccaaaaaaagtctgaagaagcaacaaaagttgtcaaaaagagtttagctcattctgatgatgaatctgaagaagagaaagaagaagaagaaaaacaagaggaggagaaggcagaagagaaagaagagaaaaaagaggaggagaatgaaaatggcattcctgataaatctgaggatgaggcgcctcagccttctgaaagcgaggagaaagatgaatctgaggagcattctgaagaagaaactacaaagaagaaacgtggttctagattgtcagctgggaagaaagaatcagcagggagagccagaaacaagaaagcagtggtcgctgcaaaatccagtccaccagagaagattacacagaagcggtcatcagccaaacgaaagaagactgatgatgacagtgatacaagtccaaaggcgtcctctaagaggaagaagtctgaaaaccctatcaaggcctccccggctccttcaaagtctgcatcaaaagagaagccagtaaaaagggctggaaaagggaaagacaagccgagtgataaagtgctgaaaaatgcaatcgttgagatcttgaaaagagtggactttagtacggctacgttcacggacatccttaaagaacttgctaaggagttcacagaagatctcactccaagaaagtcatctataaagatgataatccaagaggagctcaccaaattagcagatgaggaggaggaggaggaaaagaaagaagaggattcagagaaggaggaagcaggagggtctggtggtggtgaggaggtgaaagcctaa

SEQ ID NO: 1720 - protein, 763 aa, Arabidopsis thaliana
MGEDTKATIEPTANKTTSLEKPSEAMAGKENAGGKETQELAKDEDMAEPDNMEIDAQIKKDDEKAETEDKESEVKKNEDNAETQKMEEKVEVTKDEGQAEATNMDEDADGKKEQTDDGVSVEDTVMKENVESKDNNYAKDDEKETKETDITEADHKKAGKEDIQHEADKANGTKDGNTGDIKEEGTLVDEDKGTDMDEKVENGDENKQVENVEGKEKEDKEENKTKEVEAAKAEVDESKVEDEKEGSEDENDNEKVESKDAKEDEKEETNDDKEDEKEESKGSKKRGKGTSSGGKVREKNKTEEVKKDAEPRTPFSDRPVRERKSVERLVALIDKDSSKEFRVEKGRGAYLKDIPNVANKVMRKRSDETLKLLHPILFGGRRGKAAQIKTNILGFSGFVWHGDEKKAKEKVKEKLEKCTKEKLWEFCDVLDIHITKATTKKEDIITKLFEFLEKPHVTGDVTGDTTVSEKEKSSKGAKRKRTPKKTSPTAGSSSSKRSAKSQKKSEEATKVVKKSLAHSDDESEEEKEEEEKQEEEKAEEKEEKKEEENENGIPDKSEDEAPQPSESEEKDESEEHSEEETTKKKRGSRLSAGKKESAGRARNKKAVVAAKSSPPEKITQKRSSAKRKKTDDDSDTSPKASSKRKKSENPIKASPAPSKSASKEKPVKRAGKGKDKPSDKVLKNAIVEILKRVDFSTATFTDILKELAKEFTEDLTPRKSSIKMIIQEELTKLADEEEEEEKKEEDSEKEEAGGSGGGEEVKA

SEQ ID NO: 1721 - DNA, 525 bp, Arabidopsis thaliana
atgaaaattgacaacgctagagaagaaaagaagaaaaaaggacagaaacgcaagcaccagcagaatgatcaagctgatatggaaatgttaaaacttcgagctgctctagagggaaaacatagaagcaatggttctactgttttaaagtctgctaaagctcaaaaacgccagaaatcagaagactcagaagatgaattttacagacaagtgaaacagaaacaagaagctaaaaaagctgccaaagcagaaatctattcaaggaaaccatatttgatcccgtcatcgccagatctggtggatggaagacgattgatttcaaatcagatggctagtaacagaggattgacccggaaacgcaacaaggaccataaaaacccgagaaagaagtaccgggatcagcacaagaaaatagtcattaaccgcaaaggacaggtcagagatatcaggacgcaagtgggtccatatgcaggagaaactcgcggtatcaatccctacacaagccgcagcatccgaatcaagaactaa

SEQ ID NO: 1722 - protein, 174 aa, Arabidopsis thaliana
MKIDNAREEKKKKGQKRKHQQNDQADMEMLKLRAALEGKHRSNGSTVLKSAKAQKRQKSEDSEDEFYRQVKQKQEAKKAAKAEIYSRKPYLIPSSPDLVDGRRLISNQMASNRGLTRKRNKDHKNPRKKYRDQHKKIVINRKGQVRDIRTQVGPYAGETRGINPYTSRSIRIKN

SEQ ID NO: 1723 - DNA, 981 bp, Arabidopsis thaliana
atgtctcgttctcttgtcttcttcttcctctttcttgtcttggtcgtcccttgtctctcccatggaaccggaggagaccacgacgacgatgaggcttcgcacgttaagagttccgatctcaaatccaaatccttaatctccgtcaagatcgcatgtcttgtcatcatctttgtcctcacgttcataagcggtgtatctccttatttcttgaaatggagccaagggtttttggttcttggtacacaattcgccggaggcgtgtttcttgcaaccgccttgatgcatttcttgtcggacgctgatgagacgtttcgtggtttgttgacggcggaaggagagtcggagccatctccggcttacccatttgcttatatgttggcttgtgctggttttatgttgaccatgcttgctgattctgtcatcgctcatatctactcaaagacccaaaacgatttggagcttcaaggagaagacaaatcgaatcagaggtcagcaacaactgaaacttcgattggagatagcattctattgatcgtagctctctgttttcactctgtcttcgaaggcatagctattggtatttcagagactaaatcagatgcttggagagctctctggacaataacactccataagatatttgcagcgattgcaatggggatagctcttctccgtatgatccctgaccgtcctttattctcctcaatcacttattctttcgcattcgccatctcgagcccaattggtgttgccatcgggatagtcatcgatgcaacgactcaagggtccatcgcggattggatattcgcattgtcgatgagcttggcgtgtggggtatttgtgtatgtatctgtgaaccatttgttggcaaaagggtatcgaccaaacaagaaagttcatgttgatgagcctcgttataagtttttggctgtgttgtttggagttgttgtcattgccattgttatgatatgggacacttga

SEQ ID NO: 1724 - protein, 326 aa, Arabidopsis thaliana
MSRSLVFFFLFLVLVVPCLSHGTGGDHDDDEASHVKSSDLKSKSLISVKIACLVIIFVLTFISGVSPYFLKWSQGFLVLGTQFAGGVFLATALMHFLSDADETFRGLLTAEGESEPSPAYPFAYMLACAGFMLTMLADSVIAHIYSKTQNDLELQGEDKSNQRSATTETSIGDSILLIVALCFHSVFEGIAIGISETKSDAWRALWTITLHKIFAAIAMGIALLRMIPDRPLFSSITYSFAFAISSPIGVAIGIVIDATTQGSIADWIFALSMSLACGVFVYVSVNHLLAKGYRPNKKVHVDEPRYKFLAVLFGVVVIAIVMIWDT

SEQ ID NO: 1725 - DNA, 1539 bp, Arabidopsis thaliana
atgaacgcgagagctcttctttgctcttcaaatattcactctctctacacttcaaatcgtccacctgaaaaaacctcttcttctcgcagcctccgtaatctcaaaccatctccaaagtcgttacgggtatggatctacccgcgaaataggtccagtgttttccgggtattagttcggagctccgacaagagtgaaagcagtaattcgtattacgtagaaggagataaagtaagtggaaacaatgacgtcgtttctgattcgcctagctctatcgtcctcccatggtgggaagagtttccgaagcggtgggtgattgtgttactctgtttctcagcttttcttctctgcaatatggacagagtgaatatgagtatagctatacttccgatgtcagctgagtatggttggaatccagcaacagttggtctgattcagtcttctttcttctggggttaccttcttacacagatagctggtggaatttgggcagacactgtaggagggaaaagggttcttggattcggtgttatttggtggtcaatcgctacaattctcactcctgtagctgctaaactcggtcttccttacttgctcgttgttcgtgctttcatgggagttggagagggtgttgcaatgcctgctatgaataatatattgtcgaagtgggttcctgtgcaagagagaagcagatcactcgcgcttgtttacagcggaatgtaccttggatctgtcaccggtttagccttttcgcctttcttgattcatcaatttggatggccttctgtgttttattctttcgggtctcttggaactgtatggttgactctgtggctaactaaggcagagagttcaccattagaagatccaacattgctccctgaagaaagaaagctaattgcagacaactgtgctagcaaagagccagtgaagtcgatcccgtggaggctgatattgtcgaaaccaccggtttgggctctcatcagttgccacttttgtcacaactggggaacattcattctcttaacatggatgccaacttattaccatcaagtgctgaagttcaaccttatggagtcaggacttctctctgtatttccatggatgacaatggcaatatctgcaaatgccggtggatggattgccgatacacttgtcagccgaggtttctctgtcacgaatgtccgcaagataatgcaaacaatagggtttcttggaccagcgttcttcctaacacagctgaaacacatagattctcctacaatggctgttttgtgcatggcttgtagtcaggggactgatgcgttttcacagtctggtctatactctaaccatcaagacatcgctccaagatactctggagtgttacttggtttgtctaatactgctggagtacttgccggagttcttggcacagctgcgactggtcacatactacaacacggttcttgggatgacgttttcacgatttcggtcggtctttacctcgttgggaccgtcatttggaacctattttcaaccggagagaagataatcgattga

SEQ ID NO: 1726 - protein, 512 aa, Arabidopsis thaliana
MNARALLCSSNIHSLYTSNRPPEKTSSSRSLRNLKPSPKSLRVWIYPRNRSSVFRVLVRSSDKSESSNSYYVEGDKVSGNNDVVSDSPSSIVLPWWEEFPKRWVIVLLCFSAFLLCNMDRVNMSIAILPMSAEYGWNPATVGLIQSSFFWGYLLTQIAGGIWADTVGGKRVLGFGVIWWSIATILTPVAAKLGLPYLLVVRAFMGVGEGVAMPAMNNILSKWVPVQERSRSLALVYSGMYLGSVTGLAFSPFLIHQFGWPSVFYSFGSLGTVWLTLWLTKAESSPLEDPTLLPEERKLIADNCASKEPVKSIPWRLILSKPPVWALISCHFCHNWGTFILLTWMPTYYHQVLKFNLMESGLLSVFPWMTMAISANAGGWIADTLVSRGFSVTNVRKIMQTIGFLGPAFFLTQLKHIDSPTMAVLCMACSQGTDAFSQSGLYSNHQDIAPRYSGVLLGLSNTAGVLAGVLGTAATGHILQHGSWDDVFTISVGLYLVGTVIWNLFSTGEKIID

SEQ ID NO: 1727 - DNA, 840 bp, Arabidopsis thaliana
atgccgccgaagagaaatttcaggaagcgtagcttcgaggaggaagaagaagataatgatgtaaacaaagccgcaatttcagaggaagaagagaagcgaagattggcgttagaggaggtgaagtttttgcagaagctgcgagagaggaaattaggtatcccagctttatcttctacggcgcaatctagcatcggaaaagtgaaaccagtggagaaaactgaaactgaaggagagaaagaggagcttgtgttgcaagatacttttgctcaagagactgctgttttgattgaagatcccaacatggtaaagtacattgaacaagaattggcgaagaaacggggaagaaatattgatgatgcagaggaggttgagaacgaattgaagcgagtggaagatgagttatataagatacctgatcatcttaaagtcaagaagcgtagctcggaagagagctcgacgcagtggactaccggaatagcagaagtccaactcccaattgaatacaagctgaagaacattgaagaaactgaagctgccaagaagcttttgcaagagaggagacttatgggtcggccaaagtcagagtttagtatcccgtctagttatagtgcggattacttccaacgcgggaaagattatgctgagaagcttaggagagagcatcctgagctatacaaagatagaggaggacctcaagcggacggtgaagcagctaaaccttctactagcagtagtactaataataatgctgattcagggaaaagcagacaagcagcaactgatcaaatcatgttggaacgatttcgcaagagagagcgtaaccgtgtaatgcgaagataa

SEQ ID NO: 1728 - protein, 279 aa, Arabidopsis thaliana
MPPKRNFRKRSFEEEEEDNDVNKAAISEEEEKRRLALEEVKFLQKLRERKLGIPALSSTAQSSIGKVKPVEKTETEGEKEELVLQDTFAQETAVLIEDPNMVKYIEQELAKKRGRNIDDAEEVENELKRVEDELYKIPDHLKVKKRSSEESSTQWTTGIAEVQLPIEYKLKNIEETEAAKKLLQERRLMGRPKSEFSIPSSYSADYFQRGKDYAEKLRREHPELYKDRGGPQADGEAAKPSTSSSTNNNADSGKSRQAATDQIMLERFRKRERNRVMRR

SEQ ID NO: 1729 - DNA, 1053 bp, Arabidopsis thaliana
atggctctagtggtgtcaggtggcaaagcagccatgatgccgcttcatgccaattctcttcctctaagtatcaacaccaaatcaagagtactaagtgcatcagcatttccactattctcgtccactcctcacctcccttccagatccctctccatccgcctctcgccgaatgtttcccggtctctcactgtggtatcttctgttttgtcagaggacagagctactaacgttagtggctctgggacagatgcattcaagctgacttacttggagggcaatagctggctatgggaaacagctggactgaaaatcctagttgatccgattcttgtgggtaatttggactttggaatcccatggctttatgatgctgccaagagatatttgaaggccttcaagcttgatgatctccctgaagttgattgccttctcataactcaaagccttgatgatcattgtcatttgaatacccttaggccactttccgagaaatctccaggcataaaggttatagcaaccccaaatgctaagcctttgctagatcctctttttagtaacgtcacttatctggaacctggagatagctttgagctaaatgcaagaaacggttctaaggttcgagttaaagccacagctggacctgtccttggtccaccgtggcaacgccctgaaaacgggtatctccttgtatcccctgaagatcagatatctctctactatgaaccgcattgtgtatgcaacatggaacttctgaagaatgaaagagccgacattgtaatcacaccggtcatcaaacaacttctcccacgatttactcttgtttctggtcaagaagacgctgtccagcttgccaaactcttgaaagccaagtttgttgtgccgatgcaaaatggcgagcttgaagcaaagggacttttagcaagcctagtaaagaaagaaggaactattgaatcatttaaggaattattgttaaaagagctcccagaagctcaagtgttggagcctatagcaggtataccgctagagatcttggttccatcttcagacatttag

SEQ ID NO: 1730 - protein, 350 aa, Arabidopsis thaliana
MALVVSGGKAAMMPLHANSLPLSINTKSRVLSASAFPLFSSTPHLPSRSLSIRLSPNVSRSLTVVSSVLSEDRATNVSGSGTDAFKLTYLEGNSWLWETAGLKILVDPILVGNLDFGIPWLYDAAKRYLKAFKLDDLPEVDCLLITQSLDDHCHLNTLRPLSEKSPGIKVIATPNAKPLLDPLFSNVTYLEPGDSFELNARNGSKVRVKATAGPVLGPPWQRPENGYLLVSPEDQISLYYEPHCVCNMELLKNERADIVITPVIKQLLPRFTLVSGQEDAVQLAKLLKAKFVVPMQNGELEAKGLLASLVKKEGTIESFKELLLKELPEAQVLEPIAGIPLEILVPSSDI

SEQ ID NO: 1731 - DNA, 1143 bp, Arabidopsis thaliana
atgcgagaaatgaagtccacggttcgtgatgccgtgaaatcaatgaagcaaaaaccgacggtcatgattgttgacttttttggtacagcgttgttgtccataaccgatgtaggtgtgacgagtaagtatgtgtacataccgtctcacgcgtggttcttggcattaattgtctacttgccggtattggataaggtaatggaaggtgagtatgttgatattaaggagcctatgaaaataccaggttgtaaaccggtcggaccaaaagagcttttggacacaatgttagaccggtccgaccaacaataccgtgattgtgtacagattgggttggagatacctatgagcgatggagttttggtaaatacttggggggagttacaagggaagactctagctgcgctaagagaggacatagatttgaaccgggttataaaagtaccggtttatcctattggacctattgttaggactaatgtgcttattgaaaaaccaaacagtacattcgagtggctagacaaacaagaggaaagatctgttgtatatgtgtgtttagggagtggtggaacattgtcgtttgagcaaacgatggaactagcttgggggttagagttaagttgtcaaagtttcttatgggttctacgtaagcctccttcttaccttggagcaagctcaaaagatgatgatcaagtaagtgacggtctaccagaaggtttcttggaccgcacacgtggtgtagggcttgtggtaacgcaatgggcaccgcaagttgagatcttaagccatagatcaatcggtgggtttttgtcacattgtggttggagctcggtgttggagagtttaactaaaggagttccgatcatcgcttggcctctttatgcggagcaatggatgaatgccacgttgctgacggaggagattggtatggctattcgtacgtcagagttaccgtcgaagaaagtgatcagccgggaagaagtggcgtctttggtgaagaagattgtagcggaagaggataaagaaggacgaaagataaagactaaagctgaagaggtgagggttagctccgaacgagcttggactcatggtgggtcgtctcatagttctctctttgaatgggcaaaacgatgtgggcttgtatcttaa

SEQ ID NO: 1732 - protein, 380 aa, Arabidopsis thaliana
MREMKSTVRDAVKSMKQKPTVMIVDFFGTALLSITDVGVTSKYVYIPSHAWFLALIVYLPVLDKVMEGEYVDIKEPMKIPGCKPVGPKELLDTMLDRSDQQYRDCVQIGLEIPMSDGVLVNTWGELQGKTLAALREDIDLNRVIKVPVYPIGPIVRTNVLIEKPNSTFEWLDKQEERSVVYVCLGSGGTLSFEQTMELAWGLELSCQSFLWVLRKPPSYLGASSKDDDQVSDGLPEGFLDRTRGVGLVVTQWAPQVEILSHRSIGGFLSHCGWSSVLESLTKGVPIIAWPLYAEQWMNATLLTEEIGMAIRTSELPSKKVISREEVASLVKKIVAEEDKEGRKIKTKAEEVRVSSERAWTHGGSSHSSLFEWAKRCGLVS

SEQ ID NO: 1733 - DNA, 1575 bp, Arabidopsis thaliana
atggagtgtgttggggctaggaatttcgcagcaatggcggtttcaacatttccgtcatggagttgtcgaaggaaatttccagtggttaagagatacagctataggaatattcgtttcggtttgtgtagtgtcagagctagcggcggcggaagttccggtagtgagagttgtgtagcggtgagagaagatttcgctgacgaagaagattttgtgaaagctggtggttctgagattctatttgttcaaatgcagcagaacaaagatatggatgaacagtctaagcttgttgataagttgcctcctatatcaattggtgatggtgctttggatctagtggttattggttgtggtcctgctggtttagccttggctgcagaatcagctaagcttggattaaaagttggactcattggtccagatcttccttttactaacaattacggtgtttgggaagatgaattcaatgatcttgggctgcaaaaatgtattgagcatgtttggagagagactattgtgtatctggatgatgacaagcctattaccattggccgtgcttatggaagagttagtcgacgtttgctccatgaggagcttttgaggaggtgtgtcgagtcaggtgtctcgtaccttagctcgaaagttgacagcataacagaagcttctgatggccttagacttgttgcttgtgacgacaataacgtcattccctgcaggcttgccactgttgcttctggagcagcttcgggaaagctcttgcaatacgaagttggtggacctagagtctgtgtgcaaactgcatacggcgtggaggttgaggtggaaaatagtccatatgatccagatcaaatggttttcatggattacagagattatactaacgagaaagttcggagcttagaagctgagtatccaacgtttctgtacgccatgcctatgacaaagtcaagactcttcttcgaggagacatgtttggcctcaaaagatgtcatgccctttgatttgctaaaaacgaagctcatgttaagattagatacactcggaattcgaattctaaagacttacgaagaggagtggtcctatatcccagttggtggttccttgccaaacaccgaacaaaagaatctcgcctttggtgctgccgctagcatggtacatcccgcaacaggctattcagttgtgagatctttgtctgaagctccaaaatatgcatcagtcatcgcagagatactaagagaagagactaccaaacagatcaacagtaatatttcaagacaagcttgggatactttatggccaccagaaaggaaaagacagagagcattctttctctttggtcttgcactcatagttcaattcgataccgaaggcattagaagcttcttccgtactttcttccgccttccaaaatggatgtggcaagggtttctaggatcaacattaacatcaggagatctcgttctctttgctttatacatgttcgtcatttcaccaaacaatttgagaaaaggtctcatcaatcatctcatctctgatccaaccggagcaaccatgataaaaacctatctcaaagtatga

SEQ ID NO: 1734 - protein, 524 aa, Arabidopsis thaliana
MECVGARNFAAMAVSTFPSWSCRRKFPVVKRYSYRNIRFGLCSVRASGGGSSGSESCVAVREDFADEEDFVKAGGSEILFVQMQQNKDMDEQSKLVDKLPPISIGDGALDLVVIGCGPAGLALAAESAKLGLKVGLIGPDLPFTNNYGVWEDEFNDLGLQKCIEHVWRETIVYLDDDKPITIGRAYGRVSRRLLHEELLRRCVESGVSYLSSKVDSITEASDGLRLVACDDNNVIPCRLATVASGAASGKLLQYEVGGPRVCVQTAYGVEVEVENSPYDPDQMVFMDYRDYTNEKVRSLEAEYPTFLYAMPMTKSRLFFEETCLASKDVMPFDLLKTKLMLRLDTLGIRILKTYEEEWSYIPVGGSLPNTEQKNLAFGAAASMVHPATGYSVVRSLSEAPKYASVIAEILREETTKQINSNISRQAWDTLWPPERKRQRAFFLFGLALIVQFDTEGIRSFFRTFFRLPKWMWQGFLGSTLTSGDLVLFALYMFVISPNNLRKGLINHLISDPTGATMIKTYLKV

SEQ ID NO: 1735 - DNA, 984 bp, Arabidopsis thaliana
atggctttatcaatggagtttgggttttcaattgggtcatgcttcaaggcaccaaacccacctgttctaatctctgcaagccctaataagatcaatttcacgttgagaaggagaaagaaaagattcttacttagagtctctgctgtgtcgtataaggaattcgcagagtctgctttagaagaaaccaggaaaaggatcgttcttgaaccttcacatctccagtatagtagcatgacaggactagatggtaagaccgaacttcaaatgcttgcttttaaatcttcaaagattagactcttgaggagtatggcaatagagaatgagacaatgcaggtctttgactttgcgggtttcatggagcctgagtatgatactcccatattctgtgctaactttttcacatctaccaacgttaacatagttgtattggaccttaatcctttgcatcagttgactgaccagacggattaccaagacaagtattataacaagataatgtccatatatcacaaatatgctgagactttcccatggggagggaaattgactggtgaatccataaagtttttctcgcctttggtgatgtggactaggttttcgtctagcaaagaaaaacataaggctttgttctctgcgtttctagagtactatcaggcatggcttgagatgacaatccaagtgagggaggagatggaaccatctcatgtgagagccaattgtgaagcacaacacaagtacctgacatggcgagcacaaaaggatcctggacatggtcttcttaaaagattagtaggtgaagcaaaggcaaaggagctgctaagggatttcctgttcaatggggtggatgagttaggcacaaaaacattcattgattactttccagagtaccaaacagaagatggaactgtaagcgataaacgaagtatcattgggaagtcatatgaaactcgtccatgggatttaacaggacaatttatcggctaa

SEQ ID NO: 1736 - protein, 327 aa, Arabidopsis thaliana
MALSMEFGFSIGSCFKAPNPPVLISASPNKINFTLRRRKKRFLLRVSAVSYKEFAESALEETRKRIVLEPSHLQYSSMTGLDGKTELQMLAFKSSKIRLLRSMAIENETMQVFDFAGFMEPEYDTPIFCANFFTSTNVNIVVLDLNPLHQLTDQTDYQDKYYNKIMSIYHKYAETFPWGGKLTGESIKFFSPLVMWTRFSSSKEKHKALFSAFLEYYQAWLEMTIQVREEMEPSHVRANCEAQHKYLTWRAQKDPGHGLLKRLVGEAKAKELLRDFLFNGVDELGTKTFIDYFPEYQTEDGTVSDKRSIIGKSYETRPWDLTGQFIG

SEQ ID NO: 1737 - DNA, 1269 bp, Arabidopsis thaliana
atggtgatgagtaggtgggcaaattgggaatttcacatatcgttcgatgttcgagctggcatcgtcatatctctcgcatcccttttcgacacggacgtgaacaaataccggcaagtcctatataaaggtcacttatcggaaatgttcataccttacatggacccaagtgatgattggtatttcattacttatcttgattgtggcgattttggctgcggtcaatgcgccgtatctcttcaaccgtacactgattgtccagcgggtgcagtttttatggatggtatttttgctggtcaagatggaactcccgcaaaaatcccaaaagttatgtgcatttttgaaaaatatgctggagatatcatgtggcgacatacagaagctgaaattccaaacttagaaattacggaggttagaccggacgtaagtcttgtagcccggattgtgacgaccgtgggaaactatgactacatagttgattatgagttcaagcctagtggttccatcaaaatgggggtcggcttaaccggtgttttagaagtgaaaccggtagaatatattcacacatccgaaatcaaactaggggaagacatacacgggacaattgtcgccgacaacaccgtcggtgttaaccacgaccatttcgtgacattccgtcttcatcttgacatcgacggtaccgaaaattcctttgttcgtaacgaacttgtgaccacgaggtctccaaaatctgttaacacaccgagaaaaacctattggacaacgaagccaaagacggccaagaccgaggcagaggctcgggtgaaactaggtttgaaggcggaggagttagttgtggttaaccctaaccgaaagacgaagcatggcaatgaggttggataccgtttacttcatggatccgctgcaggcccactcctggcccaagatgatttcccgcagattcgagctgcattcaccaactataacgtgtggatcacgccgtataacaggtcagaggtttgggcaggtggtttgtacgctgacaggagccaaggcgacgatacgttggcagtgtggtctcaaaggaatagaaaaatagagaaggaagatatagtgatgtggtacaccgtcggtttccaccatgttcctagccaggaagattacccgacgatgcctactttatccggtggctttgagctccgaccgaccaactttttcgagcgaaaccctgtcctcaagaccaaacccgtcaaagttaccaccgctcgaaagtgcactcctaaaaacgattaa

SEQ ID NO: 1738 - protein, 422 aa, Arabidopsis thaliana
MVMSRWANWEFHISFDVRAGIVISLASLFDTDVNKYRQVLYKGHLSEMFIPYMDPSDDWYFITYLDCGDFGCGQCAVSLQPYTDCPAGAVFMDGIFAGQDGTPAKIPKVMCIFEKYAGDIMWRHTEAEIPNLEITEVRPDVSLVARIVTTVGNYDYIVDYEFKPSGSIKMGVGLTGVLEVKPVEYIHTSEIKLGEDIHGTIVADNTVGVNHDHFVTFRLHLDIDGTENSFVRNELVTTRSPKSVNTPRKTYWTTKPKTAKTEAEARVKLGLKAEELVVVNPNRKTKHGNEVGYRLLHGSAAGPLLAQDDFPQIRAAFTNYNVWITPYNRSEVWAGGLYADRSQGDDTLAVWSQRNRKIEKEDIVMWYTVGFHHVPSQEDYPTMPTLSGGFELRPTNFFERNPVLKTKPVKVTTARKCTPKND

SEQ ID NO: 1739 - DNA, 1326 bp, Arabidopsis thaliana
atgaaattttcaatcacattagctctatgcttcactctctccatcttcttgatcggatcacaagccaaagttccagtcgacgaccaattccgagtggtcaacgaaggtggctacaccgattacagtcccatcgaatacaaccccgacgtacgtggcttcgtacccttcagtgacaacttccgtctctgtttctacaacacaaccccaaacgcatacactctcgctctcagaatcggaaacagagtccaagaatccactctcagatgggtctgggaagcaaacagaggctcaccggtcaaagaaaacgcgacgttgacttttggcgaagacggaaacctcgtactcgctgaagccgatggacgcttggtatggcaaacgaacacagctaacaaaggcgccgtggggatcaaaatcttggagaatggcaatatggtaatatacgattccagtggaaaatttgtatggcagagctttgattctcccaccgacacacttctcgttggacagtctttgaaactcaacggtcggaccaaactcgtaagcagactgtctccatctgtcaacacaaacggaccgtacagtctcgtgatggaagccaagaagctagtcttgtactacacgacaaacaaaactccgaaaccaatcgcttattttgaatacgaattcttcaccaagataacacaattccagtcaatgacgttccaagctgtggaagattccgacacaacgtggggtctagtcatggaaggtgtcgattctggttctaaattcaacgtttcaacgttcctctcacggccgaaacacaacgcgacgttgagttttattcggttagaatcagacggaaacatcagagtttggagttacagtacgttggcgacttccacggcttgggacgtgacatacacggcgtttaccaacgccgacactgacggtaacgacgagtgtaggatccctgagcattgtttggggtttggtttgtgtaagaaaggccagtgtaacgcttgtcctagcgacaaagggcttcttggttgggacgagacatgtaaatctccaagtctcgcaagttgcgatcccaagacatttcactacttcaagatcgaaggagctgatagtttcatgacaaaatataacggtggatcatcgacgacggagagtgcgtgtggggacaagtgtacgagagattgcaaatgtttagggtttttctacaatagaaagagttcgaggtgttggttgggctacgagctcaagacattgactagaaccggagattcttccctggttgcttatgtcaaagctcctaatgcaaacaaaaagtcaactctttga

SEQ ID NO: 1740 - protein, 441 aa, Arabidopsis thaliana
MKFSITLALCFTLSIFLIGSQAKVPVDDQFRVVNEGGYTDYSPIEYNPDVRGFVPFSDNFRLCFYNTTPNAYTLALRIGNRVQESTLRWVWEANRGSPVKENATLTFGEDGNLVLAEADGRLVWQTNTANKGAVGIKILENGNMVIYDSSGKFVWQSFDSPTDTLLVGQSLKLNGRTKLVSRLSPSVNTNGPYSLVMEAKKLVLYYTTNKTPKPIAYFEYEFFTKITQFQSMTFQAVEDSDTTWGLVMEGVDSGSKFNVSTFLSRPKHNATLSFIRLESDGNIRVWSYSTLATSTAWDVTYTAFTNADTDGNDECRIPEHCLGFGLCKKGQCNACPSDKGLLGWDETCKSPSLASCDPKTFHYFKIEGADSFMTKYNGGSSTTESACGDKCTRDCKCLGFFYNRKSSRCWLGYELKTLTRTGDSSLVAYVKAPNANKKSTL

SEQ ID NO: 1741 - DNA, 1467 bp, Arabidopsis thaliana
atggagatacggagcttgattgtttctatgaaccctaatttatcttcctttgagctctctcgccctgtatctcctctcactcgctcactagttccgttccgatcgactaaactagttccccgctccatttctagggtttcggcgtcgatctccaccccgaatagtgaaactgacaagatctccgttaaacctgtttacgtcccgacgtctcccaatcgcgaactccggactcctcacagtggataccatttcgatggaacacctcggaagttcttcgagggatggtatttcagggtttccatcccagagaagagggagagtttttgttttatgtattctgtggagaatcctgcatttcggcagagtttgtcaccattggaagtggctctatatggacctagattcactggtgttggagctcagattcttggcgctaatgataaatatttatgccaatacgaacaagactctcacaatttctggggagatcgacatgagctagttttggggaatacttttagtgctgtgccaggcgcaaaggctccaaacaaggaggttccaccagaggaatttaacagaagagtgtccgaagggttccaagctactccattttggcatcaaggtcacatttgcgatgatggccgtactgactatgcggaaactgtgaaatctgctcgttgggagtatagtactcgtcccgtttacggttggggtgatgttggggccaaacagaagtcaactgcaggctggcctgcagcttttcctgtatttgagcctcattggcagatatgcatggcaggaggcctttccacagggtggatagaatggggcggtgaaaggtttgagtttcgggatgcaccttcttattcagagaagaattggggtggaggcttcccaagaaaatggttttgggtccagtgtaatgtctttgaaggggcaactggagaagttgctttaaccgcaggtggcgggttgaggcaattgcctggattgactgagacctatgaaaatgctgcactggtttgtgtacactatgatggaaaaatgtacgagtttgttccttggaatggtgttgttagatgggaaatgtctccctggggttattggtatataactgcagagaacgaaaaccatgtggtggaactagaggcaagaacaaatgaagcgggtacacctctgcgtgctcctaccacagaagttgggctagctacggcttgcagagatagttgttacggtgaattgaagttgcagatatgggaacggctatatgatggaagtaaaggcaaggtgatattagagacaaagagctcaatggcagcagtggagataggaggaggaccgtggtttgggacatggaaaggagatacgagcaacacgcccgagctactaaaacaggctcttcaggtcccattggatcttgaaagcgccttaggtttggtccctttcttcaagccaccgggtctgtaa

SEQ ID NO: 1742 - protein, 488 aa, Arabidopsis thaliana
MEIRSLIVSMNPNLSSFELSRPVSPLTRSLVPFRSTKLVPRSISRVSASISTPNSETDKISVKPVYVPTSPNRELRTPHSGYHFDGTPRKFFEGWYFRVSIPEKRESFCFMYSVENPAFRQSLSPLEVALYGPRFTGVGAQILGANDKYLCQYEQDSHNFWGDRHELVLGNTFSAVPGAKAPNKEVPPEEFNRRVSEGFQATPFWHQGHICDDGRTDYAETVKSARWEYSTRPVYGWGDVGAKQKSTAGWPAAFPVFEPHWQICMAGGLSTGWIEWGGERFEFRDAPSYSEKNWGGGFPRKWFWVQCNVFEGATGEVALTAGGGLRQLPGLTETYENAALVCVHYDGKMYEFVPWNGVVRWEMSPWGYWYITAENENHVVELEARTNEAGTPLRAPTTEVGLATACRDSCYGELKLQIWERLYDGSKGKVILETKSSMAAVEIGGGPWFGTWKGDTSNTPELLKQALQVPLDLESALGLVPFFKPPGL

SEQ ID NO: 1743 - DNA, 975 bp, Arabidopsis thaliana
atgggtagcaagatgttgtttagtttgacaagtcctcgacttttctccgccgtttctcgcaaaccttcctcttctttctctccttctcctccgtcgccgtcttcgaggactcaatggactcagctcagccctggaaaatcgatttctttgagaagaagagtcttcttgttgcctgctaaagccacaacagagcaatcaggtccagtaggaggagacaacgtcgatagcaatgttttgccctattgtagcatcaacaaggctgagaagaaaacaattggtgaaatggaacaagagtttctccaagcgttgcaatctttctattatgatggcaaagcgatcatgtctaatgaagagtttgataaccttaaagaagagttaatgtgggaaggaagcagtgttgtgatgctaagttccgatgaacaaagattcttggaagcttccatggcttatgtttctggaaatccaatcttgaatgatgaagaatatgataagctcaaactcaaactaaagattgatggtagcgacattgtgagcgagggtccaagatgcagtctccgtagtaaaaaggtgtatagtgatctcgctgtagattatttcaaaatgttattgttgaatgttccagcaaccgttgttgctctcggactctttttcttcctggacgacattacaggttttgagatcacatacatcatggagcttccagaaccatacagtttcatattcacttggttcgctgctgtgcctgtgattgtatatctggctttatcaatcaccaaattgatcatcaaggacttcttgatcttgaagggtccttgtccgaattgtggaacggaaaacacctccttctttggaacaattctgtcaatctccagcggcggcaaaaccaacactgtcaaatgcaccaactgcggaaccgcgatggtgtatgactcgggttctaggttgatcacattgccagaaggaagccaagcttaa

SEQ ID NO: 1744 - protein, 324 aa, Arabidopsis thaliana
MGSKMLFSLTSPRLFSAVSRKPSSSFSPSPPSPSSRTQWTQLSPGKSISLRRRVFLLPAKATTEQSGPVGGDNVDSNVLPYCSINKAEKKTIGEMEQEFLQALQSFYYDGKAIMSNEEFDNLKEELMWEGSSVVMLSSDEQRFLEASMAYVSGNPILNDEEYDKLKLKLKIDGSDIVSEGPRCSLRSKKVYSDLAVDYFKMLLLNVPATVVALGLFFFLDDITGFEITYIMELPEPYSFIFTWFAAVPVIVYLALSITKLIIKDFLILKGPCPNCGTENTSFFGTILSISSGGKTNTVKCTNCGTAMVYDSGSRLITLPEGSQA

SEQ ID NO: 1745 - DNA, 618 bp, Arabidopsis thaliana
atggctcctacacaaaatctcttccttgtcgctattgccttcgccgtcattttcaccgcctccaccgtacatggtcgtcataatggtgcagaagatatcgtgcattcctcctgcgaacacgcgagctatccatcactatgcgtccgtactctttcgtcatactccggtccaaccatcaccaaccgccgcgatctagctcaagccgccataaaaatcagcctctcccacgctcaaagcgccgcgaagaaactcgcggtggtgcgagactcggtggggaagaagaagcaagagaaagcggcgcttgtggactgtgtggagatgattggagactctgtggacgagctaagccgtacgctcggcgttttgaagcacctccgtgtctctggcggttcagctaaagagttccggtggcagatgagcaatgcacagacgtgggctagcgcggcacttacggatgacgacacgtgtctcgatgggtttcaagggatggacgacggtgaaatcaaaacggaggtgaagcagtggatgacgaaagtggccagggttacgagcaacgcgctttacatggtcaaccagctagatgagacacgtggcaaaccccacgacgtacatctttga

SEQ ID NO: 1746 - protein, 205 aa, Arabidopsis thaliana
MAPTQNLFLVAIAFAVIFTASTVHGRHNGAEDIVHSSCEHASYPSLCVRTLSSYSGPTITNRRDLAQAAIKISLSHAQSAAKKLAVVRDSVGKKKQEKAALVDCVEMIGDSVDELSRTLGVLKHLRVSGGSAKEFRWQMSNAQTWASAALTDDDTCLDGFQGMDDGEIKTEVKQWMTKVARVTSNALYMVNQLDETRGKPHDVHL

SEQ ID NO: 1747 - DNA, 978 bp, Arabidopsis thaliana
atggcgatcaagaacattctcgcccttgtggttcttcttagcgtggttggagtttctgtcgccattccacagttgcttgacctcgactactaccggtctaagtgtcccaaggcagaggaaattgttcgtggtgtcacagtacaatatgtttctcgccagaaaacccttgccgctaaacttctaaggatgcatttccatgattgtttcgtcagaggatgtgatggttccgttcttctgaaatctgcaaagaatgatgcggaaagagacgctgtccccaacctgaccctgaaaggttatgaagtggtggatgcggccaagacagcgctggagaggaagtgtcctaatctcatttcttgcgctgatgttcttgccttggtcgccagagatgccgtggcagtgatcgggggaccatggtggccggttccattgggccgcagggatggacgcatctcgaaattgaacgatgcattgctaaatttaccatctcctttcgccgacataaagacgctgaagaagaactttgccaacaagggtcttaacgctaaagaccttgtggttctctcagggggtcacaccattggaatctctagttgcgctctcgtcaacagtcgtctctacaacttcacaggaaagggcgattctgacccatccatgaaccctagctacgtgagggaattgaagagaaagtgcccgcctacagatttcagaacctcactgaacatggacccaggcagtgcgttgacattcgacactcactacttcaaggtcgtggctcagaagaaagggctcttcacatctgactctacgcttctcgatgacattgagaccaaaaactacgttcagactcaggccattctccctcctgtgttttcttctttcaataaagatttctccgattccatggtcaaacttggtttcgtccaaattcttaccggcaaaaatggtgagatcaggaagagatgcgccttccctaactaa

SEQ ID NO: 1748 - protein, 325 aa, Arabidopsis thaliana
MAIKNILALVVLLSVVGVSVAIPQLLDLDYYRSKCPKAEEIVRGVTVQYVSRQKTLAAKLLRMHFHDCFVRGCDGSVLLKSAKNDAERDAVPNLTLKGYEVVDAAKTALERKCPNLISCADVLALVARDAVAVIGGPWWPVPLGRRDGRISKLNDALLNLPSPFADIKTLKKNFANKGLNAKDLVVLSGGHTIGISSCALVNSRLYNFTGKGDSDPSMNPSYVRELKRKCPPTDFRTSLNMDPGSALTFDTHYFKVVAQKKGLFTSDSTLLDDIETKNYVQTQAILPPVFSSFNKDFSDSMVKLGFVQILTGKNGEIRKRCAFPN

SEQ ID NO: 1749 - DNA, 1401 bp, Arabidopsis thaliana
atggaagctctgaaaaccgcaacttttagccctatgtcggtgttatccgagaaaagatcagaaccacgaaagcctttctcgctccctaacctctttccaccaaaatcacagagaccaatctcccaagaaagcttcttgaagagattcaatggtggattggctcttctaacttctgttctaagcagtgcaacagctcctgctaaatccctgacgtacgaggaagctctgcaacaatctatgaccacttcttcatcttttgattcggatggtctgattgaagggatatccaattttgtcacagacaatcctttggttattgccggtggagttgctgcattggctgttccatttgttctgtctcaggttctgaacaagaagcccaaatcatggggagttgagtctgctaagaatgcttataccaagttgggtactgatgataatgctcagttgcttgacataagagctactgctgatttcagacaagtgggcagtcctaatattaagggtttgggtaaaaaagcggtttctactgtttataacggtgaagacaagcctggtttcctgaagaagctttctttgaagtttaaagatcctgagaacaccacattatacattctggacaagtttgatggaaactctgagcttgttgctgaattggtggctcttaatggattcaaatctgcttatgcgattaaagatggtgcagagggacctagaggctggttgaatagcagcttgccttggatagagccaaagaagactctcagccttgatttaagcagtttgacggatagcatcagcggtgtatttggtgagagttctgatggtgtatctgtcgctcttggagtagctgctgctgctggattaagtgtttttgcatttacagagattgaaaccatactccaactactaggttcagctgcacttgttcaacttgcaggcaagaaacttctatttgctgaggaccgaaagcaaactctaaaacaggtggatgagttcttgaacacaaaggttgcccctaaagaacttgttgatgagttaaaggaaataggaaaggctcttcttcctcaatcaacaagcaacaaagctctcccagcaccagcaacagtaacagcagaagcagaatcagctacagctacaaccaccacagtcgataaaccagtacctgagccagaaacagttgcagctacaacaaccactgtagataaaccagtacctgagccagagccagtgccagagccagtgccagtgccagcgattgaagctgcagtcgctgcacaagtaatcacagaaccaaccgaaacagaagccaaaccaaaacctcattcaagacctctctctccatatgcatcgtaccctgacttgaagcctccatcttctccgatgccatcgcagccctga

SEQ ID NO: 1750 - protein, 466 aa, Arabidopsis thaliana
MEALKTATFSPMSVLSEKRSEPRKPFSLPNLFPPKSQRPISQESFLKRFNGGLALLTSVLSSATAPAKSLTYEEALQQSMTTSSSFDSDGLIEGISNFVTDNPLVIAGGVAALAVPFVLSQVLNKKPKSWGVESAKNAYTKLGTDDNAQLLDIRATADFRQVGSPNIKGLGKKAVSTVYNGEDKPGFLKKLSLKFKDPENTTLYILDKFDGNSELVAELVALNGFKSAYAIKDGAEGPRGWLNSSLPWIEPKKTLSLDLSSLTDSISGVFGESSDGVSVALGVAAAAGLSVFAFTEIETILQLLGSAALVQLAGKKLLFAEDRKQTLKQVDEFLNTKVAPKELVDELKEIGKALLPQSTSNKALPAPATVTAEAESATATTTTVDKPVPEPETVAATTTTVDKPVPEPEPVPEPVPVPAIEAAVAAQVITEPTETEAKPKPHSRPLSPYASYPDLKPPSSPMPSQP

SEQ ID NO: 1751 - DNA, 321 bp, Arabidopsis thaliana
atggaatctgcagggatccagcaactgcttgctgctgaacgtgaagctcagcaaattgtcaatgccgctaggaccgcaaaaatgactagactgaagcaagccaaggaagaagctgaaacagaggttgctgagcacaaaaccagtacagagcaggggttccagaggaaactcgaagcgacaagtggagattcaggtgcaaacgtgaagaggcttgagcaagagactgatgccaaaatcgagcaattgaagaacgaagctacgagaatttccaaagatgttgtggatatgcttctgaaaaatgtgaccacagtgaacaactga

SEQ ID NO: 1752 - protein, 106 aa, Arabidopsis thaliana
MESAGIQQLLAAEREAQQIVNAARTAKMTRLKQAKEEAETEVAEHKTSTEQGFQRKLEATSGDSGANVKRLEQETDAKIEQLKNEATRISKDVVDMLLKNVTTVNN

SEQ ID NO: 1753 - DNA, 1236 bp, Arabidopsis thaliana
atgtctctccttctccctacgaatttacaacaatacccttcttcttcctccttcccatcttcaacacctatcctatctccgcctccttccaccgctttctccgtcatcgtacctcgtcggagatgtctcagattggttacttcttgtgtctccaccgttcaaagctccgtcgcaacaaacggttcctctccagctcctgctccggccgctgttgtcgttgagcgtgaccagattcgtcttggtcttcctagtaaaggacgtatggctgctgatgcaatcgatcttctcaaggactgtcaactgtttgttaaacaagtcaatcctaggcaatatgttgcacagattccccagttaccaaacactgaagtctggtttcaacggccaaaagatattgtcagaaagttactctcaggagatttggatctaggtatcgttggtcttgacacacttagtgaatatggtcaggaaaatgaagatcttatcattgtccatgaagctctcaactttggagactgtcacctgtctattgcgattccaaactatgggatatttgagaatataaattctctgaaggagctagcgcaaatgccccaatggagtgaagagagacccttacgcttagctactggcttcacttatctcggccccaaatttatgaaagaaaatggcataaagcatgtggtgttttcaactgcagacggagcactggaggcagctccagcgatggggatagctgatgccattttggatcttgtgagtagtggtataacactcaaagagaacaacttgaaagaaattgaaggaggtgttgtgctggaaagccaggcggcacttgtggcaagtagaagagcattaaacgagagaaaaggggcactaaacacagtacacgagattcttgagagattggaggcccatctaaaggcggatggccaattcactgttgttgcaaacatgagaggaaatagtgctcaggaagtggctgagcgtgtgctgagccaaccatcattgtcaggattgcagggaccgacaataagcccagtgtactgtacacaaaatggaaaagtatcggttgactactatgccatcgtgatttgtgtaccaaaaaaggccctatacgactctgtgaagcaacttagagcggccggaggcagtggggtattagtttcacctttgacctacatttttgatgaggatactccaagatggggtcagctcctgagaaacctcgggatttaa

SEQ ID NO: 1754 - protein, 411 aa, Arabidopsis thaliana
MSLLLPTNLQQYPSSSSFPSSTPILSPPPSTAFSVIVPRRRCLRLVTSCVSTVQSSVATNGSSPAPAPAAVVVERDQIRLGLPSKGRMAADAIDLLKDCQLFVKQVNPRQYVAQIPQLPNTEVWFQRPKDIVRKLLSGDLDLGIVGLDTLSEYGQENEDLIIVHEALNFGDCHLSIAIPNYGIFENINSLKELAQMPQWSEERPLRLATGFTYLGPKFMKENGIKHVVFSTADGALEAAPAMGIADAILDLVSSGITLKENNLKEIEGGVVLESQAALVASRRALNERKGALNTVHEILERLEAHLKADGQFTVVANMRGNSAQEVAERVLSQPSLSGLQGPTISPVYCTQNGKVSVDYYAIVICVPKKALYDSVKQLRAAGGSGVLVSPLTYIFDEDTPRWGQLLRNLGI

SEQ ID NO: 1755 - DNA, 465 bp, Arabidopsis thaliana
atggctatggagttagagcttgatgatgatgtcttctttgcagacataagcaaacagatctctcttctcatcatggatgaagatgaacacttaaaccctgtttctctctcttcctcctcctcctctctctcattccagggtttgttcagaggaggttaccaaacggctccatatatgtatcaacaagaacagagcaaagggactggtgtgttcatccctaaatcgtctcagcctagaagaagacctcatcatcatcagaagcaaggtaggtatagttccttcaacgccaagcaacaacactctcttcatcaaaacagacaagagtatcagcaaaatcatgagaactcaagaagtactctcaccactcacaacaataacaacaacaagagcaacatgaacagcactagtgttcatgcttctatcccaagaagaagctacagagatgcatcatctatctacacttga

SEQ ID NO: 1756 - protein, 154 aa, Arabidopsis thaliana
MAMELELDDDVFFADISKQISLLIMDEDEHLNPVSLSSSSSSLSFQGLFRGGYQTAPYMYQQEQSKGTGVFIPKSSQPRRRPHHHQKQGRYSSFNAKQQHSLHQNRQEYQQNHENSRSTLTTHNNNNNKSNMNSTSVHASIPRRSYRDASSIYT

SEQ ID NO: 1757 - DNA, 1311 bp, Arabidopsis thaliana
atggcgtcgtcttctctcacttcgaaatccattctcggatccaccaaactcggttcttcttctcttccctcggagctccgtcgtctctcttctcccgccgttcagatctctctccgtacccaaaccaggaagaacttccagatacaagctactggaagttcatatgggactcattttcgagtttcaacttttggagaatcacatggaggaggagttggttgtatcattgatggttgtcctcctcgtattccacttactgaatctgatttgcaattcgatctcgatagaaggaggcctggtcagagcaggatcacaactcctagaaaagagactgatacttgccggatatcgtctggagtctctgaaggaatgacgacaggaacacctatccatgtgtttgtaccaaacacagatcagagaggacttgattacagtgaaatgtcggttgcctatagaccatcgcatgctgatgcaacttatgacatgaagtatggtgtcagatcagtgcagggtggaggaagatcttcagctagagagaccattggaagagttgctcctggagctttggccaagaaaattttgaagcaatttgcaggaactgagattcttgcctatgtctcgcaagttcaccatgttgtacttccagaagaattggtagaccacgagaatttaacactcgaacagatagaaaataacattgtcagatgccctaatcccgagtatgcggaaaagatgatagctgcgattgatgctgtcaggacaaaagggaactctgttggtggtgttgtgacctgcattgttcggaatgctccacgtgggcttggtacaccggttttcgataaacttgaagcagaactggcaaaagcttgtatgtcgctacctgcaactaagggatttgagtttggaagcggctttgcaggtacctttttgactggtcttgaacacaatgatgagttctataccgatgaaaatggaagaatacgtaccagaaccaaccgatctggtggaattcagggagggatctcaaatggtgaaataataaacatgagagtagccttcaagccaacatcaacaattggaaggaagcaaaatacggtaaccagagacaaggtagaaaccgaaatgattgcgcgtggtcgtcatgatccttgtgttgttccacgagctgtgccaatggtggaagcaatggtggctctagttcttgtggatcaattgatggcgcaatacgcacaatgccatttgtttccaataaatccagagttgcaggaacctctccagatagagcagccgcaaaatgctactgctttgtaa

SEQ ID NO: 1758 - protein, 436 aa, Arabidopsis thaliana
MASSSLTSKSILGSTKLGSSSLPSELRRLSSPAVQISLRTQTRKNFQIQATGSSYGTHFRVSTFGESHGGGVGCIIDGCPPRIPLTESDLQFDLDRRRPGQSRITTPRKETDTCRISSGVSEGMTTGTPIHVFVPNTDQRGLDYSEMSVAYRPSHADATYDMKYGVRSVQGGGRSSARETIGRVAPGALAKKILKQFAGTEILAYVSQVHHVVLPEELVDHENLTLEQIENNIVRCPNPEYAEKMIAAIDAVRTKGNSVGGVVTCIVRNAPRGLGTPVFDKLEAELAKACMSLPATKGFEFGSGFAGTFLTGLEHNDEFYTDENGRIRTRTNRSGGIQGGISNGEIINMRVAFKPTSTIGRKQNTVTRDKVETEMIARGRHDPCVVPRAVPMVEAMVALVLVDQLMAQYAQCHLFPINPELQEPLQIEQPQNATAL

SEQ ID NO: 1759 - DNA, 804 bp, Arabidopsis thaliana
atggctcctcatggagatggattaagtgacatcgaagaacctgaggtcgatgctcaatcggagattcttcgaccgatctcctcagtcgtcttcgtcatcgctatgcaagcggaggctcttcctttggtcaacaagttcggactctctgaaactactgattcgccgcttggtaaaggattgccctgggttctgtatcacggcgtgcataaagatcttcgaatcaatgtagtttgccccggaagagatgcagctttagggatcgatagtgttggaactgttccagcttctctcataacttttgcttccatccaagcattaaaacctgacatcataatcaatgccggaacctgcggtggcttcaaggtcaaaggagccaacataggcgatgtattccttgtatctgatgttgtgtttcatgatagaagaataccaattccgatgtttgatctgtatggagttggtctccgtcaggcattctcgacacccaatctcctcaaggaactcaatttgaagattggcaggttatctactggtgactcgttggatatgtccacgcaagatgaaacattgatcattgccaatgatgctacgctaaaggacatggagggtgctgccgtggcgtatgtggctgatcttctgaaaataccagtcgtgttcctcaaagccgtgaccgatctagtggacggagataaacctacagcagaagagttcttgcagaacttgacagttgtgaccgctgcattagagggaactgctactaaagtgatcaacttcatcaatgggagaaacctttcggacctttaa

SEQ ID NO: 1760 - protein, 267 aa, Arabidopsis thaliana
MAPHGDGLSDIEEPEVDAQSEILRPISSVVFVIAMQAEALPLVNKFGLSETTDSPLGKGLPWVLYHGVHKDLRINVVCPGRDAALGIDSVGTVPASLITFASIQALKPDIIINAGTCGGFKVKGANIGDVFLVSDVVFHDRRIPIPMFDLYGVGLRQAFSTPNLLKELNLKIGRLSTGDSLDMSTQDETLIIANDATLKDMEGAAVAYVADLLKIPVVFLKAVTDLVDGDKPTAEEFLQNLTVVTAALEGTATKVINFINGRNLSDL

SEQ ID NO: 1761 - DNA, 1143 bp, Arabidopsis thaliana
atgcttgtaccgcctgaatacacttaccttgttggaccgatctcattctctggtccttattgtcaagctaacattgtgttccagcttgatggtacgattatagctccaacggattcaaagacatggggaaaagggttaatgtggtggattgattttacaaagctgaaaggaattaaagtacaagggaaaggtgttattgatggaagaggctctggttggtggcaacaagattctcctttcattgatagtgataccaaactcatcgtccctttgaacaattctgctaaccaaaaccctcctatgccgatcagaagtgagcttgatgagagaatgccaagcattaaaccaacggcattgagattctctgggagttttggtgtggaagtgacgggtataacgatacaaaacagtcctcagtgtcacctcaaattcgacgactgcgtaggggttgtggtgcatgacatagccgtttcttcacctggtgacagtccaaacactgatggaattcacctccagaacaccaaagatgtcctcattcacagcactactctcgcttgcggagatgactgtatctcgatccaaacgggttgctcgaacgtgtttgtgcacaatgtgaactgtggaccgggtcacgggatcagcattggtagtctcggcaaagagggtacaaaagcctgcgtctcgaacataacagtacgagacgtagctatgcacaacacaatgacaggtgtccgaatcaagacatggcaaggaggagtaggatcagtgaaagggataatcttctcaaacattcagctcaaccaagtacaaattccaataacgataaaccaattctactgtgaccatagcaaatgcaagaaccaaacatcagcagtagcagtggaaggagtgacttacgagaggataaaaggaacttataccgtgaaaccggtgcatttcgcttgtagcgataacttcccgtgtgtagatgtgcagttatcgtcgatagagcttaaaccggttcaagaaaagtatcgaatgtatgatgcttattgctggcagacatttggtgagctcaacactcctactcttcctcccattgattgtttgaagattgggaagcccccgagaaacaaagttcagtccgatcacgatgtgtgttaa

SEQ ID NO: 1762 - protein, 380 aa, Arabidopsis thaliana
MLVPPEYTYLVGPISFSGPYCQANIVFQLDGTIIAPTDSKTWGKGLMWWIDFTKLKGIKVQGKGVIDGRGSGWWQQDSPFIDSDTKLIVPLNNSANQNPPMPIRSELDERMPSIKPTALRFSGSFGVEVTGITIQNSPQCHLKFDDCVGVVVHDIAVSSPGDSPNTDGIHLQNTKDVLIHSTTLACGDDCISIQTGCSNVFVHNVNCGPGHGISIGSLGKEGTKACVSNITVRDVAMHNTMTGVRIKTWQGGVGSVKGIIFSNIQLNQVQIPITINQFYCDHSKCKNQTSAVAVEGVTYERIKGTYTVKPVHFACSDNFPCVDVQLSSIELKPVQEKYRMYDAYCWQTFGELNTPTLPPIDCLKIGKPPRNKVQSDHDVC

SEQ ID NO: 1763 - DNA, 666 bp, Arabidopsis thaliana
atggcgaattccggcgaagagaagttgaagctctactcttactggagaagctcgtgtgctcatcgtgtccgtatcgccctcgctttgaaagggcttgattatgagtatataccagtgaatttgctcaagggtgatcaattcgattcagatttcaagaagatcaatccaatgggaactgtaccagctctggtggatggagatgttgtgattaatgattcttttgcgataataatgtatctggatgagaagtaccctgagccacctttgttacctcgtgacctccataaacgagctgtgaattaccaggcaatgagtattgtcttgtctggcatacagcctcatcaaaatctggctgttattaggtatatcgaggaaaagataaatgtggaggagaagactgcctgggttaataatgctatcacaaaaggatttacagctctcgagaaactgttggtgaattgcgctgggaaacatgcgactggtgatgaaatttacctggctgatctctttctagcaccacagatccacggagcaatcaacagattccagattaacatggaaccgtacccaactcttgcaaaatgttacgaatcatacaacgaactgcctgcgtttcaaaatgcactaccggaaaagcagccagatgctccttcttccaccatctga

SEQ ID NO: 1764 - protein, 221 aa, Arabidopsis thaliana
MANSGEEKLKLYSYWRSSCAHRVRIALALKGLDYEYIPVNLLKGDQFDSDFKKINPMGTVPALVDGDVVINDSFAIIMYLDEKYPEPPLLPRDLHKRAVNYQAMSIVLSGIQPHQNLAVIRYIEEKINVEEKTAWVNNAITKGFTALEKLLVNCAGKHATGDEIYLADLFLAPQIHGAINRFQINMEPYPTLAKCYESYNELPAFQNALPEKQPDAPSSTI

SEQ ID NO: 1765 - DNA, 711 bp, Arabidopsis thaliana
atggcaggagaggcagaggctttggccacgacggcaccgttagctccggtcaccagtcagcgaaaagtacggaacgatttggaggaaacattaccaaaaccatacatggcaagagcattagcagctccagatacagagcatccgaatggaacagaaggtcacgatagcaaaggaatgagtgttatgcaacaacatgttgctttcttcgaccaaaacgacgatggaatcgtctatccttgggagacttataagggatttcgtgaccttggtttcaacccaatttcctctatcttttggaccttactcataaacttagcgttcagctacgttacacttccgagttgggtgccatcaccattattgccggtttatatcgacaacatacacaaagccaagcatgggagtgattcgagcacctatgacaccgaaggaaggtatgtcccagttaacctcgagaacatatttagcaaatacgcgctaacggttaaagataagttatcatttaaagaggtttggaatgtaaccgagggaaatcgaatggcaatcgatccttttggatggctttcaaacaaagttgaatggatactactctatattcttgctaaggacgaagatggtttcctatctaaagaagctgtgagaggttgctttgatggaagtttatttgaacaaattgccaaagagagggccaattctcgcaaacaagactaa

SEQ ID NO: 1766 - protein, 236 aa, Arabidopsis thaliana
MAGEAEALATTAPLAPVTSQRKVRNDLEETLPKPYMARALAAPDTEHPNGTEGHDSKGMSVMQQHVAFFDQNDDGIVYPWETYKGFRDLGFNPISSIFWTLLINLAFSYVTLPSWVPSPLLPVYIDNIHKAKHGSDSSTYDTEGRYVPVNLENIFSKYALTVKDKLSFKEVWNVTEGNRMAIDPFGWLSNKVEWILLYILAKDEDGFLSKEAVRGCFDGSLFEQIAKERANSRKQD

SEQ ID NO: 1767 - DNA, 753 bp, Arabidopsis thaliana
atggcggctattgctagtctgcaagcagttaatctcacatttaggcgacgtagcactcgatgtggaattgctgagccgagcggagagccagctccgatggggctgaagactagatacgaggatgggctggtggagagagtgttcatgggtctcttcgcgaggaagatggacaagttcgggtcgaagaagaagaaggacacgaaggagaagggtttttgggagtacgattacgagagcttcgtggaggtgtcaaagagagtgatgcagggacggtccagagtgcagcagcaagaggccgtgagggaggttcttctctctatgctgcctcctggtgctcctgaacagtttaggaaattgttcccaccaacgaaatgggctgcagagttcaatgccgctcttacagtgcctttctttcactggttggttggtccatctcaggtcatagaagtggaagtgaatggtgtgaaacagagaagtggagttcgtatcaagaaatgcaggtatctggagaacagtgggtgtgtaggaatgtgtgtgaatatgtgcaagattccaacccaagatttcttcaccaatgagtttggcctcccactcaccatgaacccaaattatgaagacatgagctgcgagatgatatacgggcaagcacctccggcctttgaggaggatgtagccaccaagcaaccttgtctagcagatatatgttctatgtcgaatccaagctccccaatctgccctaaactagaggcatga

SEQ ID NO: 1768 - protein, 250 aa, Arabidopsis thaliana
MAAIASLQAVNLTFRRRSTRCGIAEPSGEPAPMGLKTRYEDGLVERVFMGLFARKMDKFGSKKKKDTKEKGFWEYDYESFVEVSKRVMQGRSRVQQQEAVREVLLSMLPPGAPEQFRKLFPPTKWAAEFNAALTVPFFHWLVGPSQVIEVEVNGVKQRSGVRIKKCRYLENSGCVGMCVNMCKIPTQDFFTNEFGLPLTMNPNYEDMSCEMIYGQAPPAFEEDVATKQPCLADICSMSNPSSPICPKLEA

SEQ ID NO: 1769 - DNA, 510 bp, Arabidopsis thaliana
atggcggcttctttatcgagcagacttataaaaggaatcgctaatctcaaagctgttcgttctagcagattgacgtctgcatcagtctaccaaaatgggatgatgagattttcctcaacagtgccaagtgattcagatacacatgatgatttcaagcctacacaaaaagtccctcccgattctacggactcacttaaagatatcgttgagaatgatgtgaaggataatcctgttatgatctacatgaaaggtgtccctgaatctcctcagtgtgggtttagctcactagccgtcagagttttgcagcaatataatgttcctatcagttctagaaacattctagaagaccaagagttgaaaaacgctgtgaaatccttcagccactggcctacgtttccacagatcttcattaagggagagttcattggcggctcagacatcatccttaacatgcacaaggaaggtgaattggagcagaagcttaaagacgtctccggaaaccaagattga

SEQ ID NO: 1770 - protein, 169 aa, Arabidopsis thaliana
MAASLSSRLIKGIANLKAVRSSRLTSASVYQNGMMRFSSTVPSDSDTHDDFKPTQKVPPDSTDSLKDIVENDVKDNPVMIYMKGVPESPQCGFSSLAVRVLQQYNVPISSRNILEDQELKNAVKSFSHWPTFPQIFIKGEFIGGSDIILNMHKEGELEQKLKDVSGNQD

SEQ ID NO: 1771 - DNA, 741 bp, Arabidopsis thaliana
atgggagaggtgaaagtagacgacgatgcgattcttaaatccttcctcgccgaggtcggagaagttgagagagataacgaagtcggcaggattctctcatgcttcaagctgaatccgtttgagcatcttaacctctctttcgattcttccacggatgatgttaaaaggcagtacagaaagatttctttgatggttcatcctgataaatgcaaacatccacaagcacaggaggctttcggagcattggcaaaagcgcaacaactgctgctaaacgaccaagaaagagattatattcttacccaagtccatgctgcaaaagaagagcttaagatgaagagaaagaaacagttaaagaaagacaccgcctctaaaataaagtccttggttgatgagggaaagcatgagcacatatatgagcaatctgaggagtttcagaaggagctcaagttaaaggtccgagagatattaacagaccaagagtggcgtagaagaaaaatggcaatgagaatatcagaagaagaggggagactgaagaaggatgaagcagaacaaaaggagatatggaagaaaaagcgtgagcatgaagaacagtgggaaggaacaagagaaaaaagggtatcaagctggagagactttcagaaagcaggaaagaaggccaaaaaaggagagacgcgacctccaaaattgaagacagaggatccgaacaaatcatacgtccaaaggccggtcaagaaaggctga

SEQ ID NO: 1772 - protein, 246 aa, Arabidopsis thaliana
MGEVKVDDDAILKSFLAEVGEVERDNEVGRILSCFKLNPFEHLNLSFDSSTDDVKRQYRKISLMVHPDKCKHPQAQEAFGALAKAQQLLLNDQERDYILTQVHAAKEELKMKRKKQLKKDTASKIKSLVDEGKHEHIYEQSEEFQKELKLKVREILTDQEWRRRKMAMRISEEEGRLKKDEAEQKEIWKKKREHEEQWEGTREKRVSSWRDFQKAGKKAKKGETRPPKLKTEDPNKSYVQRPVKKG

SEQ ID NO: 1773 - DNA, 537 bp, Arabidopsis thaliana
atgaaaacagcaaaggggaaagataaagttaagaccacaaaggaagccttgaagccagttgatgacagaaaggtgggaaagaggaaggcaccggctgagaagcctactaaacgagagactcgtaaagagaagaaggctaaaaaggacccaaacaaaccaaaaagagctcctagtgccttctttgtctttctagaagattttagggtcacgttcaagaaagaaaatccaaatgtgaaggccgtctctgctgttgggaaagctggagggcagaaatggaagtcaatgtctcaagctgaaaaagctccatatgaagagaaagctgcaaaaaggaaagctgaatatgagaagcaaatggatgcatacaacaaaaacttggaggaagggagtgatgaatctgaaaagtctagatctgagataaatgatgaagatgaagccagtggggaggaagaactattagagaaggaagcggcaggtgatgatgaagaagaagaagaggaagaagatgacgatgatgatgacgacgaggaagaagactaa

SEQ ID NO: 1774 - protein, 178 aa, Arabidopsis thaliana
MKTAKGKDKVKTTKEALKPVDDRKVGKRKAPAEKPTKRETRKEKKAKKDPNKPKRAPSAFFVFLEDFRVTFKKENPNVKAVSAVGKAGGQKWKSMSQAEKAPYEEKAAKRKAEYEKQMDAYNKNLEEGSDESEKSRSEINDEDEASGEEELLEKEAAGDDEEEEEEEDDDDDDDEEED

SEQ ID NO: 1775 - DNA, 978 bp, Arabidopsis thaliana
atgtcgacatctgaggataaaccggaaatcatcagtagagtagttcatcaggagggtgacgtggaaatcgtcgatagaagtcagaaggataaggacgaggaaaaagaagaagggaaaggtggattcctcgataaggtgaaagatttcattcatgacattggtgagaaactcgagggaaccattggctttgggaagccaactgctgatgtctctgcgattcatatccctaagatcaatcttgagagggcagatattgttgtggatgtgcttgtcaagaacccgaatccagttcctatccctctcatcgatgtcaactacctggtcgagagcgatgggaggaaactggtttctggtttgatcccggatgctggaacactcaaggctcatggagaagaaactgtgaagataccattgacgttgatctatgatgacatcaagagcacttacaacgatatcaaccccgggatgatcataccttacagaatcaaggttgatctgattgtggatgtgccagtattgggaagactgacattgccgctggagaaatgtggagagatcccaattccaaagaaacctgatgttgatatcgagaagattaagttccagaagttctctttggaggaaaccgtggcgattctccatgtgaggcttcagaacatgaatgatttcgacttggggctcaatgacttggactgtgaagtttggctgtgtgatgtaagcattgggaaagcagagatcgcggactcgatcaagcttgacaaaaacggaagcggattgattaatgtgccgatgacattccgaccaaaggactttggttctgcgctttgggatatgattcgtggtaaaggaacagggtacacaatcaaaggtaatattgatgttgatacaccatttggagctatgaagcttcctattatcaaggaaggtggagagacccgtctgaagaaggaagatgatgatgacgacgatgaggaataa

SEQ ID NO: 1776 - protein, 325 aa, Arabidopsis thaliana
MSTSEDKPEIISRVVHQEGDVEIVDRSQKDKDEEKEEGKGGFLDKVKDFIHDIGEKLEGTIGFGKPTADVSAIHIPKINLERADIVVDVLVKNPNPVPIPLIDVNYLVESDGRKLVSGLIPDAGTLKAHGEETVKIPLTLIYDDIKSTYNDINPGMIIPYRIKVDLIVDVPVLGRLTLPLEKCGEIPIPKKPDVDIEKIKFQKFSLEETVAILHVRLQNMNDFDLGLNDLDCEVWLCDVSIGKAEIADSIKLDKNGSGLINVPMTFRPKDFGSALWDMIRGKGTGYTIKGNIDVDTPFGAMKLPIIKEGGETRLKKEDDDDDDEE

SEQ ID NO: 1777 - DNA, 252 bp, Arabidopsis thaliana
atgggtttgttgccattggtgaagaaactaggtttcatcatctttcttctagtttcagcttcagcgtttgctctctgttctgcaggccgatcatccattttaatctatagccaagaagatgatcatcccgaggtagtagaaagaagaatacatgagcatgagagaattctgagaatgaattcaagagactatggccactccagtcctaaaccaaagctcgtgagacctcctttcaagcttattcccaactga

SEQ ID NO: 1778 - protein, 83 aa, Arabidopsis thaliana
MGLLPLVKKLGFIIFLLVSASAFALCSAGRSSILIYSQEDDHPEVVERRIHEHERILRMNSRDYGHSSPKPKLVRPPFKLIPN

SEQ ID NO: 1779 - DNA, 981 bp, Arabidopsis thaliana
atgactaatggcggtagaggttccggcggcggtggtggtggcggcggcagggagtcaggcggtcgtgatttggaaattagacctggtggtatgttggttcagaaacgtaacccggatttggatcctgtcggacctccaccaccaccgatgatcagagttagaatcaagtacggtgccgtctaccatgagatcaatattagtcctcaagcttcttttggggagctaaagaagatgttgactggaccaacgggtattcatcatcaagatcagaagctaatgtataaagataaagagagggattcgaaggcgttcctcgatgtttcgggagtgaaagataaatctaagatggtgcttatagaagacccgcttagccaagagaaacggtttttggagatgaggaagattgctaaaaccgaaaaggcgtctaaagcgatatcggatattagccttgaagttgataggctcggcggacgagtttcggcttttgagatggtaactaaaaaaggagggaagattgcggagaaagatcttgtaacggttatcgaattgctgatgaatgagttgattaagttggatgcgattgtagctgaaggagatgtcaagttacaaagaaagatgcaggtgaagagagtgcagaattatgtggaaacactcgatgccttgaaggtgaaaaactccatggctaatgggcaacagaaacagtcaagtactgctcagagacttgcaccgattcaagaacataacaatgaagagagacaagaacagaaaccgatacaatcgctcatggacatgccgatacaatacaaagagaagaagcaagagattgaagaggagcctaggaattcaggggaaggaccatttgtgttagattcttctgctaaatgggaaacattcgatcatcatcccgtgacgccattgagctcgactactgcgaaaaataacgcgatcccgcccaggtttaattgggaattctttgattga

SEQ ID NO: 1780 - protein, 326 aa, Arabidopsis thaliana
MTNGGRGSGGGGGGGGRESGGRDLEIRPGGMLVQKRNPDLDPVGPPPPPMIRVRIKYGAVYHEINISPQASFGELKKMLTGPTGIHHQDQKLMYKDKERDSKAFLDVSGVKDKSKMVLIEDPLSQEKRFLEMRKIAKTEKASKAISDISLEVDRLGGRVSAFEMVTKKGGKIAEKDLVTVIELLMNELIKLDAIVAEGDVKLQRKMQVKRVQNYVETLDALKVKNSMANGQQKQSSTAQRLAPIQEHNNEERQEQKPIQSLMDMPIQYKEKKQEIEEEPRNSGEGPFVLDSSAKWETFDHHPVTPLSSTTAKNNAIPPRFNWEFFD

SEQ ID NO: 1781 - DNA, 933 bp, Arabidopsis thaliana
atggcgacggagaaaagcaagattctggtgatcggaggaactggttacatcgggaaattcctagtagaagcgagcgccaaagctggccactccacattcgctctcgttagagaagcaactctatccgatcctgtcaagggcaaaaccgtccagagtttcaaagatctcggcgtcacaatactacacggagatttgaatgatcacgagagcttagtgaaggctattaaacaggttgatgtggtgatatctaccgttgggagcatgcaaatcttggatcaaaccaagatcatttccgccatcaaagaagccggtaatgtcaagagattcttgccgtctgagtttggggtggatgtggataggacgagtgcggttgagccagctaaatcggcttttgcagggaagatacagatcaggagaaccatcgaagcggaaggaataccatacacttacgctgttaccggttgctttggtggttactacttgccaacattggttcagttcgagcctggtctcacttctcctcctagagacaaagtcaccattcttggcgatggaaatgccaaagctgtgatcaacaaagaggaagatattgctgcttacacgatcaaggcggtggatgatcctaggactctgaacaaaatcctatacattaagccttctaacaacactttatcgatgaacgaaatagtcaccttgtgggagaaaaagattggcaagtctcttgagaagactcacctcccagaggaacaactacttaaaagcatccaagagtctccgattcccatcaatgttgttctgtcgataaaccacgcggtgtttgtgaatggagataccaatatcagtatagagccttcctttggtgtggaagcctctgagctttaccctgatgtcaagtacacaagtgttgacgagtatctcagttatttcgcttga

SEQ ID NO: 1782 - protein, 310 aa, Arabidopsis thaliana
MATEKSKILVIGGTGYIGKFLVEASAKAGHSTFALVREATLSDPVKGKTVQSFKDLGVTILHGDLNDHESLVKAIKQVDVVISTVGSMQILDQTKIISAIKEAGNVKRFLPSEFGVDVDRTSAVEPAKSAFAGKIQIRRTIEAEGIPYTYAVTGCFGGYYLPTLVQFEPGLTSPPRDKVTILGDGNAKAVINKEEDIAAYTIKAVDDPRTLNKILYIKPSNNTLSMNEIVTLWEKKIGKSLEKTHLPEEQLLKSIQESPIPINVVLSINHAVFVNGDTNISIEPSFGVEASELYPDVKYTSVDEYLSYFA

SEQ ID NO: 1783 - DNA, 1797 bp, Arabidopsis thaliana
atggtgggtagtattgttggcagtaacatggctgcgactgatgcgaggtttctaagctcgaattttggcaacagtttcagcatcaacaccagaattcacagattccatgatcgctcccaaatcgtaatccctagggctcaatcttcttcttctccgtctccatctccaccctccgacaagaagaagaccaaaacccgacccggaaccataaccactaaggagagcgaagagacggttgcgaagaagctcgacgttgctccgccttcgcctcaatcaccaccgtctccgcctacactgaagttggacgatgtgaatcctgtgggattaggacgacgatcgcggcagatcttcgacgaggtgtggcggaaattctctggattaggtcagatgtcgaggacaacccgacccgatgagcaagagactcttgatagtctactcattagagaaggacctatgtgtgagtttgctgttcccggcgctcaaaacgttaccgttttagtcgtcggagctactagtagaatcggtcgtatcgttgtccgtaaactcatgctccgtggctacaccgtcaaggcactggtgaggaaacaagatgaggaagtgatgagtatgttgccaaggtcagtggatattgttgttggagatgtgggtgaaccgtcaacgctcaaatccgctgttgaaagctgcagcaagatcatctactgtgcgactgctcggtctacgattactgcagaccttacgcgggttgatcacttgggtgtttataacctcaccaaggcttttcaggattacaataacagactagcgcaattaagggcgggtaaaagcagcaaaagcaagcttctattagctaagttcaagtcagctgagtcacttgatggttgggaaattcgtcaaggaacttactttcaggacacaaccgcttccaaatatgatggtgggatggatgctaagtttgagttcactgaaactgagagagctgagttttcaggttatgttttcacccgaggaggatatgttgagttgtcgaagaaactttcacttccattgggtaccactcttgacaggtacgaaggcttagttctttctgttggtgggaatggaagatcctatgttgtaatccttgaagctggtccatcatcagatatgtctcagagcaaacagtatttcgctaggatcagtaccaaagcagggttttgtcgggtaagggtgccattttcagcttttcgaccggtcaacccagaagatccaccgctagatccatttcttgttcacacattgacaatacgctttgagcctaaaagacagaggcctgttgatggacttgctggtgcgcaacaagatttgagaagttttagccttgtatttgagtacataaaagctttgcctgcgggtcaagaaacagactttattctggtatcgtgtactggttcgggagtagaagccaacagaagggagcaagtgttgaaagctaagagggctggtgaagattctttaaggagatcaggccttggatacacaatcattcgtcctggtcccttgaaggaggaaccaggcgggcaacgagctctgatatttgatcaaggaaacagaatttctcagggcattagttgcgcggatgtggctgatatatgtgtcaaggcactgcacgattcaaccgccagaaacaaaagctttgatgtttgccatgaatacgttgctgagcaaggaatagaactctatgagctggtggctcatttgccagacaaggcgaacaactatctgactccggctttatctgtacttgagaagaacacatga

SEQ ID NO: 1784 - protein, 598 aa, Arabidopsis thaliana
MVGSIVGSNMAATDARFLSSNFGNSFSINTRIHRFHDRSQIVIPRAQSSSSPSPSPPSDKKKTKTRPGTITTKESEETVAKKLDVAPPSPQSPPSPPTLKLDDVNPVGLGRRSRQIFDEVWRKFSGLGQMSRTTRPDEQETLDSLLIREGPMCEFAVPGAQNVTVLVVGATSRIGRIVVRKLMLRGYTVKALVRKQDEEVMSMLPRSVDIVVGDVGEPSTLKSAVESCSKIIYCATARSTITADLTRVDHLGVYNLTKAFQDYNNRLAQLRAGKSSKSKLLLAKFKSAESLDGWEIRQGTYFQDTTASKYDGGMDAKFEFTETERAEFSGYVFTRGGYVELSKKLSLPLGTTLDRYEGLVLSVGGNGRSYVVILEAGPSSDMSQSKQYFARISTKAGFCRVRVPFSAFRPVNPEDPPLDPFLVHTLTIRFEPKRQRPVDGLAGAQQDLRSFSLVFEYIKALPAGQETDFILVSCTGSGVEANRREQVLKAKRAGEDSLRRSGLGYTIIRPGPLKEEPGGQRALIFDQGNRISQGISCADVADICVKALHDSTARNKSFDVCHEYVAEQGIELYELVAHLPDKANNYLTPALSVLEKNT

SEQ ID NO: 1785 - DNA, 810 bp, Arabidopsis thaliana
atgtcaacgtatctgatcacaggattcataggcatcgaatacagcaacccaaccttagcttcagccattagcaatatcaatcctgccattaccttcatccttgccattatcttcagaatggagaaagcatctttcaaagaaaagagtagtgtagccaaaatggttgggacaatagtttcactagttggcgcacttgtggtagttctctaccatggtccacgagtcttcaccccatcttctccaccatttccacaactccgtcagcttcttttgccgttatcatcctcaaactcggattggatcatcggtggttgtcttttagccatcaaagacaccctcgttcctgttgcttttattcttcaagcacatataatgaagttatatccagcaccattcacggtctctttcttctattttctgattgcttcaatcttgacgtcattgatcggaatcgtagcagaaaagaacaatccgagcatatggatcattcattttgacattacattagtttgcatagttgttgggggaatatttaatccaggatattacgcgattcatctgtgggcagtacgtaataaaggacctgtttacttagctatattcagacctttatcgattttaatagcagtgattatgggagcgatttttcttggagattctttttacctaggaagtttggtcggagggattttgatatcgttagggttttacactgtgatgtggggaaaagcaaaagaagggaagactcagttcttgtcgctgtcagaggaaactcctcttctagacgaaaacatagacgaccgaatatag

SEQ ID NO: 1786 - protein, 269 aa, Arabidopsis thaliana
MSTYLITGFIGIEYSNPTLASAISNINPAITFILAIIFRMEKASFKEKSSVAKMVGTIVSLVGALVVVLYHGPRVFTPSSPPFPQLRQLLLPLSSSNSDWIIGGCLLAIKDTLVPVAFILQAHIMKLYPAPFTVSFFYFLIASILTSLIGIVAEKNNPSIWIIHFDITLVCIVVGGIFNPGYYAIHLWAVRNKGPVYLAIFRPLSILIAVIMGAIFLGDSFYLGSLVGGILISLGFYTVMWGKAKEGKTQFLSLSEETPLLDENIDDRI

SEQ ID NO: 1787 - DNA, 309 bp, Arabidopsis thaliana
atggagaacctacagaagatgatctctgagaagtcggtagtaatttttagcaagaactcatgctgcatgtctcatacaattaagactctcttcttagactttggcgtgaacccgactatctatgagctcgacgagatcaacataggaagggagatagagcaagcattggctcagctcggatgcagcccgaccgttccggtggtgttcattggagggcagcttgttggtggagccaatcaagtcatgagtctccatctcaaccgctcccttgttcctatgcttaaacgtgctggagcattatggctttaa

SEQ ID NO: 1788 - protein, 102 aa, Arabidopsis thaliana
MENLQKMISEKSVVIFSKNSCCMSHTIKTLFLDFGVNPTIYELDEINIGREIEQALAQLGCSPTVPVVFIGGQLVGGANQVMSLHLNRSLVPMLKRAGALWL

SEQ ID NO: 1789 - DNA, 930 bp, Arabidopsis thaliana
atgagaactcttttgcacaacttcaattttgtccctcaagattctccttattacaaaacgtccccttttcccacatcatccttcttcaacgttcgctttcccatcaagaacaaccaaatctcttgtaacaaagcaaagaatttgagaatggatccgtctaagggaatccaagaacagaggattgtgattccaaacagacacaacgagaagctggttggtctgcttcatgaaactggttctacagacatcgtagtcttgtgccatggctttcgatcaaacaagagtaaccaaataatgaataatgtggctgctgctatacagaaagaagggatcagcgcttttcgttttgatttctccgggaatggagagagtgaaggcagtttctattatggtaactataaccatgaagctgatgatttacattctgttgtccaatacttctctaacaagaaccgtgtggttcctataatcctcggtcacagtaagggaggtgatgttgtcctcctctacgcctccaagtatcatgatgtccgcaatgtaatcaatctctcgggacgttatgatcttaaaaagggtataagagagcgtcttggagaagattttttggaaagaattaagcaacaaggattcatcgatgttggagatggaaaatcggggtatcgtgttactgagaagagcttaatggacaggttaagcactgatattcatgaagcttgcctcaagattgacaaagagtgcagggtcttgacggttcatggatcggaggacgaggtaatacctgtggaagatgcgaaggagtttgcgaagatcataccaaaccacaagctggagattgtggaaggagctaatcatggttatactgagcaccaaagtcaattagtttcaacagttatggagttcataaagacagtcattgtgaagaacaactag

SEQ ID NO: 1790 - protein, 309 aa, Arabidopsis thaliana
MRTLLHNFNFVPQDSPYYKTSPFPTSSFFNVRFPIKNNQISCNKAKNLRMDPSKGIQEQRIVIPNRHNEKLVGLLHETGSTDIVVLCHGFRSNKSNQIMNNVAAAIQKEGISAFRFDFSGNGESEGSFYYGNYNHEADDLHSVVQYFSNKNRVVPIILGHSKGGDVVLLYASKYHDVRNVINLSGRYDLKKGIRERLGEDFLERIKQQGFIDVGDGKSGYRVTEKSLMDRLSTDIHEACLKIDKECRVLTVHGSEDEVIPVEDAKEFAKIIPNHKLEIVEGANHGYTEHQSQLVSTVMEFIKTVIVKNN

SEQ ID NO: 1791 - DNA, 2292 bp, Arabidopsis thaliana; identical to SEQ ID NO: 1719

SEQ ID NO: 1792 - protein, 763 aa, Arabidopsis thaliana; identical to SEQ ID NO: 1720

SEQ ID NO: 1793 - DNA, 3054 bp, Arabidopsis thaliana
atggagaacccaaaaccggcgataacgtcggtggtcttgaaaggagagaactatctactatggatgaggacgacaaaaacggtgttatgtggccgagggctttggagccatgttgaaaccaaacatgttcagtttaaggctaccaaagaagacggcgacgaagggttcaagagggaagaagaagaagctgagatcgagaaagaagccaagtggtttcaagaagaccaaaacgttctcgctattcttcaacattctcttgagagctccattcttgaggcttactcttattgtgaaacggcacgcgagctatgggagacactcgagaacgtgtatgggaatgtgtcaaacttgactcgagtctttgaagtcaagaaggccattaacaaccttagccaagtagacttggagttcactaaacacttcggaaagtttaggtcactatgggctgaacttgagatgcttcgaccaagtaccgtggatccggccattcttaacgagagaaaggaacaagagaaagtattcggccttcttcttacactcaatcccgccttcaacgatctcatcaaacatcttcttcgagccgacaagcttccttcacttgaaaatgtttgttctcaagtacaaaaggaacaaggatctctcgggttgtttagtggtaagggcgaacttatcacggctcacaaagggatctacaaaggtgaagaaaggaaggtatgggtgtgtgatcattgcaagaagaagggacacatgaaagacaaatgttggattcttcatccccacctaaaaccggctaagttcaaagcaaacatatctcaagaagttgcaagtgaccaaggagaagtggtgaggaagtcagatttggagtctctcataagatccatcgcctctctaaaagaatctggtacctctttcttgacctatgaaccaaataaaatgctaaaggaatccggtacatctttctttacttccgaaccaagtaaaactcttgttatagattcgggcgcatctcaccatatgatcaacaatcctagtctaatcgataatataaaaccggcgttaggcaatgtagttatagcaaatggagataaagtaccggtaaaagaaataggagagttaaacttatttgataagaaatctaaagctctatatatgcctagctttacttcaaatcttttatcggttaagagagctactaatgatttgaattgctatacaatatttggtcctaatagtgtacattttcaggatattaagaccggaaggtctttgactatttatgagaattgttttgacttggttcactcggatgtttggacttctccttgcatgtctagggataataagaagtactttgtgacttttattgatgagaaatcgaaatatacatggatcacattgttaccatctaaagattgtgtgatggatgcctttataaatttccaaaactatgtcactaattacttcaatgctaaaattaaggtacttagatccgacaatggtggagagtatacaagtcacaaattcaaagagtaccttgcaaaacacggcatcattcatcaaacgagttgtccttacacacctcaacaaaatggagtggcggagaggaagaatcgacacctcatggaggtagaaaggtcaatgatgtttcatacgaatgtcaccaagaagttttggggagatgcggtgatgacggcttgttatcttatcaatagaacacccaccaaagttctacaagatgtttctacatttgagttctttgaagaaaaaggttattacgagaagaaagattggaatagcttggcagatctctctacaccctcaacggatcgtgctacaagtttacagtttcttcttgaccatcttggagttactccatcaagtgaaagagaaaccaagacaagagacttgatagaagaaccgattactattgatcaagaaaatgaacaagaggaggcctccaacctacaacaagatggagagattaatggaatccaaatacatgatgatatggatactcaaaatgaagatggagacgaagtactcggattaagagaaaaatcttctcgcttgtattacaacaataaggcggtagctcaccctatacaagcagtgtgttctcttgccctcttaccacaagatcaccaagcttttataggaaagatagaagcaaactttgttctgcaaacctatgaagaagctaaggagagtgaagaatggataaatgcggtggcggatgaaaccggagctatgattcgtaatcatacttgggatgaagaagacttgcctccggggaagagagccgtgagctccaaatgggtcttcacgatcaagtacttgagtaatggtgagatagagagacataaagctcgcttggtagcatgcgggttcactcaaacttatggtcgtgactatactgaaacctttgcacccgtcgccaagcttcacacggtgagagttgttctctctcttgctactaatctctcgtgggacttatggcaaatggacgtcaagaacgcctttcttcaaggagagctagaagaagaagtgtatatgactccaccaccgggactagaagattccattgctccgggtaaagttttgcgacttcggaaggcaatttatggcttgaaacaatctcctagagcttggtaccataatttaagtaccacactaaagggaaaagggttcaagaaatccgaagccgatcacactctcttcacacttcaatccgatcaaggtattattgttgctctcatctatgttgataatattatcatctccggagacaacaaagaaggtatccatgacaccaaactctttcttaaatctacatttgatataaaagaccttggtgaactaaagtatttcttagggattgaagtatgtcgctctcccgagggcttatttctttcacaaagaaaatacactcttgatcttttgaatgagacaggaaaacttggttctaaaccggctaagacacctcttgttgatggctatacggtcaagcgaaccggggggggaagaagaagaagaatgcaccacttgatccgttag

SEQ ID NO: 1794 - protein, 1017 aa, Arabidopsis thaliana
MENPKPAITSVVLKGENYLLWMRTTKTVLCGRGLWSHVETKHVQFKATKEDGDEGFKREEEEAEIEKEAKWFQEDQNVLAILQHSLESSILEAYSYCETARELWETLENVYGNVSNLTRVFEVKKAINNLSQVDLEFTKHFGKFRSLWAELEMLRPSTVDPAILNERKEQEKVFGLLLTLNPAFNDLIKHLLRADKLPSLENVCSQVQKEQGSLGLFSGKGELITAHKGIYKGEERKVWVCDHCKKKGHMKDKCWILHPHLKPAKFKANISQEVASDQGEVVRKSDLESLIRSIASLKESGTSFLTYEPNKMLKESGTSFFTSEPSKTLVIDSGASHHMINNPSLIDNIKPALGNVVIANGDKVPVKEIGELNLFDKKSKALYMPSFTSNLLSVKRATNDLNCYTIFGPNSVHFQDIKTGRSLTIYENCFDLVHSDVWTSPCMSRDNKKYFVTFIDEKSKYTWITLLPSKDCVMDAFINFQNYVTNYFNAKIKVLRSDNGGEYTSHKFKEYLAKHGIIHQTSCPYTPQQNGVAERKNRHLMEVERSMMFHTNVTKKFWGDAVMTACYLINRTPTKVLQDVSTFEFFEEKGYYEKKDWNSLADLSTPSTDRATSLQFLLDHLGVTPSSERETKTRDLIEEPITIDQENEQEEASNLQQDGEINGIQIHDDMDTQNEDGDEVLGLREKSSRLYYNNKAVAHPIQAVCSLALLPQDHQAFIGKIEANFVLQTYEEAKESEEWINAVADETGAMIRNHTWDEEDLPPGKRAVSSKWVFTIKYLSNGEIERHKARLVACGFTQTYGRDYTETFAPVAKLHTVRVVLSLATNLSWDLWQMDVKNAFLQGELEEEVYMTPPPGLEDSIAPGKVLRLRKAIYGLKQSPRAWYHNLSTTLKGKGFKKSEADHTLFTLQSDQGIIVALIYVDNIIISGDNKEGIHDTKLFLKSTFDIKDLGELKYFLGIEVCRSPEGLFLSQRKYTLDLLNETGKLGSKPAKTPLVDGYTVKRTGGGRRRRMHHLIR

SEQ ID NO: 1795 - DNA, 870 bp, Arabidopsis thaliana
atgagtctcttcaacactgaaaacacatgggcctttgtctttggcttgctcggcaaccttatctcctttgccgtgttcctatctcctgtgccaacgttctataggatttggaagaagaagacaacagaagggtttcagtctattccttatgttgtggcgctcttcagtgcgacgctttggctttactatgcgacacagaagaaagatgtcttcctcctcgtaaccattaacgcctttggttgcttcatcgaaaccatctacatctctatgttccttgcctacgctcccaagccagctcggatgttgacagtgaagatgctacttcttatgaactttggaggattctgtgcgattctccttctttgccaattcttggtaaaaggagccacacgtgctaagattatcggaggaatctgtgtcggattctctgtttgtgttttcgctgctcctctaagcataatcaggacggtaataaagacaagaagtgtggagtacatgccctttagcttatccttaacccttaccatcagtgctgtcatatggctcctttatggtcttgctctcaaggacatctatgttgctttcccgaatgtgcttggttttgctctcggtgcactccaaatgatactctacgttgtctacaaatactgtaaaacgtcgccgcatctaggagagaaagaagtcgaagctgctaagttaccggaggtgagcctcgatatgttgaagctaggcacagtttcatcccctgagccaatctcagtggttcgtcaagcgaacaagtgtacctgcggaaatgatcgaagggctgagattgaagatggacaaacccctaaacatggcaagcagtcctcttccgcagcagctacatga

SEQ ID NO: 1796 - protein, 289 aa, Arabidopsis thaliana
MSLFNTENTWAFVFGLLGNLISFAVFLSPVPTFYRIWKKKTTEGFQSIPYVVALFSATLWLYYATQKKDVFLLVTINAFGCFIETIYISMFLAYAPKPARMLTVKMLLLMNFGGFCAILLLCQFLVKGATRAKIIGGICVGFSVCVFAAPLSIIRTVIKTRSVEYMPFSLSLTLTISAVIWLLYGLALKDIYVAFPNVLGFALGALQMILYVVYKYCKTSPHLGEKEVEAAKLPEVSLDMLKLGTVSSPEPISVVRQANKCTCGNDRRAEIEDGQTPKHGKQSSSAAAT

SEQ ID NO: 1797 - DNA, 1833 bp, Arabidopsis thaliana
atggcaactgtgactgcttcttctaactttgtgtcaagaacttcacttttcaacaatcatggtgcttcttcatgctctgatgtcgctcagattaccttaaaaggccaatccttgactcattgtgggttaaggtcattcaacatggtggataaccttcagaggagatctcaagctaaacctgtttctgctaaatcctcaaagagatcttctaaagttaagactgctggtaagattgtgtgtgagaaaggaatgtctgtgatttttattggagctgaagttggtccatggagtaaaactggtggtcttggtgatgttctcggtggtctacctccagctcttgctgctagaggccaccgtgtgatgacaatttgtcctcggtatgaccaatataaagatgcttgggacacttgtgttgtggttcagatcaaagttggggataaagttgagaatgttcgtttcttccattgctacaaacgaggagttgatcgtgtctttgttgaccatccaatctttcttgctaaggttgtgggcaaaacaggatccaaaatctatggtcctataactggagtagactacaatgacaaccaactccggttcagtttgttgtgtcaggctgctcttgaggcaccacaggttctgaacctgaacagcagcaagtacttctctggaccatatggtgaagatgtagtctttgttgccaatgactggcacactgctctacttccatgttacctcaaatctatgtatcaatcccgcggagtctacatgaatgcaaaggtggtcttctgcattcacaacatagcctaccagggaagatttgcctttgatgactattcccttctcaacttgcccatcagctttaaaagttctttcgacttcatggacgggtatgaaaagccagtaaaaggacggaaaattaactggatgaaggctgcaattctggaagctcaccgtgtcttaacagttagtccatactacgctcaagaactcatctctggagttgatagaggcgtggaattgcataaatatcttcgaatgaaaacagtttccggaattattaatggaatggatgttcaagaatggaacccgtctactgacaagtacatcgatatcaaatacgatattaccactgttacagatgctaaaccattgatcaaagaagcacttcaggctgctgttggacttcccgtggacagggatgtcccggttatcggtttcatagggagattggaggagcagaagggttctgatattctagtggaagctatttccaagttcatggggctcaatgttcagatggttatccttgggactggaaagaagaagatggaggctcagattcttgaactagaagagaagttcccagggaaggcggttggagtggcgaaattcaacgtgccattggctcatatgatcactgctggagctgacttcatcattgtcccaagcaggtttgagccgtgtggtctcattcagctgcacgcaatgagatatggaaccgtccctattgtggcatctactggtggacttgtggacactgtgaaagatggctacacaggtttccacattggaagattcaacgtcaagtgtgaagttgtggatccagatgatgtgatagcaacagcaaaggctgtgacaagagccgttgcagtatatggaacatccgcaatgcaagaaatggtcaagaactgcatggaccaagacttctcctggaagggacctgcgaggttgtgggagaaggtactattgtcccttaatgtggcgggaagtgaagccggaaccgagggtgaagagatagctcctctggccaaggagaacgtagcgacgccgtga

SEQ ID NO: 1798 - protein, 610 aa, Arabidopsis thaliana
MATVTASSNFVSRTSLFNNHGASSCSDVAQITLKGQSLTHCGLRSFNMVDNLQRRSQAKPVSAKSSKRSSKVKTAGKIVCEKGMSVIFIGAEVGPWSKTGGLGDVLGGLPPALAARGHRVMTICPRYDQYKDAWDTCVVVQIKVGDKVENVRFFHCYKRGVDRVFVDHPIFLAKVVGKTGSKIYGPITGVDYNDNQLRFSLLCQAALEAPQVLNLNSSKYFSGPYGEDVVFVANDWHTALLPCYLKSMYQSRGVYMNAKVVFCIHNIAYQGRFAFDDYSLLNLPISFKSSFDFMDGYEKPVKGRKINWMKAAILEAHRVLTVSPYYAQELISGVDRGVELHKYLRMKTVSGIINGMDVQEWNPSTDKYIDIKYDITTVTDAKPLIKEALQAAVGLPVDRDVPVIGFIGRLEEQKGSDILVEAISKFMGLNVQMVILGTGKKKMEAQILELEEKFPGKAVGVAKFNVPLAHMITAGADFIIVPSRFEPCGLIQLHAMRYGTVPIVASTGGLVDTVKDGYTGFHIGRFNVKCEVVDPDDVIATAKAVTRAVAVYGTSAMQEMVKNCMDQDFSWKGPARLWEKVLLSLNVAGSEAGTEGEEIAPLAKENVATP

SEQ ID NO: 1799 - DNA, 501 bp, Arabidopsis thaliana
atggaactggtgtctcttccgatccaccaccgtacggcgccgccgaattttccaccactcgaaactggaaatccagtagctaaccggattggacaagctctacgattcagcaatgttagaatgagaaagcccgcgtatttaggaacgatcttatctgagaaatcaagagcaagaacattaacgacggcggaagcagtttccggaagtggagtttcgcttccgccgctggatttgactgaggataatatccatttggtactatccgaagctcgtatcgagctagcacaactcttcgactcatcggttgggataacaggacaagtagagttagtggaactagacggaccattcgttacgataagtttaagaggcaagttttggcatacgcgtgcaatggttctagctcgacttgggaactacttaaaacagaggatccctgagattttggaggttaatattgaagatgaaaagcaactcgatgatagtcctgcaaatttctaa

SEQ ID NO: 1800 - protein, 166 aa, Arabidopsis thaliana
MELVSLPIHHRTAPPNFPPLETGNPVANRIGQALRFSNVRMRKPAYLGTILSEKSRARTLTTAEAVSGSGVSLPPLDLTEDNIHLVLSEARIELAQLFDSSVGITGQVELVELDGPFVTISLRGKFWHTRAMVLARLGNYLKQRIPEILEVNIEDEKQLDDSPANF

SEQ ID NO: 1801 - DNA, 477 bp, Arabidopsis thaliana
atgtctctgcaaaagtttaagcttctcgcaactcattgcagcaccgtcgcagagagtccgacacgtagtccagtcatccacctccgccgtcgtaaaacgctgcgtttgttactcactcgatcatcagaccgatggagattaccggagatccaaaacaacgtagatgaatcgaagaaaacggataagagaggtaagatccgatctagccggaagcttggagatctttttgtttcgtcgccaccgtttgaggaaagtggcggtggcggcggcggagataaggggacgaagatggaggtggagatggagagggatgtaccggttaacggcgttagtaataacgcaggttttggagaagagataacggctcggcgtgtgggctttaacgggtctgttaggcccatgtcatctgttacacttcgatgtagattacttagacgatcttggcgtcctgtacttgtaactattcctgaacaataa

SEQ ID NO: 1802 - protein, 158 aa, Arabidopsis thaliana
MSLQKFKLLATHCSTVAESPTRSPVIHLRRRKTLRLLLTRSSDRWRLPEIQNNVDESKKTDKRGKIRSSRKLGDLFVSSPPFEESGGGGGGDKGTKMEVEMERDVPVNGVSNNAGFGEEITARRVGFNGSVRPMSSVTLRCRLLRRSWRPVLVTIPEQ

SEQ ID NO: 1803 - DNA, 597 bp, Arabidopsis thaliana
atggctgtcgtcggcgctccaatatcgtctccggcggctcagctgcagacacaatttctctccaatcccattctcccccgctttcgccggtctttctccaccggaaaatcaccagcaactttctccgtcgtagctatggctccccagaaaaaggtgaacaaatatgatgccaagtggaagaaacaatggtacggagctggattgtttttcgaagggagtgagcaaataaacgttgatgttttcaagaagctggagaagcgaaaagtgttgagcaacgttgagaaatctggcctgctgtcaaaagcagaggggttgggactcacattgtcatctcttgagaagcttaaagtcttctccaaagcagaggaccttggtcttctcagtctccttgagaacttagctggaacatcgcctgcggtcttagcctcggctgcattaccagctctcacggctgctattgtagccgtggtgttgatcccggatgactcaactactctagtggttgctcaggcggttttggccggtgctcttgcgcttacaggggttgttttgttggttggttctgttgttttggatggacttcaagaagctgactga

SEQ ID NO: 1804 - protein, 198 aa, Arabidopsis thaliana
MAVVGAPISSPAAQLQTQFLSNPILPRFRRSFSTGKSPATFSVVAMAPQKKVNKYDAKWKKQWYGAGLFFEGSEQINVDVFKKLEKRKVLSNVEKSGLLSKAEGLGLTLSSLEKLKVFSKAEDLGLLSLLENLAGTSPAVLASAALPALTAAIVAVVLIPDDSTTLVVAQAVLAGALALTGVVLLVGSVVLDGLQEAD

SEQ ID NO: 1805 - DNA, 627 bp, Arabidopsis thaliana
atggcgtcgattacgaacctcgcctcttctctctcttcactctcgttctcctcccaagtttctcaaagacctaacaccatttccttcccccgcgcgaattcagtattcgcattaccggcgaaatccgcacgccgcgcttctctatctatcaccgccacggtatctgctccaccggaggaggaggagatagttgaactgaagaaatacgtcaaatcgaggcttcccggaggatttgctgctcagaagattattggcactggacgacgtaagtgcgcaatcgctagagttgttcttcaggaaggtactgggaaggttatcatcaactatcgtgatgccaaggagtaccttcagggaaatccattgtggcttcagtatgttaaagtaccattggtgactttaggatatgagaatagctacgacatatttgtgaaagcccatggaggcggtctctcaggtcaagctcaagcaattaccttgggagtcgcacgtgcactcctgaaggtaagtgcagaccacagatcgcctttgaagaaggaaggtttgctcactagagatgcgagagtggttgaaagaaagaaggccgggctcaagaaggcgcgtaaagccccacaattctccaagcgttaa

SEQ ID NO: 1806 - protein, 208 aa, Arabidopsis thaliana
MASITNLASSLSSLSFSSQVSQRPNTISFPRANSVFALPAKSARRASLSITATVSAPPEEEEIVELKKYVKSRLPGGFAAQKIIGTGRRKCAIARVVLQEGTGKVIINYRDAKEYLQGNPLWLQYVKVPLVTLGYENSYDIFVKAHGGGLSGQAQAITLGVARALLKVSADHRSPLKKEGLLTRDARVVERKKAGLKKARKAPQFSKR

SEQ ID NO: 1807 - DNA, 2154 bp, Arabidopsis thaliana
atggatcaaatcgaagcaatgttgtgcggcggaggagagaagacaaaagtggcggttactacgaagactttggcagatccattgaattggggtttagcagcggatcaaatgaaaggaagtcatttagatgaagtgaagaagatggtcgaagagtatcgtagaccagtcgtgaatcttggcggagaaacactgacgatcggacaagttgctgccatctccaccgtaggaggcagcgttaaggttgagttagcggagacttcaagagccggtgtgaaagctagcagtgattgggttatggagagcatgaacaaaggtactgacagttacggagtcaccaccggctttggtgctacttctcaccggagaaccaaaaacggcaccgcattacaaacagaactcattagatttttgaacgccggaatattcggaaacacgaaggagacatgtcacacactgccgcaatccgccacaagagccgccatgctcgtcagagtcaacactcttctccaaggatactccgggatccgattcgagatcctcgaagcgattacaagtctcctcaaccacaacatctctccgtcactacctctccgtggaaccattaccgcctccggcgatctcgttcctctctcttacatcgccggacttctcaccggccgtcctaattccaaagccaccggtcccgacggtgaatcgctaaccgcgaaagaagcttttgagaaagccggaatcagtactggattcttcgatttacaacctaaggaaggtttagctctcgttaatggcacggcggttggatctggaatggcgtcgatggttctattcgaagcgaatgtccaagcggtgttagcggaggttttatcagcgatcttcgcggaggttatgagcgggaaacctgagtttaccgatcatctgactcatcgtttaaaacatcatcccggacaaatcgaagcggcggcgataatggagcacatactcgacggaagctcatacatgaaattagctcaaaaggttcacgagatggatccattgcagaaaccaaaacaagatcgttacgctcttcgtacatctcctcaatggctaggtcctcaaattgaagtaatccgtcaagctacgaaatcgatagagcgtgaaatcaactccgttaacgataatccgttgatcgatgtttcgaggaacaaggcgattcacggtggtaacttccaaggaacaccaatcggagtttctatggataacacgagattggcgattgctgcgattgggaagctaatgtttgctcaattctctgagcttgttaatgatttctacaacaatggacttccttcgaatctaactgcttcgagtaatccaagtttggattatggattcaaaggagcagagattgctatggcttcttattgttctgagcttcaatacttggctaatccagtcacaagccatgttcaatcagctgagcaacataatcaagatgtgaactctcttggtttgatctcgtctcgtaaaacatctgaagctgtggatattcttaagctaatgtcaacaacgttccttgtggggatatgtcaagctgttgatttgagacatttggaggagaatctgagacaaactgtgaagaacacagtttctcaagttgctaagaaagtgttaaccactggaatcaacggtgagttacatccgtcaaggttttgcgagaaggacttgcttaaggttgttgatcgtgagcaagtgttcacgtatgtggatgatccttgtagcgctacgtacccgttgatgcagagactaagacaagttattgttgatcacgctttgtccaacggtgagactgagaagaatgcagtgacttcgatctttcaaaagattggagcttttgaagaggagcttaaggctgtgcttccaaaggaagttgaagcggctagagcggcttatgggaatggaactgcgccgattcctaaccggattaaggaatgtaggtcgtatccgttgtataggttcgtgagggaagagcttggaacgaagttgttgactggagaaaaggttgtgtctccgggagaggagtttgataaggtcttcactgctatgtgtgaaggtaaacttattgatccgttgatggattgtctcaaggaatggaacggagctccgattccgatttgctaa

SEQ ID NO: 1808 - protein, 717 aa, Arabidopsis thaliana
MDQIEAMLCGGGEKTKVAVTTKTLADPLNWGLAADQMKGSHLDEVKKMVEEYRRPVVNLGGETLTIGQVAAISTVGGSVKVELAETSRAGVKASSDWVMESMNKGTDSYGVTTGFGATSHRRTKNGTALQTELIRFLNAGIFGNTKETCHTLPQSATRAAMLVRVNTLLQGYSGIRFEILEAITSLLNHNISPSLPLRGTITASGDLVPLSYIAGLLTGRPNSKATGPDGESLTAKEAFEKAGISTGFFDLQPKEGLALVNGTAVGSGMASMVLFEANVQAVLAEVLSAIFAEVMSGKPEFTDHLTHRLKHHPGQIEAAAIMEHILDGSSYMKLAQKVHEMDPLQKPKQDRYALRTSPQWLGPQIEVIRQATKSIEREINSVNDNPLIDVSRNKAIHGGNFQGTPIGVSMDNTRLAIAAIGKLMFAQFSELVNDFYNNGLPSNLTASSNPSLDYGFKGAEIAMASYCSELQYLANPVTSHVQSAEQHNQDVNSLGLISSRKTSEAVDILKLMSTTFLVGICQAVDLRHLEENLRQTVKNTVSQVAKKVLTTGINGELHPSRFCEKDLLKVVDREQVFTYVDDPCSATYPLMQRLRQVIVDHALSNGETEKNAVTSIFQKIGAFEEELKAVLPKEVEAARAAYGNGTAPIPNRIKECRSYPLYRFVREELGTKLLTGEKVVSPGEEFDKVFTAMCEGKLIDPLMDCLKEWNGAPIPIC

SEQ ID NO: 1809 - DNA, 1029 bp, Arabidopsis thaliana
atgatcaaaggaaacaatggaaacagaggatcttcttcttctggttactctgcagatttgttggtttgtttcccttcaagaacccacttagctctgactcctaagcccatttgtagcccatctcgtccctcagactcttccactaaccgtcgtcctcaccaccgtcgccagctcagtaaactctccggcggcggtggaggaggacacggtagtcctgttttgtgggctaaacaagcaagtagtaagaatatgggaggtgacgaaatagcagaaccaacttctcctaaagtaacttgcgcaggtcagatcaaagtccggccaagtaaatgcggagggagaggaaagaactggcaatcggtgatggaagagattgagaggatacatgataatagatcgcaaagcaagttttttgggttgaagaaagatgtgatgggtttcttgacttgtcttagaaacatcaaattcgatttcaggtgttttggtgatttccgacatgctgatgtcactagcgacgacgatgaggaagaagatgatgatgatgatgaggaagaagaggtagtggaaggagaagaagaagagaattcaaagactgttttctctaaatggtttatggttttacaagaggaacagaacaacaaagatgacgacaagaacaacaacaagtgtgatgagaaacgcgatcttgaagacacagagacagaaccagcggttccgccgccaaacgcgcttttgttgatgcggtgtagatcagctccagcgaagagttggttagaagagagaatgaaagtaaaaacagagcaagaaaagagagaagaacaaaaagaggaaaaagaaacagaggatcaagaaacgagtatgaagacaaagaagaaggatttgagatcattaatggaagaagagaagatggaattggtgttgatgagatacgatactgagttttacagactctcttcagacatagctaaggaaacttgggttgtcggaggaattcaagatcctctgtctcggagtcgaagctggaaaaattga

SEQ ID NO: 1810 - protein, 342 aa, Arabidopsis thaliana
MIKGNNGNRGSSSSGYSADLLVCFPSRTHLALTPKPICSPSRPSDSSTNRRPHHRRQLSKLSGGGGGGHGSPVLWAKQASSKNMGGDEIAEPTSPKVTCAGQIKVRPSKCGGRGKNWQSVMEEIERIHDNRSQSKFFGLKKDVMGFLTCLRNIKFDFRCFGDFRHADVTSDDDEEEDDDDDEEEEVVEGEEEENSKTVFSKWFMVLQEEQNNKDDDKNNNKCDEKRDLEDTETEPAVPPPNALLLMRCRSAPAKSWLEERMKVKTEQEKREEQKEEKETEDQETSMKTKKKDLRSLMEEEKMELVLMRYDTEFYRLSSDIAKETWVVGGIQDPLSRSRSWKN

SEQ ID NO: 1811 - DNA, 624 bp, Arabidopsis thaliana
atgacagggttctctgtgtctctttttgtgtcaaacttgtcaaatgtggcctcgtatttgtcgcccatcttcgagaacatcccctccaccaaggttgttcccgcacagatcgagaaagttgtctctttggtctctcgtaccggtcgcgatttgcagcgttacgatcacgctggctatcgtcaagtcgtcggatgtgtaccgtatagatacaagaaacaagaagtcaatggagttgaaacccaagtaatccaagttcttcttgtcagtgctcaaaagggcaaaggaatgttatttccaaaaggaggttgggagacggatgaatcaatggaggaagctgctttgagagagacgatcgaagaagcgggtgtaacaggagagctcgaagaaaagcttgggaaatggcaatacaaaagcaaaagacatagcataattcacgatgggtatatgtttgctttgcttgtcagtcaagagttcgagcgatggcctgaggcggaaatgagacaacgcagatgggtaagtttggatgaagcaagagaagtatgtcagaattggtggatgagagaagctcttgaagcattcattaacctgaaatgtctagctgacgatgatgaaagtgggaactga

SEQ ID NO: 1812 - protein, 207 aa, Arabidopsis thaliana
MTGFSVSLFVSNLSNVASYLSPIFENIPSTKVVPAQIEKVVSLVSRTGRDLQRYDHAGYRQVVGCVPYRYKKQEVNGVETQVIQVLLVSAQKGKGMLFPKGGWETDESMEEAALRETIEEAGVTGELEEKLGKWQYKSKRHSIIHDGYMFALLVSQEFERWPEAEMRQRRWVSLDEAREVCQNWWMREALEAFINLKCLADDDESGN

SEQ ID NO: 1813 - DNA, 1485 bp, Arabidopsis thaliana
atgtctgcctgtttgtgtcttgttttcctgttcttctctattgttgcagaagcaacgtattctccaggaggtttccaccatctttcttctctaagactaaagaagaaggtgtccaagtcaaaacatgagttaccttttgaaactcgttacttccctcaaaatcttgaccacttcagtttcacaccagacagctacaaagtcttccaccagaagtacctcatcaacaaccgtttctggcgaaaaggtggtcccatctttgtttacactggaaatgaaggagacatcgactggtttgcttccaacaccggtttcatgctggatattgctcccaagttccgggctcttcttgttttcattgaacaccggttctatggagaatcaacgccatttgggaagaagtcgcataagtcagctgagacattgggttacctaaactctcagcaagcgttggctgattatgcaatcctgataagaagcttgaagcagaatctatcgtctgaggcatcgcctgtggttgtctttggtggctcttatggtggaatgcttgcagcgtggttcagactcaagtatccccacataacaatcggtgcattggcatcctccgctccaatacttcatttcgataacattgtaccattgacaagcttctatgatgccatttctcaggattttaaggatgcaagtattaattgtttcaaagtcatcaagagaagctgggaagagctagaggcagtttcaactatgaaaaatggcttgcaagaactcagcaaaaagttccgaacttgcaagggccttcattctcaatattcagccagagattggttaagtggagcatttgtttatacagccatggttaattatccaactgcagctaatttcatggcgccactgcctggttatcccgtagagcagatgtgcaagatcatcgacgggttccctcgaggatccagtaatcttgaccgtgcctttgctgctgcaagcttatactacaactattcgggatcagaaaaatgcttcgagatggaacaacaaactgatgatcatggacttgatggttggcaatatcaggcgtgtacagagatggtgatgccaatgagctgctcgaaccagagcatgctccctccgtacgaaaatgactctgaggcattccaagaacaatgcatgactagatacggagtcaagcctcgaccccattggatcaccacagaatttggtggaatgaggatagagacagtactgaagagatttggaagcaacatcatattctccaatggaatgcaggacccttggagccgtggaggggttctgaagaacatttcaagtagcatcgttgcgcttgtgaccaagaaaggagctcaccatgcagatctcagggctgctacaaaagatgacccagagtggctgaaagagcagaggaggcaagaggttgccattatagagaaatggatcagtgagtattacagagatttaagagaagagcaatag

SEQ ID NO: 1814 - protein, 494 aa, Arabidopsis thaliana
MSACLCLVFLFFSIVAEATYSPGGFHHLSSLRLKKKVSKSKHELPFETRYFPQNLDHFSFTPDSYKVFHQKYLINNRFWRKGGPIFVYTGNEGDIDWFASNTGFMLDIAPKFRALLVFIEHRFYGESTPFGKKSHKSAETLGYLNSQQALADYAILIRSLKQNLSSEASPVVVFGGSYGGMLAAWFRLKYPHITIGALASSAPILHFDNIVPLTSFYDAISQDFKDASINCFKVIKRSWEELEAVSTMKNGLQELSKKFRTCKGLHSQYSARDWLSGAFVYTAMVNYPTAANFMAPLPGYPVEQMCKIIDGFPRGSSNLDRAFAAASLYYNYSGSEKCFEMEQQTDDHGLDGWQYQACTEMVMPMSCSNQSMLPPYENDSEAFQEQCMTRYGVKPRPHWITTEFGGMRIETVLKRFGSNIIFSNGMQDPWSRGGVLKNISSSIVALVTKKGAHHADLRAATKDDPEWLKEQRRQEVAIIEKWISEYYRDLREEQ

SEQ ID NO: 1815 - DNA, 258 bp, Arabidopsis thaliana
atggttttgaagttgtaccaagactggagattttggatgctcctttcacgagttcttgaaggtcaaagagagcgtgaccgtgaaagggctctagctcgaaccggaggcaaaggaaagaacaaagatgatggattaactcctgagcaacgtcgtgaaagagatgcaaaagcattgcaagagaagactgcaaagaaagctgctcaagccgctgctgcagctagttccggaggaggaggaggcaaaggaaacaataagtga

SEQ ID NO: 1816 - protein, 85 aa, Arabidopsis thaliana
MVLKLYQDWRFWMLLSRVLEGQRERDRERALARTGGKGKNKDDGLTPEQRRERDAKALQEKTAKKAAQAAAAASSGGGGGKGNNK

SEQ ID NO: 1817 - DNA, 1026 bp, Arabidopsis thaliana
atgccacgccctttcttccataagttgattttctcatccactatccaagaaaaacgtctgagggtcccagataagtttgtgagtaaattcaaggatgagctttcggttgctgttgcactcacagtacctgatggtcatgtttggcgtgtaggactaaggaaagctgacaacaaaatttggtttcaagatggttggcaagagtttgttgaccgttactccattcgcattggttatcttttgatttttagatatgaaggaaactctgccttcagcgtctacattttcaatttatcccactctgagatcaattaccattccaccggtctcatggattccgctcacaaccacttcaaacgcgcccgtttgtttgaagaccttgaagatgaagatgccgaggtcatctttccttcttctgtgtacccatcaccacttcctgagtctacagtaccagccaacaaagggtatgctagttcagccatccaaaccttgttcactggaccagttaaagctgaagagccaacgccaaccccaaaaatacctaaaaagagagggaggaagaagaaaaatgctgatcctgaggaaataaactcatcagctccgcgagatgatgatccagagaaccgttcaaagttctacgagagtgcttctgcgagaaagagaaccgtgactgcagaagaaagagagagagccatcaatgcagccaaaacgttcgaaccaacaaaccctttcttcagagtggttctgcgaccatcctatctatacagaggttgcatcatgtatcttccttctgggtttgctgagaagtacctaagtgggatctccgggttcatcaaagtccagcttgcggagaaacaatggcctgttcgatgtctctacaaagccgggagagccaaattcagtcaaggatggtacgaattcactctagagaacaacttaggagaaggagacgtctgtgtgtttgagctgctcagaaccagagatttcgttttgaaagtgacagcctttcgagtcaacgagtacgtctga

SEQ ID NO: 1818 - protein, 341 aa, Arabidopsis thaliana
MPRPFFHKLIFSSTIQEKRLRVPDKFVSKFKDELSVAVALTVPDGHVWRVGLRKADNKIWFQDGWQEFVDRYSIRIGYLLIFRYEGNSAFSVYIFNLSHSEINYHSTGLMDSAHNHFKRARLFEDLEDEDAEVIFPSSVYPSPLPESTVPANKGYASSAIQTLFTGPVKAEEPTPTPKIPKKRGRKKKNADPEEINSSAPRDDDPENRSKFYESASARKRTVTAEERERAINAAKTFEPTNPFFRVVLRPSYLYRGCIMYLPSGFAEKYLSGISGFIKVQLAEKQWPVRCLYKAGRAKFSQGWYEFTLENNLGEGDVCVFELLRTRDFVLKVTAFRVNEYV

SEQ ID NO: 1819 - DNA, 468 bp, Arabidopsis thaliana
atggctcgatctttatctccttcactttctctctctcgataccgtttcgccgcagcttctcttcttctcccttcatctcaaaccattttcatccgatctcaatcctccaatcgtcggtctaactctaaccatctcggagtaatctacgagattgatatcgctgcggatcctcttgtcaataagttggaagatgctgtccaccggattatggtacgccgatccgcacctgattggctcccttttgtccccggtgcttccttttgggttccacctcctagatcccagtctcatgggatcgctaagctcgttgagaagctggccaatccgatctctgatgaagaatctatttcaatctcatcggttcgaggatggccttgctctgattacttcatcaaaggtgtaaagcctcaatcagttgagacggagatgacttcaaatactgcatatcactccgaggacgaggaataa

SEQ ID NO: 1820 - protein, 155 aa, Arabidopsis thaliana
MARSLSPSLSLSRYRFAAASLLLPSSQTIFIRSQSSNRRSNSNHLGVIYEIDIAADPLVNKLEDAVHRIMVRRSAPDWLPFVPGASFWVPPPRSQSHGIAKLVEKLANPISDEESISISSVRGWPCSDYFIKGVKPQSVETEMTSNTAYHSEDEE

SEQ ID NO: 1821 - DNA, 630 bp, Arabidopsis thaliana
atggagataacaatatcccaattgtgctctcgagttaagttttcatcatcatcatcatcatcatcacttttctgtttctatggaaacagtaatagaaacaacctaaatggagctgtttcagtaaactgcttgagagagaatgagcagatcagtaatattagcttcattgcgaagaaaccaagaagtcatgcaccggtggtgagaacaacacgcgcctccttggatgagaatcaatccccaacttccggaggagaacggtggcttctcaaaccagttggcgatggagacacaagacacattggttacaaagtggcaatgcctgctccttttgagatctcctctggccaagttaccatcggacggctaccggaaaaggctgacgtcgtgattcctgttgccaccgtgtcaggagtccatgcgacaatcaatacgaatgaaaagaaccttcttgtgacggatatgaacagcaccaacggtacattcatcgaagacaaacgtctaattcctggtgttgctgctcctgcctttcccggaacacgaatcacctttggagatacaaatctagcaattttccgtgttttcaagctccaagatagtgaagaatccatagagaaaccaactacagagtaa

SEQ ID NO: 1822 - protein, 209 aa, Arabidopsis thaliana
MEITISQLCSRVKFSSSSSSSSLFCFYGNSNRNNLNGAVSVNCLRENEQISNISFIAKKPRSHAPVVRTTRASLDENQSPTSGGERWLLKPVGDGDTRHIGYKVAMPAPFEISSGQVTIGRLPEKADVVIPVATVSGVHATINTNEKNLLVTDMNSTNGTFIEDKRLIPGVAAPAFPGTRITFGDTNLAIFRVFKLQDSEESIEKPTTE

SEQ ID NO: 1823 - DNA, 504 bp, Arabidopsis thaliana
atggcctcagtaacctcagccaccgttgcaatcccatctttcaccggccttaaagcctcaaccatcaaatcatccgccaccgtcagaatccaaactgctgctgttgcatcaccgaagcttacagtgaagtcatctctaaagaacttcggagtcgcggccgtagcggctgcagcttcaattgctttggccggaaacgccatggcaatagaagttctcttgggaggaggggatgggtcgttagcttttattcccaacgacttctctatagctaaaggagagaagattgtgttcaagaacaacgctggatacccacacaatgttgtcttcgatgaagacgagatcccaagtggcgtcgacgtggccaagatctcgatggacgagcaagatctactcaacggtgcgggagagacgtacgaggttgctttgaccgagccagggacttacagcttctactgtgcgccacatcagggtgctggtatggtcggtaaagtcaccgttaactaa

SEQ ID NO: 1824 - protein, 167 aa, Arabidopsis thaliana
MASVTSATVAIPSFTGLKASTIKSSATVRIQTAAVASPKLTVKSSLKNFGVAAVAAAASIALAGNAMAIEVLLGGGDGSLAFIPNDFSIAKGEKIVFKNNAGYPHNVVFDEDEIPSGVDVAKISMDEQDLLNGAGETYEVALTEPGTYSFYCAPHQGAGMVGKVTVN

SEQ ID NO: 1825 - DNA, 1374 bp, Arabidopsis thaliana
atgagtgaagcaaagaagggtcacgtactgttttttccatatccattacaaggccacattaacccaatgatccaactcgctaaacgcttatccaaaaagggcatcaccagcacactcatcatcgcctccaaagaccaccgtgaaccttacacctccgacgactactccatcaccgtccacaccatccacgacggtttctttccacatgaacaccctcacgccaagttcgtagatcttgaccgtttccacaactctacttctcgaagcctgaccgatttcatctctagtgcgaagttgtcggacaatcctccaaaagctctgatctatgatccatttatgccctttgcattggacatagccaaggacttggatctatacgtagtggcatatttcactcaaccatggttggctagtcttgtttactaccatatcaacgaaggcacctacgatgttcccgttgatagacacgagaacccaacacttgcatcgtttcctggtttcccattgttaagccaagatgatctgccttcgttcgcctgcgaaaaagggtcgtaccctcttctacacgagtttgtggttaggcaattctctaatttattgcaagctgattgcattctctgcaacacttttgatcaacttgaaccaaaggtagtgaaatggatgaatgatcaatggccggtgaagaacattggaccggtggttccatcgaagttcttggataaccggttgccagaagacaaagattacgaactcgagaactccaagacagagccagacgagtctgttttgaagtggttgggaaacaggccggcgaagtcggtggtttacgtggcgtttgggacattggtggctttgagcgaaaaacagatgaaggaaattgcaatggcgattagccaaaccggatatcacttcttgtggtctgttagagaatccgagagaagcaaactaccctctggttttatcgaagaggcagaggagaaagactctggacttgtggctaagtgggttcctcagctagaggttttagcacatgaatcaatcgggtgtttcgtgtcacactgtggatggaactcgacattggaggcactatgcttaggggttccaatggtgggcgtgcctcagtggactgatcagcccacaaatgctaagtttatagaggatgtgtggaagattggggttagagtgaggaccgatggagaagggctttcgagtaaagaagagattgcgagatgcattgttgaggtcatggaaggagagagagggaaagagataaggaagaatgttgagaagcttaaggtgttggctcgcgaagctatctctgaaggaggtagttccgacaagaagattgatgagtttgttgctcttttgacttaa

SEQ ID NO: 1826 - protein, 457 aa, Arabidopsis thaliana
MSEAKKGHVLFFPYPLQGHINPMIQLAKRLSKKGITSTLIIASKDHREPYTSDDYSITVHTIHDGFFPHEHPHAKFVDLDRFHNSTSRSLTDFISSAKLSDNPPKALIYDPFMPFALDIAKDLDLYVVAYFTQPWLASLVYYHINEGTYDVPVDRHENPTLASFPGFPLLSQDDLPSFACEKGSYPLLHEFVVRQFSNLLQADCILCNTFDQLEPKVVKWMNDQWPVKNIGPVVPSKFLDNRLPEDKDYELENSKTEPDESVLKWLGNRPAKSVVYVAFGTLVALSEKQMKEIAMAISQTGYHFLWSVRESERSKLPSGFIEEAEEKDSGLVAKWVPQLEVLAHESIGCFVSHCGWNSTLEALCLGVPMVGVPQWTDQPTNAKFIEDVWKIGVRVRTDGEGLSSKEEIARCIVEVMEGERGKEIRKNVEKLKVLAREAISEGGSSDKKIDEFVALLT

SEQ ID NO: 1827 - DNA, 753 bp, Arabidopsis thaliana
atgaagcattctcacgttttgcttcttctatttgttcaagtcattgtccttttgcctctcctttgtctatccgacgattttgttaactctagagctacttattatggcagccccgattgcaaagcaaatcctcggggacattgtgggtatggagaatttggaagagatatcaataacggtgaagtgagtggtgtttcatggcgactatggaacaatggaactggctgtggtgcttgttaccaggtgaggtgcaagataccaccacactgcagtgaggaaggagtatacgtagtggctacggactccggagaaggagatggcacggacttcatcttaagccctaaggcgtacggacgtatggcgcgacccggcacagaaaatcagctctactccttcggtgtagtcaacgttgagtaccaaaggatcccttgccgatacgcagggtataatctggtgtataagatccatgagaaaagctacaatcctcattatcttgccatccttgtcttgtacgttggtggtgttaatgacatcctcgccgttgaagtctggcaggaggattgcaaagagtggagacgtatgagaagagtgtttggagcggttcatgatttgcagaatccacctagaggcactctcacattgaggttcttagtctacggaagcgcaggaatcaattggatccaatcgccaaacgctattcccgctgattggactgccggagccacctacgactccaacattctacttacttaa

SEQ ID NO: 1828 - protein, 250 aa, Arabidopsis thaliana
MKHSHVLLLLFVQVIVLLPLLCLSDDFVNSRATYYGSPDCKANPRGHCGYGEFGRDINNGEVSGVSWRLWNNGTGCGACYQVRCKIPPHCSEEGVYVVATDSGEGDGTDFILSPKAYGRMARPGTENQLYSFGVVNVEYQRIPCRYAGYNLVYKIHEKSYNPHYLAILVLYVGGVNDILAVEVWQEDCKEWRRMRRVFGAVHDLQNPPRGTLTLRFLVYGSAGINWIQSPNAIPADWTAGATYDSNILLT

SEQ ID NO: 1829 - DNA, 1359 bp, Arabidopsis thaliana
atggataccctccgattcgagttaagctcagcttccttcacttccgccgtcaccgcctcttctttacacagtcactcacggtatttcttctcctcagtgcaactcggccgagtcggctcatcatctccggcgatcacatcggtctcgaggacgacagtgaatgaaatctgcacggcggatgaacttcactacgttcctgttcccaactccgattggcgcgtcgctctctggcgatatcttccttccccaaaggcaccgaagaggaaccatcctttgcttctattgtctgggattgggaccaatgctgttacatacgatctttcccctgagtgttcctttgcaagatccatgtctggatcaggatttgatacatggattcttgagctccgtggagccgggctgagttctctcagtgttgatacaaatcttggtaaaggcaataaccagcagcggatagtctcgaatctattggagaatttcataagtgtatctgaaaggctggaaaatgttcttgatggaggttccaagatccttgggatgcaagaccgtctatcgaagagagcgggagatttcaagcagcggtttgaacttatccctcattacaattgggattttgataactatctagaagaagatgttccttctgcgatggactatgtaaggactcaaaccaagtcaaaagatggaaagttgctagcagttggtcactcaatgggtggtatcttgttatatgccttgctctcaagatgtggctttaaaggaatggattcaggtttggctggtgtcaccactctcgcatcaacatttgactattcatcctcaggaacactcctcaagtacctattaccaatgaaagagcctgcacaagctattaaccttcctatcatgccaattgacacaatgctcgctatggctcaccctctaatgtgtcgtcctccatattctttgtcctggttaaccgctaatatctctgctcctcaaatgatggaccctgaagttattgagaagcttgttttgaacagcttatgcacagtaccagtcaagcttctcttgcagctaacaacagccgtggaccacggtgggttgcgtgacagaaccggtactttctgttacaaggatcatatcagcaaaacaaatgtgcctatcttagctcttgcaggggactgggacataatctgccctcccgatgcagtatacgatactgtaaagctgattccagaacatctagccacttacaaagttgtaggatcacccggaggtccacattatggccaccaggatctaatttcgggtcgaacggctcggaacgaagtatatcctctgattactagatttcttcaacaacaagatgagagttaa

SEQ ID NO: 1830 - protein, 452 aa, Arabidopsis thaliana
MDTLRFELSSASFTSAVTASSLHSHSRYFFSSVQLGRVGSSSPAITSVSRTTVNEICTADELHYVPVPNSDWRVALWRYLPSPKAPKRNHPLLLLSGIGTNAVTYDLSPECSFARSMSGSGFDTWILELRGAGLSSLSVDTNLGKGNNQQRIVSNLLENFISVSERLENVLDGGSKILGMQDRLSKRAGDFKQRFELIPHYNWDFDNYLEEDVPSAMDYVRTQTKSKDGKLLAVGHSMGGILLYALLSRCGFKGMDSGLAGVTTLASTFDYSSSGTLLKYLLPMKEPAQAINLPIMPIDTMLAMAHPLMCRPPYSLSWLTANISAPQMMDPEVIEKLVLNSLCTVPVKLLLQLTTAVDHGGLRDRTGTFCYKDHISKTNVPILALAGDWDIICPPDAVYDTVKLIPEHLATYKVVGSPGGPHYGHQDLISGRTARNEVYPLITRFLQQQDES

SEQ ID NO: 1831 - DNA, 1014 bp, Arabidopsis thaliana
atggcgaaggaagcggtcaagtatgtatgggaaggagcaattcctctgcagattcatctccacaaatccgacgtcgcttctcaccctgctcctcctcctgctcttgtgttagcaccaagaataggatatttgcctctgttgattcctcttataaagccttatttcaaggattcacttcctcctggtgaagattcaatttggtttgattacaaaggatttcctctaaaatggtatataccaacaggtgttcttttcgatctcctttgtgcagaacccgaaagaccatggaatctcacgatacactttagaggatatccttgcaacatactgataccatgtgaaggagaagattctgtaaaatggaactttgttaattctttgaaagaggcacaatatatcatcaatggaaattgcaagaatgttatgaacatgtctcagagtgatcaagaggatctatggacctctgtcatgaacggtgatcttgatgcctatacaagattatcacccaagcttaaaatgggaacagtcgaagatgagttttcaaggaaaacaagtttgtcatctccacaatctcaacaagttgtgcctgagacggaggtggctggacaagttaagacagcaagaattcctgttcggttgtatgttcgaagtctaaataaagatttcgagaatcttgaagatgtaccggagatcgatacctgggatgacatctcgtaccttaatcgccctgttgagttcctcaaagaagaagggaaatgctttacgttacgtgacgccattaaaagtctcctccctgagtttatgggagacagagcgcaaacgagtggtgaagaaagaagcatagatgatacagaagaagcagatgggtcgagggagatgggtgaaatcaaattggtaaggatacaagggatagaaatgaagctagagataccgttttcgtgggtggtaaataacttgatgaacccagaattctatctccatatctctgtccttgtgaaagctcctcaaaggtga

SEQ ID NO: 1832 - protein, 337 aa, Arabidopsis thaliana
MAKEAVKYVWEGAIPLQIHLHKSDVASHPAPPPALVLAPRIGYLPLLIPLIKPYFKDSLPPGEDSIWFDYKGFPLKWYIPTGVLFDLLCAEPERPWNLTIHFRGYPCNILIPCEGEDSVKWNFVNSLKEAQYIINGNCKNVMNMSQSDQEDLWTSVMNGDLDAYTRLSPKLKMGTVEDEFSRKTSLSSPQSQQVVPETEVAGQVKTARIPVRLYVRSLNKDFENLEDVPEIDTWDDISYLNRPVEFLKEEGKCFTLRDAIKSLLPEFMGDRAQTSGEERSIDDTEEADGSREMGEIKLVRIQGIEMKLEIPFSWVVNNLMNPEFYLHISVLVKAPQR

SEQ ID NO: 1833 - DNA, 1206 bp, Arabidopsis thaliana
atggctctccaagctgcctattctcttcttccttctaccatttcaatccaaaaagagggcaaattcaatgcttctctaaaggagacgacttttactggttcttcattttcaaaccatcttagagctgaaaagatatccaccctgttgaccatcaaggaacagagaagacagaaaccgcgattttccaccggtattcgtgcacagacagttacagccacgccgccggcaaacgaagcatcgccggagcaaaagaagactgagagaaaaggcactgcagtgatcactggagcttcgtctggtttaggtttagctacggccaaagctttagcagacacagggaaatggcatgtgatcatggcttgcaggaactttctcaaggccgagaaggcagcgagatctgttggaatgtccaaggaagattacacagtgatgcatcttgatcttgcttcgcttgaaagcgtgaagcaattcgttgaaaatttccggagaacagaacaaccactcgatgttcttgtctgcaatgccgcggtttaccaaccaactgctaaagagccttcttttacagctgaaggctttgagataagcgttggaaccaaccatctcggtcactttcttctctcaagattgcttcttgatgacctgaaaaaatctgattatccatcaaaacgtatgatcatcgtaggatctataacaggaaacacaaatactttggctgggaatgtaccgccaaaggcaaaccttggagacctaagaggcttagcgtcaggattgaatgggcaaaacagttcaatgatagatggaggagagtttgatggagcaaaggcttacaaagacagcaaagtatgcaatatgctgacaatgcaggagcttcacagacgttaccacgaggaaacaggagtcacgtttgcttctctttaccctggttgcatcgctacaacagggttgttcagagaacacataccgctgtttcggcttctttttccgccttttcaaaagtatatcaccaaaggttacgtatctgaagaggaagctggcaaaagactagcacaggttgtgagtgaccctagtcttgggaagtcaggagtgtattggagttggaacaataactcgtcttcgtttgagaatcagctttctaaagaagcaagtgatgcggagaaggcaaagaaactgtgggaggttagcgagaagcttgttggtttggcatga

SEQ ID NO: 1834 - protein, 401 aa, Arabidopsis thaliana
MALQAAYSLLPSTISIQKEGKFNASLKETTFTGSSFSNHLRAEKISTLLTIKEQRRQKPRFSTGIRAQTVTATPPANEASPEQKKTERKGTAVITGASSGLGLATAKALADTGKWHVIMACRNFLKAEKAARSVGMSKEDYTVMHLDLASLESVKQFVENFRRTEQPLDVLVCNAAVYQPTAKEPSFTAEGFEISVGTNHLGHFLLSRLLLDDLKKSDYPSKRMIIVGSITGNTNTLAGNVPPKANLGDLRGLASGLNGQNSSMIDGGEFDGAKAYKDSKVCNMLTMQELHRRYHEETGVTFASLYPGCIATTGLFREHIPLFRLLFPPFQKYITKGYVSEEEAGKRLAQVVSDPSLGKSGVYWSWNNNSSSFENQLSKEASDAEKAKKLWEVSEKLVGLA

SEQ ID NO: 1835 - DNA, 822 bp, Arabidopsis thaliana
atggccctcgaagcgatgaacactccaacttcttctttcaccagaatcgaaacgaaagaagatttgatgaacgacgccgttttcattgagccgtggcttaaacgcaaacgctccaaacgtcagcgttctcacagcccttcttcgtcttcttcctcaccgcctcgatctcgacccaaatcccagaatcaagatcttacggaagaagagtatctcgctctttgtctcctcatgctcgctaaagatcaaccgtcgcaaacgcgatttcatcaacagtcgcaatcgttaacgccgccgccagaatcaaagaaccttccgtacaagtgtaacgtctgtgaaaaagcgtttccttcctatcaggctttaggcggtcacaaagcaagtcaccgaatcaaaccaccaaccgtaatctcaacaaccgccgatgattcaacagctccgaccatctccatcgtcgccggagaaaaacatccgattgctgcctccggaaagatccacgagtgttcaatctgtcataaagtgtttccgacgggtcaagctttaggcggtcacaaacgttgtcactacgaaggcaacctcggcggcggaggaggaggaggaagcaaatcaatcagtcacagtggaagcgtgtcgagcacggtatcggaagaaaggagccaccgtggattcatcgatctaaacctaccggcgttacctgaactcagccttcatcacaatccaatcgtcgacgaagagatcttgagtccgttgaccggtaaaaaaccgcttttgttgaccgatcacgaccaagtcatcaagaaagaagatttatctttaaaaatctaa

SEQ ID NO: 1836 - protein, 273 aa, Arabidopsis thaliana
MALEAMNTPTSSFTRIETKEDLMNDAVFIEPWLKRKRSKRQRSHSPSSSSSSPPRSRPKSQNQDLTEEEYLALCLLMLAKDQPSQTRFHQQSQSLTPPPESKNLPYKCNVCEKAFPSYQALGGHKASHRIKPPTVISTTADDSTAPTISIVAGEKHPIAASGKIHECSICHKVFPTGQALGGHKRCHYEGNLGGGGGGGSKSISHSGSVSSTVSEERSHRGFIDLNLPALPELSLHHNPIVDEEILSPLTGKKPLLLTDHDQVIKKEDLSLKI

SEQ ID NO: 1837 - DNA, 798 bp, Arabidopsis thaliana
atggatccaatatcagcggttagcgaagagctggctgagatcgaaggacaaatcaatgacatcttccgtgctttatcaaatggattccagaagctggagaagatcaaagatgctaataggcagagtaggcagctggaagaactcactgacaaaatgcgtgactgtaagagccttattaaagatttcgatagggaaatcaaaagcttggaaagcggtaatgatgccagcactaaccggatgttgaacgatagacgacaatctatggttaaggaactcaactcatatgttgctcttaagaagaaatactcatcaaacctagcaagcaataacaagcgagtagatcttttcgatggacctggagaagaacacatggaagaaaatgtcttattagcttcaaacatgtccaatcaagagttaatggataaaggaaactcaatgatggatgacacagatcaagctattgagagagggaaaaagattgtacaagaaactataaatgtgggaacagatacttcagcagctctcaaggctcagaccgagcaaatgagtagagttgtcaatgagctcgattctattcatttctcactcaagaaagcctccaagctggtcaaggaaattggtaggcaggttgccactgacaaatgtattatggcatttcttttccttatcgtcattggtgtcatagcaatcatcatcgtcaagattgtgaacccaaacaacaaagacattcgcgacataccgggtgtgggcctagctccaccagccatgaacagacgtctgctctggaaccattactga

SEQ ID NO: 1838 - protein, 265 aa, Arabidopsis thaliana
MDPISAVSEELAEIEGQINDIFRALSNGFQKLEKIKDANRQSRQLEELTDKMRDCKSLIKDFDREIKSLESGNDASTNRMLNDRRQSMVKELNSYVALKKKYSSNLASNNKRVDLFDGPGEEHMEENVLLASNMSNQELMDKGNSMMDDTDQAIERGKKIVQETINVGTDTSAALKAQTEQMSRVVNELDSIHFSLKKASKLVKEIGRQVATDKCIMAFLFLIVIGVIAIIIVKIVNPNNKDIRDIPGVGLAPPAMNRRLLWNHY

SEQ ID NO: 1839 - DNA, 1233 bp, Arabidopsis thaliana
atggagtcacgcgtgctgttacgcgccaccgcgaatgtcgttggaattccgaaattgagacgaccaatcggagcgatccaccgtcaattcagcactgcatcgtcttcctcgttctcggttaaaccaatcggaggaatcggagagggagcgaatctgatctccggtcgtcagcttcgtccaattcttcttctcgattcgtcggcgatcaacggaggagagaaaagagaaattctcaaaccggttaaagccgccgctgctgaaggtggagataccgctggggatgctaaagttggattcctcgccaagtatccatggctagtcactggattcttcttcttcatgtggtacttcttgaatgtgattttcaacatccttaacaagaagatctataattacttcccttatccctattttgtatcggtgatacacttgttcgtgggagttgtttactgcttgatcagctggtccgtgggtcttcctaaacgtgccccgattgactcgaacctcctcaaggtattgataccagtcgcagtctgtcacgccttaggccatgtcactagcaatgtctctttcgctgcggttgctgtctccttcactcacaccatcaaagcacttgagccattcttcaatgcggctgcttctcaattcattatgggacaatccatccccataacactatggttgtctctagctcctgttgttcttggtgttgcaatggcttcactaactgagctatcattcaactggctcggtttcatcagtgctatgatatcaaacatttctttcacttaccgaagcatcttctccaagaaagccatgactgatatggacagtacaaatgtctacgcttacatctccatcatcgcactcttcgtctgcattcctcctgccatcatcgttgaaggtcctaaactacttaaccatggtttcgccgacgcgattgctaaagttggaatgactaaattcatctctgatctcttctgggttggaatgttttaccatctctacaatcagctggctaccaataccttggagagggttgcaccgctgactcacgcggttggaaacgttctgaaacgtgtgttcgtgatcggtttctccatcgttatcttcggaaacaagatatcgacacagacaggtataggaacaggaatagccattgctggagttgcaatgtactctatcattaaggccaagatcgaagaagagaaacggcaaggaaagaaagcatag

SEQ ID NO: 1840 - protein, 410 aa, Arabidopsis thaliana
MESRVLLRATANVVGIPKLRRPIGAIHRQFSTASSSSFSVKPIGGIGEGANLISGRQLRPILLLDSSAINGGEKREILKPVKAAAAEGGDTAGDAKVGFLAKYPWLVTGFFFFMWYFLNVIFNILNKKIYNYFPYPYFVSVIHLFVGVVYCLISWSVGLPKRAPIDSNLLKVLIPVAVCHALGHVTSNVSFAAVAVSFTHTIKALEPFFNAAASQFIMGQSIPITLWLSLAPVVLGVAMASLTELSFNWLGFISAMISNISFTYRSIFSKKAMTDMDSTNVYAYISIIALFVCIPPAIIVEGPKLLNHGFADAIAKVGMTKFISDLFWVGMFYHLYNQLATNTLERVAPLTHAVGNVLKRVFVIGFSIVIFGNKISTQTGIGTGIAIAGVAMYSIIKAKIEEEKRQGKKA

SEQ ID NO: 1841 - DNA, 1215 bp, Arabidopsis thaliana
atggagtcaccgcactcgaatttgctccctgaagtcgattctttacccgatggattcgtcgacggcgcaacagagccgcctctcaattctcccaagacccaggaagaaacaacaaaccatgaaactgttgcgatcgagaaaacagagaagccaagaacttttccggttccgttgtgtgaaactgatggtaatgaagatgacgaagtagctgacctaattcaagaatcaatcaagcttgagttagagttcgagcagaaagaaaaagaagcttctcctcctatttctcaaacattgtcagaagggtcaactcaaaattcaaccttgtctaaggaaatggattcactcaaacccaaaaaacaagaggtggttgagagcaagcgtaagggttcaaagaatatgttcaaatcagagaaagagtttttggaatttatgctcaagtatcagcaagtcctttctgaaagagattctgctattactgttcgtgacaagcttgaatcactttgtagagagttacaacgtcagaacaaaatgttaatggaagaatgcaagagggtttcaactgagggacagactttaagatcggatttatcgacaaagttccaggatgctataatggatgtgagcattaagttggacgagcaaaagaatgaaagcctcacgcaactcaaagaaaatgagatgttaaggacgaagttgaagcacctggctgatcaatttatgctttcagaacaacaacatgagcaaaggttgaagcagaaaacacttgagctacagatctctgctttaaaaattaaacagcacgaggagaaactcatccatgaacaatctcagatgaaagtttacgcagatcaagtttctcagcttttgtctactgagaaaaatttgcggttgcagctgacttctgatggagataaattccagcagttccaggacgcgttggttaagagcaatgaggtgtttgaaacattcaaacaagaaatcgataagatgtcaaaagcaatcaaagaactcagaaaagaaaacgcattcttgaaaaacaaaactgagaagtcggatatcactctcatagaactcgtcgaagagcgtgaaagattgaagaaactgttggagaagacaaagaaacagaaagacaagcttgaatcactttgcagatcccttcaagctgaaagaaaacagaaagaaactaacagtactgattctgctgttcaaccatga

SEQ ID NO: 1842 - protein, 404 aa, Arabidopsis thaliana
MESPHSNLLPEVDSLPDGFVDGATEPPLNSPKTQEETTNHETVAIEKTEKPRTFPVPLCETDGNEDDEVADLIQESIKLELEFEQKEKEASPPISQTLSEGSTQNSTLSKEMDSLKPKKQEVVESKRKGSKNMFKSEKEFLEFMLKYQQVLSERDSAITVRDKLESLCRELQRQNKMLMEECKRVSTEGQTLRSDLSTKFQDAIMDVSIKLDEQKNESLTQLKENEMLRTKLKHLADQFMLSEQQHEQRLKQKTLELQISALKIKQHEEKLIHEQSQMKVYADQVSQLLSTEKNLRLQLTSDGDKFQQFQDALVKSNEVFETFKQEIDKMSKAIKELRKENAFLKNKTEKSDITLIELVEERERLKKLLEKTKKQKDKLESLCRSLQAERKQKETNSTDSAVQP

SEQ ID NO: 1843 - DNA, 993 bp, Arabidopsis thaliana
atgggttcgatttcgatgcacataactccctctactgctctccctatacgccatttcagagctagagtctcttgttgctcttctgggcatgtatcatttatcaaagatgttgctgccactgaacctccaatgcatcttcatcacttactcaaagtgcttcaaacaagaggtgagacaatcatatctcctggagctaagcagggactgatccctcttgctattccgctttcgaagaattcgtcaggctctgttactgcgcttttgagatggcctactgctccaccaggaatggatatgccggttgtggaagtttggaggagtggagtcaggcttatagctagaaatgtagatgaatacattcaccggattctagttgaagaagatgcacaagagttgacagaactatatcgtgcttcgggagaggcaggtgaaaaactttacgaaaagggtgcttttgctgaatctgaaattgacaatctcgatgtctatgttttgaaaaaggttggactgtttccagatttgttggagcggaaagtattacggcattttgatgaaggagatcatgtttcagctatggtgacaggagaattttacacaaagaaagacctctttccaggatttggacgaccttttgtatattatgcaaacatactacagaaggtagggcggaatgtagaagcaaaagatgcggctagggtagcattgagatcaccgtggtggacattaggatgtccgtatgaggaggttgctagtatagcacaatgggaagacgagcagatcgaattcataagggaaaaagtgagtgatgaaggtcgttttgaagatttgcataaaggcaaagctccaatccaagttgcgttggatgttgcggcttttctcttggatttggcttctatcgaaggaacttggtccgaatctttaaaccatattgctaaatgttatgaggaagctggattacaccatatctctaatttcgttttgtacacagattga

SEQ ID NO: 1844 - protein, 330 aa, Arabidopsis thaliana
MGSISMHITPSTALPIRHFRARVSCCSSGHVSFIKDVAATEPPMHLHHLLKVLQTRGETIISPGAKQGLIPLAIPLSKNSSGSVTALLRWPTAPPGMDMPVVEVWRSGVRLIARNVDEYIHRILVEEDAQELTELYRASGEAGEKLYEKGAFAESEIDNLDVYVLKKVGLFPDLLERKVLRHFDEGDHVSAMVTGEFYTKKDLFPGFGRPFVYYANILQKVGRNVEAKDAARVALRSPWWTLGCPYEEVASIAQWEDEQIEFIREKVSDEGRFEDLHKGKAPIQVALDVAAFLLDLASIEGTWSESLNHIAKCYEEAGLHHISNFVLYTD

SEQ ID NO: 1845 - DNA, 735 bp, Arabidopsis thaliana
atggatcatcaatttggatatggtgttgaagttactgggttatctccatctgttactcataatgatcttatcgatttcttctctttctctggtactatccaagatattgatattgtcaggtcgggtgagcaagcttgtactgcttatgtgatgtttaaggattcttattctcaagaaactgctgttttactcactggcgcaacgatattggatcagcgtgtttgtataactcgttggggacaacatcacgaagagttcgatttctggaatgcgacttcgcgaggttttgaagatgaatcggactcacaacattatgctcaacgaagcgagttcaacgctggagaagcagtgacaaaagctcaagaagtggtgaaaataatgcttgccacaggattcgtgctaggcaaagacgctttaagcaaagctaaagcctttgatgaatcccacggcgtatcagctgcagcggtggctagagtatctcaactagaacagaggattggtcttactgacaaaatctttaccggacttgaagctgttagaatgactgaccaaaggtatcatgtttcagatacagctaaatcagctgtctttgccacaggaagaaccgcggcagcagctgcaactagtgttgtcaatagcagttacttctccagcggagctctttggctgtctggtgcattagagagagctgctaaagccgcatctgatctcggtacccgcggctcaaggcagtga

SEQ ID NO: 1846 - protein, 244 aa, Arabidopsis thaliana
MDHQFGYGVEVTGLSPSVTHNDLIDFFSFSGTIQDIDIVRSGEQACTAYVMFKDSYSQETAVLLTGATILDQRVCITRWGQHHEEFDFWNATSRGFEDESDSQHYAQRSEFNAGEAVTKAQEVVKIMLATGFVLGKDALSKAKAFDESHGVSAAAVARVSQLEQRIGLTDKIFTGLEAVRMTDQRYHVSDTAKSAVFATGRTAAAAATSVVNSSYFSSGALWLSGALERAAKAASDLGTRGSRQ

SEQ ID NO: 1847 - DNA, 237 bp, Arabidopsis thaliana
atgcttgatacgcttattggagggattgtcggagggattgccggagcgattattggaacggtggatgggttcgccagagggatcggaatatgccccgatagttaccagagctgcactcgtaccgactgcgaggagcacaaaaagaagctcccgaccaaccttagccgtaacggcggtgcagcagcagtgaaggctaaggagaacggccgccgtcgccgccagaaagacagggagtag

SEQ ID NO: 1848 - protein, 78 aa, Arabidopsis thaliana
MLDTLIGGIVGGIAGAIIGTVDGFARGIGICPDSYQSCTRTDCEEHKKKLPTNLSRNGGAAAVKAKENGRRRRQKDRE

SEQ ID NO: 1849 - DNA, 1269 bp, Arabidopsis thaliana
atggcaacccttaagtgcattgattggcaattcagcggaagcgaggcggccaaagatgctgctgcggcctccttaggctcatatacctctgcactctatgccctgtgcgatcctcatggcaaacccattttgcccccacgaaatgagatcctggagaccagcaatacagccgaaaaagcagttgttaaagctgttctttatggctcgggaaacgcctatgctcctagcttaggcctcgcggccgccaaaagtgccgtagcagagtatctaaaccaaggtcttccaaagaagcttaccgcagatgacgtgtttatgactctgggatgcaaacaagctattgagctcgcggtagacattctcgctaaaccgaaagccaacgttttgcttccgagtcccggcttcccatgggacctagtccgctccatctacaagaaccttgaggtccgccactataatttccttccagaaaagaactttgaaatcgactttgatagcgtccgagcgctcgtggacgagaacacatttgccatatttataatcaacccccacaaccccaatggtaacacctactccgaggctcatctcaaacagctggctgaactggctaaggaactcaagattatggtggtttctgacgaggtttttagatggacactctttggtagtaacccttttgttcctatgggaaaattctcgtcgatcgtaccagtggttacactcggatccatatcaaagggatggaaagtcccaggatggcgaactggttggctcacgctacatgatctagacggtgtcttcagaaacaccaaggtcttacaagctgctcaagattttctccagataaacaataaccctccgacagttatccaggcggctattcctgacatcttggagaaaactcctcaagagttttttgataagaggcagagttttctgaaagataaagtagaatttggttattctaagctcaagtacattcctagcctcacttgctacatgaaacccgaagcctgcaccttcttatggaccgagcttgatttatcgagctttgtggacatcgaagacgatcaagacttttgcaataagcttgctaaagaagaaaacctcgtcgttttaccagggattgcattcagtcagaagaactggttgaggcattctatcgatatggagactccggtattggaggatgcattggaaagattgaagagcttctgcgatcgccattccaacaaaaaagctcccctcaaagacgtcaatggtgttaagtaa

SEQ ID NO: 1850 - protein, 422 aa, Arabidopsis thaliana
MATLKCIDWQFSGSEAAKDAAAASLGSYTSALYALCDPHGKPILPPRNEILETSNTAEKAVVKAVLYGSGNAYAPSLGLAAAKSAVAEYLNQGLPKKLTADDVFMTLGCKQAIELAVDILAKPKANVLLPSPGFPWDLVRSIYKNLEVRHYNFLPEKNFEIDFDSVRALVDENTFAIFIINPHNPNGNTYSEAHLKQLAELAKELKIMVVSDEVFRWTLFGSNPFVPMGKFSSIVPVVTLGSISKGWKVPGWRTGWLTLHDLDGVFRNTKVLQAAQDFLQINNNPPTVIQAAIPDILEKTPQEFFDKRQSFLKDKVEFGYSKLKYIPSLTCYMKPEACTFLWTELDLSSFVDIEDDQDFCNKLAKEENLVVLPGIAFSQKNWLRHSIDMETPVLEDALERLKSFCDRHSNKKAPLKDVNGVK

SEQ ID NO: 1851 - DNA, 654 bp, Arabidopsis thaliana
atgcaaatatacaatcctatttctccggtgaaaaccatggtgaagatttatcctcacctggcgtttccggtggatatggacgtcgtacaagacaagattttgccctacttaacgacggagcaagagaggttcacgatttggatgaaatctttggtgttcaatagcaaaggctgcacagtttttgattccaaaggaaacttaatctatcgagtggataattatgattccaagagttggagtaatgaagtttactttatggatttaaacggcaaaattttgtttactttacgtcaaaagaaactgggattcttcaaatcttgggaaggatataactcaaccgggaccagatttcgactaagaaagattttcaagattttgccaagagaatcatcttcgtcttacaaagttgtaatgggatcacgcatagttgatggtgatcaacaatcttgttataagattgtaaatcgtggatcagttttcgcaatcaaggatggatcgggaagattaatggcagaagttaaaaacaaactatcggatattagtggtttggatcttggagatgatgttttgacaatgatggtggagccacaactagatcattctttaataatgggtattgttatagcttataaacttaccaaatgtaaattgtga

SEQ ID NO: 1852 - protein, 217 aa, Arabidopsis thaliana
MQIYNPISPVKTMVKIYPHLAFPVDMDVVQDKILPYLTTEQERFTIWMKSLVFNSKGCTVFDSKGNLIYRVDNYDSKSWSNEVYFMDLNGKILFTLRQKKLGFFKSWEGYNSTGTRFRLRKIFKILPRESSSSYKVVMGSRIVDGDQQSCYKIVNRGSVFAIKDGSGRLMAEVKNKLSDISGLDLGDDVLTMMVEPQLDHSLIMGIVIAYKLTKCKL

SEQ ID NO: 1853 - DNA, 1629 bp, Arabidopsis thaliana
atgatggcggtgggcagatccggaggcaccatcctattgttctgcctatcattcttcgccgcggtaaccgcggagagtccataccgattctttgactggaatgtaacatacggcgacatttacccactcggtgttcgtcagcagggaatattgattaatgggcaatttccgggaccagacattcacagtgtgacaaacgacaatctcatcattaacgtacacaacagcttagacgagcctttcttaatctcatggaacggagtacaaaacagaagaaattcttatgttgatggaatgtacggaaccacgtgtccaattccaccgagaagcaactacacatacattttgcaagtgaaagaccaaattggaagtttctattacttcccatctcttgcctttcacaaggcagctggtggattcggaggtatcagaatccttagccgtcctggaattccagttccatttgctgaccctgcaggagattacactgtcctcattggagattggtacaaatttaatcacacggatttgaagtctcgtcttgatagaggaaggaagttaccttcgcctgatggtattcttatcaatggccgaagtaacggtgctaccttaaacgttgaacaaggaaaaacataccgattgaggatatcaaacgttggattacaagattctctgaacttccgaatccaaaaccacagaatgaagcttgtggaagtcgaagggacgcacacacttcaaaccatgttttcctctcttgacgttcacgttggccagtcttactccgttctaattactgctgaccaatctcctcgtgactactacgtggttgtttcgtctcgattcacggataaaatcataaccaccaccggggttcttcgctacagtggctcgtctacccctgcttctggtcctattcctggcggtcccactattcaggttgattggtccttgaaccaagcacgtgccatcagaaccaatttgacagctagtggaccaagaccaaacccgcaaggctcataccattatggtcttataccgctcattaggacaattgtgttcggtagttcagccggacagataaacgggaaacaaagatatggtgtcaatagtgtgtcatttgtgccagctgatacccctctaaaactggctgacttcttcaagattagcggtgtctataagatcaacagcatctcagacaaacccacatatggaggtttataccttgacacctcagttttgcaagtcgactatcgaacctttatcgagattgtattcgagaaccaagaagatatcgtccaaagttatcatctcaatggttactccttttgggtggtcgggatggatggtggacagtggaagacaggaagcagaaatggttataatttacgcgatgcagtttcacgttccacagtccaagtgtacccaaaatcatggacagccatatacattgcattagacaacgttggaatgtggaacttaagatcagaattttgggcaagacagtacttgggacaacaactttacttacgtgtcttcacgtcatctacgtctttgagagatgagtaccctatcccgaagaattcgcgtttgtgcggccgggcaagaggacgacatactaggcctttgtaa

SEQ ID NO: 1854 - protein, 542 aa, Arabidopsis thaliana
MMAVGRSGGTILLFCLSFFAAVTAESPYRFFDWNVTYGDIYPLGVRQQGILINGQFPGPDIHSVTNDNLIINVHNSLDEPFLISWNGVQNRRNSYVDGMYGTTCPIPPRSNYTYILQVKDQIGSFYYFPSLAFHKAAGGFGGIRILSRPGIPVPFADPAGDYTVLIGDWYKFNHTDLKSRLDRGRKLPSPDGILINGRSNGATLNVEQGKTYRLRISNVGLQDSLNFRIQNHRMKLVEVEGTHTLQTMFSSLDVHVGQSYSVLITADQSPRDYYVVVSSRFTDKIITTTGVLRYSGSSTPASGPIPGGPTIQVDWSLNQARAIRTNLTASGPRPNPQGSYHYGLIPLIRTIVFGSSAGQINGKQRYGVNSVSFVPADTPLKLADFFKISGVYKINSISDKPTYGGLYLDTSVLQVDYRTFIEIVFENQEDIVQSYHLNGYSFWVVGMDGGQWKTGSRNGYNLRDAVSRSTVQVYPKSWTAIYIALDNVGMWNLRSEFWARQYLGQQLYLRVFTSSTSLRDEYPIPKNSRLCGRARGRHTRPL

SEQ ID NO: 1855 - DNA, 648 bp, Arabidopsis thaliana
atgagtctctttgggttaggaagaaatcagaagactttccgacctaagaagagtgcaccttctggaagcaagggtgcacagcttcgaaagcatatagatgccaccctaggaagtgggaacttgagagaagctgtaagacttcctccgggagaggatgcaaatgaatggcttgctgtaaacactgtggatttctttaatcaggtgaatttgctatatggcacccttaccgagttctgcacacctgataactgtcctacaatgactgctggcccaaagtacgagtatagatgggcagatggtgtacagatcaagaagcccatcgaggtttctgctccaaagtatgtcgagtacttgatggattggatcgagacccaactcgatgatgagactttatttcctcaaaggcttggagcaccatttcctcagaacttcaaagatgtggtgaaaacgatctttaaacggctattccgagtttatgctcacatataccactctcatttccagaaaatcgttagcctaaaagaagaagctcatctcaacacttgcttcaaacacttcatcctctttactcatgaatttggactgatagacaagaaagaactcgcgcctctacaagagctcatagaatctatcatttcaccttattga

SEQ ID NO: 1856 - protein, 215 aa, Arabidopsis thaliana
MSLFGLGRNQKTFRPKKSAPSGSKGAQLRKHIDATLGSGNLREAVRLPPGEDANEWLAVNTVDFFNQVNLLYGTLTEFCTPDNCPTMTAGPKYEYRWADGVQIKKPIEVSAPKYVEYLMDWIETQLDDETLFPQRLGAPFPQNFKDVVKTIFKRLFRVYAHIYHSHFQKIVSLKEEAHLNTCFKHFILFTHEFGLIDKKELAPLQELIESIISPY

SEQ ID NO: 1857 - DNA, 2766 bp, Arabidopsis thaliana
atgggactgggcattgacccatctgtcgctattacggcactgattgtggtcattctggtggttccaatggattgccaaagacctcaactggtgaacatcggtgctgtttttgcttttgattcggttatcggaagagctgcaaaagtagctctagaggcagctgtttccgatgtgaacaatgataaaagctttctcaaagaaacggagctacggctattaatggaggattctgcctgcaatgtctttcgtgggtcctttggagcttttgaattgcttgagaaagaagtggtggctatgatcggtccaatttcatcctctgttgctcatacaatttccgatattgcaaaagggctccactttcctcttgtctcatttgcagcaactgatccaactctctctgccctccaatttcccttctttcttcggactacacctaatgatgcccaccaaatgtctgcccttgtggatcttatcaatttttatggatggaaagaagtgatctcagtttactcggatgatgagctcggaagaaatggagtttctgctctagatgatgaactgtacaagaaaagatccagaatttcctataaagtgccgctctcagttcattctgatgaaaaattccttactaatgctttgaacaaatccaagtccatcggtcctcgagtttatattcttcattttggtccggacccattgctcagaatttttgatatagcgcaaaagctgcagatgatgacccatgaatacgtatggctcgccacagactggctctctgttaccttagattctttgagtgacaaaggtactctaaaacgccttgaaggagtagtggggcttcgtcaacatatcccagaatccgtaaagatggaacatttcacgcataaactgcagagcaacagatcaatgaatgcctacgcattacatgcctatgatacagtgtggatgattgcgcatggcatcgaggaattgctgaatgaaggaatcaacataacgttttcttactccgaaaagttacttcatgcacggggaaccaaactgcacttggagaaaatcaaatttttcaacagtggggagttactacttgagaaacttctgaaagtaaactttactggtatagccggtcaagttcagtttggttctggccgaaacgttatcggctgtgactacgaaattatcaatgtaaacaaaaccgatgttcatactgtcggtttctggtcgaaaaatggaggcttttcggttgtagccccaaaaacccgtcattcacagaagaagactagctttgtttctgatgaaaaacttggagatataacctggcctggtggtggccgtgaaaagccacgtggttgggtcattgcagattctgcagatccattgaagattgttgtcccgagaagagtgagttttgtcgagtttgtgactgaagaaaagaacagtagccatcggatccaaggattttgcatcgatgtcttcattgaagcattaaagttcgtcccttacagtgttccttacatatttgagcctttcgggaatggtcattcaagtcctaattacaaccaccttattcaaatggtcacggatggtgtatatgatgctgctgttggggatattgcaatagtcccaagccggtccaagttagtggatttctcgcagccatatgcttccacaggccttgtagtggtgattcctgctaatgatgacaatgcgacttggatctttctgagacccttcaccagccggttatggtgtgttgttctagtttcattcctggttattgccgtagtcatctggatcctcgaacatcgcatcaatgaagatttcagagggccaccccgaagacaactcagcacaatgctcttgttcagcttctcaactcttttcaagagaaaccaggaagatacaataagtaatctagcaagactagtgatgattgtatggctcttcctattgatggttctaaccgcgagctacacagcgaacctcacctcaatcctcacagttcaacagcttccctctgctattaccggtattgatagcttgcgggcaagtgaggtacctatcgggtaccaggctgggacgttcactttagagtatttaacctacagtcttggcatggctcggtctagactggtcccacttgactcgaccgaggagtatgaaaaggctctaaagctggggccaaccaattggggaggtgttgctgccattgtcgacgaactcccttacatcgaactgtttctagcagaacgaacaggcttcaagattgttggagaaccctttatgcaccgtggttggggatttgcgtttaagagagattctccattggctatagacatgtcaacagctatcttgaaactctctgagacgaggaaattgcaagaaattcgaaagaaatggttatgcaagacgaattgcgcagggaaatcaaattggaacccagagccaaaccagcttcatctcaaaagcttcaaagggctgtaccttgtctgcattgcaatcacagtctctgcgtttttggtgtttgttctcaggatgatacgccagttcgtgcggtacagacggatggagagaacatcctcgatgccacgcgcttcttggtcagcttctcctacattgcggttgagagaattagtgtttgattttgtggagtttgtggatgagaaagaagaagctattaagagaatgttcagaagaagcgatgactctaataacaacccatctcatgtaggggaagtccaagctgatactgaggtaccacgaaattga

SEQ ID NO: 1858 - protein, 921 aa, Arabidopsis thaliana
MGLGIDPSVAITALIVVILVVPMDCQRPQLVNIGAVFAFDSVIGRAAKVALEAAVSDVNNDKSFLKETELRLLMEDSACNVFRGSFGAFELLEKEVVAMIGPISSSVAHTISDIAKGLHFPLVSFAATDPTLSALQFPFFLRTTPNDAHQMSALVDLINFYGWKEVISVYSDDELGRNGVSALDDELYKKRSRISYKVPLSVHSDEKFLTNALNKSKSIGPRVYILHFGPDPLLRIFDIAQKLQMMTHEYVWLATDWLSVTLDSLSDKGTLKRLEGVVGLRQHIPESVKMEHFTHKLQSNRSMNAYALHAYDTVWMIAHGIEELLNEGINITFSYSEKLLHARGTKLHLEKIKFFNSGELLLEKLLKVNFTGIAGQVQFGSGRNVIGCDYEIINVNKTDVHTVGFWSKNGGFSVVAPKTRHSQKKTSFVSDEKLGDITWPGGGREKPRGWVIADSADPLKIVVPRRVSFVEFVTEEKNSSHRIQGFCIDVFIEALKFVPYSVPYIFEPFGNGHSSPNYNHLIQMVTDGVYDAAVGDIAIVPSRSKLVDFSQPYASTGLVVVIPANDDNATWIFLRPFTSRLWCVVLVSFLVIAVVIWILEHRINEDFRGPPRRQLSTMLLFSFSTLFKRNQEDTISNLARLVMIVWLFLLMVLTASYTANLTSILTVQQLPSAITGIDSLRASEVPIGYQAGTFTLEYLTYSLGMARSRLVPLDSTEEYEKALKLGPTNWGGVAAIVDELPYIELFLAERTGFKIVGEPFMHRGWGFAFKRDSPLAIDMSTAILKLSETRKLQEIRKKWLCKTNCAGKSNWNPEPNQLHLKSFKGLYLVCIAITVSAFLVFVLRMIRQFVRYRRMERTSSMPRASWSASPTLRLRELVFDFVEFVDEKEEAIKRMFRRSDDSNNNPSHVGEVQADTEVPRN

SEQ ID NO: 1859 - DNA, 2115 bp, Arabidopsis thaliana
atggaaacaaaccagtggcggtcgaggaaaaagatagaatcagctgcagaaacactccaagtttcttctagaagaggcagaggacaggcacgtatggttcctcctgtaagtggagttagatccgagagagctcgaaaaagtctaagtgagaagctagagactgtagctttaaactctcctaagaaagatgctcgtgtgagtctttatggcgagaaaagtgtagtagatgagattttcctagaagatgaagaaatgggtcatgaaactggtttgaagaatggagagtcgtcgcctttttgtggtgtatcggacaagcttctgcagcgaatcgagcttcttgggagagaccatgaggcaacgagacttgataacaacaagttcaggtcaatcgaatctatgaaaaagagacaagaagaatcggcatgtgatgatctagttgatatgaagacaaagattcaaacgttagctgcggagaacactcagcttaagaagtctcttgtggcgaaagaagagcttgcggtaagtcttcaagagcgtaaatttcaggtggaatcagaattcgaagcgttaatgactagattagattcaacggagaaagaaaacgcattcttgagatatgagtatactgttcttgagaaagatcttcaggtaaaaacagaggaaacagagcatactcgcaggtctatggagctaacgcataagcagcaacttaggaatgtgaacaagattgttgagcttgaagctgaatgccaaaggttaagacttctctttcgaaagaagtttccagagaagtctatatctatgaggaatgaaggtgaagaaaagaagatggagatgagaagacgaaacgctaataagagcgatatgatgatgagagatgaagttcagagcaggaagctgaagtatgatcttttgatggagcagattgggaatgttagggcagagaacaagaatctaatggacataattatgaagaaaaacattgagatcaaagatcttagccgcgggcagaaaccgttagaggcttcgagtttcgatattcaaagcgaaagtagtgtgatgagcccctgtggttccaaggagatgaagttactgatggatgattttaatgagatggagaagttagccattgtgtgtactgagaaagatccaagagtggatgatgagaaggaaggatcttttgattggattcaagttgttttgagcgctataacgaagcaagagaggatatcgaaacgcggtgttaaagaactcttacaagacattaagattgctttaggatgtatggatgaaaatgataatgtagaaagaaagaaaggtgaagaagatcctctctgcatcacatggaaatctaataacgaatcgggtccaatgactaaggatgagatcaagagacatttgggtttgacgaaatcagataaggtggagaagattgaatctgatgaaaagcaagaactgagaaagaagcttgaggaatcagtggagaagatcagaaacttagaagcagagatgaaaacattgagagagaataaggaaaaggtagaggcagagatggaaacggagaaatcgatgaaggaagatcttgatacaaagctgaacataacaagagctaacctcaacgagacacagaagaagttgtcttctcttgaagtagaatttgattacagaaagagctgttgtgaagaactcgaagggacttgcatcgagcttcagcttcagctagaaagtgttgaaacaaagaaaccgacgcagagaaacaaaaacgggtgggatatagcaacagcttctgtgaagttatcagagtgtcaagaaacgattaccagtttacggaagcaactaagagcgttatctacaacagaaacaagcagcaccattaaatttctacacaaaagatcttctctccgggaaaatatagcagaggatgatactaacagagttgctcaagatgatgatggtaaccgttacaacgctttgatcgtgtacgaaccagtgaaggcgagaggtgagaagatggagatggtaccgagaaagaagcaaggattagggttcttgaaaaaactgttgttcaggaggaaaagagtgagcagcaagaaatgtcttgccttgactatgtga

SEQ ID NO: 1860 - protein, 704 aa, Arabidopsis thaliana
METNQWRSRKKIESAAETLQVSSRRGRGQARMVPPVSGVRSERARKSLSEKLETVALNSPKKDARVSLYGEKSVVDEIFLEDEEMGHETGLKNGESSPFCGVSDKLLQRIELLGRDHEATRLDNNKFRSIESMKKRQEESACDDLVDMKTKIQTLAAENTQLKKSLVAKEELAVSLQERKFQVESEFEALMTRLDSTEKENAFLRYEYTVLEKDLQVKTEETEHTRRSMELTHKQQLRNVNKIVELEAECQRLRLLFRKKFPEKSISMRNEGEEKKMEMRRRNANKSDMMMRDEVQSRKLKYDLLMEQIGNVRAENKNLMDIIMKKNIEIKDLSRGQKPLEASSFDIQSESSVMSPCGSKEMKLLMDDFNEMEKLAIVCTEKDPRVDDEKEGSFDWIQVVLSAITKQERISKRGVKELLQDIKIALGCMDENDNVERKKGEEDPLCITWKSNNESGPMTKDEIKRHLGLTKSDKVEKIESDEKQELRKKLEESVEKIRNLEAEMKTLRENKEKVEAEMETEKSMKEDLDTKLNITRANLNETQKKLSSLEVEFDYRKSCCEELEGTCIELQLQLESVETKKPTQRNKNGWDIATASVKLSECQETITSLRKQLRALSTTETSSTIKFLHKRSSLRENIAEDDTNRVAQDDDGNRYNALIVYEPVKARGEKMEMVPRKKQGLGFLKKLLFRRKRVSSKKCLALTM

SEQ ID NO: 1861 - DNA, 1848 bp, Arabidopsis thaliana
atggcgacgaagaactcaaagcaaaacatgtccgtgttgttaactaagctcggagatcgagatactttcacaatggcggctcgtgagcttgatttaatggctagacagattgatccttcttcctcctccgggaatctccagtcgtttatttccgttatactctccgtcgacaccggagataaaccggcggttcgtaagcattgtattcacttgctcgccgttttatcagtttctcttcctctcaattctctatctcctttcctctctaagatcctcactcgcatcacgagacgtctccgtgatcccgactcttcgattcgatcaacttgcgtcgcggctgtgtcggcgatctcttcacgcacgacgaagcctccgttttactcggcgtttatgaagccgttagcagatacacttttcactgagcaggaggttaatgcgcagatcggagcggcgctttgtctcgcggcggcgattgattcagcgtctgatccggatccggttcggttagggcagacacttttgcctaggctagagaagctcgtgaagtgtaacgcgtttaaggcgaaatcggcgggagttgttgtgatcggaagtgtgattggtgctggtggtttgtctggaaccagtgtgagctccggtggattgaaaggacttgtggattgcttattgagcttcttggttagtgaagattgggcggcgaggaaagcagctgctgaagctttggggaggttagctacaatggagagaaatgagctaggtgagttcaaggctaagtgcttgaagatctttgaaagcaggaaatatgataaggtgaaagctgtgagagaggtgatgaatcagatgatggaggcttggaaacaggttccagatttatcagaagaggtttctccacccagatctaatgcttcttctaaaggtgatgcaagtgatggacgatatccttcagggtctagagttggttcaacacctgctaaatcaagaactcatctggttaacagatcgactccaccggggagttcactagccaccacggctaggaagcaggctaatagaaaaagcattgatcagaagaaaaccagtctaacagcatcacttacaaaaccaaacgtgaggagaagattggaatggaaagctggaggagctagtattcccactggtgtgtctcttgaagacgaacaacattgtgatcatgacgagaatgcgaaggaaacgagtcattctagtcacaatacggtgcagaagttaggaggtgtttccagttctcttaatggcaatatcccaccatccggtgctacaatggtaacagggcatcacgtcttgtctgaaaacccaaatagtaataactgcaaagggcttgaagatatatctttgatccgtaatcagcttgttcagattgaacaacagcaagccaatctaatggatcttcttcagagatttgtcggaagctcgcaacacggaatgcgtggtctggaaacacgagttcacggattagaacttgctctggacgaaatatcttatgacttggcggtttcaaatgggagaatgagtaacggttcaagcagaaacaactgttgtctccttccttctggaagtttcatcaaatctaaattctggaagaaacacgattccaagtattcagcatcgagaatgtccacttataggaacagaaatgcagaaaccaccgagatacaaaactcgaggcatcggtttaatggctctcctggatttatagtcaacccattagctgaaattcgaccagataatgatctgcaggtctgcctcacaattgagggacgacgagaaacaaaaccttcaaaagcttctgagactttaaaaaccactgtgtga

SEQ ID NO: 1862 - protein, 615 aa, Arabidopsis thaliana
MATKNSKQNMSVLLTKLGDRDTFTMAARELDLMARQIDPSSSSGNLQSFISVILSVDTGDKPAVRKHCIHLLAVLSVSLPLNSLSPFLSKILTRITRRLRDPDSSIRSTCVAAVSAISSRTTKPPFYSAFMKPLADTLFTEQEVNAQIGAALCLAAAIDSASDPDPVRLGQTLLPRLEKLVKCNAFKAKSAGVVVIGSVIGAGGLSGTSVSSGGLKGLVDCLLSFLVSEDWAARKAAAEALGRLATMERNELGEFKAKCLKIFESRKYDKVKAVREVMNQMMEAWKQVPDLSEEVSPPRSNASSKGDASDGRYPSGSRVGSTPAKSRTHLVNRSTPPGSSLATTARKQANRKSIDQKKTSLTASLTKPNVRRRLEWKAGGASIPTGVSLEDEQHCDHDENAKETSHSSHNTVQKLGGVSSSLNGNIPPSGATMVTGHHVLSENPNSNNCKGLEDISLIRNQLVQIEQQQANLMDLLQRFVGSSQHGMRGLETRVHGLELALDEISYDLAVSNGRMSNGSSRNNCCLLPSGSFIKSKFWKKHDSKYSASRMSTYRNRNAETTEIQNSRHRFNGSPGFIVNPLAEIRPDNDLQVCLTIEGRRETKPSKASETLKTTV

SEQ ID NO: 1863 - DNA, 981 bp, Arabidopsis thaliana
atggcggtggcttctcttagtatttgcttctctgctcggccacatcttcttcttcgcaacttctctcctcgacccaaatttgttgctatggctgcaatgagtgaggatccaattcgtgaatggattcttacagaaggaaaagcaactcagataacaaagattggttctgttggtggtggatgcattaatcttgcaagtcattatcaaactgatgctggttctttcttcgttaaaactaacaggagtattggacctgccatgtttgagggagaggctcttggtcttgaggctatgtatgaaaccagaacaatccgtgttccaaatccacacaaagctggggaattgccaacaggtggatcttatatcatcatggagtttatagattttgggggatcaagaggcaatcaggctgaattaggaaggaagctagctgagatgcataaagccgggaaaacttcgaaaggttttggctttgaggttgacaacactattggcagtaccccgcagatcaatacttggtcttcggattggattgaattttatggtgagaagagattgggttaccagcttaagttagctagggatcagtatggtgactctgctatttatcagaaaggtcatacactgatacagaacatggcacctctctttgagaatgttgtcatagaaccgtgcttgttacatggtgatctctggagcgggaatatcgcatacgacaagaacaacgaacctgtcattcttgatcctgcctgttactatgggcataacgaggcggattttggaatgtcgtggtgcgcaggatttggagaatctttctacaatgcctatttcaaggtaatgccaaaacaagcgggatatgagaagaggagggatctgtatttgctctatcattacttgaaccattataacctgtttggctcgggctaccgatcatctgcgatgtcaatcatcgatgattatctacggatgctcaaagcttaa

SEQ ID NO: 1864 - protein, 326 aa, Arabidopsis thaliana
MAVASLSICFSARPHLLLRNFSPRPKFVAMAAMSEDPIREWILTEGKATQITKIGSVGGGCINLASHYQTDAGSFFVKTNRSIGPAMFEGEALGLEAMYETRTIRVPNPHKAGELPTGGSYIIMEFIDFGGSRGNQAELGRKLAEMHKAGKTSKGFGFEVDNTIGSTPQINTWSSDWIEFYGEKRLGYQLKLARDQYGDSAIYQKGHTLIQNMAPLFENVVIEPCLLHGDLWSGNIAYDKNNEPVILDPACYYGHNEADFGMSWCAGFGESFYNAYFKVMPKQAGYEKRRDLYLLYHYLNHYNLFGSGYRSSAMSIIDDYLRMLKA

SEQ ID NO: 1865 - DNA, 1182 bp, Arabidopsis thaliana
atggactgcaacatggtatcttcgtcccagtgggattgggagcatttgatcatgtccaatccgtcaaggactgaagatgacagcaaacagctacctactgagtgggaaattgaaaaaggtgaaggaattgaatctatagttccacatttctcaggccttgagagagtcagtagtggctctgccaccagcttctggcacactgctgtatcgaaaagctcacagtcgacctctatcaactcatcatctcccgaagccaaacgatgcaagcttgcatcagaaagttcccctggagattcttgcagcaacatagactttgtccaggtgaaggctcccacagctctcgaggtatccgttgcctcagctgaatcagatctttgtttaaaactaggaaagcggacatactctgaagaatactggggtagaaacaataatgaaatttcagcggtttctatgaagttgttaactccatctgttgtcgctgggaaatccaaattgtgtggtcagagcatgccagtcccgcgttgccaaattgatggctgtgaactggatctctcatctgctaagggttatcatcgtaagcacaaagtctgcgaaaagcattcaaagtgcccaaaagttagcgtgagtggcctggaacgtcggttctgccaacagtgtagcaggttccatgctgtctctgaatttgatgagaagaaacgaagctgccgaaaacgtctttctcatcataatgcgaggcgtcgtaagccacaaggagtattttcaatgaatcccgagagggtgtatgatcgaagacagcatacaaatatgttgtggaatggggtgtcccttaacgcgagatctgaagaaatgtatgaatggggtaataacacttatgatacaaagcctagacaaacggaaaaaagctttactctgagcttccagagaggtaatggctctgaggaccagctggttgctagtagcagccgtatgttctctacatctcaaacctcaggtgggttcccagcaggaaagtccaagtttcaacttcatggcgaagatgtgggagaatactcaggagtcctccatgaatctcaagatatccaccgtgctctctctcttctgtcaacctcttcggatcccctggcccaaccacatgtgcagccattttctctactctgttcatatgatgttgtaccaaaatag

SEQ ID NO: 1866 - protein, 393 aa, Arabidopsis thaliana
MDCNMVSSSQWDWEHLIMSNPSRTEDDSKQLPTEWEIEKGEGIESIVPHFSGLERVSSGSATSFWHTAVSKSSQSTSINSSSPEAKRCKLASESSPGDSCSNIDFVQVKAPTALEVSVASAESDLCLKLGKRTYSEEYWGRNNNEISAVSMKLLTPSVVAGKSKLCGQSMPVPRCQIDGCELDLSSAKGYHRKHKVCEKHSKCPKVSVSGLERRFCQQCSRFHAVSEFDEKKRSCRKRLSHHNARRRKPQGVFSMNPERVYDRRQHTNMLWNGVSLNARSEEMYEWGNNTYDTKPRQTEKSFTLSFQRGNGSEDQLVASSSRMFSTSQTSGGFPAGKSKFQLHGEDVGEYSGVLHESQDIHRALSLLSTSSDPLAQPHVQPFSLLCSYDVVPK

SEQ ID NO: 1867 - DNA, 3252 bp, Arabidopsis thaliana
atggcaagaaatgattggataaacagttacctggaagctattcttgatgttggaactagcaagaaaaagaggtttgagagcaactccaagatcgtccagaagcttggagatatcaacagtaaggatcatcaggagaaggtgtttggagatatgaatgggaaggatcatcaagagaaggtgtttagtcccatcaaatactttgtggaagaggtcgtcaacagtttcgatgagtctgacctgtataaaacatggattaaggtgatagcaacaaggaatactcgtgaacgcagtaacaggcttgagaatatatgctggcgcatttggcatctcgcacgcaagaaaaagcagattgtgtgggatgacggggttagactttccaaacgaagaattgaacgtgaacaaggtcgcaatgatgcagaagaggatcttctttctgagctttctgaaggagagaaggataagaatgatggagagaaggagaagagtgaagttgttacaactctcgaaccacctcgagatcacatgccccgtatccgctctgaaatgcaaatttggtcagaagatgataaatcaagtcgaaacctttacattgtcttaatcaggcaagtagagattggtttttctgacttatttgttgttttcaatatgctcgtgggacttacctggtgcctctatttggttccatgctttaccaactgcagcatgcatggactcgtgcgtggagaaaacatggagcttggaagagactctgatactggtgggcaggtgaaatatgttgttgagcttgctcgtgcgttggccaacactgaaggtgtccacagggtcgatctcttaacacggcagatcagttcaccagaggttgactacagctacggcgagccagttgagatgttatcatgccctccagaaggtagcgacagctgtggctcctacattatccgcatcccctgtggttctcgggacaagtacataccaaaggagtcactctggccccatattcccgagtttgttgacggggcgctaaatcacatagtgagcatagcaaggtcgctaggagagcaagtgaatggagggaaaccaatatggccttatgtaattcatggccactatgctgatgcaggagaagtagctgcacatttggcaggagcgttaaatgtgccaatggttctaactggtcactctttgggaaggaataagtttgagcagttgcttcaacaagggagaattaccagagaggatattgacagaacatataagatcatgaggagaatagaagctgaagaacagagcctagatgcagcggagatggtggtgacaagcacacgacaagagattgacgcgcagtgggggctgtatgatggttttgatatcaagctggagaggaagctcagggttagaagacggcgtggagtcagctgccttggtagatacatgccacgaatggtggttatacccccaggcatggatttcagctatgtcttgacacaagattcacaggaacccgatggtgatcttaagtcgctaattggccctgaccgaaaccagataaaaaagcctgtgcctccaatatggtccgagataatgagatttttctcaaatcctcataaaccaaccatacttgcgctgtctcgtcctgaccacaagaaaaatgtcaccacattggtcaaagcttttggtgaatgtcagcctcttcgagaactagccaacctggtacttatactaggtaaccgagatgacatcgaagagatgcctaatagcagctcagttgttctcatgaatgtactaaagctgatagaccagtacgacttgtacggccaagtagcttatccaaagcatcataaacaatctgaagttccagatatttaccgcttagcagccaaaactaagggggttttcatcaatccagctctggtggagccgtttggtctcacgctcattgaggcagctgcttatggtctgcccattgttgccaccagaaatggagggcctgttgatattgtgaaggcactaaataatggtctcctagtcgacccccatgaccaacaagccatttctgatgcccttctaaagctagttgctaacaaacatctctgggctgagtgtagaaaaaacggactcaagaacatccaccgtttttcatggccagagcactgccgtaactacctatcccatgtcgaacattgcagaaaccgtcaccctaccagtagtctcgacatcatgaaagttccagaagagctcacaagtgattctctacgagatgtcgatgacatatctttgagattctccacagaaggagatttcactctcaacggagaactagatgcaggtaccagacagaagaaactagtcgatgccataagtcaaatgaattcaatgaaaggttgctcagctgctatctacagccctggtagaaggcagatgctctttgtggttgctgttgattcctatgatgacaacggaaacatcaaagcgaatttgaacgaaatcatcaagaatatgataaaagctgcagatttgacatcgggtaaaggaaaaataggttttgtgctagcctcaggttcaagcttacaagaagttgtggatattacgcagaaaaacctgattaatctggaagattttgatgcaatagtttgcaacagcggaagtgagatctactatccatggagagatatgatggttgatgcagactacgaaactcatgtggaatacaaatggcctggtgaaagtataaggtcggtgattctgagacttatatgtacggaacctgcagctgaggatgatatcacagagtatgcgagttcatgcagtacaagatgctatgcaatttctgtgaaacaaggagtcaagactcgaagagtcgatgaccttaggcagaggcttcggatgagaggtttaaggtgcaacattgtctatactcatgcagcaacaaggctaaatgttataccactatgtgcatcaagaatacaagcactcaggtatctttctataaggtggggaattgacatgtcgaagactgttttctttttgggagagaaaggagacacagactatgaggacttactgggtggcctccacaaaaccatcattctaaaaggtgtagtgggatcagacagtgagaagcttcttcgcagtgaagaaaacttcaaaagagaagacgcagttccacaagagagccctaacatttcctatgtcaaagagaatggcggatctcaggaaattatgtccactttagaggcctatgggatcaagtaa

SEQ ID NO: 1868 - protein, 1083 aa, Arabidopsis thaliana
MARNDWINSYLEAILDVGTSKKKRFESNSKIVQKLGDINSKDHQEKVFGDMNGKDHQEKVFSPIKYFVEEVVNSFDESDLYKTWIKVIATRNTRERSNRLENICWRIWHLARKKKQIVWDDGVRLSKRRIEREQGRNDAEEDLLSELSEGEKDKNDGEKEKSEVVTTLEPPRDHMPRIRSEMQIWSEDDKSSRNLYIVLIRQVEIGFSDLFVVFNMLVGLTWCLYLVPCFTNCSMHGLVRGENMELGRDSDTGGQVKYVVELARALANTEGVHRVDLLTRQISSPEVDYSYGEPVEMLSCPPEGSDSCGSYIIRIPCGSRDKYIPKESLWPHIPEFVDGALNHIVSIARSLGEQVNGGKPIWPYVIHGHYADAGEVAAHLAGALNVPMVLTGHSLGRNKFEQLLQQGRITREDIDRTYKIMRRIEAEEQSLDAAEMVVTSTRQEIDAQWGLYDGFDIKLERKLRVRRRRGVSCLGRYMPRMVVIPPGMDFSYVLTQDSQEPDGDLKSLIGPDRNQIKKPVPPIWSEIMRFFSNPHKPTILALSRPDHKKNVTTLVKAFGECQPLRELANLVLILGNRDDIEEMPNSSSVVLMNVLKLIDQYDLYGQVAYPKHHKQSEVPDIYRLAAKTKGVFINPALVEPFGLTLIEAAAYGLPIVATRNGGPVDIVKALNNGLLVDPHDQQAISDALLKLVANKHLWAECRKNGLKNIHRFSWPEHCRNYLSHVEHCRNRHPTSSLDIMKVPEELTSDSLRDVDDISLRFSTEGDFTLNGELDAGTRQKKLVDAISQMNSMKGCSAAIYSPGRRQMLFVVAVDSYDDNGNIKANLNEIIKNMIKAADLTSGKGKIGFVLASGSSLQEVVDITQKNLINLEDFDAIVCNSGSEIYYPWRDMMVDADYETHVEYKWPGESIRSVILRLICTEPAAEDDITEYASSCSTRCYAISVKQGVKTRRVDDLRQRLRMRGLRCNIVYTHAATRLNVIPLCASRIQALRYLSIRWGIDMSKTVFFLGEKGDTDYEDLLGGLHKTIILKGVVGSDSEKLLRSEENFKREDAVPQESPNISYVKENGGSQEIMSTLEAYGIK

SEQ ID NO: 1869 - DNA, 1365 bp, Arabidopsis thaliana
atggctttagctgttacttcttcttcaactgcaatctctggatcgagtttctctcgttctggagcttcttctgaatctaaagctcttcaaatatgttcgattaggttatctgatcgaacccatttgtctcagagacgttactctatgaaacctttaaacgctgagtcacattcacgaagcgaatcttgggttactcgtgcttcaactctaattgctcctgaagttgaagagaaaggaggagaagttgaagactttgagcaacttgctaaaaagcttgaagatgcttctccacttgaaatcatggataaagctcttgagagattcggagaccaaatcgcaattgcttttagtggagctgaagatgttgcattgattgaatatgcacgtttaactggaaagccatttagggtttttagtttagatacagggagattaaaccctgaaacgtacaggctctttgacgcagtcgagaagcagtacgggattcgaattgagtacatgtttcctgatgcagttgaggttcaagctttagtgaggaacaagggtttgttctcattctatgaagatggtcatcaagagtgttgccgtgtgaggaaagttagacctttgcgtcgtgctcttaagggtcttaaagcttggattacaggacagaggaaagaccaatctccgggtacgagatctgagatccctattgttcaggttgatccagtgtttgaagggttagatggcggtgttggaagtcttgtgaagtggaatcctttggctaatgttgaaggagctgatgtgtggaactttctgagaactatggatgttccggtgaatgcattgcacgcacaagggtatgtgtcaatcgggtgtgagccgtgtactaggccggtgcttccaggccaacatgagagagaaggaaggtggtggtgggaagatgctaaagctaaagaatgtggtctacacaaagggaacatcaaggaggaagatggtgctgcagactcaaagcctgctgctgtgcaagagatatttgaaagcaacaatgtggttgcattgagcaaaggaggggttgagaatcttttgaagctagagaaccgtaaagaggcgtggttggtcgtactttacgctccttggtgccctttctgccaggcgatggaagcatcgtacatcgaattggctgagaaacttgcgggaaaaggagttaaagtggcgaaattccgagctgacggtgagcagaaggagtttgctaagcaagagcttcagttagggagcttcccgacgatacttctctttccgaaaagagctccacgggctattaagtacccttcagagcatagagatgttgattcactcatgtcgtttgtgaatcttcttcggtga

SEQ ID NO: 1870 - protein, 454 aa, Arabidopsis thaliana
MALAVTSSSTAISGSSFSRSGASSESKALQICSIRLSDRTHLSQRRYSMKPLNAESHSRSESWVTRASTLIAPEVEEKGGEVEDFEQLAKKLEDASPLEIMDKALERFGDQIAIAFSGAEDVALIEYARLTGKPFRVFSLDTGRLNPETYRLFDAVEKQYGIRIEYMFPDAVEVQALVRNKGLFSFYEDGHQECCRVRKVRPLRRALKGLKAWITGQRKDQSPGTRSEIPIVQVDPVFEGLDGGVGSLVKWNPLANVEGADVWNFLRTMDVPVNALHAQGYVSIGCEPCTRPVLPGQHEREGRWWWEDAKAKECGLHKGNIKEEDGAADSKPAAVQEIFESNNVVALSKGGVENLLKLENRKEAWLVVLYAPWCPFCQAMEASYIELAEKLAGKGVKVAKFRADGEQKEFAKQELQLGSFPTILLFPKRAPRAIKYPSEHRDVDSLMSFVNLLR

SEQ ID NO: 1871 - DNA, 408 bp, Arabidopsis thaliana
atggtgaagttcttgaagcagaacaaggccgtgatccttcttcaaggacgttacgccggaaagaaagccgtcatcatcaaatccttcgacgacggtaaccgtgatcgtccttacggacactgcctcgtcgccggactcaagaagtacccgagcaaagtcatccgcaaagactcagctaagaagacagctaagaaatctagggttaagtgtttcatcaagcttgttaattaccagcatctgatgcctactcgttacacactcgacgtggatctcaaggaagtggcgactcttgatgctcttcagagtaaggataagaaggttgctgctcttaaggaagctaaggctaagcttgaggagaggttcaaaaccggtaagaacagatggttctttaccaagctcaggttctga

SEQ ID NO: 1872 - protein, 135 aa, Arabidopsis thaliana
MVKFLKQNKAVILLQGRYAGKKAVIIKSFDDGNRDRPYGHCLVAGLKKYPSKVIRKDSAKKTAKKSRVKCFIKLVNYQHLMPTRYTLDVDLKEVATLDALQSKDKKVAALKEAKAKLEERFKTGKNRWFFTKLRF

SEQ ID NO: 1873 - DNA, 1827 bp, Arabidopsis thaliana
atggagacaaattcgtctggagaagatctggttattaagactcggaagccatatacgataacaaagcaacgtgaaaggtggactgaggaagaacataatagattcattgaagctttgaggctttatggtagagcatggcagaagattgaagaacatgtagcaacaaaaactgctgtccagataagaagtcacgctcagaaatttttctccaaggtagagaaagaggctgaagctaaaggtgtagctatgggtcaagcgctagacatagctattcctcctccacggcctaagcgtaaaccaaacaatccttatcctcgaaagacgggaagtggaacgatccttatgtcaaaaacgggtgtgaatgatggaaaagagtcccttggatcagaaaaagtgtcgcatcctgagatggccaatgaagatcgacaacaatcaaagcctgaagagaaaactctgcaggaagacaactgttcagattgtttcactcatcagtatctctctgctgcatcctccatgaataaaagttgtatagagacatcaaacgcaagcactttccgcgagttcttgccttcacgggaagagggaagtcagaataacagggtaagaaaggagtcaaactcagatttgaatgcaaaatctctggaaaacggtaatgagcaaggacctcagacttatccgatgcatatccctgtgctagtgccattggggagctcaataacaagttctctatcacatcctccttcagagccagatagtcatccccacacagttgcaggagattatcagtcgtttcctaatcatataatgtcaacccttttacaaacaccggctctttatactgccgcaactttcgcctcatcattttggcctcccgattctagtggtggctcacctgttccagggaactcacctccgaatctggctgccatggccgcagccactgttgcagctgctagtgcttggtgggctgccaatggattattacctttatgtgctcctcttagttcaggtggtttcactagtcatcctccatctacttttggaccatcatgtgatgtagagtacacaaaagcaagcactttacaacatggttctgtgcagagccgagagcaagaacactccgaggcatcaaaggctcgatcttcactggactcagaggatgttgaaaataagagtaaaccagtttgtcatgagcagccttctgcaacacctgagagtgatgcaaagggttcagatggagcaggagacagaaaacaagttgaccggtcctcgtgtggctcaaacactccgtcgagtagtgatgatgttgaggcggatgcatcagaaaggcaagaggatggcaccaatggtgaggtgaaagaaacgaatgaagacactaataaacctcaaacttcagagtccaatgcacgccgcagtagaatcagctccaatataaccgatccatggaagtctgtgtctgacgagggtcgaattgccttccaagctctcttctccagagaggtattgccgcaaagttttacatatcgagaagaacacagagaggaagaacaacaacaacaagaacaaagatatccaatggcacttgatcttaacttcacagctcagttaacaccagttgatgatcaagaggagaagagaaacacaggatttcttggaatcggattagatgcttcaaagctaatgagtagaggaagaacaggttttaaaccatacaaaagatgttccatggaagccaaagaaagtagaatcctcaacaacaatcctatcattcatgtggaacagaaagatcccaaacggatgcggttggaaactcaagcttccacatga

SEQ ID NO: 1874 - protein, 608 aa, Arabidopsis thaliana
METNSSGEDLVIKTRKPYTITKQRERWTEEEHNRFIEALRLYGRAWQKIEEHVATKTAVQIRSHAQKFFSKVEKEAEAKGVAMGQALDIAIPPPRPKRKPNNPYPRKTGSGTILMSKTGVNDGKESLGSEKVSHPEMANEDRQQSKPEEKTLQEDNCSDCFTHQYLSAASSMNKSCIETSNASTFREFLPSREEGSQNNRVRKESNSDLNAKSLENGNEQGPQTYPMHIPVLVPLGSSITSSLSHPPSEPDSHPHTVAGDYQSFPNHIMSTLLQTPALYTAATFASSFWPPDSSGGSPVPGNSPPNLAAMAAATVAAASAWWAANGLLPLCAPLSSGGFTSHPPSTFGPSCDVEYTKASTLQHGSVQSREQEHSEASKARSSLDSEDVENKSKPVCHEQPSATPESDAKGSDGAGDRKQVDRSSCGSNTPSSSDDVEADASERQEDGTNGEVKETNEDTNKPQTSESNARRSRISSNITDPWKSVSDEGRIAFQALFSREVLPQSFTYREEHREEEQQQQEQRYPMALDLNFTAQLTPVDDQEEKRNTGFLGIGLDASKLMSRGRTGFKPYKRCSMEAKESRILNNNPIIHVEQKDPKRMRLETQAST

SEQ ID NO: 1875 - DNA, 954 bp, Arabidopsis thaliana
atgggagagagcaaacgcaccgagaaaacgcgcgttttggtggttggagcgactggatacatagggaagaggatagtaagggcgtgtttggctgaaggtcacgagacttacgttttgcagaggccagagattggtctcgaaatcgagaaagtccaactctttctttctttcaagaaactcggcgcacgtatcgttgaaggttctttctccgaccatcaaagcctcgtatccgccgtgaaacttgttgacgtcgttgtctccgccatgtccggtgttcacttccgtagccataacattctagtccagctcaagctcgtcgaagctatcaaagaggctggtaacgtaaagcggtttttaccatctgaatttggtatggatccaccacgtatgggacatgcgctaccgcccggaagagaaacctttgaccagaaaatggaagtgcgtcaggcgatagaggctgccggaattccttacacttacgttgtgggtgcttgctttgccgcctacttcgccggaaacttgtctcagatggtaactttacttcctccgaaagaaaaagttaatatttatggtgatggaaatgtaaaagtggtgtttgcggatgaagatgatatcgcaaaatacaccgcgaaaacgttaaacgatccacggacattaaacaaaaccgtgaatattagacctcccgacaacgttctcacgcagttggaattagttcagatctgggaaaagctaaccggaaaagaattggagaaaacaaatattgctgcacaagacttcctcgccaacattgaacaaatggagattccacaccaagcagggataggacatttctatcacattttctatgaaggatgtctcactgatcacgaagtcggagaagacgaagaagcttctagtctttatcctgacgtcaagtacaaacgcatggatgattacttaagaatgttcctctga

SEQ ID NO: 1876 - protein, 317 aa, Arabidopsis thaliana
MGESKRTEKTRVLVVGATGYIGKRIVRACLAEGHETYVLQRPEIGLEIEKVQLFLSFKKLGARIVEGSFSDHQSLVSAVKLVDVVVSAMSGVHFRSHNILVQLKLVEAIKEAGNVKRFLPSEFGMDPPRMGHALPPGRETFDQKMEVRQAIEAAGIPYTYVVGACFAAYFAGNLSQMVTLLPPKEKVNIYGDGNVKVVFADEDDIAKYTAKTLNDPRTLNKTVNIRPPDNVLTQLELVQIWEKLTGKELEKTNIAAQDFLANIEQMEIPHQAGIGHFYHIFYEGCLTDHEVGEDEEASSLYPDVKYKRMDDYLRMFL

SEQ ID NO: 1877 - DNA, 438 bp, Arabidopsis thaliana
atggctgaagaagctcaagtagatcgttctaatggctctgattcatcatctcctcccataaagttacctcctttcatcaccaacctattcgcctttcttcaacctaagcctcctcctgctactattgatgccaatgctcctaaacctaccggcgagaaggaacctctgaaatcgacctacgagactgtcactttcccttacaatccacccaaaagcgcagagccaatcaagtttgaggctgagcccagctctggcaggacttccaactctgtcatcctttggcaggtatatgcacttggagggtttcttgtcctgaagtgggcctgggcaagatggaatgaaaggaacgagagaagtgacaaaaaggaggcgacgggtgatgatgatcagaaagatgatgatgaggatgatcaatcatctgatgggcatgaagactag

SEQ ID NO: 1878 - protein, 145 aa, Arabidopsis thaliana
MAEEAQVDRSNGSDSSSPPIKLPPFITNLFAFLQPKPPPATIDANAPKPTGEKEPLKSTYETVTFPYNPPKSAEPIKFEAEPSSGRTSNSVILWQVYALGGFLVLKWAWARWNERNERSDKKEATGDDDQKDDDEDDQSSDGHED

SEQ ID NO: 1879 - DNA, 1245 bp, Arabidopsis thaliana
atggctgcttttggagatgacattgtgattgtagcggcatatcgtaccgccatttgcaaagcgagacgtggaggtttcaaagacactcttcctgatgatcttcttgcttctgttcttaaggctgtagtggaaagaacatctttggatccaagtgaagttggtgatatcgttgttggtaccgtgatagcgcctggttctcagagagcaatggagtgtagagttgcagcttattttgctggttttcctgactccgtgccagttagaactgtcaatagacaatgctcatcaggactacaagcagttgctgatgttgctgcttccattagagctggttattacgacattggtattggtgctggagtggaatcaatgtcaactgatcatattcctggaggcggctttcatggctctaatccaagagcacaggatttcccaaaagcccgtgattgtttgcttccaatgggaattacttctgaaaacgttgcagaaaggttcggtgtcacaagagaagagcaagatatggctgcggtggagtctcacaaacgcgctgcagctgcaatcgcgtctggtaaactcaaggatgaaatcattcctgttgctactaagattgtggaccctgagactaaagcagagaaggcaatcgtcgtatctgttgatgacggtgtacgtccaaactcaaacatggcagatttggcaaagctgaagactgtctttaaacagaacggttccaccacagctggcaatgctagtcagatcagtgatggtgctggagcagtactgctaatgaagagaagtttggctatgaagaagggacttcccattcttggagtattcaggagttttgctgttactggtgtggaaccatctgtaatgggtattggtccagctgttgccattcccgctgcaactaagctcgcagggctcaacgtcagcgatattgatctattcgagatcaatgaggcatttgcatctcagtatgtgtactcttgcaagaagttagagctggatatggaaaaggtcaatgttaatggaggagccattgctattggccatcccctgggtgctacaggagctcgatgtgttgcgacattgttgcacgagatgaagcggagaggaaaagattgccgctttggagtaatctcaatgtgcataggcactggaatgggagctgcagctgtttttgagaggggagactctgttgataacttgtccaacgctcgtgtggctaacggggatagtcattag

SEQ ID NO: 1880 - protein, 414 aa, Arabidopsis thaliana
MAAFGDDIVIVAAYRTAICKARRGGFKDTLPDDLLASVLKAVVERTSLDPSEVGDIVVGTVIAPGSQRAMECRVAAYFAGFPDSVPVRTVNRQCSSGLQAVADVAASIRAGYYDIGIGAGVESMSTDHIPGGGFHGSNPRAQDFPKARDCLLPMGITSENVAERFGVTREEQDMAAVESHKRAAAAIASGKLKDEIIPVATKIVDPETKAEKAIVVSVDDGVRPNSNMADLAKLKTVFKQNGSTTAGNASQISDGAGAVLLMKRSLAMKKGLPILGVFRSFAVTGVEPSVMGIGPAVAIPAATKLAGLNVSDIDLFEINEAFASQYVYSCKKLELDMEKVNVNGGAIAIGHPLGATGARCVATLLHEMKRRGKDCRFGVISMCIGTGMGAAAVFERGDSVDNLSNARVANGDSH

SEQ ID NO: 1881 - DNA, 894 bp, Arabidopsis thaliana
atggcttcaagttcaacttcattcccgttaaccaccgcgccaccgcagggtgtcaggtttaaccggagaaaaccgaggttaaccgtgtgggctaagcaaacggcgtttcaactcgggaaaacgaagggtgatgatgactcggaggggaaacaaaaagggaagaacccgttccagtttgatttcggtaagttaccggacatgaagtcactgataccggttgtgacgaatccttctaccggtttagtgtttggtaataacagaaagaaagatcctggtactatttttgtggctggtgctacgggacaagctggtatacgcatagctcaaacgctcttacaacgaggattcagtgttcgagccggtgttcctgaccttggagctgcccaggacctagctcgtgtcgcggctacttacaagattttatcaaatgatgaagtcaagaggctaaacgcagttcaatcccccttccaagacgctgaatcaatagcaaaagcgattggaaacgcaaccaaagttgttgttacggtcggggcaacagagaatggtccggacgcccaagtttcgacctcagacgcattgctcgtggtccaagcagctgagctagccggcgtaagccacgtggcgatagtctacgacggcaccatcagcgggtccacatacaacgtgctcgacgggattacttcgtttttcggcaatcttttcgcaaaatctcagccattgactatctctgacctcatcgagaaagtagctcaaaccgacgtggcctacacactcataaagacgagtttgacggaggatttctctccggagaaagcttataacgtcgtcgtttcagctgaagggagtaacagcggcagtggcagtagttcgtccgaggcctacaaagtaatgtaa

SEQ ID NO: 1882 - protein, 297 aa, Arabidopsis thaliana
MASSSTSFPLTTAPPQGVRFNRRKPRLTVWAKQTAFQLGKTKGDDDSEGKQKGKNPFQFDFGKLPDMKSLIPVVTNPSTGLVFGNNRKKDPGTIFVAGATGQAGIRIAQTLLQRGFSVRAGVPDLGAAQDLARVAATYKILSNDEVKRLNAVQSPFQDAESIAKAIGNATKVVVTVGATENGPDAQVSTSDALLVVQAAELAGVSHVAIVYDGTISGSTYNVLDGITSFFGNLFAKSQPLTISDLIEKVAQTDVAYTLIKTSLTEDFSPEKAYNVVVSAEGSNSGSGSSSSEAYKVM

SEQ ID NO: 1883 - DNA, 1938 bp, Arabidopsis thaliana
atggatactaatacatctggagaagaattattagctaaggcaagaaagccatatacaataacaaagcagcgagagcgatggactgaggatgagcatgagaggtttctagaagccttgaggctttatggaagagcttggcaacgaattgaagaacatattgggacaaagactgctgttcagatcagaagtcatgcacaaaagttcttcacaaagttggagaaagaggctgaagttaaaggcatccctgtttgccaagctttggacatagaaattccgcctcctcgtcctaaacgaaaacccaatactccttatcctcgaaagcctgggaacaacggtacatcttcctctcaagtatcatcagcaaaagatgcaaaacttgtttcatcggcctcttcttcacagttgaatcaggcgttcttggatttggaaaaaatgccgttctctgagaaaacatcaactggaaaagaaaatcaagatgagaattgctcgggtgtttctactgtgaacaagtatcccttaccaacgaaacaggtaagtggcgacattgaaacaagtaagacctcaactgtggacaacgcggttcaagatgttcccaagaagaacaaagacaaagatggtaacgatggtactactgtgcacagcatgcaaaactacccttggcatttccacgcagatattgtgaacgggaatatagcaaaatgccctcaaaatcatccctcaggtatggtatctcaagacttcatgtttcatcctatgagagaagaaactcacgggcacgcaaatcttcaagctacaacagcatctgctactactacagcttctcatcaagcgtttccagcttgtcattcacaggatgattaccgttcgtttctccagatatcatctactttctccaatcttattatgtcaactctcctacagaatcctgcagctcatgctgcagctacattcgctgcttcggtctggccttatgcgagtgtcgggaattctggtgattcatcaaccccaatgagctcttctcctccaagtataactgccattgccgctgctacagtagctgctgcaactgcttggtgggcttctcatggacttcttcctgtatgcgctccagctccaataacatgtgttccattctcaactgttgcagttccaactccagcaatgactgaaatggataccgttgaaaatactcaaccgtttgagaaacaaaacacagctctgcaagatcaaaacttggcttcgaaatctccagcttcatcatctgatgattcagatgagactggagtaaccaagctaaatgccgactcaaaaaccaatgatgataaaattgaggaggttgttgttactgccgctgtgcatgactcaaacactgcccagaagaaaaatcttgtggaccgctcatcctgtggctcaaatacaccttcagggagtgacgcagaaactgatgcattagataaaatggagaaagataaagaggatgtgaaggagacagatgagaatcagccagatgttattgagttaaataaccgtaagattaaaatgagagacaacaacagcaacaacaatgcaactactgattcgtggaaggaagtctccgaagagggtcgtatagcgtttcaggctctctttgcaagagaaagattgcctcaaagcttttcgcctcctcaagtggcagagaatgtgaatagaaaacaaagtgacacgtcaatgccattggctcctaatttcaaaagccaggattcttgtgctgcagaccaagaaggagtagtaatgatcggtgttggaacatgcaagagtcttaaaacgagacagacaggatttaagccatacaagagatgttcaatggaagtgaaagagagccaagttgggaacataaacaatcaaagtgatgaaaaagtctgcaaaaggcttcgattggaaggagaagcttctacatga

SEQ ID NO: 1884 - protein, 645 aa, Arabidopsis thaliana
MDTNTSGEELLAKARKPYTITKQRERWTEDEHERFLEALRLYGRAWQRIEEHIGTKTAVQIRSHAQKFFTKLEKEAEVKGIPVCQALDIEIPPPRPKRKPNTPYPRKPGNNGTSSSQVSSAKDAKLVSSASSSQLNQAFLDLEKMPFSEKTSTGKENQDENCSGVSTVNKYPLPTKQVSGDIETSKTSTVDNAVQDVPKKNKDKDGNDGTTVHSMQNYPWHFHADIVNGNIAKCPQNHPSGMVSQDFMFHPMREETHGHANLQATTASATTTASHQAFPACHSQDDYRSFLQISSTFSNLIMSTLLQNPAAHAAATFAASVWPYASVGNSGDSSTPMSSSPPSITAIAAATVAAATAWWASHGLLPVCAPAPITCVPFSTVAVPTPAMTEMDTVENTQPFEKQNTALQDQNLASKSPASSSDDSDETGVTKLNADSKTNDDKIEEVVVTAAVHDSNTAQKKNLVDRSSCGSNTPSGSDAETDALDKMEKDKEDVKETDENQPDVIELNNRKIKMRDNNSNNNATTDSWKEVSEEGRIAFQALFARERLPQSFSPPQVAENVNRKQSDTSMPLAPNFKSQDSCAADQEGVVMIGVGTCKSLKTRQTGFKPYKRCSMEVKESQVGNINNQSDEKVCKRLRLEGEAST

SEQ ID NO: 1885 - DNA, 6417 bp, Arabidopsis thaliana
atgcagttcaagtctgcttctcaacgaacaaatgacattgacaacatcagcaactataggaacttggataaggtgaaggctgagccttcagaaggatccacatttttcagggattgcctcatagaatggagggaactgaataccgcagaagatttcattttgttttatgaagagatgttgccatctgtccagagtttgagtttgattattatgcaaaaagaaagaatcttctcaaatcttgtctctcgattacaaatgaaagcaagattgtctctggaacccattctcaggttgattgctgctctatcaagagatctcttgaatgactttattcccttcttgccacaaattgtgaactccttcgtgactctcctaaataatggtgcgcataacgatccggagattattcagcaggttgttggtattcacatcatgggcttccataatagtgtccctgcagaagtatcttgtgtgcgacatcgaaggcattctcaggatgagcaacttgaaaaagtccccttgatacacagtctagttgattcttctaacctaaaaattacaggtatgaagatgatcctttctgaagttgcacatccatccaaaaaagctggaggagttggagtactatataatgttatgaggggcccttgtacagtcgtggaagttgtgagtttggttttgcagagaatatgcgaggatttggaagcagaaaaattaagtgctatgtgggaatacttgtataagaaaataaacaaatcaatctcaaacaagaaatcagttcatctaagccggctgttgagtgtgcttatggcggttgttaagattaaggaaggtcgcaaggttcacgatatcccatcactgattggaatcgtgagccgcattgtgtcaacttttttcacttcctctgagaccgctgtagaaggggataacttatctgctgtccttgatgaagttttggaattgatattatgcacaatcaacacggtcaatgaaatggaaactgttgcttcgctttgggctcccatttttgccttgaagagttcaagtttgctgacttttttgcgggagttcctaaagaaagatcaatcagtagtgaaagcctttacaaagaatatattatgtgcaattaacaacatgatttgggagtcttctgaggaagttattcctctgttactaacattgtgtgaagagcataagacacaacaaacaagtcacgacgtcgtgaacagcataagtcaaacatttgagagtagatacgagagaattcatgagttcttggaagcaaagattaaaaaggttcaacagaatattgagaatgctggattagctcaaattaatgaggccgagttggctgcaatttggggagttgtcaagtgttatccttattttaaagtggattcatcattattgatttgctttaagaaaactctcagacagcatttggcagtgtcagatggtaagtatcaactcatgattcactcttttttgcatagcttacttggtactactttgaggtcatgttacaaaatgacgggaatcaaccacagtgatctagaggaagctttgtcttttgctaaagattacaagtcatgtgagcaagtgttgtccccggtggccgatgttttggaatttatgcacaggctgattcatttccctattttgaatcgtaggcctgcattagctcatggtaggtctaagccttatccagaacttcaagcaaataaggctggagatgcttttgaaatattttctgaaaatttgcgtcatccgaacaaaaatatccgtcttatgactctgaggattttgtgccattttgaaactttgtcgtctgacccttcttttgaagagcatcctcctaagaagaaaatgaaaactgagaagaatgttcttcagttattactcttattcgaagagactgctcccacagtggatactagtcggatgttggcaggatacatttctacaatacaagataacctctccgctggcaggatacattcggcatatgtgaagcttgtattgaatgggatgttggggatattacatattagttatcgtcctttgtgtgttcaagcatctgagtgtcttgcggttcttgtgaggaaatatactggtgcagtgtggagtgattttgtttgttatttggggcagtgccaactaaaatttgaaaccctccatgatcatagtgagaatgcgaaccaaagtatgtcagagaggcatgcatgtaatttaaatctgaatggccgttttaatttgtttctctttccaccatctgctatcacgcctactgcaacggtatctgatgtggtatctcagttgctacagaccttacaaaaagcttcaagtgttgctcagtctcgggcttctgaaattctccctttgttgttaaaatttctgggatacaacagcgaaaatcctgggagtgtcggatcatataatggccgagtttgtaaaggagaggactggaagacggttcttgtacaatggttgacgttgctaaaattaatgaagaatcctaggttcctggatgataatgatgctgaaatccaaacgaatgttctagagtgccttctgttggcgaatgacttcttactcccacaccgccagcatttgttgaatttgatcaaaccaaaagaattgagagaagaactcacaacctggaacttgtccgaaaacatcggagaacctcacagatcttatattttttctcttgtaattcgcatccttatgccaaaagttaggacattaaaaaattcggcttcaaggaagcatacaagtatccgtcaccggaaggcagttctttgctttatatctcagctggatgttaatgaacttgcgttgttctttgcattgttgataaaacctttgaacatcatatcagaggaaacaatggactcattttggagttcaggcaaaagttctctcgactatttccaaaactccaattttctgaaatatttcactgttgatactatttcaacgttatccagaaatcagaaatttgggtttcttcatgtcatccaacatatccttgaagtctttgatgaacttcgtgtccgaccttttctagactttatgatgggatgtgttgtccggctattggtaaattatgctccaaatgttgatgaagaaatgaacattgattctttggcactaagaaatgtcactgctgccccatcaacttcggatgataaagaaaatgcttcaataaatcacgaccaggctggcactgcttttaagcagtttaaagagttgagatccttatgtctgaaaatcattgctcatgttcttgataaatacgaggattgtgatcttggctccgagttctgggacctcttcttttcagctgtgagtccgttaattaagagtttcaagcaggagggttctagtagtgagaaaccaagttccttgttctcatgcttcttgtcaatgagtaaaagccgtaatctcgtgaatctcttatgtcgggaagagtcccttgttccagacattttttcaattctaactgtcaccacggcttcagaagctataaagtcttctgccttgaagttcattgagaatctgctttgtcttgacaatgtgttgggtgaggatgaaaatatgatccgtggattcgtagatccgtatatagaagcactgattaacagcttgcattctcttttcattggggatattttgaaaaggaaatcagtcaagtatcatggggaaagagagattaaaattcttaaattattgtcaaagcgtatgcaagatcgctcccatgttatgaagtatttggatgtcttgctgtctttcttgaataaaagtgttaaagatcctggtatggtgtcattgcttttattgctaaatgatatccgtcgtgaagctttgctagccattcaggacatcatagcgtatcttgggatggagagtaccagcaagattataaatacagtctctcctctacttgttgatgctgaacttgatgttagattatgcatttgtgatcttcttgagtctcttgcaaaaatcgacttttcactggatgatgtgcgcacagaagctcttgtcttctttattgatttttcagcctcaatactttgccgagaagctccagctcactctgaatttggaaaagaggtcaaaaacgctgatgtaagctggacaggagatcgtgtactgtgcattttgagaaattttattttgaaacacattggagatgcaataaacagagggggcattataataaaggaatggattcttttgatacgcgagatggtgaccaaacttccagatgccgcaaatctttctgcattcagacctctatgctctgaagacgagaatgtagatttttttaaagctattgttcacattcaggcacaccgtagagctagggcaatttcacgtttcagtagtgtggttaaagatagcagtctgcctgagggagtagtgagaaaacttttggtctcggtctttttcaatatgttactcgaaggacaagatggaaaagataataatgtcagaaatgcatgcacagaagcccttgcatctatatctgctcatatgagttggacatcgtactatgctttactgaatcggtgtttccgagagatgaacaagcacaccaaaaaaggaaaaattctgctgcgacttatctgcttgattttggataaatttcattttgcaaaagatggctacccacatgaggctgaggaaattaggacttgccttcagaaaattgtgttcccgaggatgcagaagctgatgaattctgattctgataatgttaatgttaacagtagtgtggctgcgcttaaggttctaaagctactccctgaagatgtattggactcaaacctatcatctatagttcacaaaattgccagttttttaaagaaccggttggagagcacacgtgatgaagccagattggctctggttgcttgtttgaaagaacttgggctggagtacttgcaagttgtagtcaacattttacgtgctatcttaaaacgaggatctgaggtgcatgtgctggggtacactctcaattctatcttatcaaagtgcttgtccaatcctacatgtgggaagttagatcattgtttggttgatctccttgctgtggtggaaaccgatatccttggagaggttgctgaacagaaagaggtggaaaaatttgcatccaaaatgaaagaaacaagaaaacggaagtcatttgagactctgaaattgattgctgaaaatgtaacgttcagaagccatggattaaagttactttctccggtcactgctcagctgcagcggcatctaactccaaagatcaaaacaaatctggagaagatgttaaaacaaattgcagctggtattgaaggcaatacatctgttgaccaaggagatctttttctttttatatatggcctagttgatgatggtattaataacaggagtggtcttggagatcaagtgtctttaccaccctccaaaaagaagaagaaatcaagagatctgaaagagacttctgggttgtgttttggtccgaagtcatgtccacatcttataaccgtgtttgctctggacttattttataaccgaatgaaaaaattgagactcgacaacactgatgaagagctactgtcgaaatgttttacttcattagtaaagtttccactgccttccctcacgtctgaagcagatgaactgaaaacagcattgttaaccattgctcagtctgcagttagttccagcagtcctcttgtgcagtcatgccttaagctgcttacaacgcttctcaaaaatataaatataactttatcatctgagcagttgaaaatgttgattcagttccccatatttattgatctggagtctgattcatcctttgttactctttcacttctcaaggccatcatgaaccggaagcttgtagttccagagatatatgacattgcaattcaggtttcaaagctgatggtaaatagtcagttggaatcaatccgcaagaaatgtaaacatatactgttgcaatttatggtccactatacactttctgaaaaacgtttagagcaacatgtgaactttctgctggaaaatctgaggtatgagtttccaactggaagagaagcagttcttgacatgcttcatgccctaatcttaaaattctcagaacctaatcttggcaagcagtctgttcttgaccagcagtcgcaaaaattgtttattcaacttactgtctgtttgtccaatgaaactgatagaaaagtgctgcccttggttggtgctgtgatagaagttctgataggccgcatgagtaaagatcaagttgattccagtctcttgtactgtttgtgttggtataagcagcagaacttaagtgctgcggcggcacaggtaaatgctgtgggtgtatattcattaaactcatttcgtgacaatagttag

SEQ ID NO: 1886 - protein, 2138 aa, Arabidopsis thaliana
MQFKSASQRTNDIDNISNYRNLDKVKAEPSEGSTFFRDCLIEWRELNTAEDFILFYEEMLPSVQSLSLIIMQKERIFSNLVSRLQMKARLSLEPILRLIAALSRDLLNDFIPFLPQIVNSFVTLLNNGAHNDPEIIQQVVGIHIMGFHNSVPAEVSCVRHRRHSQDEQLEKVPLIHSLVDSSNLKITGMKMILSEVAHPSKKAGGVGVLYNVMRGPCTVVEVVSLVLQRICEDLEAEKLSAMWEYLYKKINKSISNKKSVHLSRLLSVLMAVVKIKEGRKVHDIPSLIGIVSRIVSTFFTSSETAVEGDNLSAVLDEVLELILCTINTVNEMETVASLWAPIFALKSSSLLTFLREFLKKDQSVVKAFTKNILCAINNMIWESSEEVIPLLLTLCEEHKTQQTSHDVVNSISQTFESRYERIHEFLEAKIKKVQQNIENAGLAQINEAELAAIWGVVKCYPYFKVDSSLLICFKKTLRQHLAVSDGKYQLMIHSFLHSLLGTTLRSCYKMTGINHSDLEEALSFAKDYKSCEQVLSPVADVLEFMHRLIHFPILNRRPALAHGRSKPYPELQANKAGDAFEIFSENLRHPNKNIRLMTLRILCHFETLSSDPSFEEHPPKKKMKTEKNVLQLLLLFEETAPTVDTSRMLAGYISTIQDNLSAGRIHSAYVKLVLNGMLGILHISYRPLCVQASECLAVLVRKYTGAVWSDFVCYLGQCQLKFETLHDHSENANQSMSERHACNLNLNGRFNLFLFPPSAITPTATVSDVVSQLLQTLQKASSVAQSRASEILPLLLKFLGYNSENPGSVGSYNGRVCKGEDWKTVLVQWLTLLKLMKNPRFLDDNDAEIQTNVLECLLLANDFLLPHRQHLLNLIKPKELREELTTWNLSENIGEPHRSYIFSLVIRILMPKVRTLKNSASRKHTSIRHRKAVLCFISQLDVNELALFFALLIKPLNIISEETMDSFWSSGKSSLDYFQNSNFLKYFTVDTISTLSRNQKFGFLHVIQHILEVFDELRVRPFLDFMMGCVVRLLVNYAPNVDEEMNIDSLALRNVTAAPSTSDDKENASINHDQAGTAFKQFKELRSLCLKIIAHVLDKYEDCDLGSEFWDLFFSAVSPLIKSFKQEGSSSEKPSSLFSCFLSMSKSRNLVNLLCREESLVPDIFSILTVTTASEAIKSSALKFIENLLCLDNVLGEDENMIRGFVDPYIEALINSLHSLFIGDILKRKSVKYHGEREIKILKLLSKRMQDRSHVMKYLDVLLSFLNKSVKDPGMVSLLLLLNDIRREALLAIQDIIAYLGMESTSKIINTVSPLLVDAELDVRLCICDLLESLAKIDFSLDDVRTEALVFFIDFSASILCREAPAHSEFGKEVKNADVSWTGDRVLCILRNFILKHIGDAINRGGIIIKEWILLIREMVTKLPDAANLSAFRPLCSEDENVDFFKAIVHIQAHRRARAISRFSSVVKDSSLPEGVVRKLLVSVFFNMLLEGQDGKDNNVRNACTEALASISAHMSWTSYYALLNRCFREMNKHTKKGKILLRLICLILDKFHFAKDGYPHEAEEIRTCLQKIVFPRMQKLMNSDSDNVNVNSSVAALKVLKLLPEDVLDSNLSSIVHKIASFLKNRLESTRDEARLALVACLKELGLEYLQVVVNILRAILKRGSEVHVLGYTLNSILSKCLSNPTCGKLDHCLVDLLAVVETDILGEVAEQKEVEKFASKMKETRKRKSFETLKLIAENVTFRSHGLKLLSPVTAQLQRHLTPKIKTNLEKMLKQIAAGIEGNTSVDQGDLFLFIYGLVDDGINNRSGLGDQVSLPPSKKKKKSRDLKETSGLCFGPKSCPHLITVFALDLFYNRMKKLRLDNTDEELLSKCFTSLVKFPLPSLTSEADELKTALLTIAQSAVSSSSPLVQSCLKLLTTLLKNINITLSSEQLKMLIQFPIFIDLESDSSFVTLSLLKAIMNRKLVVPEIYDIAIQVSKLMVNSQLESIRKKCKHILLQFMVHYTLSEKRLEQHVNFLLENLRYEFPTGREAVLDMLHALILKFSEPNLGKQSVLDQQSQKLFIQLTVCLSNETDRKVLPLVGAVIEVLIGRMSKDQVDSSLLYCLCWYKQQNLSAAAAQVNAVGVYSLNSFRDNS

SEQ ID NO: 1887 - DNA, 894 bp, Arabidopsis thaliana; identical to SEQ ID NO: 1881

SEQ ID NO: 1888 - protein, 297 aa, Arabidopsis thaliana; identical to SEQ ID NO: 1882

SEQ ID NO: 1889 - DNA, 1008 bp, Arabidopsis thaliana
atggctttctccactagaggctccctcttattcttcttcactacacttgttcttctctccacccaaatccatgcaagagacagttacttctttggaaaattccacagagaatcccccaaagatcaaaaccctaacagtttcatccctcttgagactagcgagaaaaccacagtagaagaatccgtcctcaacaagaaagagcaagaacaagatcctacctttgtccccgagtccggaaacgggtatggcttgtatggtcacgagaccacatacaacaacaacaacgacaacaaagaagagttcaacaacaacaacaagaacgatgaaaaagtcaacagcaagactttctccactccaagcctgagcgagaccgaagagtctttcaacaactacgaggaaaattacccgaagaagacagagaactacggcactaaaggttataacaatgaggagttcaacaacaacaacaacaagtacgatgcaaacttcaaggaagagttcaacaacaacaagtacgatgaaaattacgccaaggaagagttcaacaacaacaacaacaacaacaactacaactacaagtacgatgaaaacgttaaggaagagtctttccccgagaacaatgaagacaacaagaaaaacgtctacaactctaacgcttacgggacagagttagaacgtgaaacaccgtacaaaggttacagccacaacttggagagacaaggcatgagtgacacaaggttcatggagaaaggtagctactactacgacctttacaacgacagaaaccacggccattactaccggaagtcacacagtaaaagccccgccggttactattcttctcccgcgaccgagactaactacgaacagcaatcgtactcgtacggaaacaacaacgaggagaacagttttaaggatccgtacaactccaagtgggagaagaacttgatgaacgaacagcctgaagagtttgttgaggagcaaggcactaatcagttcaagccttga

SEQ ID NO: 1890 - protein, 335 aa, Arabidopsis thaliana
MAFSTRGSLLFFFTTLVLLSTQIHARDSYFFGKFHRESPKDQNPNSFIPLETSEKTTVEESVLNKKEQEQDPTFVPESGNGYGLYGHETTYNNNNDNKEEFNNNNKNDEKVNSKTFSTPSLSETEESFNNYEENYPKKTENYGTKGYNNEEFNNNNNKYDANFKEEFNNNKYDENYAKEEFNNNNNNNNYNYKYDENVKEESFPENNEDNKKNVYNSNAYGTELERETPYKGYSHNLERQGMSDTRFMEKGSYYYDLYNDRNHGHYYRKSHSKSPAGYYSSPATETNYEQQSYSYGNNNEENSFKDPYNSKWEKNLMNEQPEEFVEEQGTNQFKP

SEQ ID NO: 1891 - DNA, 726 bp, Arabidopsis thaliana
atggcaactaaacaagaagctttagccatcgatttcataagccaacaccttctcacagactttgtttccatggaaactgatcacccatctctttttaccaaccaacttcacaactttcactcagaaacaggccctagaaccatcaccaaccaatcccctaaaccgaattcgactcttaaccagcgtaaaccgcccttaccgaatctatccgtctcgagaacggtttcaacaaagacagagaaagaggaagaagagaggcactacaggggagtgagacgaagaccgtggggaaaatacgcggcggagattagggatccgaacaaaaagggttgtaggatctggcttgggacttacgacactgccgtggaagctggaagagcttatgaccaagcggcgtttcaattacgtggaagaaaagcaatcttgaatttccctctcgatgttagggttacgtcagaaacttgttctggggaaggagttatcggattagggaaacgaaagcgagataagggttctccgccggaagaggagaaggcggctagggttaaagtggaggaagaagagagtaatacgtcggagacgacggaggctgaggttgagccggtggtaccattgacgccgtcaagttggatggggttttgggatgtgggagcaggagatggtattttcagtattcctccgttatctccgacgtctcccaacttttccgttatctccgtcacttaa

SEQ ID NO: 1892 - protein, 241 aa, Arabidopsis thaliana
MATKQEALAIDFISQHLLTDFVSMETDHPSLFTNQLHNFHSETGPRTITNQSPKPNSTLNQRKPPLPNLSVSRTVSTKTEKEEEERHYRGVRRRPWGKYAAEIRDPNKKGCRIWLGTYDTAVEAGRAYDQAAFQLRGRKAILNFPLDVRVTSETCSGEGVIGLGKRKRDKGSPPEEEKAARVKVEEEESNTSETTEAEVEPVVPLTPSSWMGFWDVGAGDGIFSIPPLSPTSPNFSVISVT

SEQ ID NO: 1893 - DNA, 1152 bp, Arabidopsis thaliana
atggtagcagaagcagaggttgtgtttcaacagagtttaccggcggttctggagattgagttgtttgacggagtttcctccgccgttaaatctcccgtttcttctccgaaattgggttttactcagtcaacggcgtcggtttccggaagtttaacgacttctcctgtggctgatatctttccagagggtgattgcgatcctagtgtcttggattatattccgaccatccggtctggaagctttgctgatattgggccaaagagaaacatggaagatgaacacattcgcatagacgatttatcttctcaagttggttccctttttgagttgccgaagcctagtgctttctatgcggtttttgacgggcatggaggaccagaagcagcagcatacgtacgggaaaatgccattaggtttttctttgaagatgagcagtttccacagacatcggaagtgagtagtgtttatgtggaagaagttgagacttcattgagaaatgcgtttcttcaagctgatctagctttggcagaggattgcagtatcagcgattcttgtggtaccaccgctctgactgctcttatttgtggaagactcttaatggttgcaaatgccggagactgcagagcggttctatgcaggaaaggcagagcgatagacatgtctgaagaccataaaccgattaatctacttgagagaagaagagtggaggaatccggcggtttcatcactaatgacggttacctaaatgaagtcctagctgtaacccgagctctgggcgactgggatttaaaactgccacacggctctcaatctccactgatctcggaaccagaaatcaagcagataactctaactgaagacgatgagtttcttgtgattgggtgcgatgggatttgggatgtcttgacgagccaagaagcggttagcattgttaggcgtggcttaaaccggcacaacgatccaacaagatgtgcgcgagagctagtgatggaggctctggggcggaactcatttgataatttaactgcggtggtggtatgtttcatgacaatggacagaggggacaagccggtggtgccattggagaagagaaggtgttttagtctttcgcctgaagctttctgtagcttgaggaatctgttggatggctga

SEQ ID NO: 1894 - protein, 383 aa, Arabidopsis thaliana
MVAEAEVVFQQSLPAVLEIELFDGVSSAVKSPVSSPKLGFTQSTASVSGSLTTSPVADIFPEGDCDPSVLDYIPTIRSGSFADIGPKRNMEDEHIRIDDLSSQVGSLFELPKPSAFYAVFDGHGGPEAAAYVRENAIRFFFEDEQFPQTSEVSSVYVEEVETSLRNAFLQADLALAEDCSISDSCGTTALTALICGRLLMVANAGDCRAVLCRKGRAIDMSEDHKPINLLERRRVEESGGFITNDGYLNEVLAVTRALGDWDLKLPHGSQSPLISEPEIKQITLTEDDEFLVIGCDGIWDVLTSQEAVSIVRRGLNRHNDPTRCARELVMEALGRNSFDNLTAVVVCFMTMDRGDKPVVPLEKRRCFSLSPEAFCSLRNLLDG

SEQ ID NO: 1895 - DNA, 948 bp, Arabidopsis thaliana
atgatgatcggcgaaaataaaaaccggccacatccaacgatccatatccctcaatgggatcaaatcaacgatccaacggccacaatctcttcaccattctcttccgtcaaccttaacagcgttaacgactacccacactctccgtcaccgtatctcgactccttcgcttctctcttccgttacctcccgtcaaacgagttaacaaacgattcagactcatcaagtggcgacgagtcatcaccactcaccgactcattctcctccgacgagtttcgcatctacgagttcaaaatccggcgatgcgctcgaggtcgatctcatgattggacggagtgtccgttcgcacatcccggagaaaaagctcgacgacgtgatccgagaaagtttcattactccggcaccgcttgtcctgagtttcgtaaaggaagttgtagaagaggtgattcgtgtgagttctctcatggagttttcgagtgttggctccatccttctcgttaccgtactcagccgtgtaaagacggaactagctgccggagaagaatctgtttcttcgctcatacgacggagcagttacgtgtattaccttgttcgttagatccagatcttggattcttctcaggattagctacttctccgacttcgattcttgtttctccttcgttttcaccaccgtcggaatctccgccgctttctccgagtaccggtgaacttattgcgtcgatgaggaaaatgcaattgaacggaggtggttgttcgtggagttctccgatgagatctgcagttaggttacctttttcgtcgtctctgcgtccgattcaggcggcaacgtggccgaggataagagagtttgagatcgaagaagctccggcgatggaatttgtggaatctgggaaagagctgagagcggagatgtatgcaagactcagtagagagaactcactcggttga

SEQ ID NO: 1896 - protein, 315 aa, Arabidopsis thaliana
MMIGENKNRPHPTIHIPQWDQINDPTATISSPFSSVNLNSVNDYPHSPSPYLDSFASLFRYLPSNELTNDSDSSSGDESSPLTDSFSSDEFRIYEFKIRRCARGRSHDWTECPFAHPGEKARRRDPRKFHYSGTACPEFRKGSCRRGDSCEFSHGVFECWLHPSRYRTQPCKDGTSCRRRICFFAHTTEQLRVLPCSLDPDLGFFSGLATSPTSILVSPSFSPPSESPPLSPSTGELIASMRKMQLNGGGCSWSSPMRSAVRLPFSSSLRPIQAATWPRIREFEIEEAPAMEFVESGKELRAEMYARLSRENSLG

SEQ ID NO: 1897 - DNA, 447 bp, Arabidopsis thaliana
atggcttcgaaacggatcttgaaggagctgaaggatctccagaaagaccctccaacctcctgcagtgcaggtccagttgctgaagacatgtttcattggcaagctacaattatgggtcctgcagagagtccgtattcaggcggtgtgtttctcgttaccattcacttccctccggactatccattcaaaccaccaaaggttgcatttaggacgaaggtgtttcaccctaatatcaacagcaacggaagcatttgccttgacattttgaaagaacaatggagccctgccctcaccatttccaaggtgttgctctcgatatgttcgctgttaacagatccaaatccagatgaccctttggtaccagagattgcacacatgtacaaaaccgacagagccaaatacgaggctactgcaagaaactggactcagaagtatgccatgggctaa

SEQ ID NO: 1898 - protein, 148 aa, Arabidopsis thaliana
MASKRILKELKDLQKDPPTSCSAGPVAEDMFHWQATIMGPAESPYSGGVFLVTIHFPPDYPFKPPKVAFRTKVFHPNINSNGSICLDILKEQWSPALTISKVLLSICSLLTDPNPDDPLVPEIAHMYKTDRAKYEATARNWTQKYAMG

SEQ ID NO: 1899 - DNA, 1065 bp, Arabidopsis thaliana
atggagtttcgtggagatgccaaccagaggattgctaggatttcagctcatctcactcctcagatggaggccaagaactctgtaatcggacgggaaaactgcagagctaaaggtggtaatccaggattcaaagtagcaattcttggagctgcaggtggaattggacaatctttatctttgctgatgaagatgaaccctcttgtctctttacttcatctctacgatgttgtcaatgctcctggcgtcactgctgacgtcagtcatatggacactggagctgttgtccgcgggttcttgggagcgaagcagcttgaggacgcgctaacgggtatggatcttgtgatcataccagccggtataccgaggaaaccagggatgacccgcgatgatctgtttaaaatcaatgctgggattgttaaaacactatgtgaaggtgtagcaaaatgttgtcctaatgctattgtcaacttgatcagcaaccctgtgaactctactgtccccattgccgctgaggttttcaagaaagctggaacttatgatcctaagaagctccttggagttactacactcgatgttgctcgtgccaacacatttgtggcagaagttcttggccttgatccaagagaagtcgatgtgccagtagttgggggacacgccggagtcacaatcttgccactactgtcacaggttaaacctcctagcagcttcacacctcaagaaattgagtacctgacaaaccggattcaaaatggtggaactgaagttgtggaggcaaaagctggagctggttctgcaacactttcaatggcatatgctgcagccaagtttgcagatgcttgccttcgcgggttaagaggagatgcgaatgtcgtagaatgctcttttgttgcttcacaggtgacagaattagctttctttgcaacaaaagtgcgccttggccgtacaggagcagaggaagtgtatcagcttggacccttaaacgaatacgaaaggattggtctggagaaagcaaaagatgaattagccggaagtattcagaaaggtgttgaattcatcagaaaatga

SEQ ID NO: 1900 - protein, 354 aa, Arabidopsis thaliana
MEFRGDANQRIARISAHLTPQMEAKNSVIGRENCRAKGGNPGFKVAILGAAGGIGQSLSLLMKMNPLVSLLHLYDVVNAPGVTADVSHMDTGAVVRGFLGAKQLEDALTGMDLVIIPAGIPRKPGMTRDDLFKINAGIVKTLCEGVAKCCPNAIVNLISNPVNSTVPIAAEVFKKAGTYDPKKLLGVTTLDVARANTFVAEVLGLDPREVDVPVVGGHAGVTILPLLSQVKPPSSFTPQEIEYLTNRIQNGGTEVVEAKAGAGSATLSMAYAAAKFADACLRGLRGDANVVECSFVASQVTELAFFATKVRLGRTGAEEVYQLGPLNEYERIGLEKAKDELAGSIQKGVEFIRK

SEQ ID NO: 1901 - DNA, 1191 bp, Arabidopsis thaliana
atggcttcggttactttctctgtccccaagggtttcactgaattctcaggattgcgaagctcctctgcttctcttcccttcggcaagaaactttcttccgatgagttcgtttccatcgtctccttccagacttctgcaatgggaagcagtggtggatacaggaaaggtgtgactgaggccaagcttaaggtggccattaatggattcggtaggatcgggaggaacttcctgagatgttggcatggtcgcaaggactctcctcttgatatcattgccattaatgacactggtggcgtcaagcaggcttcgcatttacttaaatacgactctactctcggaatctttgatgctgatgtcaaaccttctggagagactgcaatctctgttgatggaaagatcatccaagttgtctctaaccgaaacccgtctcttctcccttggaaggagctaggaattgacattgtcatcgaaggaaccggagtgtttgtggatagagaaggtgcagggaaacacattgaagctggtgccaagaaggttatcattactgctccaggcaaaggagatattccaacttatgtcgttggtgtcaatgcagatgcttacagtcatgatgaacctatcatcagcaatgcatcttgcactaccaactgtcttgctccctttgtcaaagttcttgaccagaaattcggtatcataaagggtacaatgacgactactcactcttacaccggtgaccagaggttgctagacgcgagtcaccgtgatctaaggagagcaagagcagctgctttgaacattgttcctacttctacaggagcagctaaagctgtggctcttgtgctccctaacctcaaaggaaaactcaacgggatcgctctccgtgtaccaacaccaaacgtatcagtggttgatctcgttgtgcaggtctcaaagaagacatttgctgaggaagtcaacgctgctttcagagattctgcagagaaagagcttaaaggtatactcgatgtctgcgatgagccactagtgtccgttgatttcagatgctcagatttttcaacgaccattgattcatcactcactatggttatgggagatgatatggttaaggtgattgcttggtatgataatgaatggggttactcacagagagttgttgacttggctgacattgttgccaacaactggaagtga

SEQ ID NO: 1902 - protein, 396 aa, Arabidopsis thaliana
MASVTFSVPKGFTEFSGLRSSSASLPFGKKLSSDEFVSIVSFQTSAMGSSGGYRKGVTEAKLKVAINGFGRIGRNFLRCWHGRKDSPLDIIAINDTGGVKQASHLLKYDSTLGIFDADVKPSGETAISVDGKIIQVVSNRNPSLLPWKELGIDIVIEGTGVFVDREGAGKHIEAGAKKVIITAPGKGDIPTYVVGVNADAYSHDEPIISNASCTTNCLAPFVKVLDQKFGIIKGTMTTTHSYTGDQRLLDASHRDLRRARAAALNIVPTSTGAAKAVALVLPNLKGKLNGIALRVPTPNVSVVDLVVQVSKKTFAEEVNAAFRDSAEKELKGILDVCDEPLVSVDFRCSDFSTTIDSSLTMVMGDDMVKVIAWYDNEWGYSQRVVDLADIVANNWK

SEQ ID NO: 1903 - DNA, 1065 bp, Arabidopsis thaliana; identical to SEQ ID NO: 1899

SEQ ID NO: 1904 - protein, 354 aa, Arabidopsis thaliana; identical to SEQ ID NO: 1900

SEQ ID NO: 1905 - DNA, 1182 bp, Arabidopsis thaliana
atggagaccagcatcgcgtgctactcacgtgggatccttcccccaagtgtctcttctcaacgatcctctacattggtctctcctccttcctactccacatcctccagcttcaagcgtctaaaatcgagctcaatcttcggagattcactacgattagcaccaaaatcgcaacttaaagccacaaaagctaagagcaatggtgcttcaactgtgaccaaatgtgaaattggccaaagcttggaagagtttttggcacaagcaactcctgacaagggattgagaactttgctgatgtgtatgggagaagcattgagaacaatagcttttaaagttagaacagcttcttgcggtggaacagcttgtgttaattcctttggtgatgaacaactcgctgttgatatgcttgctgataagcttctctttgaggctttgcaatactcgcatgtgtgcaagtatgcttgctctgaagaagtacctgagcttcaagacatgggaggtccagtggaaggtgggtttagtgttgcgtttgatccattggatggatcaagcattgtggatacaaatttcactgtgggaaccatattcggtgtttggcctggagacaagttaaccggaatcactggaggagatcaagtggctgcagccatgggaatctacggtccacgaaccacttatgttttggctgttaagggctttccaggaactcatgagttcttgcttcttgatgaagggaaatggcagcatgtaaaggagacaacagagatcgcagaagggaaaatgttctcaccaggaaacttaagagccacattcgacaactccgaatacagcaagctgattgattactacgtgaaagagaaatacacactgcgatacaccggaggaatggttcctgatgttaaccagattattgtgaaggagaaaggaatcttcacaaatgtgacttctcctacggctaaggcaaagttgaggctgttgtttgaagtggctcctcttggcctgctcatagagaatgctggtggattcagcagtgatggacacaagtccgtgcttgacaagaccatcatcaacctcgacgatagaactcaagttgcttatggctcaaagaacgagatcatccgcttcgaagaaaccctttatggaacatcaagactcaagaatgttcccattggagttaccgcttag

SEQ ID NO: 1906 - protein, 393 aa, Arabidopsis thaliana
METSIACYSRGILPPSVSSQRSSTLVSPPSYSTSSSFKRLKSSSIFGDSLRLAPKSQLKATKAKSNGASTVTKCEIGQSLEEFLAQATPDKGLRTLLMCMGEALRTIAFKVRTASCGGTACVNSFGDEQLAVDMLADKLLFEALQYSHVCKYACSEEVPELQDMGGPVEGGFSVAFDPLDGSSIVDTNFTVGTIFGVWPGDKLTGITGGDQVAAAMGIYGPRTTYVLAVKGFPGTHEFLLLDEGKWQHVKETTEIAEGKMFSPGNLRATFDNSEYSKLIDYYVKEKYTLRYTGGMVPDVNQIIVKEKGIFTNVTSPTAKAKLRLLFEVAPLGLLIENAGGFSSDGHKSVLDKTIINLDDRTQVAYGSKNEIIRFEETLYGTSRLKNVPIGVTA

SEQ ID NO: 1907 - DNA, 1020 bp, Arabidopsis thaliana
atgaagactaagaacgtgaaactcttattcttcttcttctccgtctccctccttctcatcgccgtcgtcaacgccgccgaaggccattcacatggtggaccaaaatgtgaatgctcacacgaagacgaccatgaaaacaaagccggagctcggaaatacaagatcgccgcaattcctacagttctaatagccggcataatcggagttcttttccctttgttaggcaaagtcttcccttctttgcgtccagaaacatgtttcttcttcgtcacgaaagctttcgcagccggagttatcttggctaccggatttatgcatgtcttgcctgaggcttacgagatgcttaactctccatgtttgacatctgaagcatgggaatttccgttcaccggatttattgcgatgattgctgcgatcttgacgttatccgttgatacatttgccacttcgagtttctataaatcgcattgcaaagcgtctaagagggtcagtgatggagaaaccggcgagtcctccgttgactccgagaaggtccaaattctccggactagagttattgcacaggtattggagttgggaataatagtacactcagtggtaataggaatatcactaggagcttcacagagcccagatgctgcaaaagctctgtttattgccttaatgtttcatcaatgcttcgaaggtctaggccttggtggttgtattgctcagggaaaattcaagtgtttgtcagtaacaatcatgtcgacgttcttcgcaataacgacaccgataggaatcgttgtgggaatgggaatagcaaattcttacgatgagtcttcaccaacggctctgatcgttcaaggagttttgaacgctgcatccgcaggcattctcatctacatgtctttggttgaccttctcgcagcagatttcacgcaccctaaaatgcaatccaatactgggcttcaaattatggcccatattgctctccttcttggtgctggcctcatgtctctattggctaaatgggcttga

SEQ ID NO: 1908 - protein, 339 aa, Arabidopsis thaliana
MKTKNVKLLFFFFSVSLLLIAVVNAAEGHSHGGPKCECSHEDDHENKAGARKYKIAAIPTVLIAGIIGVLFPLLGKVFPSLRPETCFFFVTKAFAAGVILATGFMHVLPEAYEMLNSPCLTSEAWEFPFTGFIAMIAAILTLSVDTFATSSFYKSHCKASKRVSDGETGESSVDSEKVQILRTRVIAQVLELGIIVHSVVIGISLGASQSPDAAKALFIALMFHQCFEGLGLGGCIAQGKFKCLSVTIMSTFFAITTPIGIVVGMGIANSYDESSPTALIVQGVLNAASAGILIYMSLVDLLAADFTHPKMQSNTGLQIMAHIALLLGAGLMSLLAKWA

SEQ ID NO: 1909 - DNA, 666 bp, Arabidopsis thaliana
atgaagagtctctcatttcttgcagtgctctctctcttggctttaacacttccattagccattgcttctgatccaagccaacttcaagacttttgtgtcagcgccaacacctcagccaatggcgtttttgttaatggaaagttctgcaaggacccaaagctggtcacagcagatgacttctttttctcagggcttcaaactgcaagacccattactagtcccgttgggtcgaccgtgacagccgtcaatgttaacaaccttcttggattaaacactcttggaatctcccttgtccgtattgattatgcggttaacggacagaacccacctcacacccacccacgtgccacagagatcttggttgtcgaacaaggaacacttctcgtagggtttgtcacatcaaacccggataatcgcctattctcaaaagttctcaacgagggtgatgtatttgtgtttcccgagggactcatccattttcaagcaaacattggcaaggcaccagcggttgcattcgccgctctaagcagccaaaaccctggtgtcatcactattgccaacaccgtgtttggggctaacccagccataaacccaactattcttgcaaaggcattccagttgaacccaagggttgtcatggatctacagaccaagttcaagaaataa

SEQ ID NO: 1910 - protein, 221 aa, Arabidopsis thaliana
MKSLSFLAVLSLLALTLPLAIASDPSQLQDFCVSANTSANGVFVNGKFCKDPKLVTADDFFFSGLQTARPITSPVGSTVTAVNVNNLLGLNTLGISLVRIDYAVNGQNPPHTHPRATEILVVEQGTLLVGFVTSNPDNRLFSKVLNEGDVFVFPEGLIHFQANIGKAPAVAFAALSSQNPGVITIANTVFGANPAINPTILAKAFQLNPRVVMDLQTKFKK

SEQ ID NO: 1911 - DNA, 1182 bp, Arabidopsis thaliana
atgcgttcactgcttcaccgtactatcttactcacatctccgtctcattctcttatccggcgcacttctctctccgccatggccaccaccgcctcctcttccttgctcctcccttccatatctctcaacaatctctcctcctctaaaaatgcctcctttggcttcgccgccaagaatctcagccgatctaggatttctatgagcgtctctgctggatctcagagtactactgttcacgattctctgttcgctgattacaaacccacctctgcttttctctttcccggtcagggagctcaagcagtaggaatgggaaaagagtctcagagtgttggagcagctggagagttgtataagaaagctaatgatatcttagggtatgatcttttggatatttgtgttaatggaccaaaagagaagcttgattctacggtcataagccagcctgctatttatgtcacaagtttagcagcagttgaattgctccgtgttcgtgaaggcggagaacaaataattaactcggttgatgtgacttgcggtctcagtttgggagagtatactgctctggcttttgctggagccttcagcttcgaggacgggctgaagcttgtaaaacttagaggagaagctatgcaggctgctgcagatgctgctaagagtgccatggttagtatcatagggttggactcagaaaaggttcagcagttgtgtgatgcagcaaatcaagaagtagatgaagctgacaaagttcagatcgcaaattacttatgtccgggtaattacgcagtatctggaggtcttaaaggaatcgaagttgttgaagccaaagctaagtcattcaaagcacgaatgacggtgcgtctagctgttgcaggtgctttccacactagtttcatggaaccagcagtctcgagattagaagctgcattggcagccacagagatcagaagtccgaggatcccagtgatctcgaatgtcgatgcacagcctcatgcagatccagacacgatcaagaagatacttgcacgccaggtgacatctccagtccaatgggagacaacagtaaagactctcttatccaaaggacttaaaagcagctacgaattgggacctggaaaggtaattgcagggatattcaagagagtagataaaagcgcaagtttcgaaaacatcagtgcttga

SEQ ID NO: 1912 - protein, 393 aa, Arabidopsis thaliana
MRSLLHRTILLTSPSHSLIRRTSLSAMATTASSSLLLPSISLNNLSSSKNASFGFAAKNLSRSRISMSVSAGSQSTTVHDSLFADYKPTSAFLFPGQGAQAVGMGKESQSVGAAGELYKKANDILGYDLLDICVNGPKEKLDSTVISQPAIYVTSLAAVELLRVREGGEQIINSVDVTCGLSLGEYTALAFAGAFSFEDGLKLVKLRGEAMQAAADAAKSAMVSIIGLDSEKVQQLCDAANQEVDEADKVQIANYLCPGNYAVSGGLKGIEVVEAKAKSFKARMTVRLAVAGAFHTSFMEPAVSRLEAALAATEIRSPRIPVISNVDAQPHADPDTIKKILARQVTSPVQWETTVKTLLSKGLKSSYELGPGKVIAGIFKRVDKSASFENISA

SEQ ID NO: 1913 - DNA, 858 bp, Arabidopsis thaliana
atggccgccgttagtagttcgtcggagaccggagactgcggcgttacgggaaagagagatgagatcatgttgttcggagttagagtcgtggttgatccgatgagaaagtgtgtgagtttgaacaatctctctgattatgaaaagtcttctccggaggatgagatccctaagatagtcaccgccggagctggagatggtgaagataagaacgaaacggatgcgacggtgattgtcgctgacggttacgcctccgccaatgacgctgtccagatttcgtcttcttccggcgggaggaaacgaggggttccatggacagagaacgagcataagaggttcttgattgggttgcagaaagtaggaaaaggagattggaaaggaatatcaagaaactttgtgaagagtaggactcctactcaagtagctagtcatgctcagaaatacttcctccgacgaaccaacctcaaccgtcgccgaagaagatctagcctttttgatatcactactgagacggttacagaaatggccatggagcaagatcctactcaggagaactcaccactacctgaaaccaacatcagctctggacagcaagcgatgcaagtttttactgacgtgccgacaaaaactgagaatgcaccagagacatttcatctcaacgatccatatctggttccagtaaccttccaagcaaagccaacattcaatctaaacacagatgctgctccactttctctcaacctttgtctggcatcctcatttaatcttaacgagcaacccaactcaagacactcggctttcacgatgatgccaagcttcagcgatggagatagcaatagcagcatcatcagagttgcttag

SEQ ID NO: 1914 - protein, 285 aa, Arabidopsis thaliana
MAAVSSSSETGDCGVTGKRDEIMLFGVRVVVDPMRKCVSLNNLSDYEKSSPEDEIPKIVTAGAGDGEDKNETDATVIVADGYASANDAVQISSSSGGRKRGVPWTENEHKRFLIGLQKVGKGDWKGISRNFVKSRTPTQVASHAQKYFLRRTNLNRRRRRSSLFDITTETVTEMAMEQDPTQENSPLPETNISSGQQAMQVFTDVPTKTENAPETFHLNDPYLVPVTFQAKPTFNLNTDAAPLSLNLCLASSFNLNEQPNSRHSAFTMMPSFSDGDSNSSIIRVA

SEQ ID NO: 1915 - DNA, 2244 bp, Arabidopsis thaliana
atggatgatcatgaaacccctcttttgtccaaggacttatcatcatcatcatcatcatcatcatcatcatcatctgtggtggtttcatctttgaaatggatattgaaagttgtaatgtctgtgatttttgtgacttgggttgtgttccttatgatgtatcctggatcactcggtgatcaaatcctcacaaactggagagcaatctcctccaacactctctttggcctcacaggaagcatgttcttaattttcagtggtccgattcttgtcatcgccatcttggcttctctctatctgataatctcaggggaagagacggttttcactaagaagaagataacgaaattcccgaggtttaggctatggacatttcctgttcttgtggatggaccatttggagttgtttctgcagctgagtttcttggaattatggtcttctctgtttttttcctttgggctatctatgcttataccttgaggaatctcaacgttcttgactacttccacgtgcttcccaataacagaagtatttttctgttggagttaacgggtctgcgttttgggatgattggattgttgtgtatggtgtttttgtttcttccaatctcgagaggctctattcttctccggcttattgatatccctttcgagcatgctacaagataccatgtttggcttggtcatatcaccatgactttcttctctttacatggcctctgttatgttgttggatggaccattcaaggtcaacttttagagcttttatttgaatggaaagctactggaatcgctgttttacccggagttatcagtctagtggctggtttactcatgtgggtcacatcgcttcacaccgtgagaaagaattactttgagctcttcttctacacacatcaactatacattgtctttgtcgtcttcttggcacttcatgttggtgactacttattcagtatagttgctggaggaatctttctcttcattctagaccgcttcttgaggttctaccaatcaagaaggactgttgatgttatctctgcaaagagtttaccttgtggaactcttgaacttgtcctttcaaaaccaccaaatatgcgatacaacgcgcttagctttatctttcttcaagtgaaggaactgtcttggttacagtggcatcctttcagtgtttcatcaagtcctctagatgggaaccatcatgttgcggttcttataaaagttcttggtggatggactgcaaagcttagggatcaattgtcaactctatatgaggcagaaaatcaagaccagcttatttctcctgagtcatatcccaaaatcacaacttgtgtggagggaccttatggccatgaatctccataccacttagcgtatgagaacctggtattagtagcaggaggaatcgggattacgcctttttttgccatcttaagcgatatcctacaccgtaaaagagatgggaaagattgtttacctggtaaggttttagttgtatgggccattaaaaactcagacgagctctctctgctctcagcaattgacataccttccatttgccatttcttctctaagaaactaaaccttgagattcacatatatgtcactcgacaatccgagccttgcttggaagatgggatggttcacaaggtggtgcatccttctgtcaaaacaccatggaccaacggatgttccatgtcggttttagttggtacaggggataacatatggtctggactctatctaattatctccaccattgggtttattgcaatgatcacattggtggacatcttttacataaacaagtacaacataacaacatggtggtacaagggacttctgtttgttgtttgtatggttgcaagtgtgttgatttttggaggtcttgtggttgttttctggcatcgctgggaacacaaaaccggtgaagtggaagcaaatggcaacgacaaggtagatttgaatggagaagaaacccataatccatctgcagcagagcttaagggcttggcaatagaagaagatgtccagaattacaccactattcgttatggcaccagaccggcctttagagagatatttgagtcattgaatgggaaatgggggagtgtggatgttggagtgatagtatgcggtccagcgactcttcagacgaccgtagccaaagaaatacggtcacatagcatctggcgatcggcgaatcatcctcttttccacttcaacagccacagtttcgatctctaa

SEQ ID NO: 1916 - protein, 747 aa, Arabidopsis thaliana
MDDHETPLLSKDLSSSSSSSSSSSSVVVSSLKWILKVVMSVIFVTWVVFLMMYPGSLGDQILTNWRAISSNTLFGLTGSMFLIFSGPILVIAILASLYLIISGEETVFTKKKITKFPRFRLWTFPVLVDGPFGVVSAAEFLGIMVFSVFFLWAIYAYTLRNLNVLDYFHVLPNNRSIFLLELTGLRFGMIGLLCMVFLFLPISRGSILLRLIDIPFEHATRYHVWLGHITMTFFSLHGLCYVVGWTIQGQLLELLFEWKATGIAVLPGVISLVAGLLMWVTSLHTVRKNYFELFFYTHQLYIVFVVFLALHVGDYLFSIVAGGIFLFILDRFLRFYQSRRTVDVISAKSLPCGTLELVLSKPPNMRYNALSFIFLQVKELSWLQWHPFSVSSSPLDGNHHVAVLIKVLGGWTAKLRDQLSTLYEAENQDQLISPESYPKITTCVEGPYGHESPYHLAYENLVLVAGGIGITPFFAILSDILHRKRDGKDCLPGKVLVVWAIKNSDELSLLSAIDIPSICHFFSKKLNLEIHIYVTRQSEPCLEDGMVHKVVHPSVKTPWTNGCSMSVLVGTGDNIWSGLYLIISTIGFIAMITLVDIFYINKYNITTWWYKGLLFVVCMVASVLIFGGLVVVFWHRWEHKTGEVEANGNDKVDLNGEETHNPSAAELKGLAIEEDVQNYTTIRYGTRPAFREIFESLNGKWGSVDVGVIVCGPATLQTTVAKEIRSHSIWRSANHPLFHFNSHSFDL

SEQ ID NO: 1917 - DNA, 492 bp, Arabidopsis thaliana
atgacaattgctttaacgatcggaggaaacgggttttcgggtctaccaggatcgtcgttttcttcatcatcttcgtcgtttcgattaaaaaacagcagaagaaagaacacgaagatgctcaacagatcaaaagtcgtttgttcttcttcatcttctgtaatggatccgtataagactcttaagatccgacccgattcatctgaatacgaggtcaagaaagctttcagacaactcgctaaaaagtatcatcctgatgtttgtagaggaagcaattgtggggtacagtttcagacaattaacgaagcttacgatattgtgttgaagcaaattaaaaatcagatggaagggacggaggaatttgagccgttcgatgtatacgacgagggattgaacggaatgaatgatccagattgcgacacgtgggaagaatggatgggatgggagggagcaggaacccgtgattactcctctcacgttaatccttacgcttga

SEQ ID NO: 1918 - protein, 163 aa, Arabidopsis thaliana
MTIALTIGGNGFSGLPGSSFSSSSSSFRLKNSRRKNTKMLNRSKVVCSSSSSVMDPYKTLKIRPDSSEYEVKKAFRQLAKKYHPDVCRGSNCGVQFQTINEAYDIVLKQIKNQMEGTEEFEPFDVYDEGLNGMNDPDCDTWEEWMGWEGAGTRDYSSHVNPYA

SEQ ID NO: 1919 - DNA, 441 bp, Arabidopsis thaliana
atggccttatctcaagtgtctgcgtctctcgccttttctcttcccaattctggtgccctaaagctagccacaatcacaaacccaacttctacatgtcgggttcatgttccgcaacttgctggaatccgatccaccttcgcttctggttctcctctcttgccattgaagttgagtatgacccgtagaggaggaaacagagcagcatcagtttccataagaagtgagcaaagtacagaaggaagcagtggtttggatatatggcttggtcgtggcgccatggttggttttgcagttgccattactgttgagatttccactggaaaaggacttcttgagaattttggagtagcaagtccattgcctacggttgctttagctgttacagcattggttggtgttctagctgcggttttcatcttccaatcttcttctaaaaactga

SEQ ID NO: 1920 - protein, 146 aa, Arabidopsis thaliana
MALSQVSASLAFSLPNSGALKLATITNPTSTCRVHVPQLAGIRSTFASGSPLLPLKLSMTRRGGNRAASVSIRSEQSTEGSSGLDIWLGRGAMVGFAVAITVEISTGKGLLENFGVASPLPTVALAVTALVGVLAAVFIFQSSSKN

SEQ ID NO: 1921 - DNA, 1212 bp, Arabidopsis thaliana
atggcgtctctgcaactctgcgacggttatcttctcttcaagccctctgtttctcctcgattcctctctcaacgcatttctcatcgcctaatccctaaagcctcatcttctcctcctccatctccatcaccatcatcgtcctcttcatccttatctttcagtcggcgggagcttctgtaccaatcggcagctgtatcactctcgctttcttccattgttggaccagcgagagctgatgaacagttatccgaatgggaaagagtgtttctcccaatcgatcccggtgttgttcttctcgacattgctttcgtccccgacgaacctagccgagggtttttacttggaacgagacagactttgttagagactaaagatggtggaagcacttggaatccacgttcgattccttcagctgaagaagaagatttcaattatagattcaattcgattagctttaaaggcaaagaaggatggattattggcaaacctgcgattttattgtacactgctgatgctggagagaattgggataggattcctctaagttctcagcttcctggagatatggtgtttataaaagcgacagaagataagagtgcagagatggttactgatgaaggtgctatttatgttacttcaaacaggggatataactggaaagctgctattcaggaaactgtttcagctaccttgaacagaacagtatccagtggaatcagtggtgctagttactacacgggaactttcagtgctgttaatcgttcacctgatggaagatatgtcgctgtttcgagccgtggtaacttctttctgacatgggagcctgggcagccttactggcaaccacacaatagagctgttgctagaagaattcagaacatgggatggagagctgatggtggtctttggcttcttgttcgtggtggaggactttatcttagcaaaggtactgggattacagaggagtttgaagaagttccagtacaaagccgtggctttggcattctagatgttggatatcgctcagaggaagaagcatgggcagcaggaggcagtggcatactactgagaacaagaaatggaggcaaatcatggaaccgtgacaaagctgctgataatatcgcagctaacctatacgcagtcaaatttgtggatgacaagaaaggatttgtgcttggcaacgatggagtcttgctccgatatgttggctga

SEQ ID NO: 1922 - protein, 403 aa, Arabidopsis thaliana
MASLQLCDGYLLFKPSVSPRFLSQRISHRLIPKASSSPPPSPSPSSSSSSLSFSRRELLYQSAAVSLSLSSIVGPARADEQLSEWERVFLPIDPGVVLLDIAFVPDEPSRGFLLGTRQTLLETKDGGSTWNPRSIPSAEEEDFNYRFNSISFKGKEGWIIGKPAILLYTADAGENWDRIPLSSQLPGDMVFIKATEDKSAEMVTDEGAIYVTSNRGYNWKAAIQETVSATLNRTVSSGISGASYYTGTFSAVNRSPDGRYVAVSSRGNFFLTWEPGQPYWQPHNRAVARRIQNMGWRADGGLWLLVRGGGLYLSKGTGITEEFEEVPVQSRGFGILDVGYRSEEEAWAAGGSGILLRTRNGGKSWNRDKAADNIAANLYAVKFVDDKKGFVLGNDGVLLRYVG

SEQ ID NO: 1923 - DNA, 678 bp, Arabidopsis thaliana
atgagtttggtcgccagtttgcaactcatcctcccgccacggccgagaagcaccaagttgttgtgctcattgcaaagcccaaaacaagaacaagaactctcttctacttctcctccaatctctcttttaccaaaactaatctcttttgctcttgctatctctctaacttccttttcccctgccttagccattccttctctctcctcttctcagccactcaccactcctttcacccaatccaagttcgtccagaccggtcttctcaatggcaaaattaggccttgcccttccacgaacccaggatgtgtatcgacgaatccaacctcatcttccttctcttttccattgacgatcccagaaaccgatacacaggatcccattgagaaactgaaagaagcaataatgagcacccagaagaaccccaagtttgtggttcttgaagatactccctatgggaggtatgtggaggcagaggtagaaggaggaggatttagcagagatgtgatggagtttttggtgaagcaagatgtggttgcttacaggtgtatggccactaaggttacctttgtgtatcctttcaccactgcttttggagactccaagggacaagaagagaggttgaagaagctcatcgatcagcttggttggtatgctcctacctttgaatctatggaataa

SEQ ID NO: 1924 - protein, 225 aa, Arabidopsis thaliana
MSLVASLQLILPPRPRSTKLLCSLQSPKQEQELSSTSPPISLLPKLISFALAISLTSFSPALAIPSLSSSQPLTTPFTQSKFVQTGLLNGKIRPCPSTNPGCVSTNPTSSSFSFPLTIPETDTQDPIEKLKEAIMSTQKNPKFVVLEDTPYGRYVEAEVEGGGFSRDVMEFLVKQDVVAYRCMATKVTFVYPFTTAFGDSKGQEERLKKLIDQLGWYAPTFESME

SEQ ID NO: 1925 - DNA, 822 bp, Arabidopsis thaliana
atgtcaatggcgtctatagcttcttcttcttccaccaccctactctcttcctctagggttcttcttccctccaagtcttctcttttatctcctaccgtctctttccccagaatcataccctcttcctcggcatcatcctcttctctctgttccgggttctccagtctcggttccctcaccaccaaccgctccgcctcacgccggaacttcgccgtcaaggctcaggctgatgatttaccactggtcggtaataaggcgcctgattttgaagctgaggcagtttttgatcaagagttcataaaggtgaagctctctgagtacattggcaaaaagtatgttattctattcttctaccctttggacttcacttttgtctgccccactgagattactgccttcagtgaccgttatgaagaatttgagaagctaaacaccgaagtattaggggtctctgtcgacagtgtgttctcgcatcttgcgtgggtccaaacagacagaaagtcgggagggctcggtgatctgaattatcctcttgtttcggatatcactaaatccatttcaaaatcgtttggagtgctcatccctgatcagggcattgcactgagagggcttttcatcatagacaaggaaggagtcattcagcattccaccatcaacaacctcggtattggccgaagtgttgatgagacaatgagaaccctccaggcattacagtatgttcaagaaaacccggatgaagtgtgccctgcgggatggaagccaggggagaaatcaatgaaacctgaccccaagctcagcaaagaatacttttcagctatctag

SEQ ID NO: 1926 - protein, 273 aa, Arabidopsis thaliana
MSMASIASSSSTTLLSSSRVLLPSKSSLLSPTVSFPRIIPSSSASSSSLCSGFSSLGSLTTNRSASRRNFAVKAQADDLPLVGNKAPDFEAEAVFDQEFIKVKLSEYIGKKYVILFFYPLDFTFVCPTEITAFSDRYEEFEKLNTEVLGVSVDSVFSHLAWVQTDRKSGGLGDLNYPLVSDITKSISKSFGVLIPDQGIALRGLFIIDKEGVIQHSTINNLGIGRSVDETMRTLQALQYVQENPDEVCPAGWKPGEKSMKPDPKLSKEYFSAI

SEQ ID NO: 1927 - DNA, 408 bp, Arabidopsis thaliana
atggacattactgttcgaatctccggcttaaaatcctccaatctaatccggataacccctagattctcatcttcctctagattccgttgctccaacaacgaacctcctcgaaagggaaacgagtccaacggtggtggtggtgataaagcgtcgacggactgggacaaggcgtggaagaatttcaagaagcagagcaagaagtcattgttctcgcaattcaacgtggacaagtacgtgacttggaatcctcccagatcggagtttgatttgtcggaagaagtcgatcctataaaaagaacagagagatccaatctcatgctctggacaagtccaaggttcacacttgttggagccatcgtcattgtctcattcctccttctctacaccattcttgctcctgtcaagtga

SEQ ID NO: 1928 - protein, 135 aa, Arabidopsis thaliana
MDITVRISGLKSSNLIRITPRFSSSSRFRCSNNEPPRKGNESNGGGGDKASTDWDKAWKNFKKQSKKSLFSQFNVDKYVTWNPPRSEFDLSEEVDPIKRTERSNLMLWTSPRFTLVGAIVIVSFLLLYTILAPVK

SEQ ID NO: 1929 - DNA, 369 bp, Arabidopsis thaliana
atgggtaaagcaagaggagtgaacaatggcgtgaatgaaagttctctcggttatctttttggttccggccagccttcttccgctgctgctgccacaatggggactactactactacaaccaccacaactaccaccgatgggaccggaggcagaccgataaccaccacgacgaccacagtcactgataacaagaagacatctgcaggtgttagaggaagtcctaataattacttcagatcagaaggccaaaactgtggaaactttctcacggacaggccatctactaaggttcatgcagctcctggtggaggatcttctcttgattatctgtttggaggaccaagtcctgctggatctggaaacaaatga

SEQ ID NO: 1930 - protein, 122 aa, Arabidopsis thaliana
MGKARGVNNGVNESSLGYLFGSGQPSSAAAATMGTTTTTTTTTTTDGTGGRPITTTTTTVTDNKKTSAGVRGSPNNYFRSEGQNCGNFLTDRPSTKVHAAPGGGSSLDYLFGGPSPAGSGNK

SEQ ID NO: 1931 - DNA, 1227 bp, Arabidopsis thaliana
atgtctccattgccttatagttcttggcctctgatactattgttagtattgtggtgcatggtagctagattatcaaacggagcttccaacaatgtaaaggttggaatcatttcaaaggtggaagatgctacgaatttccatatctattatggacagacctttaaagtcatcaaaaacgccattgatggcaagagctatctccttattcagaacacttctagaatggcggttcggacaaagtattgtacttccaggataaagtcttatgtgattccacttctaaattactcattagacactcaatcttctcaaggaagtgttccggtttctttctttgagttacttggattactcggaagcttgaagggaataacatcggatgaggtagtttcaccgtgtcttctgaaactgtgtgaggcaggggaagtagttaagcttgacaaaggtgaacaactatctcaattcgcggcgcatttcatcagcgatactgatcaacctcagacttgcaattttgcaaacttttttccacttagtgaaggaacacctcttcagcgagcggagtggatcaaattccttggagcgtttacaaatcttgaaactaaagccaatcaagtctatgactcggttaaagcaagctatacttgcttgtctcaaatggctgccaacaagacaaaatccttcaagccgattgtagcctggatgggatatgatcaaaatggaggcatgtggagttttactaaggaatcacacaagctaaagtttgtagaagatgctggtggtgaaaatatcgacaagtctattaacaaggtctcttacaatgtctctgatcctgatgatttggaagcactccatgccattttatgtactgtggatgctgtgatcgatgaaacgctatcatctgaccctcaaaactacacacagacaacgttcttggcgaacataaacgtggatgataactcttgttttgcgtttcttgctaatcaaagcatctggagatatgacaaaagggtcagaaacagaacaactcttgactggtatgacggagcaatctcgcaaccaaatcttgtactggctgacattgttgaagccttgtttccaacgggaaactatacaacttcgtacttcagaaacattgctaagggtgaaggagtcataaacattagtccggatatgtgtgatagagacgcatcattgccgttagttccttcaattccagcttgtggatga

SEQ ID NO: 1932 - protein, 408 aa, Arabidopsis thaliana
MSPLPYSSWPLILLLVLWCMVARLSNGASNNVKVGIISKVEDATNFHIYYGQTFKVIKNAIDGKSYLLIQNTSRMAVRTKYCTSRIKSYVIPLLNYSLDTQSSQGSVPVSFFELLGLLGSLKGITSDEVVSPCLLKLCEAGEVVKLDKGEQLSQFAAHFISDTDQPQTCNFANFFPLSEGTPLQRAEWIKFLGAFTNLETKANQVYDSVKASYTCLSQMAANKTKSFKPIVAWMGYDQNGGMWSFTKESHKLKFVEDAGGENIDKSINKVSYNVSDPDDLEALHAILCTVDAVIDETLSSDPQNYTQTTFLANINVDDNSCFAFLANQSIWRYDKRVRNRTTLDWYDGAISQPNLVLADIVEALFPTGNYTTSYFRNIAKGEGVINISPDMCDRDASLPLVPSIPACG

SEQ ID NO: 1933 - DNA, 957 bp, Arabidopsis thaliana
atggcgacggtaccattgttcacccagtttccctgcaaaaccctaaatccaagctcatcaaacactaaacaccaatcgaaatctccgatcctactaccgattaactcaataaatcggcgatcggagattggagtctctgttcatcggccagatttcaaaatccgagcgacggacatcgacgacgaatggggtcaagatggagtggagagagtatttgcctcatcttcaaccgtatcggtagcagataaagcaatcgaatccgtggaggagacggagaggctaaagagatcactagcggattcgttgtacggaacagatcgaggtttaagcgtatcgagtgatacgagagctgagatcagcgagctcatcacacagctcgagtctaagaaccctactccagctcctaacgaagctctgtttctcctcaacggcaaatggatcctcgcctacacgtcgttcgtggggttgttcccattgctctcacgaagaattgaaccgttggttaaagtggatgagatctcacaaaccattgattccgatagcttcaccgttcaaaactctgtccggttcgctggtccgttttccacaacgtcgtttagcaccaacgctaagtttgaaatccgaagtcctaaacgtgtccagattaagttcgagcaaggtgttatagggactcctcagctaacggattcgattgaaataccggaatccgtggaggttcttggtcagaaaatcgatctcaatcccattaaaggtttacttacatcagtccaagacactgcttcttcagtggctagaaccatttcaaaccaaccaccattgaagttttctctgcctagtgacaacacgcagtcgtggctgctcacaacttatctcgacaaggaccttcggatctcgagaggcgatggtggaagcgtctatgtgctcatcaaagaaggaagctctctcttaaacccttaa

SEQ ID NO: 1934 - protein, 318 aa, Arabidopsis thaliana
MATVPLFTQFPCKTLNPSSSNTKHQSKSPILLPINSINRRSEIGVSVHRPDFKIRATDIDDEWGQDGVERVFASSSTVSVADKAIESVEETERLKRSLADSLYGTDRGLSVSSDTRAEISELITQLESKNPTPAPNEALFLLNGKWILAYTSFVGLFPLLSRRIEPLVKVDEISQTIDSDSFTVQNSVRFAGPFSTTSFSTNAKFEIRSPKRVQIKFEQGVIGTPQLTDSIEIPESVEVLGQKIDLNPIKGLLTSVQDTASSVARTISNQPPLKFSLPSDNTQSWLLTTYLDKDLRISRGDGGSVYVLIKEGSSLLNP

SEQ ID NO: 1935 - DNA, 1791 bp, Arabidopsis thaliana
atggaggtttcgtcttcactcaagctctcatcgtcgttatctccttccatcatcaaacttcagggttcttcatcaagtattgatataaaattctctaagtacacttcacttcctaaaccgtttcttcaacttgatgataaaagccgacgtcttcgtgaccaacaagtttcacattctctcgagctaaggtcttacagaaaacgggtcactgcgaaatcaggttctcaaggttgggactttggtagattcgtcaaaacattgtactttttcaatggaccaccatctcctctaaagtttgtttcatcggtgtttgagaaacttactaacggagcaacggaggaaccggttgctgaaatgggaacttctggaatcatacttgtggctggagctactggtggtgtaggaagaaggattgttgatatcttgaggaaaagagggttgcctgttaaagcattggttagaaatgaagagaaggctcggaagatgttaggacctgagattgacttgattgttgcagatattacaaaggagaatacattggttcctgaaaagttcaaaggagtgaggaaagtgatcaatgctgtttctgttattgttggtccaaaggaaggagatacacctgagagacaaaaatataatcagggagtcaggttcttcgagccagagataaaaggcgactctcccgagttagtggaatacattggaatgaagaacttaatcaatgctgttagagatggtgttggacttgagaatgggaagcttatttttggtgtcggggataacacgtttaaggatctaccttggggagcattggatgatgttgtaatgggaggtgtcagcgaaagtaacttcatagtagatctaaccgctggtgaaaacggtggacctaccggaatttttaaaggaattgtttccacaacaaataatggcggatttacgagtgtccgaaccaagaactttcccgaggcggagaatgtctctgcatatgatggtctagagctaagactaaaaggtgatggactccgttataagctaatcgtccgaacaagccaagattgggatactgttggttacaccgccagttttgacacttcaccaggccaatggcaatctgtacgcttacctttctcgtctttaagacctgtatttcgcgcacgtacagttacagatgcaccaccttttaatgcaagcagtatcatttcactacagcttatgtttagcaaatttgagtatgatggtaagcttaaccctacattcaaagaaggacctttcgagcttcctttatctagcattcgagcttatatccaagaccccgtcactccaaggtttgttcacgttggctctgcgggagttactcgaccagagagacccggtttggatctaagcaaacaacctccggccgtgagattaaacaaagagcttgatttcattctcacttacaagttaaagggagaggatctgatacgcgacagcgggattccatttgcaattgtacggccatgtgctttaacagaagagcctgccggagctgatctcattttcgaacaaggagacaacattacggggaaggtatcaagagacgaagtagcgcgtatatgcatcgctgctttagaaagcccgtatgctcttaacaagaccttcgaggttaaaagtacggttccgtttagcgagcctttcacggtagatcctgagaatcctccaccggagaaagactacaatgagtatttcaagactctgaaagatggaatcaccggtaaagaagctttagaacagagcactgttgcagtttaa

SEQ ID NO: 1936 - protein, 596 aa, Arabidopsis thaliana
MEVSSSLKLSSSLSPSIIKLQGSSSSIDIKFSKYTSLPKPFLQLDDKSRRLRDQQVSHSLELRSYRKRVTAKSGSQGWDFGRFVKTLYFFNGPPSPLKFVSSVFEKLTNGATEEPVAEMGTSGIILVAGATGGVGRRIVDILRKRGLPVKALVRNEEKARKMLGPEIDLIVADITKENTLVPEKFKGVRKVINAVSVIVGPKEGDTPERQKYNQGVRFFEPEIKGDSPELVEYIGMKNLINAVRDGVGLENGKLIFGVGDNTFKDLPWGALDDVVMGGVSESNFIVDLTAGENGGPTGIFKGIVSTTNNGGFTSVRTKNFPEAENVSAYDGLELRLKGDGLRYKLIVRTSQDWDTVGYTASFDTSPGQWQSVRLPFSSLRPVFRARTVTDAPPFNASSIISLQLMFSKFEYDGKLNPTFKEGPFELPLSSIRAYIQDPVTPRFVHVGSAGVTRPERPGLDLSKQPPAVRLNKELDFILTYKLKGEDLIRDSGIPFAIVRPCALTEEPAGADLIFEQGDNITGKVSRDEVARICIAALESPYALNKTFEVKSTVPFSEPFTVDPENPPPEKDYNEYFKTLKDGITGKEALEQSTVAV

SEQ ID NO: 1937 - DNA, 3066 bp, Arabidopsis thaliana
atgtctgctacaaaaggtctagctgacgttcagtcagatatgaagagtgctgtcaaagtaaattctccacccactgaggattttgtgggattcccaacccaagaggagataaaaagttcaggtaacccaacactggacaaattggaaaatacatcccgcactgttaaaggtgcacaagttataggtgaaaatgataaagcattggaccttgttttgctgtcactggaaagattttcaaaatcgccagattctaaaagggacaaagatgttgcttgctctgttcagtccctcaggatcatctccaatttggttgcaactcgtgccatagtttcagttggactgattgagaaaataacatgtgcactgctagactttactgacgctcttgttgggatgaaatcacccgagttcaacaacataataccaaagagtctttcagtcactaaaaacttggtagggcatgttgaaggcaataacatacatagttcttacatcaggcactggaccaaagtagtggaaatcttcatacaggtcgttagatgggaagaagagggaactggtagaattatatatgaggcctgttcttgcatcacaacaatgttatctcgagttgcccaagatcttaaatcttcaactcctgattctgtttctaaacagattttggagcatgctaacatgtctcgcatagttgatcatttgtgtctttgtctggcttcttctgggtcgagtttaacttccggctcttcgcaaatgttagcagctgcctgtgaagcttgtcgagcaatatggattctcatagatacttccgaaacattcttcaagaacgatgatgtaaacatattacctctagatgccttgcagaaccgtctctctcagcatgacataggaaacagtgagtggggtccgttatctgagaaacttgtcgatacagtgacaagagcatatctccgatcaaagcatgtgcaagttgctgttggtcattgccttcaccaacgagtggaggctccattggtttctgcaattcagctcttgtcaagatgctgccttcataatggaattctgcctagcatgctttgtggtcttcccagttcactgcctattacgaccgtagtcagtggtggagaggatggtacagttatttcagaaatattttctatactatcatacgcaacattatcaagcaaagaccagcaaacaggagaaaaagataacttcgagggcagactaaacaatctggtgttccattcatgccttatgttggcaacagttgctcaatgtttgaagttaactgggagaaattctgttctgttaatgcttacaacttctccaaagaagcatcaacatcgtctttctgctatagccaatcacattgcctcagatgataaaatcgaagcttctcttcagaatcactctgcttcagctatgcttgctctcgcatctattctcgctcttgaaaaaggatcttctgctggatcttctgtctctgagctagtggtgtctctgattcctcgagctactaagctttgttatcatcttaggcctatgccaagtaatgaaggtgaagtcatctctcattctgccaattatgccaaatggcacggacttctggatggatgtatcggtttattagaatccagattgaagtggggtggacctctagctgtgcagcagcttattgctagtggtacgccattgcttctcataaatctgttagctggcaaactttcaaatgcttccccagaggacatcaagaagacatccaaccggattggcttgtcccctattggcgttgtatggactatttcgtccatatgccactgtctttcgggtggcacaactttccgtcaggttcttgtgaaaatcgaaaccatgaagctaattacttgtttactatctgatgctcatatcaagctagtaaagagctggggaggtccggggggaggaaaagatggggtcagagagacaataaatgtgataattgatctcctagcatttccttttgttgctctgcaaagtcaaccaggttcgttatctgccacagcttctgtaaatagtggattcattctcaacattggctctcctggtgtgagagtatgcatggaagatagagatttgctaaaagctatagaagaggatatggacaaatacataatagtcctcctggaggtgggagtgccgagtttaatcctacgttgcttggatcatttggaattaaaagatttagtaaggcccgttgcttttcttgccaaaatggtgggtcgtccacgtcttgctgtagatctcgtgagcaaaggtctgttagatcctaatagaatgaaaaaattactcaaccaatcaagtccaagagaagtcatacttgatattttgatgatcatatctgatctatcgaggatggataaggctttttataaatacatcggcgaggcttctgttttacagcctttgaaagaatatcttacccatgtggatccaaatatacgtgcaaaagcttgtagtgctcttggcaatatgtgcagacacaatggatatttctacagcgctcttgcggaacatcaaatcatcggtctcctcattgatcgatgcgctgatccggacaaacgaacacagaaattcgcttgttttgctattggaaatgcggcttaccataacgacacgctgtatgaagagctaagaagatctataacgcagctagcaaacgttttgaccacggctgaagaagacaagacaaaagcaaacgcggctggtgcattgagcaaccttgtccgaaactccaacaaactctgtgaagatatagtctccaagggagctttacaaacgttactgaggctagttgcggattgctcgactcttgccttgaacccaagcaagaaagagacagcgagtgagtcaccgctcaagattgcactcttctcattggctaaaatgtgttcgaaccaccagatttgcagacagtttgtgaagtcatcagagttgttcccggtcattgcaaggcttaaacaatcccctgaggctaacattgctcactatgcttcagttattgtcgccaaagtcagtggtgagtcttaa

SEQ ID NO: 1938 - protein, 1021 aa, Arabidopsis thaliana
MSATKGLADVQSDMKSAVKVNSPPTEDFVGFPTQEEIKSSGNPTLDKLENTSRTVKGAQVIGENDKALDLVLLSLERFSKSPDSKRDKDVACSVQSLRIISNLVATRAIVSVGLIEKITCALLDFTDALVGMKSPEFNNIIPKSLSVTKNLVGHVEGNNIHSSYIRHWTKVVEIFIQVVRWEEEGTGRIIYEACSCITTMLSRVAQDLKSSTPDSVSKQILEHANMSRIVDHLCLCLASSGSSLTSGSSQMLAAACEACRAIWILIDTSETFFKNDDVNILPLDALQNRLSQHDIGNSEWGPLSEKLVDTVTRAYLRSKHVQVAVGHCLHQRVEAPLVSAIQLLSRCCLHNGILPSMLCGLPSSLPITTVVSGGEDGTVISEIFSILSYATLSSKDQQTGEKDNFEGRLNNLVFHSCLMLATVAQCLKLTGRNSVLLMLTTSPKKHQHRLSAIANHIASDDKIEASLQNHSASAMLALASILALEKGSSAGSSVSELVVSLIPRATKLCYHLRPMPSNEGEVISHSANYAKWHGLLDGCIGLLESRLKWGGPLAVQQLIASGTPLLLINLLAGKLSNASPEDIKKTSNRIGLSPIGVVWTISSICHCLSGGTTFRQVLVKIETMKLITCLLSDAHIKLVKSWGGPGGGKDGVRETINVIIDLLAFPFVALQSQPGSLSATASVNSGFILNIGSPGVRVCMEDRDLLKAIEEDMDKYIIVLLEVGVPSLILRCLDHLELKDLVRPVAFLAKMVGRPRLAVDLVSKGLLDPNRMKKLLNQSSPREVILDILMIISDLSRMDKAFYKYIGEASVLQPLKEYLTHVDPNIRAKACSALGNMCRHNGYFYSALAEHQIIGLLIDRCADPDKRTQKFACFAIGNAAYHNDTLYEELRRSITQLANVLTTAEEDKTKANAAGALSNLVRNSNKLCEDIVSKGALQTLLRLVADCSTLALNPSKKETASESPLKIALFSLAKMCSNHQICRQFVKSSELFPVIARLKQSPEANIAHYASVIVAKVSGES

SEQ ID NO: 1939 - DNA, 792 bp, Arabidopsis thaliana
atgcttagaaacaaacctagagcagccgtgacgactaagaaacaaacatctctgttaatggctgatcaacctccacctccaaagcctaacacttgccactgctcaccatctctctttagctctcccaagtttaggtttttcacttctaagatgatgatgactccctttgactctgatttctcactcgttagccctacgtctatactcgaagctaacccatccatcttctcctccaaaaaccctaaacccgtttcctatttcgagccaactatccctaatccccagcgttttcactctccagacgtctttggcctagccgatctcgtgaaagacggagacagtaacagagaccactctagaaaacctgtcaacaagatggtccttttcgggtcaaagctcagagtccagatcccatcatcagctgattttggaactaaaaccggcatcagatatcctccttgtcaacttagtccttgtgtccaaacgaaggtcttagcagtgagcgagattgaccagacggaggactacacgcgcgtcatctctcacggtcctaacccaaccatcactcatatcttcgacaactctgttttcgtggaggctactccttgctctgttcctttaccccaaccagccatggagaccaagagcaccgagagttttctaagccgttgcttcacctgcaagaagaatcttgaccagaaacaggacatctacatatacaggggagagaaaggtttttgcagcagcgagtgcaggtaccaggagatgcttcttgatcaaatggagacctag

SEQ ID NO: 1940 - protein, 263 aa, Arabidopsis thaliana
MLRNKPRAAVTTKKQTSLLMADQPPPPKPNTCHCSPSLFSSPKFRFFTSKMMMTPFDSDFSLVSPTSILEANPSIFSSKNPKPVSYFEPTIPNPQRFHSPDVFGLADLVKDGDSNRDHSRKPVNKMVLFGSKLRVQIPSSADFGTKTGIRYPPCQLSPCVQTKVLAVSEIDQTEDYTRVISHGPNPTITHIFDNSVFVEATPCSVPLPQPAMETKSTESFLSRCFTCKKNLDQKQDIYIYRGEKGFCSSECRYQEMLLDQMET

SEQ ID NO: 1941 - DNA, 942 bp, Arabidopsis thaliana
atgggtctactgtcacttgaagacaccataaaagagaagctaaaggaccgcaaaaacgctcacttcatgttggttgacggaatgtctaagctactgacggaaaaagttaagaattgtcagtcattggatttccaagtttctggtgtcaaatggaggttggttatacgcttatctaggggaagaaaagaccatctatcttttgttctggagatcacagatgaaaagtgtaccgggtctacttgggacgtcaaattcaacttcaaaatcggcatagtccctcagactggaccagattattgcttcgttttggtggggcatcaaaacgaaaaaaaacgtagtcaagggttagccaacttcatatcacacacggatttgaaggagaggtttcttgtgaacgacaaagcggggttctatgccgagataagcgatgtccaaccaaacttccccgttacccgtatccctcgaacaatggggacagcagaacgctttaaactgatagagttttctccgaaaaactccagattcacctggaagatcacgcagttttcctccttcgatggtgaagagcattcttcttacgagttcacggttggaccacggagatggaaactagtaatgtacccaaaaggaaacggagatggaaaaggaaattcgttgtctttgtatttgtttgcatccgattacgtcaccaatggtcctaagggtggaacattggccatctataaattgagagtgttggaccaactcaatcgcaatcactgtgaaactgagtgtagatattggtttccttataaccctgttaatcaaatggattccttatggggacgtcccaagtttttgccgctggaggaactccacaaatcttcgaggggatttctagtgaacgatcagatatatatcggtgttgagatctcaattgtatccactactgagtatctctga

SEQ ID NO: 1942 - protein, 313 aa, Arabidopsis thaliana
MGLLSLEDTIKEKLKDRKNAHFMLVDGMSKLLTEKVKNCQSLDFQVSGVKWRLVIRLSRGRKDHLSFVLEITDEKCTGSTWDVKFNFKIGIVPQTGPDYCFVLVGHQNEKKRSQGLANFISHTDLKERFLVNDKAGFYAEISDVQPNFPVTRIPRTMGTAERFKLIEFSPKNSRFTWKITQFSSFDGEEHSSYEFTVGPRRWKLVMYPKGNGDGKGNSLSLYLFASDYVTNGPKGGTLAIYKLRVLDQLNRNHCETECRYWFPYNPVNQMDSLWGRPKFLPLEELHKSSRGFLVNDQIYIGVEISIVSTTEYL

SEQ ID NO: 1943 - DNA, 1569 bp, Arabidopsis thaliana
atggtggtctctgctgactgcagaatctccctctctgcccctagctgcatacgtagtagctccacgggattgactaggcacattaagcttggcagcttctgcaatggtgagctcatggggaagaagctcaacttgtctcagcttccaaacattcgtcttcgatcttctactaacttctctcagaagagaattttaatgtctctaaatagtgtagctggggagagtaaggtacaagaacttgagactgagaaaagggatccaaggacagttgcttccattattcttggaggtggagcaggaactcgactctttcctctcacaaaacgccgcgccaagcctgccgttcctatcgggggagcctataggttgatagatgtaccaatgagcaattgtattaacagcggaatcaacaaagtctacatactcacacaatataactcagcatcattgaacaggcatttagcccgtgcttacaactccaatggacttggctttggagatggctatgttgaggttcttgcggccactcaaacgccaggagaatctggtaaaaggtggttccaaggtacagcagatgcggttcggcaattccattggcttttcgaggatgcaagaagcaaggacatagaggatgtattgatcctttctggagatcacctctacaggatggattacatggattttatacaggatcatcggcagagtggcgcggatataagcatttcctgcataccaatagatgacagacgtgcctcagattttgggcttatgaagatagatgacaaaggaagagttatctcattcagtgaaaaacctaaaggagacgacctgaaagcaatggcagtagacacaactattttaggactttccaaggaggaagctgaaaagaaaccatacatagcttcaatgggagtttatgttttcaaaaaagaaatactgttaaatctcttgagatggcgtttccccacagcaaacgactttggttcagagattatacccttctcagctaaagaattctatgtgaatgcttatctctttaatgactactgggaagatataggaacaataagatctttcttcgaggcgaatcttgcactcactgagcatcctggggcatttagtttctacgacgcggcaaaaccaatatatacatcaaggagaaacctgccaccatcaaaaatagacaactctaagctcatcgattcaatcatttctcatggaagcttcttaaccaactgcttgattgagcatagcattgtgggaattagatcaagagtaggcagtaatgttcagttgaaggacactgtgatgcttggggcagattactacgaaactgaagcagaagttgcagcactacttgctgagggaaacgttcccattggaataggagagaacacaaaaattcaagaatgcataatagacaagaatgctagagttggaaagaatgtaatcatcgcaaactcggagggaatacaagaagcagataggtcatccgatggattttacatcagatctggcattactgtaatcttgaagaactcagtaattaaagatggagttgtgatatga

SEQ ID NO: 1944 - protein, 522 aa, Arabidopsis thaliana
MVVSADCRISLSAPSCIRSSSTGLTRHIKLGSFCNGELMGKKLNLSQLPNIRLRSSTNFSQKRILMSLNSVAGESKVQELETEKRDPRTVASIILGGGAGTRLFPLTKRRAKPAVPIGGAYRLIDVPMSNCINSGINKVYILTQYNSASLNRHLARAYNSNGLGFGDGYVEVLAATQTPGESGKRWFQGTADAVRQFHWLFEDARSKDIEDVLILSGDHLYRMDYMDFIQDHRQSGADISISCIPIDDRRASDFGLMKIDDKGRVISFSEKPKGDDLKAMAVDTTILGLSKEEAEKKPYIASMGVYVFKKEILLNLLRWRFPTANDFGSEIIPFSAKEFYVNAYLFNDYWEDIGTIRSFFEANLALTEHPGAFSFYDAAKPIYTSRRNLPPSKIDNSKLIDSIISHGSFLTNCLIEHSIVGIRSRVGSNVQLKDTVMLGADYYETEAEVAALLAEGNVPIGIGENTKIQECIIDKNARVGKNVIIANSEGIQEADRSSDGFYIRSGITVILKNSVIKDGVVI

SEQ ID NO: 1945 - DNA, 723 bp, Arabidopsis thaliana
atggtagcttctctttcctttcattccatcgccaccgttaatccaatcttctccggcgatggtggtcgttcaatcttccggactaatcgccgattcgaagcaactggagtgagttgccgaggacagaatcctactgacgagccacagacaagtaaaggacccgagccggataatgttctactcaaaatcgcttggtacggatctgagctactcggaatagctgcttctgttttccgatctccggagacttctccgattgtgacaggctttgaggttcctgttgattgttctggtcgagccgttcgtgtagctgtcgtggactcgattaaacaagactttaaacgatcctacttcgtcacaggtaatttgacgccggaggtttatgaggagaagtgtgaattcgctgatccggctggatccttcaagggtcttgctcgtttcaaaaggaattgcactaatttcggaagccttatcgagaaatccaatatgaagctcatgaaatgggagaattttgaggataaaggaattggacattggaaatttagctgtgtcatgtcgtttccatggaaacccattctttcagcaactggttacacggagtattatttcgacacagaatccgggaaaatttgcaggcacgtggagcattggaatgtccctaagattgctctgttcaaacaacttctgagacccagccgtggtttagtggggacacaaaactag

SEQ ID NO: 1946 - protein, 240 aa, Arabidopsis thaliana
MVASLSFHSIATVNPIFSGDGGRSIFRTNRRFEATGVSCRGQNPTDEPQTSKGPEPDNVLLKIAWYGSELLGIAASVFRSPETSPIVTGFEVPVDCSGRAVRVAVVDSIKQDFKRSYFVTGNLTPEVYEEKCEFADPAGSFKGLARFKRNCTNFGSLIEKSNMKLMKWENFEDKGIGHWKFSCVMSFPWKPILSATGYTEYYFDTESGKICRHVEHWNVPKIALFKQLLRPSRGLVGTQN

SEQ ID NO: 1947 - DNA, 1155 bp, Arabidopsis thaliana
atgagtgtgagttgttgttgtaggaatctgggcaagacaataaaaaaggcaataccttcacatcatttgcatctgagaagtcttggtgggagtctctatcgtcgtcgtatccaaagctcttcaatggagaccgatctcaagtcaacctttctcaacgtttattctgttctcaagtctgaccttcttcatgacccttccttcgaattcaccaatgaatctcgtctctgggttgatcggatgctggactacaatgtacgtggagggaaactcaatcggggtctctctgttgttgacagtttcaaacttttgaagcaaggcaatgatttgactgagcaagaggttttcctctcttgtgctctcggttggtgcattgaatggctccaagcttatttccttgtgcttgatgatattatggataactctgtcactcgccgtggtcaaccttgctggttcagagttcctcaggttggtatggttgccatcaatgatgggattctacttcgcaatcacatccacaggattctcaaaaagcatttccgtgataagccttactatgttgaccttgttgatttgtttaatgaggttgagttgcaaacagcttgtggccagatgatagatttgatcaccacctttgaaggagaaaaggatttggccaagtactcattgtcaatccaccgtcgtattgtccagtacaaaacggcttattactcattttatctccctgttgcttgtgcgttgcttatggccggcgaaaatttggaaaaccatattgatgtgaagaatgttcttgttgacatgggaatctacttccaagtgcaggatgattatctggattgttttgctgatcccgagacgcttggcaagataggaacagatatagaagatttcaaatgctcgtggttggtggttaaggcattagagcgctgcagcgaagaacaaactaagatattatatgagaactatggtaaacccgacccatcgaacgttgctaaagtgaaggatctctacaaagagctggatcttgagggagttttcatggagtatgagagcaaaagctacgagaagctgactggagcgattgagggacaccaaagtaaagcaatccaagcagtgctaaaatccttcttggctaagatctacaagaggcagaagtag

SEQ ID NO: 1948 - protein, 384 aa, Arabidopsis thaliana
MSVSCCCRNLGKTIKKAIPSHHLHLRSLGGSLYRRRIQSSSMETDLKSTFLNVYSVLKSDLLHDPSFEFTNESRLWVDRMLDYNVRGGKLNRGLSVVDSFKLLKQGNDLTEQEVFLSCALGWCIEWLQAYFLVLDDIMDNSVTRRGQPCWFRVPQVGMVAINDGILLRNHIHRILKKHFRDKPYYVDLVDLFNEVELQTACGQMIDLITTFEGEKDLAKYSLSIHRRIVQYKTAYYSFYLPVACALLMAGENLENHIDVKNVLVDMGIYFQVQDDYLDCFADPETLGKIGTDIEDFKCSWLVVKALERCSEEQTKILYENYGKPDPSNVAKVKDLYKELDLEGVFMEYESKSYEKLTGAIEGHQSKAIQAVLKSFLAKIYKRQK

SEQ ID NO: 1949 - DNA, 930 bp, Arabidopsis thaliana
atggaaggaaccggcgttgtggcggtgtacggtaacggtgcgataacggaggcgaagaaatctcccttctccgtgaaggtcggtttggctcagatgctccgtggtggtgttatcatggatgtcgtcaacgccgagcaagctcgtatcgccgaggaggctggtgcttgcgccgtcatggctttggagcgtgttcctgctgatatccgcgctcaaggaggcgtcgctcgtatgagcgatccacaaatgattaaagaaatcaaacaagccgttacgattccggtgatggctaaggctaggattggtcatttcgttgaagctcagatccttgaagcaattggaatcgattacatcgatgagagcgaggttttgactcttgctgatgaagatcatcacatcaacaagcataatttccggatcccgttcgtttgcggttgccggaatctcggcgaggctctgaggaggatccgtgaaggtgcggcgatgattaggaccaaaggtgaagctggaaccggtaacattattgaagctgtgaggcatgtgaggtctgttaatggtgacattagggttttgcgaaacatggatgatgatgaggttttcactttcgctaagaaattagccgctccgtacgatctcgtgatgcagactaagcagcttggtcgtcttcctgtagtccaattcgccgccggtggagtggctactccggctgatgcagctctcatgatgcagcttggatgtgatggtgtctttgttggttctggtatcttcaagagcggtgacccagctcgtcgtgcacgtgccattgttcaggctgtgactcattacagtgaccctgagatgcttgtggaggtgagctgtgggcttggagaagccatggttgggatcaatctcaacgatgagaaggttgagaggttcgctaatcgctccgagtga

SEQ ID NO: 1950 - protein, 309 aa, Arabidopsis thaliana
MEGTGVVAVYGNGAITEAKKSPFSVKVGLAQMLRGGVIMDVVNAEQARIAEEAGACAVMALERVPADIRAQGGVARMSDPQMIKEIKQAVTIPVMAKARIGHFVEAQILEAIGIDYIDESEVLTLADEDHHINKHNFRIPFVCGCRNLGEALRRIREGAAMIRTKGEAGTGNIIEAVRHVRSVNGDIRVLRNMDDDEVFTFAKKLAAPYDLVMQTKQLGRLPVVQFAAGGVATPADAALMMQLGCDGVFVGSGIFKSGDPARRARAIVQAVTHYSDPEMLVEVSCGLGEAMVGINLNDEKVERFANRSE

SEQ ID NO: 1951 - DNA, 1314 bp, Arabidopsis thaliana
atggaagaatcatcaaaccaacaaatcctcaactccgagacccgacccgacccgattcaaaaaccaccggaatcaccagccaccaaactctcattcccgagactcttcctctggtttgatcaatcaaatcgcatcaaaactctgctctcatggtccatcttcttcctcctcgccgtcatcgtcccaatgatctcacacttcgtgctaatctgcgccgattgcgatttcaaacaccgtcgtccttacgacggtttagtgcagctttcgttatcgatcttcgccggaatctcgttcgttagtctctcagattggtccaagaaatatggaatccgaaggtttctcttcttcgataagcttaaagatgttagcgataaagttaggatcggatacgaagctaaaatccagagatcaatgaagctactagctatctttgtccttccatcgacaacgcttcaagctatctatcgcatttggtggtatgcttcaggctttaaccaaatcccttacattataaacccaacgctgagccatgtcttagcctgcacactccagctctcttcttggctctaccgtacatcactcttcatcattgcttgtatcctctaccaaaacatctgccacctccaggtcctccgtcttgatgaattcgcacgctgcttcgcctctgagatcaaagatttcagttccatactcgccgagcatctcaaaatccgtcgtgaactgaagattgtcagtcaccggttcagacgattcattcttttgtcattgtttttcgtcactgccactcagttcatggcattgctgactaccatcagagctagtgttccctttaatatctacgaagttggcgagctcgcgttatgctccacaagcttggtgtcaggactattcatatgcttgaaaagtgcaacacaaatgactcacaaagctcaatcagtaacgagcatcgccacaaagtggaacgtgtgcgcgtctttagatacatttgatgttctttatgacggagagactcctaaatgtccaacaactacacaacattcccagattttatcgcgtcgtcgtaatgttgttcaatcgtctgatgatgatgaagaaggagaaggagatgacaatgatcttgagatacatccaatctttgcccgcgccatttcttctcagaaacgtcaagctctagtgacctatctagagaacaacagagcagggatcactgtttacggattcttggtggataaaacatggttgcgtatgatcttcagcatcgaacttgctcttcttctatggctgctcaaaaagacaatcatgaacataacatga

SEQ ID NO: 1952 - protein, 437 aa, Arabidopsis thaliana
MEESSNQQILNSETRPDPIQKPPESPATKLSFPRLFLWFDQSNRIKTLLSWSIFFLLAVIVPMISHFVLICADCDFKHRRPYDGLVQLSLSIFAGISFVSLSDWSKKYGIRRFLFFDKLKDVSDKVRIGYEAKIQRSMKLLAIFVLPSTTLQAIYRIWWYASGFNQIPYIINPTLSHVLACTLQLSSWLYRTSLFIIACILYQNICHLQVLRLDEFARCFASEIKDFSSILAEHLKIRRELKIVSHRFRRFILLSLFFVTATQFMALLTTIRASVPFNIYEVGELALCSTSLVSGLFICLKSATQMTHKAQSVTSIATKWNVCASLDTFDVLYDGETPKCPTTTQHSQILSRRRNVVQSSDDDEEGEGDDNDLEIHPIFARAISSQKRQALVTYLENNRAGITVYGFLVDKTWLRMIFSIELALLLWLLKKTIMNIT

SEQ ID NO: 1953 - DNA, 1377 bp, Arabidopsis thaliana
atggcgaagatgtaccggaagttggcactctgcggtggtgagggaggacaagaatgggacgacgatgtatatgagggtgtaagaaaagtgtatgtagggcaagatctcaaccgtatcacttacatcaagtttgagtacgtgcaggaagacggcgaagtagtaacaactgaatatgggacaacaaatcagcaccctaaagagtttgtaattcaatacccggacgaacacatcatagcagtggagggaagttaccaccaagtggctctcattgccacagaggtgattacgtccctcgtcttcaagacctcaaagggtagaaagtctccattgtttggtccaaacttacttggaattacgaccggtacaaagtttgtttttgaggatgagggaaagaagatcgtagggtttcatggacgggcaggtgatgctgtcgacgctcttggagtttactttgtattggataccacgccgttccctctttacaagcttgatgcccaaggtggtacagacgggcgtgtttgggatgatggttcttacgatggcattaaaacgctgcgtattgatcaagataattctcgtatcacttatttagaggttgagtacgagaaagacggggaagcaaaaacatgtaaccatggggggaaaggagatacaccatccgagtttgtgcttggttacccagatgaatacatcaaatcggtggaagcaacctatcagaagccaaacatttttagcaatacggcaattacgtcacttaagttcttaacatcaaaggggagaacatcattctttgggtataatgtgggtaagaagtttgtgttggagcaaaagggtcataggcttgtcgggttccatggaaaggaagatgcagctattgatgctcttggagcatattttggacctgttcctactcctactcccttgattccatctaagaaactaccagcgataggcggcaacgaaggagttacatgggatgatggtgtctacgacggtgtaaggaagatacttgtaggacaaggtaacgatggtgtatcctttgtcaaatttgagtacagtaagggcaaagaccttgtacccggagatgaccatgggaagaagacattactcggagctgaagagtttgtgcttgaagatggtgaatatctcatgaacatagatggctactacgataagatcttcggagttgaggaaccaataattgtatgtcttcagtttaagaccaacaaaagggagtcaatgccgtttggaatggattctggtaagaagttctcgcttggagaggaaggccacaagatcgttggattccatggacaagctagtgatgttgttcacagcatcggagtcactatcgtgcccatcaccaccaccgagtga

SEQ ID NO: 1954 - protein, 458 aa, Arabidopsis thaliana
MAKMYRKLALCGGEGGQEWDDDVYEGVRKVYVGQDLNRITYIKFEYVQEDGEVVTTEYGTTNQHPKEFVIQYPDEHIIAVEGSYHQVALIATEVITSLVFKTSKGRKSPLFGPNLLGITTGTKFVFEDEGKKIVGFHGRAGDAVDALGVYFVLDTTPFPLYKLDAQGGTDGRVWDDGSYDGIKTLRIDQDNSRITYLEVEYEKDGEAKTCNHGGKGDTPSEFVLGYPDEYIKSVEATYQKPNIFSNTAITSLKFLTSKGRTSFFGYNVGKKFVLEQKGHRLVGFHGKEDAAIDALGAYFGPVPTPTPLIPSKKLPAIGGNEGVTWDDGVYDGVRKILVGQGNDGVSFVKFEYSKGKDLVPGDDHGKKTLLGAEEFVLEDGEYLMNIDGYYDKIFGVEEPIIVCLQFKTNKRESMPFGMDSGKKFSLGEEGHKIVGFHGQASDVVHSIGVTIVPITTTE

SEQ ID NO: 1955 - DNA, 609 bp, Arabidopsis thaliana
atgggttgtgttcgctgcaaatcatcagatccatggcaaacatctgccaatgcctttgaatccgtcgatgaatccggaatcaacgaagcctgggttgagatctccagccgcagatcatttgtcgccggcgaaggtagtcggaagaagctagagaggaagaagagccaagtgttactggaaggttacgttgagactgcttcttcttcctcggtggatgatcaaaaggacgatctgacgagatccaagagtttgacggatgacgacctcgaagatcttagaggttgtttagatctagggtttggttttagctacgacgagatccctgagctctgcaacactttacctgctttggagctttgctattcaatgagccagaagttcttagacgataagcaaaataaatcaccggaaacttcgtcggtggaagattgtccgtcgcctccactggtcaccgccactccgattgccaattggaagatctctagtcccggtgataatccggatgatgtgaaagctaggctcaaatactgggcacaagccgttgccttgctgagagactttgtgtttatgagagctatcactaactggttatggacctccacttgctga

SEQ ID NO: 1956 - protein, 202 aa, Arabidopsis thaliana
MGCVRCKSSDPWQTSANAFESVDESGINEAWVEISSRRSFVAGEGSRKKLERKKSQVLLEGYVETASSSSVDDQKDDLTRSKSLTDDDLEDLRGCLDLGFGFSYDEIPELCNTLPALELCYSMSQKFLDDKQNKSPETSSVEDCPSPPLVTATPIANWKISSPGDNPDDVKARLKYWAQAVALLRDFVFMRAITNWLWTSTC

SEQ ID NO: 1957 - DNA, 858 bp, Arabidopsis thaliana
atggagcatgaatctatcaccgctcgacgcaggctcgctgccttcgccgctcacttcccggcaaccagttacgattccgcctccaccgcatctctcgtccccttgaactgcagcagcagtttgaacactgtcatccaaaggtgtgacaacaaaatctcttttgcccggcaagcatcatctgaacagggcttttttatgaggccagcttcacccgatgatgtccttgagaacttaggtatgaatttgaagaacactgtcgttagaaggggtgacaacaggctgtattttgctcggcaagcatcttctgcacaaggtttttttatgagacaggcttcgactaatgagaggaccataccacatgatgctgctgcatctaccaagttttctgctaccaaaacaactggcttcgattcttcttcacctgcgtacgctgcaccacacttttctaagcctgcaaaagaggacatcttttttccttctttatcaccaaatctgcaaaaggaaaggcctaagcttgatcttcctaagttagccaatttaggtactgtttggtctcccagatcgaatgttgctgaatcgacacacagctatgttgtggcaatagagctaccaggagccagtatcaatgatataagagtggaggttgacaacacaaacttgactgtgacaggtagacgcacatctatctgtcaaaaagttgatgcaggcaccaaagcttcgatccttggatatcataagcaagaaatactacaaggaccattcaaagtttcctggccactccccagcaatgtgaacaaggataatgtttccgctgaatttatggatgggattctgagaatagtaattccaaagctttga

SEQ ID NO: 1958 - protein, 285 aa, Arabidopsis thaliana
MEHESITARRRLAAFAAHFPATSYDSASTASLVPLNCSSSLNTVIQRCDNKISFARQASSEQGFFMRPASPDDVLENLGMNLKNTVVRRGDNRLYFARQASSAQGFFMRQASTNERTIPHDAAASTKFSATKTTGFDSSSPAYAAPHFSKPAKEDIFFPSLSPNLQKERPKLDLPKLANLGTVWSPRSNVAESTHSYVVAIELPGASINDIRVEVDNTNLTVTGRRTSICQKVDAGTKASILGYHKQEILQGPFKVSWPLPSNVNKDNVSAEFMDGILRIVIPKL

SEQ ID NO: 1959 - DNA, 1464 bp, Arabidopsis thaliana
atgcaaacgcttctctgtcagccatgtaagtctcttcctatactcactgcttcgtcgtcgtcgtcgttgattcgtagctccggtgatgtgcgagaatgtatcgattttagagcgtcggagaaagtctcgaagtttcaatttcatgtaaccctaagcccctttgcctttcgtggtttctcaatatgtcgcgaatttgctgttcgtggagcttatgggattagattttgctcacgagaagatgtttccggtgttggaaatggaggaatcgtggcggaggaggagattgagctattgaacaagccgaatcctttaccaaaatcagaaaatgaggagagtggtaaagcagacgatgacgcgattctggagccgtttttgaaattctttaaaccggaagaagaaggggaaggaattgaatcggaagtttcggatgagacggatagagtcagcgtagagtattatgatcctaaaccaggtgattttgtggttggtgttgtggtttcgggtaatgagaataagcttgatgtgaatattggtgcagatatgttgggaactatgttgacgaaagagatacttcctttgtatgataaagagttggattatttgttgtgtgatttgaagtatgatgctgaagagtttttggttaatgggaaaatggggattgttaaggatgatgatgaaggtgttgagattgcggagtttgctcggcaaggtaggccggtggtggagattgggacggttgttttcgcggaggttttagggaggacgttgagtggaagacctttgctttcttctagacggtattttcggagaatcgcttggcaccgagtgaggcagatcaaacaacttaatgagcctattgaagttaagataacagagtggaatactggagggcttctcaccagaattgagggcttgagagcttttattccgaagcaggaactggtgggtcgtagattccttgtgcagataacgcgattgaacgaagacaaaaacgacttgatactgagtgaaaaagtagcctgggagaagctgtaccttcgagaaggaacactcttagaaggaacagttgtcaaaatcttaccatatggagctcaagtcaaacttggggatagtagcagaagtggactgctacacatttcaaacataactcgaagaagaattggatcggtgagcgatgtgcttcaggtggacgaaagtgtaaaggttctggttgtgaaatctctatttccagacaagatctctcttagcattgctgatcttgaaagcgaaccaggattgttcatctcagacagagagaaagtgtttacggaagctgaagagatggcgaagaagtacagagaaaaaatgcctttggtggctacaagtccaatttctgatcgtcctccgatcacaagcagtttcccacagggcaaggatgaagaaatctatgctaactgggagtggttcaagttcgagagtcagtga

SEQ ID NO: 1960 - protein, 487 aa, Arabidopsis thaliana
MQTLLCQPCKSLPILTASSSSSLIRSSGDVRECIDFRASEKVSKFQFHVTLSPFAFRGFSICREFAVRGAYGIRFCSREDVSGVGNGGIVAEEEIELLNKPNPLPKSENEESGKADDDAILEPFLKFFKPEEEGEGIESEVSDETDRVSVEYYDPKPGDFVVGVVVSGNENKLDVNIGADMLGTMLTKEILPLYDKELDYLLCDLKYDAEEFLVNGKMGIVKDDDEGVEIAEFARQGRPVVEIGTVVFAEVLGRTLSGRPLLSSRRYFRRIAWHRVRQIKQLNEPIEVKITEWNTGGLLTRIEGLRAFIPKQELVGRRFLVQITRLNEDKNDLILSEKVAWEKLYLREGTLLEGTVVKILPYGAQVKLGDSSRSGLLHISNITRRRIGSVSDVLQVDESVKVLVVKSLFPDKISLSIADLESEPGLFISDREKVFTEAEEMAKKYREKMPLVATSPISDRPPITSSFPQGKDEEIYANWEWFKFESQ

SEQ ID NO: 1961 - DNA, 2352 bp, Arabidopsis thaliana
atggcggcggatgctctgagaatctcgagttctagttctggttcgttggtttgtaatcttaatggttcacaaagacgacctgttcttcttcctctgtctcatcgtgctacctttctgggtcttcctcctcgtgcttcatcttcttcgatttcttcttcaattcctcagtttctgggtacttctcgtattgggctaggttcttccaagctctcacaaaagaagaaacaattctcagtcttcgctgcagctgaagccgaggcgaagcgggctgtaccgcttaaagattaccgaaacatcggtattatggctcacatagacgcgggaaagacgacaacaaccgagaggattctttactacacaggaagaaactacaaaatcggtgaagtgcatgaagggacagctacaatggattggatggaacaagagcaagaacgaggaatcaccattacttcagctgcaaccacaacgttttgggataaacacaggatcaatattattgatacaccgggtcacgtcgatttcactctggaagttgaacgtgctttaagagttctcgatggagctatatgcttgttcgatagtgttgctggtgttgagcctcagtctgagactgtgtggagacaagctgataaatatggtgtgcctaggatttgctttgttaacaagatggacaggcttggagctaactttttcaggactagggacatgattgtgaccaatttgggtgctaagccgctggtgcttcagataccaattggtgctgaagatgtctttaaaggtgttgttgatcttgtgaggatgaaagctatagtttggtcaggagaagagcttggtgcaaagttcagttacgaggatattccagaagatcttgaagatttggctcaagagtatcgggcggcgatgatggaattgattgttgatttggatgatgaggtcatggagaactatttagaaggagttgagcctgacgaggccacggtaaagagattggttagaaaaggaaccatcacgggcaagtttgtgccaattctatgtggttcagcctttaagaacaaaggagtgcagccattgctcgacgctgtggtcgattatctgccttcgcccgttgaagtcccgccgatgaatggaacagatcctgagaacccggaaattaccattatacggaaaccagatgatgacgagccatttgctgggctagcattcaagatcatgagtgatccttttgtgggttctcttacatttgtgagggtttactcagggaaaatctcagctggttcttacgtgttgaatgctaacaaaggaaagaaggagagaatcggaagactcttggaaatgcacgcaaacagcagagaagatgttaaagtggctttgacaggtgacattatcgctcttgcgggtctcaaagatacaatcactggtgaaaccttgagtgatccagaaaaccccgttgttcttgaacgaatggacttccctgatcccgtcatcaaggtagcgattgagccaaaaacaaaagcagacatcgacaaaatggcgacagggttgatcaagctcgctcaagaagacccgtctttccatttttctcgtgatgaagagatgaaccaaaccgtcattgaaggaatgggagaacttcatctcgagattatcgttgacagacttaaaagagagttcaaggtggaggctaacgttggtgcaccgcaagtcaactaccgtgagagtatctccaaaatagctgaagtgaaatacacacacaagaagcaatcaggtggacaaggtcagtttgctgatattacagtccggtttgagccattggaagcagggtcaggatacgaattcaagagtgagatcaaaggaggagctgtgccaagagagtatattcctggtgtcatgaaaggacttgaggagtgtatgagcaccggtgtgcttgctggtttcccggttgttgatgtccgtgcttgtctagttgacggatcttaccatgacgtagactcaagcgtgctagctttccagcttgctgcaagaggagctttccgtgaagggatgaggaaagcgggtccgagaatgcttgaacctatcatgagagttgaagttgttacaccagaagaacatcttggtgatgtcattggtgatcttaactcacgaagaggtcaaattaacagcttcggagacaaacccggtggtctcaaggtggtcgactctctggttccattggcagagatgtttcagtacgtgagtacattgagagggatgacaaaaggtcgagcttcttacacaatgcaactggctaagttcgacgttgttcctcaacatattcagaaccaactttcatccaaggatcaagaagttgctgcttaa

SEQ ID NO: 1962 - protein, 783 aa, Arabidopsis thaliana
MAADALRISSSSSGSLVCNLNGSQRRPVLLPLSHRATFLGLPPRASSSSISSSIPQFLGTSRIGLGSSKLSQKKKQFSVFAAAEAEAKRAVPLKDYRNIGIMAHIDAGKTTTTERILYYTGRNYKIGEVHEGTATMDWMEQEQERGITITSAATTTFWDKHRINIIDTPGHVDFTLEVERALRVLDGAICLFDSVAGVEPQSETVWRQADKYGVPRICFVNKMDRLGANFFRTRDMIVTNLGAKPLVLQIPIGAEDVFKGVVDLVRMKAIVWSGEELGAKFSYEDIPEDLEDLAQEYRAAMMELIVDLDDEVMENYLEGVEPDEATVKRLVRKGTITGKFVPILCGSAFKNKGVQPLLDAVVDYLPSPVEVPPMNGTDPENPEITIIRKPDDDEPFAGLAFKIMSDPFVGSLTFVRVYSGKISAGSYVLNANKGKKERIGRLLEMHANSREDVKVALTGDIIALAGLKDTITGETLSDPENPVVLERMDFPDPVIKVAIEPKTKADIDKMATGLIKLAQEDPSFHFSRDEEMNQTVIEGMGELHLEIIVDRLKREFKVEANVGAPQVNYRESISKIAEVKYTHKKQSGGQGQFADITVRFEPLEAGSGYEFKSEIKGGAVPREYIPGVMKGLEECMSTGVLAGFPVVDVRACLVDGSYHDVDSSVLAFQLAARGAFREGMRKAGPRMLEPIMRVEVVTPEEHLGDVIGDLNSRRGQINSFGDKPGGLKVVDSLVPLAEMFQYVSTLRGMTKGRASYTMQLAKFDVVPQHIQNQLSSKDQEVAA

SEQ ID NO: 1963 - DNA, 2667 bp, Arabidopsis thaliana
atggcggaaacagtggagctcccgagtaggttagcgattcttcctttcaggaataaggttctcttacctggcgccattattcgaatccgttgtacttctcatagcagcgtcacactagtggagcaagagctatggcagaaagaagagaaaggtttaattggcattttacctgttcgtgatgatgccgagggttcttcaattgggacgatgattaatccaggtgctggaagtgattctggagaaagaagcttgaaatttctagttggtacaacagatgctcagaagtctgatgctaaagatcagcaggatcttcaatggcacaccaggggagtagcagctcgtgctctgcatctttcaagaggggtggaaaaaccaagtggaagagttacgtatgtggttgtccttgaaggtctgagcaggtttaatgttcaggagcttggaaagagaggaccatattcggttgctcggattacatcgctcgagatgacaaaggcagagttggagcaagtaaaacaagatccagattttgtagcactgtcacgccagtttaaaaccacagctatggagcttgtctctgtgcttgagcagaaacaaaaaactggtggaaggacaaaagtgcttttggagacagttcctatccataaactagcagacatatttgttgctagctttgagatgagttttgaagagcaactatctatgctggattcagttgaccttaaagtaagactttcaaaggctactgaactagttgatcggcatctgcagtcaattcgcgtggcagagaagattacgcagaaggtggagggccagttgtcaaagtctcagaaggagtatctcttgcgccagcagatgagagctattaaagaggagcttggtgacaacgatgatgatgaagatgatgtagctgcacttgaaagaaagatgcaagctgcgggaatgccgtcaaacatatggaagcatgctcaaagggaattgaggcgtctaaaaaagatgcaacctcagcaacctggctataacagttcacgagtttacctggagctgttggctgatcttccttgggataaggcaagcgaagaacatgagttggatctaaaagcagcaaaagaacgtcttgacagtgatcactatggtttagccaaggtcaagcaacggatcattgaatatctggctgttcgaaagcttaaaccagatgcgagaggcccagtattgtgctttgttggtccaccaggtgtgggcaagacgtctttggcatcatctattgcagctgcattaggtagaaaatttgttcgcttatctttgggtggtgtgaaagatgaagctgacattagaggacacagaagaacttatataggaagcatgccagggcgcctcattgatggcctaaagagggttggtgtttgcaatccagttatgctgttggatgagattgacaaaacaggctcagacgttcggggtgatccagcttctgcactgctcgaggttttggatccagagcagaacaaatcttttaatgatcactatctgaatgttccatatgacttatcaaaggtggtttttgttgccactgctaatagggttcaacctattccacctcctcttctagacaggatggagctaattgagttgcctggttatacgcaagaggaaaaacttaagatagctatgcgccatctgattcctcgagttctagatcagcatgggcttagttccgagttcctcaagattccagaggctatggtaaagaatataattcagaggtatacaagggaagccggtgttcgtagtctagagaggaacttggctgctttagctcgtgcagctgctgtgatggtggcagagcatgaacaaagtcttccgttgagcaaagatgtgcagaaacttacatctcctctgcttaatggtagaatggccgaaggaggcgaagtggaaatggaagttattccaatgggtgtaaatgatcatgagattggaggcaccttccagagtccctcagctttggtggtggatgagaccatgcttgaaaaaatcctcgggcctccaaggtttgatgacagtgaagccgctgatcgagtggcgtcagctggcgtttcagtgggtctcgtttggactacttttggtggtgaagtccagttcgtggaggctacatctatggtgggcaaaggcgaaatgcatttgacgggccaactcggagatgttatcaaagaatctgctcaattagctcttacatgggtaagagctcgtgcgtcggattttaagctggcacttgcaggggatatgaatgttcttgatggacgagacatccacattcactttcctgctggtgcagtgccgaaagacgggccttctgcgggagtgactttggtgacagctttggtttcgttgttcagtcagaaacgagttagagcagacacagccatgaccggagagatgacactcagaggtctcgttctgcctgttggtggcatcaaagataagatattggctgcacaccggtatggtatcaaaagagtgattctaccgcaaaggaactcgaaagacttagttgaagtacccgccgctgtactttccagtctggaggtgatattggcaaagagaatggaagacgtcctggaaaatgcattcgaaggaggttgtccatggcggaacaactactctaaattatga

SEQ ID NO: 1964 - protein, 888 aa, Arabidopsis thaliana
MAETVELPSRLAILPFRNKVLLPGAIIRIRCTSHSSVTLVEQELWQKEEKGLIGILPVRDDAEGSSIGTMINPGAGSDSGERSLKFLVGTTDAQKSDAKDQQDLQWHTRGVAARALHLSRGVEKPSGRVTYVVVLEGLSRFNVQELGKRGPYSVARITSLEMTKAELEQVKQDPDFVALSRQFKTTAMELVSVLEQKQKTGGRTKVLLETVPIHKLADIFVASFEMSFEEQLSMLDSVDLKVRLSKATELVDRHLQSIRVAEKITQKVEGQLSKSQKEYLLRQQMRAIKEELGDNDDDEDDVAALERKMQAAGMPSNIWKHAQRELRRLKKMQPQQPGYNSSRVYLELLADLPWDKASEEHELDLKAAKERLDSDHYGLAKVKQRIIEYLAVRKLKPDARGPVLCFVGPPGVGKTSLASSIAAALGRKFVRLSLGGVKDEADIRGHRRTYIGSMPGRLIDGLKRVGVCNPVMLLDEIDKTGSDVRGDPASALLEVLDPEQNKSFNDHYLNVPYDLSKVVFVATANRVQPIPPPLLDRMELIELPGYTQEEKLKIAMRHLIPRVLDQHGLSSEFLKIPEAMVKNIIQRYTREAGVRSLERNLAALARAAAVMVAEHEQSLPLSKDVQKLTSPLLNGRMAEGGEVEMEVIPMGVNDHEIGGTFQSPSALVVDETMLEKILGPPRFDDSEAADRVASAGVSVGLVWTTFGGEVQFVEATSMVGKGEMHLTGQLGDVIKESAQLALTWVRARASDFKLALAGDMNVLDGRDIHIHFPAGAVPKDGPSAGVTLVTALVSLFSQKRVRADTAMTGEMTLRGLVLPVGGIKDKILAAHRYGIKRVILPQRNSKDLVEVPAAVLSSLEVILAKRMEDVLENAFEGGCPWRNNYSKL

SEQ ID NO: 1965 - DNA, 339 bp, Arabidopsis thaliana
atggcgtcgttcgacgaagcacctcccggaaaccccaaagccggtgaaaagatcttcagaaccaagtgcgctcagtgtcacaccgtcgagaaaggtgccggtcacaaacaaggaccgaatttgaatggattgtttggaagacaatctggaacaactccaggatattcttactctgctgctaacaaaagcatggctgtgaattgggaggagaagactctttacgattacttgttgaatcctaagaagtacatccctggaacaaaaatggtgtttcctggactgaaaaaaccgcaagatcgtgccgatctcatcgcttatttgaaggaaggtactgcttag

SEQ ID NO: 1966 - protein, 112 aa, Arabidopsis thaliana
MASFDEAPPGNPKAGEKIFRTKCAQCHTVEKGAGHKQGPNLNGLFGRQSGTTPGYSYSAANKSMAVNWEEKTLYDYLLNPKKYIPGTKMVFPGLKKPQDRADLIAYLKEGTA

SEQ ID NO: 1967 - DNA, 933 bp, Arabidopsis thaliana
atggtgtttggaaaagggtcaaaccttgacagattccttcattgcacaacacctgtagtgccaccccaatctctatccaaggcggagattaggagtttgaataggatttggcatccatgggagagacaaaaggttgagtttttcagattgagtgatctatgggattgttatgatgaatggagtgcttatggagctggtgttccaattcgtctctctaatggagaatctcttgttcaatattatgttccctatctctctgctattcagattttcacctctcgttcttccttgatccgcttaagggatgattctgaagatggggaaagcagagattcgtttagtgattcatatagtgatgagagtgaaagtgataaactttcgagatgtgcttctgatgaaggacttgaacatgacgctctcttgcatcctaatgatcggttgggatatctttatctgcaatactttgagagatcagctccttatgctcgagttcctctcatggataagatcaatgaattggctcaaaggtacccgggactaatgtcgttgcgaagcgtagatctttccccggcaagttggatggcggtagcgtggtaccctatttaccatattccaatgggaaggaccatcaaagatttgtccacttgtttcctcacttatcacactctttcatcttctttccaagatatggagccagaagaaaatggcggggaaaaggagaggatccggaaggaaggagaaggtgtaactttgcttccttttgggttagccacttataagatgcaaggcaatgtttggctctcggaagacgatcaaggtcaagatcaagagcgagttctttcgcttctaagtgttgcggattcttggctaaaacagctaagagtccaacaccatgacttcaactacttctcaagaatggctcaccgtggctga

SEQ ID NO: 1968 - protein, 310 aa, Arabidopsis thaliana
MVFGKGSNLDRFLHCTTPVVPPQSLSKAEIRSLNRIWHPWERQKVEFFRLSDLWDCYDEWSAYGAGVPIRLSNGESLVQYYVPYLSAIQIFTSRSSLIRLRDDSEDGESRDSFSDSYSDESESDKLSRCASDEGLEHDALLHPNDRLGYLYLQYFERSAPYARVPLMDKINELAQRYPGLMSLRSVDLSPASWMAVAWYPIYHIPMGRTIKDLSTCFLTYHTLSSSFQDMEPEENGGEKERIRKEGEGVTLLPFGLATYKMQGNVWLSEDDQGQDQERVLSLLSVADSWLKQLRVQHHDFNYFSRMAHRG

SEQ ID NO: 1969 - DNA, 828 bp, Arabidopsis thaliana
atgacaagtttaattgcatttcttttcactgtccttgtcatcgtatcttctgttcattgtcgtatgacaactgctagtactccaggttatgggataaagcaggaggatcgtctatgcatccaaggacaagaaggaacaaagttatgtagttctggaacaagtcgcgactgccttaacttttgtttaattcgtggttatgctgaagcagtcgcggatctcaatttcaggtgtttgcgattccgatttaggtttgatcggttgaaattttttccgatggtggatcattaccaagttctaggcgttacgagaaacgcgacgaagaaggaggttaaagatgcgtttaggagattggcgattaagtatcatccggataagcacgctcagtctccggagcatgttcgtcataacgccaccgtgcggtttaagcttgtatcggaggcgtacgaagttttgaatgatgatctgaaacgcgcgtcttataacgctggtagcgattctgattgctttcgccgtacgagcggttcgtatagtaatccgtatggaaatcgtggtggcagagcgcaaggttctggttacggttatggttatggttactctacgaggaatcgtcaggcctctagcttcagcagcgggtttgattcgacgtttcgttatttgactacgcgagcgtttctattgaatctcgcattagctggtggtctgtactttgcgtttactgcgattgatacaagcggagaaacactatggaaaatgcgtaactcagggaaatcattcgaagaagcaatggaatcaatcgagaaatcaaagtcacataaagatgaagggtga

SEQ ID NO: 1970 - protein, 275 aa, Arabidopsis thaliana
MTSLIAFLFTVLVIVSSVHCRMTTASTPGYGIKQEDRLCIQGQEGTKLCSSGTSRDCLNFCLIRGYAEAVADLNFRCLRFRFRFDRLKFFPMVDHYQVLGVTRNATKKEVKDAFRRLAIKYHPDKHAQSPEHVRHNATVRFKLVSEAYEVLNDDLKRASYNAGSDSDCFRRTSGSYSNPYGNRGGRAQGSGYGYGYGYSTRNRQASSFSSGFDSTFRYLTTRAFLLNLALAGGLYFAFTAIDTSGETLWKMRNSGKSFEEAMESIEKSKSHKDEG

SEQ ID NO: 1971 - DNA, 606 bp, Arabidopsis thaliana
atggcgatgatgcttctgcaaattcctccttcgtcttccttgttgaacaccagaaaccttcaaatccgattcttccactcttcagtttcagcttcctcgaagaaattcagatgcagagccgtccgtgagaaggcggaggacattgataagaacatttcgccgccgtcttcttctcctcctcctccttccgccgaagaagttaccaagaaatatggccttgaagttggtctatggaagatattaagctctaaggatgatgaaggaagtgatggagacaataagaagaagaaatcaaaaacagatgaggctaaagagttacttgcaaagtatggtggtgcttatctcgctacatctattactctttctctcatttccttctcactctgctatgtccttgtgacttccggtgttgatgttcaagctcttcttctaaaggttgggatttcgacgaatgagacaggagagaaagtaggagcctttgctttggcttacgcagcgcataaagctgcatctccgataaggtttccgcctacagtggctttgactcctattgtagccaattggattgggaagaaagtggacaaggagaaggatgatgacaagtag

SEQ ID NO: 1972 - protein, 201 aa, Arabidopsis thaliana
MAMMLLQIPPSSSLLNTRNLQIRFFHSSVSASSKKFRCRAVREKAEDIDKNISPPSSSPPPPSAEEVTKKYGLEVGLWKILSSKDDEGSDGDNKKKKSKTDEAKELLAKYGGAYLATSITLSLISFSLCYVLVTSGVDVQALLLKVGISTNETGEKVGAFALAYAAHKAASPIRFPPTVALTPIVANWIGKKVDKEKDDDK

SEQ ID NO: 1973 - DNA, 645 bp, Arabidopsis thaliana
atggcaacgagaggagctgttgctgctgctgcatccacaatatggaagcaccgaagaaacccttctcttcgatcattatctcgccatttcaatcccaatttcaatcatagaatcatcccaacagggtttaaatatcaagttagggcgatacaaggaacaagtactgatcctgtcattacaccattaaagaacagagaggaaccaaagccacaaaactggaaaatcaaaatgctttatgatggagattgtcctctctgtatgcgtgaggttaatatgcttatggaaaggaatgaaaaacatggaactataaagtttgtcgacataagttcaaatgattattccccggaagataatcaagggcttgattacaaaacagtgatggggcagattcatgccattcagtctgatggtaacgttgttaagggtgtggaggcatttaggagattgtatgaagaagttgggcttggatgggtttacactatcaccaaatttgaaccaatagggaagttagcagatgttgtgtatgatgtatgggctaaataccgacttcaagtcacagggaggccatctatagaagctattcttgaagcaagaaagaaagataaggtagagacatgtggtgaaagcaagaactgcaagatatga

SEQ ID NO: 1974 - protein, 214 aa, Arabidopsis thaliana
MATRGAVAAAASTIWKHRRNPSLRSLSRHFNPNFNHRIIPTGFKYQVRAIQGTSTDPVITPLKNREEPKPQNWKIKMLYDGDCPLCMREVNMLMERNEKHGTIKFVDISSNDYSPEDNQGLDYKTVMGQIHAIQSDGNVVKGVEAFRRLYEEVGLGWVYTITKFEPIGKLADVVYDVWAKYRLQVTGRPSIEAILEARKKDKVETCGESKNCKI

SEQ ID NO: 1975 - DNA, 1269 bp, Arabidopsis thaliana
atgtcttcttctgtagcagtgttatgggttgctacttcttctctaaatccagacccaatgaacaattgtgggttggtaagggttctagaatcttctagactgttctctccttgtcagaatcagagactaaacaaaggtaagaagaagcagataccaacttggagttcttcttttgtaaggaaccgaagtagaagaattggtgttgtgtcttcaagcttagtagcaagtccttctggagagatagctctttcatctgaagagaaggtttacaatgttgtgttgaaacaagctgctttggtgaacaaacagctaaggtcttcttcttatgaccttgatgtgaagaaaccacaagatgttgttcttcctgggagtttgagtttgttgggtgaagcttatgatcgatgcggtgaagtttgcgctgaatatgctaagacgttttatcttggaactttgcttatgacacccgaaaggcgaaaggcgatttgggcaatctacgtttggtgtagaagaactgatgaacttgtggatgggccaaatgcttcacatataactcccatggctttagatagatgggaagcaaggttagaagatcttttccgtggtcgtcctttcgatatgcttgatgctgctctcgctgatacagttgctagatacccggtcgatattcagccatttcgagacatgatcgaaggaatgagaatggacttgaagaaatcgagataccagaacttcgatgatctatacctttactgctactacgtcgctggaaccgtcggattgatgagcgttccggttatgggaatcgatcctaagtcgaaagcaacaaccgaaagtgtttacaacgctgccttggcccttggtatagccaatcagcttactaacatactcagagacgtaggcgaagatgcgagaagaggaagggtttatctgcctcaggatgaattggctcaggctggtctttcagatgaagacatattcgccggaaaagtaactgataaatggagaaacttcatgaaaatgcagcttaaacgagcaagaatgttcttcgacgaagctgagaaaggcgtcaccgagctcagtgccgctagcagatggcctgtatgggcttcattgctattgtacaggagaatactggacgagattgaagcgaatgattacaacaattttactaagagagcttatgtggggaaagtcaagaaaattgcagctttgccattggcttatgctaaatcagtactaaagacttcaagttcaagactatcgatatga

SEQ ID NO: 1976 - protein, 422 aa, Arabidopsis thaliana
MSSSVAVLWVATSSLNPDPMNNCGLVRVLESSRLFSPCQNQRLNKGKKKQIPTWSSSFVRNRSRRIGVVSSSLVASPSGEIALSSEEKVYNVVLKQAALVNKQLRSSSYDLDVKKPQDVVLPGSLSLLGEAYDRCGEVCAEYAKTFYLGTLLMTPERRKAIWAIYVWCRRTDELVDGPNASHITPMALDRWEARLEDLFRGRPFDMLDAALADTVARYPVDIQPFRDMIEGMRMDLKKSRYQNFDDLYLYCYYVAGTVGLMSVPVMGIDPKSKATTESVYNAALALGIANQLTNILRDVGEDARRGRVYLPQDELAQAGLSDEDIFAGKVTDKWRNFMKMQLKRARMFFDEAEKGVTELSAASRWPVWASLLLYRRILDEIEANDYNNFTKRAYVGKVKKIAALPLAYAKSVLKTSSSRLSI

SEQ ID NO: 1977 - DNA, 1209 bp, Arabidopsis thaliana
atgacatcaattgaggcaacagaaacgcttaacgctcctccaaagcttcagatctggaacaacgctgccttcgacgatggagattctcaaatcacttccgccatcgaagcttcttcttggtctcacctcaacgaatcattcgattccgattgtagcaaggagaatcagtttccgatttcggtttcctcttcgctccaatcctcagtctcgatcaccgaagctccgtcagcaaaatccaagaccgtgaagaccaaatccgccgcagatcggagtaaaaagcgagatatcgatgcagagatcgaagaagtagagaaggagatcggacgattatcgacgaaattggagtcgctccgattagagaaggcggagcaaaccgcaagaagcattgctatacgtggaagaatcgttccggcgaagttcatggaatcatctcagaaacaagtgaaattcgacgattcgtgttttacaggatcgaaatcaagagccactcgtagaggcgttagtcttggaccagcggagatattcaattccgcgaagaaatctgaaactgtgactcctcttcaatcagctcagaatcgacgcaagtcttgtttctttaagcttcctggaatcgaagaaggtcaagtgacgacacgaggtaaaggaagaacgagtttgagtctgagtccgagatctcgcaaagcgaaaatgacggcagctcagaagcaagcagctacgacggtggggtcaaagagagctgtgaagaaagaagaaggagttctcttaacaatccagcctaagaggctattcaaagaagatgaaaagaatgtttctttaaggaaaccattgaaaccaggaagagttgtggctagtaggtacagtcaaatgggtaaaacgcagactggagagaaagatgttaggaaaaggtcgttgcctgaggatgaagagaaagagaatcataagaggtcggagaagagaagagcttctgatgaaagtaacaagagtgaagggagagtgaagaagagatgggagattccaagtgaagttgatctgtatagcagtggtgagaacggtgacgagtctcctatagttaaggagctacctaagatcagaacgcttcgtcgtgtgggagggagccctcgtgattcaggtgctgctaagagagttgcagaattacaagccaaggatcgtaacttcactttttgccagcttctgaagtttgaagaatga

SEQ ID NO: 1978 - protein, 402 aa, Arabidopsis thaliana
MTSIEATETLNAPPKLQIWNNAAFDDGDSQITSAIEASSWSHLNESFDSDCSKENQFPISVSSSLQSSVSITEAPSAKSKTVKTKSAADRSKKRDIDAEIEEVEKEIGRLSTKLESLRLEKAEQTARSIAIRGRIVPAKFMESSQKQVKFDDSCFTGSKSRATRRGVSLGPAEIFNSAKKSETVTPLQSAQNRRKSCFFKLPGIEEGQVTTRGKGRTSLSLSPRSRKAKMTAAQKQAATTVGSKRAVKKEEGVLLTIQPKRLFKEDEKNVSLRKPLKPGRVVASRYSQMGKTQTGEKDVRKRSLPEDEEKENHKRSEKRRASDESNKSEGRVKKRWEIPSEVDLYSSGENGDESPIVKELPKIRTLRRVGGSPRDSGAAKRVAELQAKDRNFTFCQLLKFEE

SEQ ID NO: 1979 - DNA, 1110 bp, Arabidopsis thaliana
atgttgggtgctggatttcagttgacgagaggcagacacggcgacgatcctttctacacttccgcaaaaactcgcagggccaatcagcgcatcgatcagctccgtagagctcagagcgacgtctctaacgttccatcatcagctccttctccgcataaacaacaactcgagccgtccgatttatcttccagtaatctagatcggtttttagagtcggtcacaccatccgtaccggctcagtttttatccaagacattgctacgagaaagaagagcagatgatgattataataaacttgtgccttattttgtgcttggtgatatatgggactcatttgcagagtggagtgcttacggcaccggtgtgcctcttgttttgaataacaacaaggatcgtgttatccaatactatgtcccttctttgtcagccattcaaatctatgctcattctcatgccttggattcatctcttaaatcaaggcgtcctggtgatagtagcgacagtgattttcgggattcaagtagcgatgttagcagcgatagtgattccgagcgggtttctgctagagtagactgtatctcattgagggatcaacatcaggaagactcttccagtgatgatggcgaacctttaggctctcaaggtcgtttgatgtttgagtatcttgaaagagaccttccatacatccgtgaaccttttgctgataaggtcttggacctcgcagctcagtttcccgagctaatgacgctgagaagctgtgacttacttcggtcaagctggttttctgttgcatggtacccaatttacagaatacccacaggaccgacactgaaggacctggatgcttgtttcttgacgtatcattccctacacacatcttttggaggtgaaggcagtgaacaatcaatgagccttacgcaaccaagggagagcgagaagatgtcattgcctgtgtttgggcttgcttcatacaagttcagaggttcattatggacacccattgggggttcggagcaccagctcgtgaactctctgttccaagccgctgacaaatggctgcattcttgtcatgtcagccaccctgatttcctcttcttctgccgtcgttga

SEQ ID NO: 1980 - protein, 369 aa, Arabidopsis thaliana
MLGAGFQLTRGRHGDDPFYTSAKTRRANQRIDQLRRAQSDVSNVPSSAPSPHKQQLEPSDLSSSNLDRFLESVTPSVPAQFLSKTLLRERRADDDYNKLVPYFVLGDIWDSFAEWSAYGTGVPLVLNNNKDRVIQYYVPSLSAIQIYAHSHALDSSLKSRRPGDSSDSDFRDSSSDVSSDSDSERVSARVDCISLRDQHQEDSSSDDGEPLGSQGRLMFEYLERDLPYIREPFADKVLDLAAQFPELMTLRSCDLLRSSWFSVAWYPIYRIPTGPTLKDLDACFLTYHSLHTSFGGEGSEQSMSLTQPRESEKMSLPVFGLASYKFRGSLWTPIGGSEHQLVNSLFQAADKWLHSCHVSHPDFLFFCRR

SEQ ID NO: 1981 - DNA, 897 bp, Arabidopsis thaliana
atggggttagagaggaaagtgtacggtttggttatggtatctttggtacttatggctattgcaacgatgtgttgtgtccaagctacgatcgaggaagaagcggctaaggatgaatcatggactgattgggcaaaggagaagatcggtctcaagcacgaagacaacatccaacccactcacaccaccacgaccgttcaagacgacgcttggagagcgagtcaaaaagccgaggacgcaaaggaggcggctaaacgcaaagcagaggaagcggttggagccgcgaaggagaaagcgggttcggcatacgagacagctaaatcgaaagttgaggagggtttggcttctgtaaaagacaaggcctcgcagagttacgactcagctggtcaagttaaggatgacgtgtctcacaagtcaaagcaagttaaagatagcttgtcgggagacgaaaacgatgagtcttggaccggttgggccaaagagaaaatcggaatcaagaacgaagacatcaacagccctaacttgggagagacggtatctgagaaggcaaaagaagctaaggaagcggctaaacgcaaagcaggagatgctaaagagaagttggcggagacagttgagacggcgaaagagaaggcgagcgatatgacgagtgcagctaaggagaaggcggagaagttgaaggaggaagcagagagagagagtaagagtgcgaaggagaaaattaaagaaagttatgagactgcaaaatcaaaagccgatgagactttagagtccgcgaaagataaggcgtcgcagagttacgactcagctgcgcgtaaatcggaggaagctaaagataccgtgtctcacaagtcaaaacgtgttaaagagagcttgaccgacgatgatgctgagctctga

SEQ ID NO: 1982 - protein, 298 aa, Arabidopsis thaliana
MGLERKVYGLVMVSLVLMAIATMCCVQATIEEEAAKDESWTDWAKEKIGLKHEDNIQPTHTTTTVQDDAWRASQKAEDAKEAAKRKAEEAVGAAKEKAGSAYETAKSKVEEGLASVKDKASQSYDSAGQVKDDVSHKSKQVKDSLSGDENDESWTGWAKEKIGIKNEDINSPNLGETVSEKAKEAKEAAKRKAGDAKEKLAETVETAKEKASDMTSAAKEKAEKLKEEAERESKSAKEKIKESYETAKSKADETLESAKDKASQSYDSAARKSEEAKDTVSHKSKRVKESLTDDDAEL

SEQ ID NO: 1983 - DNA, 654 bp, Arabidopsis thaliana
atggcgagcattagcaacgagcccgagcgtgagaacagagacgaagaagagactggagccaacgaagatgaagacaccggtgctcaggttgctcctatcgtcaggcttgaagaagtcgccgtcaccaccggtgaagaagacgaagacaccatcctcgatctgaaatcgaagttgtatcgatttgataaagatggaagtcagtggaaggagagaggtgctggtactgttaagtttttgaaacatagagtttctgggaagattcgtctcgttatgaggcaatcgaaaactttgaagatctgtgctaatcatcttgttggatcgggtatgagtgttcaggaacacgctgggaatgataagtcttgtgtatggcacgctcgtgatttctccgatggtgaattgaaggatgagctcttctgtatccggtttgcttcagttgagaattgcaaagcatttatgcaaaagttcaaggaagtagctgaatctgaagaagagaaagaagagagcaaagatgcctctgataccgctggtcttcttgagaagttaacagtggaagagaaggaaagtgagaagaaaccagtggagaaggcagaggaaaacaaaaagagtgaagctgttgaagaaaagaaaacagaggagtctgttccctcagcttaa

SEQ ID NO: 1984 - protein, 217 aa, Arabidopsis thaliana
MASISNEPERENRDEEETGANEDEDTGAQVAPIVRLEEVAVTTGEEDEDTILDLKSKLYRFDKDGSQWKERGAGTVKFLKHRVSGKIRLVMRQSKTLKICANHLVGSGMSVQEHAGNDKSCVWHARDFSDGELKDELFCIRFASVENCKAFMQKFKEVAESEEEKEESKDASDTAGLLEKLTVEEKESEKKPVEKAEENKKSEAVEEKKTEESVPSA

SEQ ID NO: 1985 - DNA, 2352 bp, Arabidopsis thaliana
atgggtttctctcaggccattcgcttgaatcttgcttccttctcctctccctctccctgcgattattgtttgacaagagtagtaaaccataagcagaagagtcttgtcgcattcccgagcattacaaggagaaagagacatcttttactgagtgttcaatcagtcttgcacaatacaagacccaacatcaacgacaatggctcagctgagtctgcaaatgttcttttcgataaattatttgctcggacacacagattggagagacaaaccaatcaacactcggtttatcctgacgatgatgatctcccctattcaaaccttggcgtgcttgagtctgaccttgaggctgcgctagtggccttgttgaaaagggaagaggacctgcacgatgctgagaggaagcttctctctgacaaaaataaacttaaccgggcaaaggaggagttagaaaaacgtgagaaaacaatctctgaagcttcgttgaagcatgagagtctacaagaggagctgaagcgggcaaatgtggagttagcttctcaagccagggagatagaagagttaaagcataagctaagggaaagagacgaggaacgtgctgctttgcaatcgtccttgactttgaaagaggaagagctagagaagatgcgtcaagagattgcaaacagaagcaaggaggtttctatggctatttctgaatttgaaagcaagtcacaactcttaagcaaagccaacgaagttgtcaagagacaagaaggtgaaatatatgcacttcagagagctcttgaggagaaggaagaagaattagagatttctaaggctacgaagaaacttgaacaagaaaagcttagagaaacagaagccaacttgaagaaacagacagaagagtggctgatagcccaggatgaagtgaataagcttaaagaggaaaccgtgaaacgtttaggagaagccaatgaaaccatggaggacttcatgaaagtgaaaaagcttctgactgatgtaagattcgagcttatttcttctcgggaagctttggtattttccagggagcaaatggaagaaaaagagctactattggaaaaacaattggaggaactcgaggaacagaggaaaagtgtgttgtcatatatgcaaagcttgagggatgcgcacactgaagttgaaagtgagagagtaaagctcagagttgttgaggctaaaaattttgcgcttgagcgggaaatatcggtccaaaaagaattgctggaggatttacgagaggagttgcagaaagagaaaccattgttggagctagctatgcatgatatatccgttattcaagatgagctttacaaaaaagctaatgcgtttcaggtatcacaaaatctacttcaggagaaagagtcaagtttggtggaggccaaactagagattcagcatctgaagtccgaacaggcttctctagaactattactgcaagaaaaggatgaagaactcgctgaagctcgaaataaattgggagaagtgaaccaggaggtaacagagctaaaggcacttatgatcagtagagaagatcagcttatggaggcaactgagatgctgaaggagaaagatgtccaccttcacagaatagaaggtgagttgggcagttccaagctgaaagtcactgaagctgaaatggtggtggaaagaattgcagaattgacgaacagactgcttatgtcaaccaccaacggtcaaaatcagaatgcaatgaggattaacaatgagataagcattgactcaatgcagcaaccactagagaaacctcatgatgattacggaatggagaacaaacggctggtgatggagttaagcttcaccagagaaaatctacggatgaaagaaatggaagttctagcggtgcagagggctttgacatttaaagacgaagagatcaacgtggtcatgggaagattagaagccaaggagcaggaactcaagaaattgaaagaagaaacgatcaatgacagtgaagatttgaaagtgctatatgccttggcacaagagagagtcggggaaaaaacaatgggtgatctggccatagagatgcttcagcttgaggcagctaaccttgaagttgaagctgcgaccagtgcattacagaagcttgcaaaaatgagcacggaactgttaactcaagctgacatgagcattgaggccgacacaactcacactgtaatgccagagagagggtattcagaaggaagtaatgagtgtcttggtgaggtaaaaacagaagttgtcaggctctggtccttgacagagaaactcctggagaacgcaggaatcgttgctggtacatctacatgcatggaaggtgtaattttataa

SEQ ID NO: 1986 - protein, 783 aa, Arabidopsis thaliana
MGFSQAIRLNLASFSSPSPCDYCLTRVVNHKQKSLVAFPSITRRKRHLLLSVQSVLHNTRPNINDNGSAESANVLFDKLFARTHRLERQTNQHSVYPDDDDLPYSNLGVLESDLEAALVALLKREEDLHDAERKLLSDKNKLNRAKEELEKREKTISEASLKHESLQEELKRANVELASQAREIEELKHKLRERDEERAALQSSLTLKEEELEKMRQEIANRSKEVSMAISEFESKSQLLSKANEVVKRQEGEIYALQRALEEKEEELEISKATKKLEQEKLRETEANLKKQTEEWLIAQDEVNKLKEETVKRLGEANETMEDFMKVKKLLTDVRFELISSREALVFSREQMEEKELLLEKQLEELEEQRKSVLSYMQSLRDAHTEVESERVKLRVVEAKNFALEREISVQKELLEDLREELQKEKPLLELAMHDISVIQDELYKKANAFQVSQNLLQEKESSLVEAKLEIQHLKSEQASLELLLQEKDEELAEARNKLGEVNQEVTELKALMISREDQLMEATEMLKEKDVHLHRIEGELGSSKLKVTEAEMVVERIAELTNRLLMSTTNGQNQNAMRINNEISIDSMQQPLEKPHDDYGMENKRLVMELSFTRENLRMKEMEVLAVQRALTFKDEEINVVMGRLEAKEQELKKLKEETINDSEDLKVLYALAQERVGEKTMGDLAIEMLQLEAANLEVEAATSALQKLAKMSTELLTQADMSIEADTTHTVMPERGYSEGSNECLGEVKTEVVRLWSLTEKLLENAGIVAGTSTCMEGVIL

SEQ ID NO: 1987 - DNA, 912 bp, Arabidopsis thaliana
atggaggagccttgtgagacacttgacagtggtgaagcctatcaaatatctagatatcataactataaccaacacagctccagaagctcatctccctggttggatttgagagtgttctatgtccggataagcaatttcgtggtggaagattcaactcctgaggtcctcactatcaatcacattcctctggatccagatacgcttttggagattaacggtgttagaatgggaatgtactcagaaggaggttcttcacagcttaggagagatcgggttgataagaaatctgaagaagctacttatgtcagcacagacaatatcaggttaactggtagtgtgaagtttgaggtttatgacaaaaatgagctagttttgtctggaactcttgagatgtctggtagtaatggtttcactggggaatcaaagaatcgatggaaaatgaattgtgaggctgaggtcactgcagggtctggtttccttaaggagaagagcataaacggtcaagagttatcgtctccattgccaactatcgaggtctatgttactggttgcttctcaggaacacccatcatcttaaccaagactctgcaacttggtttgaaaaagaagcagagtagaagaatggcattggatgcaattcctgagtatgaaactgcagagcctcagaaagacacctcctatgcacttgatcttcaggcaacaacagagtacgggaattacaaagaggaatacgaaggagacatgtattggagaagtgagtgcattgatggggagatgtcatggtttaatgcaggtgtaagggttggtgttgggataggacttggtgtctgtgttggtcttgggattggtgtcggtcttctcgttcgtacttatcaatcaactaccagaaccttcaggaggaggcttctctag

SEQ ID NO: 1988 - protein, 303 aa, Arabidopsis thaliana
MEEPCETLDSGEAYQISRYHNYNQHSSRSSSPWLDLRVFYVRISNFVVEDSTPEVLTINHIPLDPDTLLEINGVRMGMYSEGGSSQLRRDRVDKKSEEATYVSTDNIRLTGSVKFEVYDKNELVLSGTLEMSGSNGFTGESKNRWKMNCEAEVTAGSGFLKEKSINGQELSSPLPTIEVYVTGCFSGTPIILTKTLQLGLKKKQSRRMALDAIPEYETAEPQKDTSYALDLQATTEYGNYKEEYEGDMYWRSECIDGEMSWFNAGVRVGVGIGLGVCVGLGIGVGLLVRTYQSTTRTFRRRLL

SEQ ID NO: 1989 - DNA, 3132 bp, Arabidopsis thaliana
atggccgggaacgattgggtaaacagttacttagaggcgattctcgacgtcggtcagggtcttgacgatgctcgctcttctccatcacttcttcttagggagagaggtcgattcactcccagccgttactttgttgaggaagttatcactggttacgatgagactgatcttcatagatcctgggttaaggctgttgctacgaggagtccacaagagaggaacacgaggttagagaatatgtgttggaggatctggaatcttgctcgtcaaaagaagcagcatgaggaaaaagaagcacagaggctggctaagcgcaggcttgaacgtgagaaaggtcgcagagaggcaacagctgatatgtctgaggagttttcagagggagaaaaaggagatatcatcagtgatatatctactcatggtgaaagcaccaaaccaaggttgcccagaattaattctgctgagtccatggagttatgggctagccaacagaagggaaataagctctatcttgttttgattagtcttcatggtctcatacgtggtgaaaacatggagctcggccgcgactctgacaccggtggacaggttaaatatgttgtggaacttgcacgtgcactgggttcaatgccaggagtttatagggttgacttgcttactagacaagtgtcttcaccagatgttgactatagttatggtgaacctacggaaatgctgactcctagagattctgaagatttctcggatgagatgggggagagtagcggtgcttatattgtgaggataccatttggtccaaaggacaagtatattccaaaagaacttctatggcctcacattccggaatttgttgatggtgctatgagccacatcatgcaaatgtcaaatgttctcggcgagcaagttggtgttgggaagcctatttggccttctgccatccatggacactatgctgatgctggtgatgccactgccctgctgtcgggtgcactaaatgtgcctatgctccttactggtcactcactcgggagagataaattggagcagcttttgagacaaggccgcctttcaaaagaagaaataaattcaacgtacaagattatgcgtcggatagagggtgaggaattatctcttgatgtttctgaaatggtaataactagcactcgacaggagattgatgagcaatggagactgtatgatggatttgaccccatattggagcgcaaattgagagccagaatcaagcggaatgtgagctgctatggacggttcatgcctcgcatggttaaaattccacctgggatggagttcaatcatattgtcccacatggtggtgatatggaagacacagatgggaacgaggaacatccaacttctccagatccaccaatatgggctgagataatgcgtttcttttcgaattcccgaaagcctatgatacttgcccttgcgaggcctgacccaaaaaagaacatcacgacgttagtgaaggcctttggagaatgtcgtccactgagagagcttgctaacctggcacttattatgggcaaccgagatgggattgatgaaatgtcgagcacaagttcttctgttctcctttctgttctgaagctaattgacaagtatgatctctacggtcaagttgcgtaccctaaacatcacaaacaatcagatgttccagacatatatcgcctagctgcaaagtcaaagggtgttttcatcaatccagctatcattgaaccatttggacttactctaattgaggctgcagctcatggtttacctatggttgctacaaaaaatggtggtcctgtagatattcaccgggtcctggataatggccttcttgtggatcctcatgatcagcagtctatttctgaagctcttcttaagcttgttgctgataagcacctatgggcaaagtgtcggcaaaacgggttgaagaacattcaccaattctcttggccagagcactgcaaaacttatctatctcgcataaccagcttcaaaccaagacatccacagtggcaaagtgatgatggcggtgataattcagaacccgagtcacctagtgattctttgagggatatacaggatatatccttgaacttaaagttttcatttgatggaagtgggaatgataattacatgaaccaagaagggagctccatggataggaagagcaaaatcgaagctgctgtccaaaattggtctaaaggcaaagatagccgcaaaatgggatcactggagaggtcagaggttaactctggaaaattcccagcagtgcggagaaggaagtttattgttgttattgctcttgattttgatggggaagaagacacgctagaggctacaaaaagaattcttgatgcggttgaaaaggaaagagcagaaggatctgttgggttcatactgtcgacatctctaacgatctctgaggtacaatctttcttggtgtcaggaggcttaaacccgaatgatttcgacgctttcatatgtaacagcggaagtgatctccactacacatccctcaacaacgaagacggtccttttgtcgtagacttttactaccactcccacatagaatataggtggggcggtgaagggctgaggaagactttgatccgttgggcatcttcgcttaacgagaaaaaggctgacaatgacgagcagattgtcactcttgctgagcatctttcaactgactactgctacacatttacagtcaaaaagcctgcagcggtacctccagtaagagagcttaggaagctgctgagaatccaggctttacgttgccatgtcgtttatagtcagaatggcacccgaataaacgtcataccggtgctggcttctcgtatacaagctctgaggtatttgttcgtccggtggggaattgacatggcgaaaatggcggtatttgtgggggaatcaggtgatactgattacgaaggattgcttggtgggcttcacaagagcgttgttctaaagggagtgtcgtgcagtgcatgcttgcacgctaaccggagctatcctctcaccgacgtgatctcctttgagagcaacaacgtggttcacgcatcaccagattcggatgttcgtgatgccctgaagaaattagagcttctcaaggactga

SEQ ID NO: 1990 - protein, 1043 aa, Arabidopsis thaliana
MAGNDWVNSYLEAILDVGQGLDDARSSPSLLLRERGRFTPSRYFVEEVITGYDETDLHRSWVKAVATRSPQERNTRLENMCWRIWNLARQKKQHEEKEAQRLAKRRLEREKGRREATADMSEEFSEGEKGDIISDISTHGESTKPRLPRINSAESMELWASQQKGNKLYLVLISLHGLIRGENMELGRDSDTGGQVKYVVELARALGSMPGVYRVDLLTRQVSSPDVDYSYGEPTEMLTPRDSEDFSDEMGESSGAYIVRIPFGPKDKYIPKELLWPHIPEFVDGAMSHIMQMSNVLGEQVGVGKPIWPSAIHGHYADAGDATALLSGALNVPMLLTGHSLGRDKLEQLLRQGRLSKEEINSTYKIMRRIEGEELSLDVSEMVITSTRQEIDEQWRLYDGFDPILERKLRARIKRNVSCYGRFMPRMVKIPPGMEFNHIVPHGGDMEDTDGNEEHPTSPDPPIWAEIMRFFSNSRKPMILALARPDPKKNITTLVKAFGECRPLRELANLALIMGNRDGIDEMSSTSSSVLLSVLKLIDKYDLYGQVAYPKHHKQSDVPDIYRLAAKSKGVFINPAIIEPFGLTLIEAAAHGLPMVATKNGGPVDIHRVLDNGLLVDPHDQQSISEALLKLVADKHLWAKCRQNGLKNIHQFSWPEHCKTYLSRITSFKPRHPQWQSDDGGDNSEPESPSDSLRDIQDISLNLKFSFDGSGNDNYMNQEGSSMDRKSKIEAAVQNWSKGKDSRKMGSLERSEVNSGKFPAVRRRKFIVVIALDFDGEEDTLEATKRILDAVEKERAEGSVGFILSTSLTISEVQSFLVSGGLNPNDFDAFICNSGSDLHYTSLNNEDGPFVVDFYYHSHIEYRWGGEGLRKTLIRWASSLNEKKADNDEQIVTLAEHLSTDYCYTFTVKKPAAVPPVRELRKLLRIQALRCHVVYSQNGTRINVIPVLASRIQALRYLFVRWGIDMAKMAVFVGESGDTDYEGLLGGLHKSVVLKGVSCSACLHANRSYPLTDVISFESNNVVHASPDSDVRDALKKLELLKD

SEQ ID NO: 1991 - DNA, 213 bp, Arabidopsis thaliana
atggtgatgatgatgatgatgaggattgtgtgtgaatggagcgatgaagattgcatgaaggttgatgaagacaagcttgatgtgtcttttgttatccctcgtttgggcaacttcgatcctttggcaagcttcggttcccctcggaatcagcagattatgattactatagctcttatatgtttatgttccgtgtttactttgtttccggtttag

SEQ ID NO: 1992 - protein, 70 aa, Arabidopsis thaliana
MVMMMMMRIVCEWSDEDCMKVDEDKLDVSFVIPRLGNFDPLASFGSPRNQQIMITIALICLCSVFTLFPV

SEQ ID NO: 1993 - DNA, 768 bp, Arabidopsis thaliana
atggcgtcattgtcggtaccttgcgtcaagatctgtgctctgaacaggcgggtcggatctctccctggaatctctactcaaagatggcagccgcaacccaatgggatctcctttccctccgatgtttctcagaatcattctgcattctggaggttgcgtgcaacaactaatgaggttgtttctaactccactccaatgactaatggtgggtatatgaacggaaaagcgaaaaccaatgttcctgaacccgccgagctctctgaatttatggctaaagtctctggtcttcttaagcttgtggattcaaaagacatagtggaacttgaactaaagcagctcgactgtgagatcgttattcgaaagaaggaagctttacagcaagctgtaccaccagctccagtttatcactcaatgcctcctgtaatggcagacttttcaatgcctccagctcaaccagtggctcttcctccttctcctactcctacctcaacgcctgcaacagcaaaaccaacatccgccccatcctcgtctcatcctccactcaagagtcccatggctggtactttctatagatctcctggacccggtgaacccccttttgtaaaggttggagataaggtacagaagggtcaaattgtttgtattatcgaagctatgaaactgatgaacgagattgaggctgagaagtcaggaaccatcatggaactactggctgaagatggaaaaccagtcagcgttgacacgcctctttttgtcatcgcaccttga

SEQ ID NO: 1994 - protein, 255 aa, Arabidopsis thaliana
MASLSVPCVKICALNRRVGSLPGISTQRWQPQPNGISFPSDVSQNHSAFWRLRATTNEVVSNSTPMTNGGYMNGKAKTNVPEPAELSEFMAKVSGLLKLVDSKDIVELELKQLDCEIVIRKKEALQQAVPPAPVYHSMPPVMADFSMPPAQPVALPPSPTPTSTPATAKPTSAPSSSHPPLKSPMAGTFYRSPGPGEPPFVKVGDKVQKGQIVCIIEAMKLMNEIEAEKSGTIMELLAEDGKPVSVDTPLFVIAP

SEQ ID NO: 1995 - DNA, 822 bp, Arabidopsis thaliana
atggcttttcttctttctaatctatcatctccgtcaatccatcttcaaaccggaaaatacccaaaccttaaacccattttcagtcaatctctatcgtcttcgtcttctgttagctacgaatttgtagaagagaatctatctacactctctctattgagcatccagtctcctcctcttaaagacacgcaagttcagacaagacacagttcgcaagataagcataataaccacgacagagatgaattctatatcaatcttggtgtcgctgtccgtacacttcgtgaagatttgcctttgctcttcactagagatcttaattacgacatctacagggatgatataacatttgtggatccgatgaacacattcactgggatggacaactacaagattatcttctgggcactcagatttcatgggaagatattgttcagagatatctcacttgagatcttcagagtatggcaaccatcagagaacatgattctcatcaggtggaatctcaagggtgtgcctagagttccatgggaagctaaaggagagtttcaaggcacttctcggtataaactcgaccgtaatggcaaaatctatgagcataaagtcgataacttggccttcaatttccctcaacagctcaaacctgcagcttcggttttggatttggtgactgcttcccctgcaagcagtcctaatcctacgttctttttcagtcctgtggactcttattcatcttcatgggttaagttttatcaagcggtgagagggacattggagacagaggatatgtttgtaacaacagactgtttagtcacatgctcatag

SEQ ID NO: 1996 - protein, 273 aa, Arabidopsis thaliana
MAFLLSNLSSPSIHLQTGKYPNLKPIFSQSLSSSSSVSYEFVEENLSTLSLLSIQSPPLKDTQVQTRHSSQDKHNNHDRDEFYINLGVAVRTLREDLPLLFTRDLNYDIYRDDITFVDPMNTFTGMDNYKIIFWALRFHGKILFRDISLEIFRVWQPSENMILIRWNLKGVPRVPWEAKGEFQGTSRYKLDRNGKIYEHKVDNLAFNFPQQLKPAASVLDLVTASPASSPNPTFFFSPVDSYSSSWVKFYQAVRGTLETEDMFVTTDCLVTCS

SEQ ID NO: 1997 - DNA, 750 bp, Arabidopsis thaliana
atgcaactctcactggttcaagtctcttcagtgtccaacttcagatcccaatcaacgattcctactctctccaactcaaacccatcttgtttacttcttcaaaagtccatctttcctgggtccaagttaaccctccatcgaatttttcgttatccgaagaaaatctcaaatggctctactcgtgcttcactgcttgagacccctatcttatgggctggtcggatttgtgtcttctacgctctcgtgaaagctggctttgctggatccaagtctaaccctatcgtttctggtttggatactggtggtgttgatgttgaatatgatgatggtgctgatcttggtttctcaaagtggcttcagaacattaagggcaacaaaccagataaggatgcagctgataagaggaagctagtgagcaaatggcacccaacgacaaagggaacacttagaaggaactacaggataccttcgaaagccgaaggaaaccgtttgcttaaagccattgcgtctcttctctcagatgatgatcattttagagatgcaacatctcacaagggttgtcaaatacggagggagagtgcgcacggtcaaagcgtatgttgcaacaatgtgagagctctgtttgatgagttaccgacgccacatttggtggtggagatcacaccttttccagccggaccgctcacagagaatgattaccttaaggctgagaagctggagaggattcttaggtctggcgccaacatttga

SEQ ID NO: 1998 - protein, 249 aa, Arabidopsis thaliana
MQLSLVQVSSVSNFRSQSTIPTLSNSNPSCLLLQKSIFPGSKLTLHRIFRYPKKISNGSTRASLLETPILWAGRICVFYALVKAGFAGSKSNPIVSGLDTGGVDVEYDDGADLGFSKWLQNIKGNKPDKDAADKRKLVSKWHPTTKGTLRRNYRIPSKAEGNRLLKAIASLLSDDDHFRDATSHKGCQIRRESAHGQSVCCNNVRALFDELPTPHLVVEITPFPAGPLTENDYLKAEKLERILRSGANI

SEQ ID NO: 1999 - DNA, 2739 bp, Arabidopsis thaliana
atgttttgggttttggttctgttgagcttcattgttcttattggtgatgggatgatttcagagggagctggtttaaggcctcgttatgttgatgttggagcaatattcagtttagggactttacagggtgaagttacaaatattgctatgaaagctgcagaggaagatgtaaattctgatcctagcttccttggtggatcaaaattgcgtataacgacgtatgatgcaaagcgtaatggattcctcaccatcatgggagctttgcaattcatggagactgatgctgtggctatcattggtcctcagacatcaataatggctcatgtactgtctcatcttgcaaatgagcttagtgtgcctatgttgtcattcacagctttagaccctagtctctcggcgcttcagttcccgttctttgtccagacagcacctagtgatctctttctgatgcgtgccattgcggaaatgataagttactacggttggtcagaggtgattgcattgtataatgatgatgacaacagtagaaacggtataacagctttaggcgatgagctcgaaggaaggcgctgcaagatttcatacaaggctgtgcttcctttggatgtggtgattacgagtcctcgtgagattataaatgagttggttaagattcaagggatggaatctcgggtaatcattgtgaacactttccctaaaacaggtaagaaaatctttgaggaagcccagaagcttggcatgatggagaaaggctatgtttggatagctacaacttggttgacttctctgttagattctgttaacccgttacctgccaagactgctgaatctcttagaggcgtgcttactcttcgtattcacacgccaaattcaaaaaagaaaaaagatttcgtggcacggtggaacaagttgagtaacgggactgtcggtttaaacgtttatggtctctatgcttatgatactgtctggatcattgctcgagctgttaagagacttctagatagcagagctaacatttccttctctagtgacccaaagttaaccagcatgaagggaggagggtcactgaatctaggtgcattgagcatatttgaccaaggatcacaatttcttgattatattgtgaatacaaatatgactggtgttacaggtcaaatacagtttcttcctgacagatcaatgatacagccctcatatgacatcataaacgtggttgatgacgggtttaggcagatagggtattggtctaaccattccgggctctctattatacctccagagtcactatacaaaaagctttcaaatcgttcgagctcaaaccaacatctgaacaatgtgacttggcctggtgggacttctgagacaccacgtggttgggtttttcctaacaacgggagacgattgagaatcggtgtacccgatagagcaagttttaaggagtttgtgtcaaggttggatggaagcaacaaagtgcaagggtatgccattgatgtctttgaagctgcggtaaaactgatttcttatccggttcctcatgagttcgtcctatttggagacggtctcaagaacccaaacttcaatgaatttgtcaacaatgtcactattggggtatttgatgctgttgtaggagacatagctattgttacgaaacgaacaaggattgtggatttcactcagccttacatagaatcagggcttgtcgtggttgctcctgtcacaaagctaaatgatactccgtgggcgtttttacgcccttttacacctccaatgtgggctgttacagcagcttttttcctcatcgttggatcagtaatatggattcttgaacatagaatcaacgatgagttccgcggacctccaaggaaacaaattgttactattctctggttcagcttctccacgatgtttttctcccacagagagaacacagtgagtacactcggtcgtgctgttctgctcatctggctatttgtggtactaatcataacatcaagctacacagcgagtcttacatcgattcttacagtgcaacagctaaactcaccaatcagaggagtagacacactcatcagcagcagtggacgagttgggtttcaggtaggttcttatgcagaaaactacatgattgatgagcttaacattgccagatccagacttgtaccactcggctctcctaaagaatacgctgcagctcttcaaaacggaactgttgctgcaattgttgatgagcgtccttacgttgatctcttcctctcagaattctgcggatttgccattagaggccaagaattcaccagaagtggctggggatttgcatttccaagagactctccattagcaatcgacatgtcaaccgcgatcttaggtctatcagaaaccggacagcttcaaaagatccatgacaagtggctttcaagatctaactgcagtaacctcaacggttcagtgtcagatgaagattcagaacagcttaaactccgaagcttctggggattattccttgtgtgtgggatctcttgttttatcgctctcttcatctacttcttcaagatagtccgcgacttcttccgccacggcaaatatgatgaagaagccacagtaccttcaccagaaagttcacgttctaaatcattgcagacatttctagcttattttgatgaaaaagaagacgaatccaagagaaggatgaagcgtaaacgaaacgatgatctttctttaaagccttctagaccaatatga

SEQ ID NO: 2000 - protein, 912 aa, Arabidopsis thaliana
MFWVLVLLSFIVLIGDGMISEGAGLRPRYVDVGAIFSLGTLQGEVTNIAMKAAEEDVNSDPSFLGGSKLRITTYDAKRNGFLTIMGALQFMETDAVAIIGPQTSIMAHVLSHLANELSVPMLSFTALDPSLSALQFPFFVQTAPSDLFLMRAIAEMISYYGWSEVIALYNDDDNSRNGITALGDELEGRRCKISYKAVLPLDVVITSPREIINELVKIQGMESRVIIVNTFPKTGKKIFEEAQKLGMMEKGYVWIATTWLTSLLDSVNPLPAKTAESLRGVLTLRIHTPNSKKKKDFVARWNKLSNGTVGLNVYGLYAYDTVWIIARAVKRLLDSRANISFSSDPKLTSMKGGGSLNLGALSIFDQGSQFLDYIVNTNMTGVTGQIQFLPDRSMIQPSYDIINVVDDGFRQIGYWSNHSGLSIIPPESLYKKLSNRSSSNQHLNNVTWPGGTSETPRGWVFPNNGRRLRIGVPDRASFKEFVSRLDGSNKVQGYAIDVFEAAVKLISYPVPHEFVLFGDGLKNPNFNEFVNNVTIGVFDAVVGDIAIVTKRTRIVDFTQPYIESGLVVVAPVTKLNDTPWAFLRPFTPPMWAVTAAFFLIVGSVIWILEHRINDEFRGPPRKQIVTILWFSFSTMFFSHRENTVSTLGRAVLLIWLFVVLIITSSYTASLTSILTVQQLNSPIRGVDTLISSSGRVGFQVGSYAENYMIDELNIARSRLVPLGSPKEYAAALQNGTVAAIVDERPYVDLFLSEFCGFAIRGQEFTRSGWGFAFPRDSPLAIDMSTAILGLSETGQLQKIHDKWLSRSNCSNLNGSVSDEDSEQLKLRSFWGLFLVCGISCFIALFIYFFKIVRDFFRHGKYDEEATVPSPESSRSKSLQTFLAYFDEKEDESKRRMKRKRNDDLSLKPSRPI

SEQ ID NO: 2001 - DNA, 645 bp, Arabidopsis thaliana
atggttgtgaaactatatggacaggtaacagcagcttgtccacaaagagtcttgctttgttttctcgagaaaggaattgaatttgagattattcatatcgatcttgatacatttgagcaaaaaaaaccagaacatcttcttcgtcagccatttggtcaagttccagccatagaagatggagatttcaagctttttgaatcacgagccatcgcgagatactacgctaccaagttcgcggaccaaggcacgaaccttttgggcaagtctctagagcaccgagccatcgtggaccagtgggctgacgtggagacctattacttcaacgttctggcccaacccctcgtgattaacctaatcatcaagcctaggttaggcgagaaatgtgacgtcgttttggtcgaggatctcaaagtgaagctaggagtggtcttggacatatacaataaccggctttcttcgaaccggtttttggctggtgaagaattcactatggctgatttgacgcacatgccggcgatggggtacttgatgagtataaccgatataaaccagatggttaaggctcggggtagttttaaccggtggtgggaagagatttcggatagaccgtcttggaagaagcttatggtgctggctggtcactga

SEQ ID NO: 2002 - protein, 214 aa, Arabidopsis thaliana
MVVKLYGQVTAACPQRVLLCFLEKGIEFEIIHIDLDTFEQKKPEHLLRQPFGQVPAIEDGDFKLFESRAIARYYATKFADQGTNLLGKSLEHRAIVDQWADVETYYFNVLAQPLVINLIIKPRLGEKCDVVLVEDLKVKLGVVLDIYNNRLSSNRFLAGEEFTMADLTHMPAMGYLMSITDINQMVKARGSFNRWWEEISDRPSWKKLMVLAGH

SEQ ID NO: 2003 - DNA, 1026 bp, Arabidopsis thaliana
atggatcacgcagcagatgctcaccgtacggatttgatgaccattacaagattcgtgttgaatgaacaatcaaagtatccagaatctcgtggtgatttcaccattttgcttagtcacatcgttttgggttgcaaattcgtttgcagtgctgttaataaggctggtttggctaagttaattggacttgcaggggaaacaaacattcagggtgaagagcaaaagaaacttgatgtgctctctaatgatgtctttgtcaacgctttggttagcagtggtagaacttctgttcttgtctcggaggaagatgaggaagctacgtttgtggagccatccaagcgtggaaagtactgtgttgtttttgatccgcttgatggatcttcaaacattgactgtggtgtttccattggcacaatttttggaatttacacgttggaccacactgatgagccaaccactgcagatgttctgaaacctgggaatgaaatggtggctgcaggttattgtatgtacggaagctcctgcatgcttgtgttgagcactggaaccggtgtccacggatttacactggacccatctctaggagagttcattctaactcacccggacattaagattccaaataagggaaacatttattcggtgaatgaaggcaatgcgcagaactgggatggtccaactacaaagtatgtagagaaatgcaagtttcctaaagatggttctcctgcaaagtctctgagatacgtaggaagtatggtagctgatgttcatcgtacactactttatggaggaatcttcttgtacccggctgacaagaaaagccccaatggaaaattgcgtgtcttgtatgaagttttcccgatgtcgtttttgatggagcaagccggaggtcaggcctttacgggaaagaaaagggcgctagaccttgtcccggagaagatccatgagcgttctccgatatttcttggtagctacgatgatgtagaagagattaaagctctctatgctgaggaggaaaagaagaactaa

SEQ ID NO: 2004 - protein, 341 aa, Arabidopsis thaliana
MDHAADAHRTDLMTITRFVLNEQSKYPESRGDFTILLSHIVLGCKFVCSAVNKAGLAKLIGLAGETNIQGEEQKKLDVLSNDVFVNALVSSGRTSVLVSEEDEEATFVEPSKRGKYCVVFDPLDGSSNIDCGVSIGTIFGIYTLDHTDEPTTADVLKPGNEMVAAGYCMYGSSCMLVLSTGTGVHGFTLDPSLGEFILTHPDIKIPNKGNIYSVNEGNAQNWDGPTTKYVEKCKFPKDGSPAKSLRYVGSMVADVHRTLLYGGIFLYPADKKSPNGKLRVLYEVFPMSFLMEQAGGQAFTGKKRALDLVPEKIHERSPIFLGSYDDVEEIKALYAEEEKKN

SEQ ID NO: 2005 - DNA, 780 bp, Arabidopsis thaliana
atggcgaccttgtcgatgactctgtcaaatccgaagtcgctctcagctcctccacgaagactttctccgatcaatacctccgctttcacatctacctctttccgattgcgcaccaaatcttccttcgattcaatctcgttctcgtcttcaactcccttctccgcctcatcgctcctccttcacacgtcttataccaaaagaaaccaccgctgtttctctgttcaatccaatgctgaggtggttactgaaccgcaatcgaaaataacacacaaggtgtatttcgatataagtgttggcaatccagtggggaagttagctgggaggattgttattggattgtatggtgatgatgttccccaaactgtggagaactttcgtgctctatgcacaggtgaaaagggatttggctacaagggttctacattccatcgtgtcatcagagatttcatgattcagggaggagactttgagaagggcaatggaactggaggtaaaagtgtatatggccgtacattcaaggatgagaatttcaagttatcccatgtcggaccaggagttctaagtatggcaaatgctggccctaatacaaatggaagtcagttctttatctgcactattaagacgtcatggttggacggaagacatgtggtgttcgggcaagtaatagaaggaatggaagtggtgaagctgatagaggaacaagagacagacagaggagaccgtcccagaaagaaagtggtgatagcagactgtggtcaacttccaatgtctgaagcttaa

SEQ ID NO: 2006 - protein, 259 aa, Arabidopsis thaliana
MATLSMTLSNPKSLSAPPRRLSPINTSAFTSTSFRLRTKSSFDSISFSSSTPFSASSLLLHTSYTKRNHRCFSVQSNAEVVTEPQSKITHKVYFDISVGNPVGKLAGRIVIGLYGDDVPQTVENFRALCTGEKGFGYKGSTFHRVIRDFMIQGGDFEKGNGTGGKSVYGRTFKDENFKLSHVGPGVLSMANAGPNTNGSQFFICTIKTSWLDGRHVVFGQVIEGMEVVKLIEEQETDRGDRPRKKVVIADCGQLPMSEA

SEQ ID NO: 2007 - DNA, 1098 bp, Arabidopsis thaliana
atgattggagatctaatgaagaataacaacaatggcgacgttgtggataacgaagtgaacaaccggttaagccggtggcatcacaattcttcccggataattagggtttcacgagcttccggtggtaaagatcgacacagcaaagtcttgacttctaaaggaccacgtgaccgtcgtgtccggttatcagtctccaccgctcttcaattctatgatcttcaagatcggttaggttatgatcaacctagcaaagctgttgaatggttaatcaaagctgctgaagattcaatctctgagcttccttcactcaacaacactcattttccgaccgatgacgagaatcaccagaatcagacattaacaacagttgctgctaattccttgtctaaatctgcttgtagtagcaattcagacacgagcaagaactcttctggtttgtctttatcaagatcggagcttagagataaagctagagagagggctagagagagaacagctaaagagaccaaggaaagagatcataaccacacttcgtttacggatttgttaaattccggttcagatccggttaactcaaaccggcaatggatggcttcagctccttcttcatctccaatggagtatttcagttcgggtttaattctcgggtcgggtcaacaaacccatttccctatttcaacaaattctcatcctttctcatcaatctccgatcatcatcatcatcatcctcatcatcagcatcaagagttttcattcgttcccgaccatttgatatcaccggcagaatccaacggcggagcattcaatcttgattttaatatgtcaacaccctccggcgccggagctgccgtctccgccgcatcaggtggtggcttcagtggtttcaacagggggacccttcagtccaattcaacaaatcagcatcagtcattcctcgctaatctacagaggtttccaacatcagaaagtggaggaggtccacagttcttattcggtgcactgcctgcagagaatcaccaccacaatcaccagtttcagctttactatgaaaatggatgcagaaactcatcagaacataagggtaaaggcaagaactga

SEQ ID NO: 2008 - protein, 365 aa, Arabidopsis thaliana
MIGDLMKNNNNGDVVDNEVNNRLSRWHHNSSRIIRVSRASGGKDRHSKVLTSKGPRDRRVRLSVSTALQFYDLQDRLGYDQPSKAVEWLIKAAEDSISELPSLNNTHFPTDDENHQNQTLTTVAANSLSKSACSSNSDTSKNSSGLSLSRSELRDKARERARERTAKETKERDHNHTSFTDLLNSGSDPVNSNRQWMASAPSSSPMEYFSSGLILGSGQQTHFPISTNSHPFSSISDHHHHHPHHQHQEFSFVPDHLISPAESNGGAFNLDFNMSTPSGAGAAVSAASGGGFSGFNRGTLQSNSTNQHQSFLANLQRFPTSESGGGPQFLFGALPAENHHHNHQFQLYYENGCRNSSEHKGKGKN

SEQ ID NO: 2009 - DNA, 945 bp, Arabidopsis thaliana
atgggtggttccagagagttccgagctgaggaacattcaaatcaattccactctatcatcgccatggccatctggcttggcgccattcacttcaacgtcgctcttgttctctgttctctcattttccttcctccttctctatctctcatggtcttgggcttgctctctctgtttatctttatcccaatcgatcatcgtagcaaatatggtcgtaagctcgctaggtacatatgcaagcacgcgtgtaattatttccccgtctctctgtacgtcgaggattacgaagctttccagcctaatcgtgcctatgtctttggttatgaaccacattcggtgctaccgattggagttgttgctctttgtgatctcacagggtttatgcctattcctaacattaaagttcttgcaagtagtgctatattctacactccctttctaaggcatatatggacatggttagggctcaccgctgcttctaggaagaatttcacttcccttttggattctggctacagttgtgttcttgtacctggtggtgtgcaggagacttttcatatgcaacatgatgctgagaatgtcttcctttcaaggagaagaggatttgtgcgcatagccatggaacaggggagccctctggttccagtattctgctttggtcaggcacgcgtgtacaaatggtggaagccggattgtgatctctatcttaaactatctagagcaatcagattcaccccgatctgcttctggggagtttttggatcaccattaccgtgtcgacagcctatgcatgtggtcgttggtaaaccaatagaagtcacaaaaactctgaagccaactgacgaagagattgctaagtttcatggccagtatgtggaagcgcttagggatctgtttgagaggcacaagtcccgagtcggctatgatcttgagctgaaaattctttga

SEQ ID NO: 2010 - protein, 314 aa, Arabidopsis thaliana
MGGSREFRAEEHSNQFHSIIAMAIWLGAIHFNVALVLCSLIFLPPSLSLMVLGLLSLFIFIPIDHRSKYGRKLARYICKHACNYFPVSLYVEDYEAFQPNRAYVFGYEPHSVLPIGVVALCDLTGFMPIPNIKVLASSAIFYTPFLRHIWTWLGLTAASRKNFTSLLDSGYSCVLVPGGVQETFHMQHDAENVFLSRRRGFVRIAMEQGSPLVPVFCFGQARVYKWWKPDCDLYLKLSRAIRFTPICFWGVFGSPLPCRQPMHVVVGKPIEVTKTLKPTDEEIAKFHGQYVEALRDLFERHKSRVGYDLELKIL

SEQ ID NO: 2011 - DNA, 852 bp, Arabidopsis thaliana
atggctgaggcttctgatttgttggaatggcctaagaaggataaccgtcgttttctccatgttgtctaccgcgttggtgatcttgatcgcaccattgagttttacactgaggtctttggtatgaagctgttgaggaaaagagatatccctgaggagaagtattctaatgcttttcttggttttggacctgaaacatctaactttgttgtggagctcacatataactatggtgttagctcatatgatattggaactggctttgggcattttgccatttcaactcaagatgtttccaaactggttgagaacgtccgtgccaagggtggaaatgtgactagggaacctggtccagtcaaaggtggaggcagtgtcattgcgtttgtgaaggaccctgatggctacacttttgagctcatccagagaggtccaactcctgaacctttctgccaagtcatgcttcgtgttggtgatctcgaccgtgccatcaaattctatgaaaaggccctcgggatgagactcttgagaaagattgagagacctgagtacaagtacaccataggcatgatggggtatgctgaagaatacgagtcgatagttttggagctgacctataactacgacgtgactgagtacacaaagggcaatgcatatgcacagattgcaataggcacagatgatgtgtacaaaagcggtgaagttattaagatagtcaaccaagagctaggaggaaagatcactagagaagccggacctcttcctggactcggcaccaagattgtctcattccttgatccagatggctggaaaacggttttggtggacaacaaagattttctcaaggaactggaatga

SEQ ID NO: 2012 - protein, 283 aa, Arabidopsis thaliana
MAEASDLLEWPKKDNRRFLHVVYRVGDLDRTIEFYTEVFGMKLLRKRDIPEEKYSNAFLGFGPETSNFVVELTYNYGVSSYDIGTGFGHFAISTQDVSKLVENVRAKGGNVTREPGPVKGGGSVIAFVKDPDGYTFELIQRGPTPEPFCQVMLRVGDLDRAIKFYEKALGMRLLRKIERPEYKYTIGMMGYAEEYESIVLELTYNYDVTEYTKGNAYAQIAIGTDDVYKSGEVIKIVNQELGGKITREAGPLPGLGTKIVSFLDPDGWKTVLVDNKDFLKELE

SEQ ID NO: 2013 - DNA, 477 bp, Arabidopsis thaliana
atgcagtcgatgaaagaaacagcttcgaatattgcagcttctgcaaaatctggcatggacaaaaccaaagctaccttggaggaaaaggcggagaagatgaagacacgagaccctgttcagaaacagatggctacacaggttaaagaagataagatcaatcaagctgagatgcagaagagagaaacgcgtcagcacaacgcggccatgaaagaagcggctggagccggaaccggtttaggtttggggacggccactcactcgaccactggacaagtcggacacggcactgggacacatcagatgtcggctctgcctggtcacggaacgggacaactgaccgaccgcgttgtggagggcacggctgtgaccgacccgattggaaggaacactggaactggtcggacaaccgctcataacactcacgttggtggtggtggtgccaccgggtacggaaccggcgggggatatactggataa

SEQ ID NO: 2014 - protein, 158 aa, Arabidopsis thaliana
MQSMKETASNIAASAKSGMDKTKATLEEKAEKMKTRDPVQKQMATQVKEDKINQAEMQKRETRQHNAAMKEAAGAGTGLGLGTATHSTTGQVGHGTGTHQMSALPGHGTGQLTDRVVEGTAVTDPIGRNTGTGRTTAHNTHVGGGGATGYGTGGGYTG

SEQ ID NO: 2015 - DNA, 456 bp, Arabidopsis thaliana
atgaagatttctctcttcctcctctctatcctcattctcttacccatctccctacaagatcctactcctgaagtcaagaaaccaactcgtgcacacgcagagctcacgaatcatggattcccaattggactcctacctttatctgtcaaagattacttcctcaaccaaacctccggcgacttctctcttttcctcaacggagcatgcaaaatcacgcttccacctgataactacatcgctacttattctaacaaagtaacgggtcggatctctcagggtaagatcgcggagctccaagggattcgggttcgggcgtttttcaagtcgtggtctattactgggattcgatcttctggagataatcttgtctttgaggttgctgggataactgctaaatacccttcgaagaatttcgatgagagtcttgattgtgaagggaaacgatcttcttcttga

SEQ ID NO: 2016 - protein, 151 aa, Arabidopsis thaliana
MKISLFLLSILILLPISLQDPTPEVKKPTRAHAELTNHGFPIGLLPLSVKDYFLNQTSGDFSLFLNGACKITLPPDNYIATYSNKVTGRISQGKIAELQGIRVRAFFKSWSITGIRSSGDNLVFEVAGITAKYPSKNFDESLDCEGKRSSS

SEQ ID NO: 2017 - DNA, 828 bp, Arabidopsis thaliana
atggcggcttctttctcttccactgctcccacgacaccggttcttcgattcagagccaactactccaagcctctcctctctctcccagattcgtgtttgaggataatctcttcggcgatatctccctctacacgcttaattgcgtgttcgttcaagacagacaagcttccgctcggtgccggcgtcaatctctccggtggccccgttgtcaagcgctctctacagaagagattggtgataaggtctgctactattgaagaaatagaagcagagaagtctgctattgagactgatgttaaatcaaagatggagaagactattgaaacgcttcggacgagtttcaactccataaggactgggagatccaatgcagcgatgcttgacaagattgaggtggaatactatggaagtccagtaagtttgaaaagcatagcccaaatcagtactccggatggaagttctcttttgctgcaaccatatgacaaatccagcttgaaggctatagagaaagccattgtgaattctgatcttggtgtgacccctaataacgatggagatgttattcgactgtccttgcctcccctcacatctgacagaagaaaggaactatcaaaggttgttgctaaacagtctgaagaagggaaggttgcactgaggaacattaggagagatgccttgaaatcttatgataaactcgagaaggagaagaagctgtcagaagacaacgtgaaggatttgtcaagtgatttgcagaaactaattgatgtatacatgaagaagatagaggagctctacaaacagaaagaaaaggaattgatgaaggtgtga

SEQ ID NO: 2018 - protein, 275 aa, Arabidopsis thaliana
MAASFSSTAPTTPVLRFRANYSKPLLSLPDSCLRIISSAISPSTRLIACSFKTDKLPLGAGVNLSGGPVVKRSLQKRLVIRSATIEEIEAEKSAIETDVKSKMEKTIETLRTSFNSIRTGRSNAAMLDKIEVEYYGSPVSLKSIAQISTPDGSSLLLQPYDKSSLKAIEKAIVNSDLGVTPNNDGDVIRLSLPPLTSDRRKELSKVVAKQSEEGKVALRNIRRDALKSYDKLEKEKKLSEDNVKDLSSDLQKLIDVYMKKIEELYKQKEKELMKV

SEQ ID NO: 2019 - DNA, 414 bp, Arabidopsis thaliana
atggaagacgtgaaagggaaggagattattgatgatgctcctattgacaacaaggtttcagatgaaatggagagtgaggaaaatgcgatcaagaaaaagtatggaggattgttgcctaagaagattcctttgatatctaaggaccatgaacgtgcgttttttgactcagctgattgggctttaggcaagcaaaaaggacagaagccgaaagggcctttggaagctctccgcccaaaactgcagccaaccccgcaacagcaaccaagagcaagacgaatggcttattcttcaggcgaaactgaagacactgagattgataacaacgaagctccggatgaccaagcctgcgcatcagctgtggatagtaccaatttaaaggacgatggaggcgcaaaagacaacatcaaatcatga

SEQ ID NO: 2020 - protein, 137 aa, Arabidopsis thaliana; identical to SEQ ID NO: 18

SEQ ID NO: 2021 - DNA, 1392 bp, Arabidopsis thaliana
atggagaaacagaacattatctcaaacacttcttcttcttcgtcttcttggattcgtggttcttgtgttggaagaggttgttttggtacagtaagcaaagctttgagtaaaatcgacggtggacttttcgccgtgaagtcgatagatctcgccacgtgtcttccttctcaagcagagtcgttagagaacgaaatcgttattctacggtcgatgaagtctcatccaaacatagtgaggtttctcggtgatgatgtgtctaaagaaggaacggcgtcgtttcgaaatcttcatttagagtattcaccggaaggtgacgttgctaacggtggaatcgttaacgaaacgcttctcaggcgttacgtgtggtgtcttgtctctgctttgagtcacgttcattctaacggaattgttcactgcgacgttaaatctaagaacgttcttgtttttaacggtggtagctccgttaagctagcggattttggatcggcggttgagtttgagaaatctacgattcatgtttcgccacgtggaagtccgctttggatggctccggaggtggttagaagagagtaccaaggaccggagagtgacgtgtggtctttagggtgtaccgtcatcgagatgctcaccggaaaaccagcttgggaagatcacggtttcgactcgctgagtcggatcgggttctctaacgatttgccttttattccggtggggttatcggaactcgggagagatttcttagagaaatgcttgaaacgtgatcggagtcagcgttggagctgtgatcagctcttgcagcatccgtttctgtgtcaagatcatcatgactcgttcttcactgagtcgtctccgcgttgtgttcttgactgggtcaactcggagtttgacgaagaagaagagagcgacgaatggagaccagaatccatggtttcggcgatggcaaggataagtaaattagctataaccggaggagcaaattgggaatctaatggttggactgaggttagagacacttccgaagagtcagaggcaaaaaaggaagttcttgtttctccaagggtagaattggaatcttacatatcattggagtcgtcaagcgatgattccgtaagacaaccgaggaatgaagagtcggcgacggagttggcgtcggcagtgacgtgtgaagcaatattgttggtgatgatattggtggtagagaatattcaaatatatgccacgttttacaccagtagtattattatgcatattctatattgttgtagttgttgttgttattatcattatcaaaacaataataagaagaataatttttcgaaatctacatctttcattctcagccttaactttttgtttggtattgcatgtgattcggatcggtctatctattaa

SEQ ID NO: 2022 - protein, 463 aa, Arabidopsis thaliana
MEKQNIISNTSSSSSSWIRGSCVGRGCFGTVSKALSKIDGGLFAVKSIDLATCLPSQAESLENEIVILRSMKSHPNIVRFLGDDVSKEGTASFRNLHLEYSPEGDVANGGIVNETLLRRYVWCLVSALSHVHSNGIVHCDVKSKNVLVFNGGSSVKLADFGSAVEFEKSTIHVSPRGSPLWMAPEVVRREYQGPESDVWSLGCTVIEMLTGKPAWEDHGFDSLSRIGFSNDLPFIPVGLSELGRDFLEKCLKRDRSQRWSCDQLLQHPFLCQDHHDSFFTESSPRCVLDWVNSEFDEEEESDEWRPESMVSAMARISKLAITGGANWESNGWTEVRDTSEESEAKKEVLVSPRVELESYISLESSSDDSVRQPRNEESATELASAVTCEAILLVMILVVENIQIYATFYTSSIIMHILYCCSCCCYYHYQNNNKKNNFSKSTSFILSLNFLFGIACDSDRSIY

SEQ ID NO: 2023 - DNA, 882 bp, Arabidopsis thaliana
atggctttgtctcttatctttctagctctcttagtgttgtgccctagtagtggtcacagccaacgttctccttcaccgggatactacccgagttcccgagtaccgacttcaccttttgatcgtgaattccgtactttatggggctctcaacaccaacgtagagagcaagacgttgtcactctttggctcgacaaatccactgggagtgggttcaagtctcttcgtccataccggtcgggctactttggtgcttccattaagctccaaccaggcttcactgctggagtggatacatccctctatctctcaaacaaccaagagcatcctggagaccacgatgaggtcgatatcgagtttctagggacaacgccagggaagccttattcccttcaaacgaatgtcttcgttaggggaagtggcgaccgaaatgtcattggaagagaaatgaaatttaccttgtggtttgaccctactcaagattttcaccattacgcaattttgtggaaccctaaccaaattgtattctttgtagacgatgtaccgatacgtacatataatagaaagaatgaagctatattccccacaagaccgatgtgggtttacggatcgatatgggatgcatcggactgggccacagaaaatggaaggatcaaagccgactatcgataccaaccatttgtggctaagtacaaaaactttaagctagcgggatgcacagcggatagctctagctcatgcagaccgccatcgcctgcacccatgcgcaaccgcgggttgagccggcagcagatggcggcattgacatgggcacagaggaacttcttggtctataactattgccatgatccgaaaagagaccatacccaaacaccagaatgttaa

SEQ ID NO: 2024 - protein, 293 aa, Arabidopsis thaliana
MALSLIFLALLVLCPSSGHSQRSPSPGYYPSSRVPTSPFDREFRTLWGSQHQRREQDVVTLWLDKSTGSGFKSLRPYRSGYFGASIKLQPGFTAGVDTSLYLSNNQEHPGDHDEVDIEFLGTTPGKPYSLQTNVFVRGSGDRNVIGREMKFTLWFDPTQDFHHYAILWNPNQIVFFVDDVPIRTYNRKNEAIFPTRPMWVYGSIWDASDWATENGRIKADYRYQPFVAKYKNFKLAGCTADSSSSCRPPSPAPMRNRGLSRQQMAALTWAQRNFLVYNYCHDPKRDHTQTPEC

SEQ ID NO: 2025 - DNA, 699 bp, Arabidopsis thaliana
atgcttcgctcctcaattcgacttctctatataagaagaaccagtcctctgcttcgaagtttatcatcatcatcatcatcatcatcatcaaaacgattcgattctgcgaaaccacttttcaattctcatcggattatttctcttccaatttctacaacgggagctaaactatctagatcggagcattcaatggctgcttcttccgaacccaaatctctttacgatttcaccgtcaaggatgctaagggaaacgatgttgatctaagcatctacaaagggaaggttcttttgattgtgaacgttgcttctcaatgtggcttgactaattcgaattatactgagcttgcgcagctgtatgagaagtacaaaggccatggtttcgagattcttgcgtttccgtgtaaccagtttgggaatcaagagcctggtactaatgaagagattgttcagtttgcttgtactcgtttcaaggctgagtacccgattttcgacaaggttgatgttaacggtgacaaagctgccccagtctacaagtttctgaaatcaagcaaaggcgggctctttggagacggcattaagtggaacttcgcaaagttcttggttgacaaagatggaaatgttgtcgatcgtttcgcaccaactacctcacctctcagcattgagaaggatgtgaagaagttgttgggagttactgcttaa

SEQ ID NO: 2026 - protein, 232 aa, Arabidopsis thaliana
MLRSSIRLLYIRRTSPLLRSLSSSSSSSSSKRFDSAKPLFNSHRIISLPISTTGAKLSRSEHSMAASSEPKSLYDFTVKDAKGNDVDLSIYKGKVLLIVNVASQCGLTNSNYTELAQLYEKYKGHGFEILAFPCNQFGNQEPGTNEEIVQFACTRFKAEYPIFDKVDVNGDKAAPVYKFLKSSKGGLFGDGIKWNFAKFLVDKDGNVVDRFAPTTSPLSIEKDVKKLLGVTA

SEQ ID NO: 2027 - DNA, 1182 bp, Arabidopsis thaliana; identical to SEQ ID NO: 1905

SEQ ID NO: 2028 - protein, 393 aa, Arabidopsis thaliana; identical to SEQ ID NO: 1906

SEQ ID NO: 2029 - DNA, 918 bp, Arabidopsis thaliana
atggaggtagcagcagcgactgcgacgagcttcacaacgcttcgagctcgtacgtcagcgattatcccgtcttctacacgtaatctgagatctaaaccgagattttcttcatcttcatctctcagagcttctctttcgaatggctttctttcgccgtataccggaggaagcatctctagtgacttatgcggcgctaagcttcgtgcggaatcgcttaatccgttaaatttttccagttccaagcctaaacgcggagttgtcactatggttatacctttctcaaagggaagtgcacacgaacaacctcctcctgatttggcatcatatttgttcaagaaccgaattgtatatttgggaatgtctctcgtaccttcagttactgagttgatacttgcggagtttctttaccttcagtatgaagacgaggaaaagcctatttacctttacataaactcgactgggacaaccaagaatggtgaaaagttgggctatgatactgaggcttttgcaatctatgatgtcatggggtatgtcaaaccaccaatctttactctttgcgtcgggaatgcttggggtgaagctgctttgcttctgactgctggtgcaaaaggaaatcgatctgcgttgccctcatcaactattatgataaagcagcccattgctcgatttcaaggccaagcaactgatgttgaaattgcaaggaaagaaatcaagcacataaagacagaaatggtcaagctgtattcaaagcatattggtaaatccccggagcagattgaagctgacatgaaacgcccgaaatattttagtcccactgaggctgttgaatatgggatcattgataaggtggtttacaatgaaaggggcagccaagacagaggagttgtgtctgaccttaaaaaggcacaactcatttga

SEQ ID NO: 2030 - protein, 305 aa, Arabidopsis thaliana
MEVAAATATSFTTLRARTSAIIPSSTRNLRSKPRFSSSSSLRASLSNGFLSPYTGGSISSDLCGAKLRAESLNPLNFSSSKPKRGVVTMVIPFSKGSAHEQPPPDLASYLFKNRIVYLGMSLVPSVTELILAEFLYLQYEDEEKPIYLYINSTGTTKNGEKLGYDTEAFAIYDVMGYVKPPIFTLCVGNAWGEAALLLTAGAKGNRSALPSSTIMIKQPIARFQGQATDVEIARKEIKHIKTEMVKLYSKHIGKSPEQIEADMKRPKYFSPTEAVEYGIIDKVVYNERGSQDRGVVSDLKKAQLI

SEQ ID NO: 2031 - DNA, 708 bp, Arabidopsis thaliana
atgtcgaatgtcttgctatccccaaacggctacgtatttgcatcgcctaaacctcttggcagattcatcaattcaaagtccggcggacggaaacttttcttctccgtcgttagagcttcttccgatgatgctgattgtaatgccgaagaatgtgctcccgagaaggaggtaggaacagtgagtatggaatggttagctggagagaagacgaaagtggtgggaacatttcctcctcggaagccgcgtggttggactggctatgttgagaaagatactgctggtcagactaatgtttactccattgagcctgcagtatatgttgcagagagcgcgattagctcaggtactgcaggatcatcggctgatggggctgagaacacagcagcaatcgtagcaggcattgctcttatcgcagtcgctgcagcttcctctatactcctccaagtcgggaaagatgccccaactcgacccaaagcagtggattacagtggaccgtctcttagctactacatcaacaagttcaagccttctgaaattgttcaaccttctaccccctccgtcacagaagccccaccggtggccgagctagaaacttcactgccagaaactccatcggtggctcagcaagaaacctcactgccggaaactatggctagtgaggctcagccagaggcgtcttctgttccaacaacaagtagtacctcttag

SEQ ID NO: 2032 - protein, 235 aa, Arabidopsis thaliana
MSNVLLSPNGYVFASPKPLGRFINSKSGGRKLFFSVVRASSDDADCNAEECAPEKEVGTVSMEWLAGEKTKVVGTFPPRKPRGWTGYVEKDTAGQTNVYSIEPAVYVAESAISSGTAGSSADGAENTAAIVAGIALIAVAAASSILLQVGKDAPTRPKAVDYSGPSLSYYINKFKPSEIVQPSTPSVTEAPPVAELETSLPETPSVAQQETSLPETMASEAQPEASSVPTTSSTS

SEQ ID NO: 2033 - DNA, 327 bp, Arabidopsis thaliana
atggctatcatcgcaagcacgttcggcacggggctaagttacgccggggagcttccattcaagccagtcaccgggggagaggtgggacgaaagcagcagagaatggtggtggtgagagcagaaggcggtggaggtatcaatccggagatcagaaagaacgaagataaggttgttgactccgtcgttgtcaccgagctttccaagaacataactccctattgcaggtgttggaggtcggggacgtttccattgtgtgatgggagtcatgtgaagcacaacaaagctaatggagataacgttggccctcttcttctcaagaaacagtag

SEQ ID NO: 2034 - protein, 108 aa, Arabidopsis thaliana
MAIIASTFGTGLSYAGELPFKPVTGGEVGRKQQRMVVVRAEGGGGINPEIRKNEDKVVDSVVVTELSKNITPYCRCWRSGTFPLCDGSHVKHNKANGDNVGPLLLKKQ

SEQ ID NO: 2035 - DNA, 1779 bp, Arabidopsis thaliana
atgaggacaccgacgacgattctccttcttgtcggagctatcctcttctccggcgccggctatgtcagatccgacgcctccgaccaccgttacaaggaaggagacaccgttcctctctacgccaacaaggtcggcccatttcacaatccaagtgagacgtatcgatattttgatcttcccttctgtatcccagagggtgtgaaagagaagaaggaagctcttggcgaggttctaaacggggatcggctagttagcgctccatacaagctcaacttcagagatgaaaaagagtctgaggtatactgcaacaagaagttgagtaaagaagaggtcaaacagttcagaaaagctgttgagaaggactactacttccagatgtactatgatgatctacctatctggggattcattggaaaggttgacaaggatatcaaatctgatccgagtgaattcaaatatttcttgtacaagcacattcagtttgagattctatacaataaggaccgtgtgatcgagatcagtgctagaatggatcctcattcgcttgtggatctcactgaggataaggaagttgatgcagagtttatgtacactgtgaagtggaaggaaactgagactccttttgagaaaagaatggagaagtactctatgtcttcttctcttccacatcatttggaaatccactggttctccattattaactcctgtgtcactgtccttcttttgactggattccttgcaactatcttgatgcgagtcctcaagaacgatttcatgaagtatgctcaagatgaggaagctgctgatgatcaagaggaaactggatggaagtacattcatggcgatgtgtttcggttccctactcacaattctttatttgctgcatcgctcggtagtggcactcaattgttcacgctcaccatatttattttcatgcttgctcttgttggagtgttctacccatacaaccgaggagcactctttaccgctttggtggtcatttacgctctcacttctggaattgccggatacacatctgcctctttctactgtcaacttgaaggaaaaagctgggtgaggaacttgttactcactggatgtctcttctgtggcccattattcctaaccttttgcttccttaacaccgtagccatcacctacactgcaaccgctgcattaccctttggaaccattgtggtgatcgtccttatatggactctagttacctcacctttactcgttttgggtggtatcgcgggtaaaaacagcaaagcagagttccaagcaccatgccgtacaaccaaatatcctcgtgagattccaccactcccttggtacagaagtgctattcctcagatggccatggctggttttcttcctttcagtgccatctacatcgagctttactacattttcgctagtgtctggggtcaccggatctacaccatctacagcatcttattcatcgttttcatcattctcatcatcgtcactgcttttataaccgttgccttgacttacttccaactcgctgctgaagatcaccaatggtggtggagatcattcctatgtggtggatcgaccggtttgtttatctacgcatactgcttatactattactacgcacgatcagacatgtcgggttttatgcaaacctcgtttttcttcggatacatggcttgcatttgctacggattcttcttaatgctcggaacagttggcttccgcgcagccctcctctttgtccgtcacatttaccggtcgatcaaatgcgagtaa

SEQ ID NO: 2036 - protein, 592 aa, Arabidopsis thaliana
MRTPTTILLLVGAILFSGAGYVRSDASDHRYKEGDTVPLYANKVGPFHNPSETYRYFDLPFCIPEGVKEKKEALGEVLNGDRLVSAPYKLNFRDEKESEVYCNKKLSKEEVKQFRKAVEKDYYFQMYYDDLPIWGFIGKVDKDIKSDPSEFKYFLYKHIQFEILYNKDRVIEISARMDPHSLVDLTEDKEVDAEFMYTVKWKETETPFEKRMEKYSMSSSLPHHLEIHWFSIINSCVTVLLLTGFLATILMRVLKNDFMKYAQDEEAADDQEETGWKYIHGDVFRFPTHNSLFAASLGSGTQLFTLTIFIFMLALVGVFYPYNRGALFTALVVIYALTSGIAGYTSASFYCQLEGKSWVRNLLLTGCLFCGPLFLTFCFLNTVAITYTATAALPFGTIVVIVLIWTLVTSPLLVLGGIAGKNSKAEFQAPCRTTKYPREIPPLPWYRSAIPQMAMAGFLPFSAIYIELYYIFASVWGHRIYTIYSILFIVFIILIIVTAFITVALTYFQLAAEDHQWWWRSFLCGGSTGLFIYAYCLYYYYARSDMSGFMQTSFFFGYMACICYGFFLMLGTVGFRAALLFVRHIYRSIKCE

SEQ ID NO: 2037 - DNA, 741 bp, Arabidopsis thaliana
atggcggcgaaaattcccggagtgatcgctttgttcgacgtcgacggtactctcacagctccaaggaaggaagctactccagaattgctcgattttatccgagaattgcgaaaggtcgtcactattggagtcgtcggtggatctgatctaagtaagatatctgagcagcttggcaaaacagtcacaaacgactatgattattgtttctctgagaatggtcttgtcgcccataaagatgggaaatccattggaattcagagcctgaagctgcaccttggagacgataaactcaaggagttgataaatttcacgctgcactacattgcagacctggatattccaattaagaggggaacatttattgaattccgaaatggaatgctcaatgtatcacccattggtcgcaactgcagccaagaagaaagagatgaatttgagagatatgataaggttcaaaacatccgaccaaagatggtagctgaacttcgtgagcggtttgcacatcttaaccttactttctcaattgggggacagataagcttcgatgtcttccctaaaggttgggataagacttactgcttgcaatacctcgaggacttcagtgaaatccatttcttcggtgacaagacctatgagggtggaaatgactatgaaatctatgaatcaccaaaaacaattggccattcagttacgagtccagatgacacagtggcaaaatgcaaggctctgttcatgtcttga

SEQ ID NO: 2038 - protein, 246 aa, Arabidopsis thaliana
MAAKIPGVIALFDVDGTLTAPRKEATPELLDFIRELRKVVTIGVVGGSDLSKISEQLGKTVTNDYDYCFSENGLVAHKDGKSIGIQSLKLHLGDDKLKELINFTLHYIADLDIPIKRGTFIEFRNGMLNVSPIGRNCSQEERDEFERYDKVQNIRPKMVAELRERFAHLNLTFSIGGQISFDVFPKGWDKTYCLQYLEDFSEIHFFGDKTYEGGNDYEIYESPKTIGHSVTSPDDTVAKCKALFMS

SEQ ID NO: 2039 - DNA, 393 bp, Arabidopsis thaliana
atggcgtcaccaaagtcacccacaagaccaacccaacaaaacccacaacccaatttccacgattttcttcctaccatggccggaaacctaggcggtgaaggtctgatcggagagctatgcaacggcttcgagcttttgatggacagagagaaaggtgtcatcacgttcgagagtctccgacgtaacgctgcggcggttctgggtttaggagatttgactgatgaagatgtccggtgtatgattaaagaaggtgattttgactgcgacggtgcgttgaatcagatggagttttgtgtgttgatgtttaggcttagccctgatttgatggaagcgtcgcggtgtctcgtcacggaggtcattgaggaggagtttggcttcacgcgccggcattga

SEQ ID NO: 2040 - protein, 130 aa, Arabidopsis thaliana
MASPKSPTRPTQQNPQPNFHDFLPTMAGNLGGEGLIGELCNGFELLMDREKGVITFESLRRNAAAVLGLGDLTDEDVRCMIKEGDFDCDGALNQMEFCVLMFRLSPDLMEASRCLVTEVIEEEFGFTRRH

SEQ ID NO: 2041 - DNA, 1599 bp, Arabidopsis thaliana
atgccgcttcttcatccacagtcgttgcggcatccttctttcgagattcagacccaaagaagaagcaattccacaacaagattgcttctttctcacaagtttctccattctcaagcttccattatctcaatctccaggacaagaatcctcaaacgggtctctcagaatctctctgtagctaaagctgcttcagctcaagctagtagtagtgttggtgagagtgttgctcaaacatcagaaaaagatgtgttgaaggctctgtctcagattattgatcctgattttgggacagatattgtttcttgtggttttgtgaaagatttggggattaatgaagctttgggtgaggtttcgttccgtttggagctgacaacacccgcatgtccagtcaaagacatgtttgagaacaaggcaaatgaggtagttgcagcccttccatgggtgaagaaggtaaatgtgacaatgtcagcacaaccagccaagcccatttttgcagggcagcttccctttggattatcaagaatttcgaacatcatcgctgtttctagttgcaagggtggtgttgggaaatcaacagtagctgtaaatcttgcttatacattagctggtatgggtgctagagttggtatctttgatgctgatgtctatggtccaagtctaccaaccatggtcaatcctgagagccgtatattggaaatgaacccggagaagaagaccatcattccaacagaatacatgggcgtcaagctagtctcatttggatttgcaggacaagggcgtgccattatgagaggtcctatggtgtctggtgttataaaccaactccttacaacaactgaatggggagagctggactatcttgttatcgacatgcctcctggaactggtgatatacaactgaccttatgccaggttgcgccattgacagcagcggtaattgtcaccacccctcaaaagttggcgtttattgatgttgcaaaaggtgtaaggatgttctcaaaacttaaggtgccttgcgttgctgttgtggagaatatgtgccactttgacgctgatgggaaacgttattacccttttgggaaaggttcaggttctgaggtggtcaagcaattcggcatacctcacctctttgacctccccattagaccaacgttatctgcttcgggggatagcggaactcctgaagtagtgtcggatcctctaagtgacgttgccagaacgttccaggatcttggtgtatgtgtagtgcaacaatgcgccaagatacgccagcaagtatcaacggccgtgacatacgacaagtatctcaaggcaattagagtgaaggtaccaaactcagacgaagagttcttactgcaccctgcaaccgtcagaagaaatgatagatctgcacaaagtgtggatgaatggactggagagcaaaaagttctatatggcgatgtagcggaagatatcgaacctgaggacatacgaccaatgggaaactacgctgtctcgataacctggcccgacgggtttagccagattgctccatatgaccagttggaagaaattgaaaggctagtagatgttcctccattgtctccagtcgaagtctag

SEQ ID NO: 2042 - protein, 532 aa, Arabidopsis thaliana
MPLLHPQSLRHPSFEIQTQRRSNSTTRLLLSHKFLHSQASIISISRTRILKRVSQNLSVAKAASAQASSSVGESVAQTSEKDVLKALSQIIDPDFGTDIVSCGFVKDLGINEALGEVSFRLELTTPACPVKDMFENKANEVVAALPWVKKVNVTMSAQPAKPIFAGQLPFGLSRISNIIAVSSCKGGVGKSTVAVNLAYTLAGMGARVGIFDADVYGPSLPTMVNPESRILEMNPEKKTIIPTEYMGVKLVSFGFAGQGRAIMRGPMVSGVINQLLTTTEWGELDYLVIDMPPGTGDIQLTLCQVAPLTAAVIVTTPQKLAFIDVAKGVRMFSKLKVPCVAVVENMCHFDADGKRYYPFGKGSGSEVVKQFGIPHLFDLPIRPTLSASGDSGTPEVVSDPLSDVARTFQDLGVCVVQQCAKIRQQVSTAVTYDKYLKAIRVKVPNSDEEFLLHPATVRRNDRSAQSVDEWTGEQKVLYGDVAEDIEPEDIRPMGNYAVSITWPDGFSQIAPYDQLEEIERLVDVPPLSPVEV

SEQ ID NO: 2043 - DNA, 387 bp, Arabidopsis thaliana
atggctgggagagctacgatccctgctcgcaactctgccctcatcgcaatgatcgccgatgaggacactgttgttggatttttgatggctggagttggtaatgttgacataaggaggaagacaaattacctcatcgtggattcaaagacaactgtgagacaaattgaggatgctttcaaggaattctcagcaagggatgatatcgctatcattcttttaagccaatatatcgccaatatgatccggttcttggtggatagctacaacaagccagttcctgcaatcttggagatcccttccaaggaccatccctatgatcctgctcatgattcagttctctctcgtgtcaagtacctcttttctgcagaatctgtgtcacagcgttaa

SEQ ID NO: 2044 - protein, 128 aa, Arabidopsis thaliana
MAGRATIPARNSALIAMIADEDTVVGFLMAGVGNVDIRRKTNYLIVDSKTTVRQIEDAFKEFSARDDIAIILLSQYIANMIRFLVDSYNKPVPAILEIPSKDHPYDPAHDSVLSRVKYLFSAESVSQR

SEQ ID NO: 2045 - DNA, 1842 bp, Arabidopsis thaliana
atgcaaatccattttcatcatcatcaatatcatcaccaacttcattctcatcatccatggcccatttctcatctatacatgactcttccttatcgtttctcttccgttagaaaccactcacttctacttaagacttctcatctctgcacacccagatcagctcttggttgttgtttctctcccaaggaatcccctttcttcaggaagaacactgcccaattcctttctcctcagaaacacacttctcttcctctgaaacttgtctgccctttagctagtttctcttcttatgcggattctgagggagaagagcaacaccatgctgatcaaccgatacagaaccctcacgaatcttctaccgtttcaaacgaatcagatgggaaaggtaatgcagaagctactggagacttttctggaatggctcaagcctttcacatttcttccacaacagcaagggcaatctctatagtcatcgccttctctgctctcacccttccaatcttcatgaagtccctgggacaaggactggctctcaagaccaagcttctctcttacgcaacactactctttggtttctacatggcctggaacatcggagctaatgatgtcgcaaatgccatggggacttctgttggatctggagccttgacaatccggcaagctgtgatgacagctgcagttctcgaattctcaggtgctcttttgatgggaactcacgtgactagcacgatgcagaaaggaattctcatggctaatgtgttccaagggaaagatatgttgctctttgctggtctcctctcttccttagctgcagctggaacttggttacaggtagcttcttactatggatggccagtatcaacaactcactgtatcgtcggatcaatggttgggtttgggcttgtatatggaggagctggtgccgttttctggagttccctagctaaagtagcttcatcttgggtcatctctcctatactgggagctcttgtctccttcctagtctacaaatgcatcaggagatttgtttacagtgcaccaaacccaggacaagcagcggctgctgccgctcccgtcgctgtatttgtaggtgtggccagtatctcctcagccgcattgcctctaagtaagatctttccaatagctctatcacaagccttagcctgtggagtagcaggagccatagtattcgacagaatcatccgcaaacagctcggtcacctcctagctaaaacaaaatcaccagaaacatctcaaaaccaacccaaaaccattggtttcctctccgatatcgcaggaccaacaggtacacaactcgaaatagtctacggaatctttggctatatgcaagtcctctccgcttgcttcatgtcattcgctcacggaggcaacgacgtctccaacgcaatcggaccattagccgccgcattaagcattctccaaaacggagcagctgcaggaggagccgagatcgttatcccaatggatgttctcgcttggggaggattcggaatcgttgctggtctcacaatgtggggatacagagtcatcgcaacgatagggaagaagatcactgagctaacaccaacaagaggattcgctgcggaattcgccgccgcgtcggttgttttgtttgcttcgaaattagggcttccgatttctgcgactcatacacttgttggtgctgtgatgggtgttggtttcgctagagggcttaatagtgtgagagctgagactgtgagagagatcgttgcttcgtggcttgtcaccattcccgttggtgctacactcgccgttatctacacttggattttcaccaagatcttatcttttgtattgtga

SEQ ID NO: 2046 - protein, 613 aa, Arabidopsis thaliana
MQIHFHHHQYHHQLHSHHPWPISHLYMTLPYRFSSVRNHSLLLKTSHLCTPRSALGCCFSPKESPFFRKNTAQFLSPQKHTSLPLKLVCPLASFSSYADSEGEEQHHADQPIQNPHESSTVSNESDGKGNAEATGDFSGMAQAFHISSTTARAISIVIAFSALTLPIFMKSLGQGLALKTKLLSYATLLFGFYMAWNIGANDVANAMGTSVGSGALTIRQAVMTAAVLEFSGALLMGTHVTSTMQKGILMANVFQGKDMLLFAGLLSSLAAAGTWLQVASYYGWPVSTTHCIVGSMVGFGLVYGGAGAVFWSSLAKVASSWVISPILGALVSFLVYKCIRRFVYSAPNPGQAAAAAAPVAVFVGVASISSAALPLSKIFPIALSQALACGVAGAIVFDRIIRKQLGHLLAKTKSPETSQNQPKTIGFLSDIAGPTGTQLEIVYGIFGYMQVLSACFMSFAHGGNDVSNAIGPLAAALSILQNGAAAGGAEIVIPMDVLAWGGFGIVAGLTMWGYRVIATIGKKITELTPTRGFAAEFAAASVVLFASKLGLPISATHTLVGAVMGVGFARGLNSVRAETVREIVASWLVTIPVGATLAVIYTWIFTKILSFVL

SEQ ID NO: 2047 - DNA, 690 bp, Arabidopsis thaliana
atggatattttcgacaactctgatcttgaataccttgttgatgaatttcacgctgatttcgatgatgatgagccctttggagaggttgatgtcaccagtgagtctgattccgatttcatggactccgattttgatttcgagctgagtgagagtaagacgaacaatgaaacatcagcgttagaagctaggaatggaaaagatattcaagggattccatgggagagcttgaattacacgagggatagataccgtgagaatagattgctgcactataaaaactttgagagtctgtttcgatccagagaagagcttgataaggaatgcttgcaagtagagaaaggaaagaacttttatgactttcagttcaatacaaggcttgtcaagtccacaatagcgcattttcagctgaggaacttggtatgggcaacatcaaagcacgatgtgtatttcatgaacaactactctctcatgcactggtcatctttgttgcaaaggggcaaagaagtacttaatgtggcaaagcccattgttccttcaatgaagcagcatggatcgttgtcacagtctgtatcaagagtccagataagcaccatggcagttaaagacgatttgaagttgcgggagggttccaaggagagcttatctgtaagaaaatcaacgaacctgaggttgctttctgcactaaactaa

SEQ ID NO: 2048 - protein, 229 aa, Arabidopsis thaliana
MDIFDNSDLEYLVDEFHADFDDDEPFGEVDVTSESDSDFMDSDFDFELSESKTNNETSALEARNGKDIQGIPWESLNYTRDRYRENRLLHYKNFESLFRSREELDKECLQVEKGKNFYDFQFNTRLVKSTIAHFQLRNLVWATSKHDVYFMNNYSLMHWSSLLQRGKEVLNVAKPIVPSMKQHGSLSQSVSRVQISTMAVKDDLKLREGSKESLSVRKSTNLRLLSALN

SEQ ID NO: 2049 - DNA, 1461 bp, Arabidopsis thaliana
atgttggagaaagagtttttcacggagtatggtgaagcaagtcaatatcagatccaagaagttgttggcaaaggaagctacggagttgttgcttctgcggaatgtccacacacgggaggcaaagtagccatcaagaagatgacaaatgtgtttgaacatgtctcagatgctattcgtatcctcagagagatcaagcttctcaggcttcttcgacatcctgatatcgtggagatcaagcatatcatgcttcctccttgtcgcaaggaattcaaagatatatatgttgtttttgagttgatggagtctgatcttcaccacgttcttaaggtaaatgacgacctcactcctcagcatcatcaattcttcttgtaccaacttcttcgtggcttaaaattcatgcactcagctcatgtgttccatagagatctgaagcctaagaacatcctcgctaatgctgattgcaaaatcaagatctgtgatttaggacttgctcgtgtctcctttactgattccccttctgctgtgttttggactgactacgttgctacaagatggtaccgtgcgccagagctctgtggttccttctattctaactacacgccggcgattgacatgtggagtgttgggtgcatatttgcagagatgctaactggaaaacctttgtttcctggcaaaaacgttgtgcaccagctagaactcgtgactgatctgcttggaactccgtcgccgataactctatccaggattcggaatgagaaggctagaaagtatttgggaaacatgaggcgaaaggatcctgtacctttcacccataaattccccaatatcgatcctgtggcgctgaagttacttcagcgtttgatcgcttttgacccaaaggaccgtccctctgcagaagaggcattggctgatccgtattttcaaggattggcaaatgtggactatgaaccatcgaggcaacctatctcgaaacttgagtttgagtttgagaggaggaaattgactcgcgatgacgtgagggaactcatgtacagagagattttggagtatcatccacagatgttgcaagagtatctacaaggagaagagaacataaactctcattttctatacccaagcggagttgatcagttcaaacaagagtttgcccgactcgaagaacacaacgacgatgaagaggaacacaactccccaccacatcagagaaagtacacttcactccctagagaacgggtgtgctcatcagaagacgaaggttctgattcagttcatgctcaatcgtcttcagcttcagtggtgtttacacctccacagactccaaacacagcaactggcttatcatcacagaaggcgtcacaagtagacaaagcagcaactccggtaaaacggtctgcatgtctaatgaggagtgatagtatctgtgcttcaagatgtgttggtgtctcctctgcagtgtcatag

SEQ ID NO: 2050 - protein, 486 aa, Arabidopsis thaliana
MLEKEFFTEYGEASQYQIQEVVGKGSYGVVASAECPHTGGKVAIKKMTNVFEHVSDAIRILREIKLLRLLRHPDIVEIKHIMLPPCRKEFKDIYVVFELMESDLHHVLKVNDDLTPQHHQFFLYQLLRGLKFMHSAHVFHRDLKPKNILANADCKIKICDLGLARVSFTDSPSAVFWTDYVATRWYRAPELCGSFYSNYTPAIDMWSVGCIFAEMLTGKPLFPGKNVVHQLELVTDLLGTPSPITLSRIRNEKARKYLGNMRRKDPVPFTHKFPNIDPVALKLLQRLIAFDPKDRPSAEEALADPYFQGLANVDYEPSRQPISKLEFEFERRKLTRDDVRELMYREILEYHPQMLQEYLQGEENINSHFLYPSGVDQFKQEFARLEEHNDDEEEHNSPPHQRKYTSLPRERVCSSEDEGSDSVHAQSSSASVVFTPPQTPNTATGLSSQKASQVDKAATPVKRSACLMRSDSICASRCVGVSSAVS

SEQ ID NO: 2051 - DNA, 447 bp, Arabidopsis thaliana
atgccgagcagatacccaggagcagtaacacaagactgggaaccagtagttctccacaaatcaaaacaaaagagccaagacctacgcgatccgaaagcggttaacgcagctctgagaaacggtgtcgcggttcaaacggttaagaaattcgatgccggttcgaacaaaaaggggaaatctacggcggttccggtgattaacacgaagaagctggaagaagaaacagagcctgcggcgatggatcgtgtgaaagcagaggtgaggttgatgatacagaaagcgagattggagaagaagatgtcacaagcggatttggcgaaacagatcaatgagaggactcaggtagttcaggaatatgagaatggtaaagctgttcctaatcaggctgtgcttgcgaagatggagaaggttctaggtgttaaacttaggggtaaaattgggaaatga

SEQ ID NO: 2052 - protein, 148 aa, Arabidopsis thaliana
MPSRYPGAVTQDWEPVVLHKSKQKSQDLRDPKAVNAALRNGVAVQTVKKFDAGSNKKGKSTAVPVINTKKLEEETEPAAMDRVKAEVRLMIQKARLEKKMSQADLAKQINERTQVVQEYENGKAVPNQAVLAKMEKVLGVKLRGKIGK

SEQ ID NO: 2053 - DNA, 759 bp, Arabidopsis thaliana
atggcgcagaggaagatgattgtgtttcccaccaagaatgaattgtccgaagcaatggctgagtacactgccaatctctccgccaagttcatcaaagagaaaggccttttcaccgttgttctctccggcggtgacctaatcgattggctctgcaagttggtgcaacctccttatattgattcaatcgaatggccaaaatggcacgtcttttgggtcgatgagagggtttgtgcatgggaagatccagacagtaactacaaactcgccatggagggttttctctctaaggttccgattccggataagaacatctacgcaatcgacaagcacttggcggctgatggtaacgccgagcactgcgcgacgctctacgaggagtgtctaaagaatctggtgaaagaaaagattatcccaatatcgaaaaagacagggtatcctgagtttgatctacaacttctagggatgggtcctgatggccacatggcgtctctcttcccaaaccatccacagatcaatgagaagcagaaatgggtcacttacatcaccgactctccaaaaccaccaccaaagagaatcacattcactttaccggtcatcaactctactttgtacaatcttatggccatttgtgacaaagcaccggccaaatccgtggctgagatcatgaagcacaacaacctctcgttaccttctgctcatcttagtgctcaagtcgaaaatgtttggtaccttgaccaagcagctgcctccgagctctag

SEQ ID NO: 2054 - protein, 252 aa, Arabidopsis thaliana
MAQRKMIVFPTKNELSEAMAEYTANLSAKFIKEKGLFTVVLSGGDLIDWLCKLVQPPYIDSIEWPKWHVFWVDERVCAWEDPDSNYKLAMEGFLSKVPIPDKNIYAIDKHLAADGNAEHCATLYEECLKNLVKEKIIPISKKTGYPEFDLQLLGMGPDGHMASLFPNHPQINEKQKWVTYITDSPKPPPKRITFTLPVINSTLYNLMAICDKAPAKSVAEIMKHNNLSLPSAHLSAQVENVWYLDQAAASEL

SEQ ID NO: 2055 - DNA, 1611 bp, Arabidopsis thaliana
atggaagtttcagtgattggaaatcctcaagcgaggatctgcagagcagaattagcttacagagagcttggatttagatttggctctgatgtaatctccggtgaatcgagaaatagggttagtttctgcaaccaaagctctaaatggaaagagatcgcgatacgttgctcttcgagatctgtcaaatgtgaagccatcgtctccgatgacgcttctccgtttctcaaatccactccaaaatctaaatcgctcgagagtgtaaaattatttgttgggcttccgttagacacagtttcagactgcaacaatgtgaatcacttgaaagctattacagctgggcttaaagctttgaagctacttggtgtagaaggtattgagttacctatcttttggggagttgttgagaaagaagctgctgggaaatatgaatggtctgggtacttggcagtagctgagattgttaagaaagtgggacttaagcttcatgcttcactttctttccatggatcgaaacaaacagagataggtcttcctgattgggtggcaaagattggtgatgctgaaccagggatctattttacagatagatatggacaacagtacaaagattgtttgtcgtttgctgttgatgatgttcctgttcttgatgggaagactcctatggaggtttacagaggtttctgtgagagcttcaagtctgctttcgcagattacatgggcaacacaatcacgggaatcacattaggtttgggaccagacggtgagctgaaatatccttctcatcaacataatgccaagctctctggcgcgggagagttccagtgttacgacaaacacatgctttctgctcttaaaggctacgctgaatccactggaaaccctctttggggtctcggtggtcctcacgatgctcctgcttacgatcaacagcctaattcctcttcattcttctcagacggcgggtcatgggaatctcagtacggcgatttcttcttgtcttggtattcgtctcttctcacctcccacgcagaccgagtcctctccgttgcttcatctgcatttagcgggattggagtgcctctatgtgggaagctacctctcttacaccaatggcacaagctaagatctcatccttctgagttaacagctggattctacagctctaatggtcaggacaggtacgaggctatcgcagagatctttgcaaagaactcttgtagaatgataataccaggaatggacctatccgacgagcaccaatcacctgaatctctctcgagccccgagtcattacttggccacatcaaaacttcctgcaagaaacaaggagtcgttgtctcagggcaaaactcatccaccccggttcctggtgggtttgagaggatcgttgagaatctgaaggatgagaatgtaggaattgatctgttcacttaccagagaatgggagcacttttcttctctccagagcatttccatgctttcacagtctttgtccggaacctgagccaattcgagttgtcctcagacgatcaagcctcagaggctgaggttgaggccgagacagctagcataggttcaggcactggtgcacctagtttgcaaaccgcttaa

SEQ ID NO: 2056 - protein, 536 aa, Arabidopsis thaliana
MEVSVIGNPQARICRAELAYRELGFRFGSDVISGESRNRVSFCNQSSKWKEIAIRCSSRSVKCEAIVSDDASPFLKSTPKSKSLESVKLFVGLPLDTVSDCNNVNHLKAITAGLKALKLLGVEGIELPIFWGVVEKEAAGKYEWSGYLAVAEIVKKVGLKLHASLSFHGSKQTEIGLPDWVAKIGDAEPGIYFTDRYGQQYKDCLSFAVDDVPVLDGKTPMEVYRGFCESFKSAFADYMGNTITGITLGLGPDGELKYPSHQHNAKLSGAGEFQCYDKHMLSALKGYAESTGNPLWGLGGPHDAPAYDQQPNSSSFFSDGGSWESQYGDFFLSWYSSLLTSHADRVLSVASSAFSGIGVPLCGKLPLLHQWHKLRSHPSELTAGFYSSNGQDRYEAIAEIFAKNSCRMIIPGMDLSDEHQSPESLSSPESLLGHIKTSCKKQGVVVSGQNSSTPVPGGFERIVENLKDENVGIDLFTYQRMGALFFSPEHFHAFTVFVRNLSQFELSSDDQASEAEVEAETASIGSGTGAPSLQTA

SEQ ID NO: 2057 - DNA, 4497 bp, Arabidopsis thaliana
atgccggtggaggtagagagagaccaaggagaggtgtcggtgaaggttgattttgagaatgcgactgagattaaaccggaggtagttgtttcggccaccaaagaggacgtggtgaatgggatcagccatggtggtagtaataatggcaacgggaacgataccgatggttcttacgatttcattacggagaatgataccgttggagatgattttgtagagtctgattatgttaagcctgttgatgatgccaatgtggagaaagatcttaaggaaggagagaatgtgaaggtagatgctccaagtattgccgatgatgatgttttgggagtttctcaagatagtcaaaccctggaaaagtctgagctagaaagtacagatgatggaccagaggaagtcgttgagatcccaaagtcggaagttgaggattctcttgaaaaaagtgtcgaccagcagcatcctggtaatgggcatctagaaagtgggcttgagggtaaagtggaatctaaagaggaagtggagcaacttcatgattctgaagttggatccaaggatctgacaaagaataacgtagaggagcctgaagttgaaatcgaatctgatagtgaaacagatgtcgagggacatcaaggggacaagattgaagcccaagaaaaatctgatcgggatttggatgtttctcaagatctaaaacttaacgagaatgtagaaaagcaccctgttgactcagatgaagtaagggagtctgagttggtgagcgctaaggtttctccaactgagcctagtgatggaggcatggatttgggacaacctacggtaacagatccagctgaaaccatcaatggatctgaatctgtgaatgatcacgtcggatcagaacctgtaacagttttggaacctgtttctgttgaaaacggtcaccctccagtagaatcagagttggagagaagtagtgatgttccattcacttcagtggcggaaaaagtcaatgcttccgatggtgaagtgttgccagactctggaaccgtggatgttgttgtatcagaggtaagcagtgacgtccctgctgagactcaagctctcaatgccatcagcttggattcccagccttctggcaaagatagtgttgttgaaaatggtaatagcaaatcagaatctgaagacagcaagatgcaatcggaaattggagctgttgatgatggctctgtgtctgatgggagtataaacactcatccagaatctcaagatgccagcgatcctacttgtgatcaaggtggaaaacaacacatatcatccgaagttaaggaagttcttgatgcccctgcttcagaagaaataagtgatgctgttattgttgccaaagataatggttcagaagctgctatttctgatggcttatcttgtactaaccagcagggatcagaaagtgatgagatatctgggctagttgaaaaactcccatcccatgcgctacatgaggttgtgtcttctgcgaatgacacgagtgtaattgtaagcgatgacaccaaaagtcaaggtttatcagaggatcatggagttgacactaaccagacaattcaagatgattgtagtgctgagttggaagaagttaccgatgtgaatgtaaaacatgctccaaatgagaaagttcaaggagacaatagcgaggggaacttaaatgttggtggtgatgtttgtctaaattctgctgaagaagcgaaagaattacctacaggggatctttctgggaatgcatcacatgagagtgctgagactctctctacaaacatcgacgaaccattgagcttgttggataccaaaactgctgtctctgactttgcagaaagctcagcaggagtggctggcgaaatagacgctgttgccatggaatctgaagctgctcaatcaattaaacaatgcgctgaagcacatgtagctccatccattattgaagatggtgaaatagacagagaagtcaattgtggttcagaagtgaacgtgacaaagactactcctgttgctgtgcgcgaggatataccacctaaagaagtttctgagatggaagaatcggacgtcaaagaaagatcttcgataaatacagatgaagaagtcgctactgcctcagttgcatctgaaatcaagacctgtgcacaggatcttgaatctaaagtggttacatctactgataccatacatacaggagctaaagactgtgtggacagccaacctgctgaaaacaaagaaggtaataagttaattaaaaatgaaattaggctatgtacttctcttgttgagaatcagaaggatggagttgacagtatatataaattgttgtgttcaggaaatgttgttgatagaacagatgataaagtagcctcgaccggtgaagtttctgtacttgatgcttctgaagggcttactgtagcggcagagatagagaaaagacctttttactttctgcctagagttcctagatatgatgatgaaaagttagccgagcaactgaagcatgctgaagagcaggttgatcagaaaacacaaaatcgggatgctcttagagcggatatccagaagatacgcgcaatatgtaaggactatgatatcagttacaaggcggtcatggcagaagagagatctgcaagaaaagcaatgcattcaaaacggcaggaaattgaggcccttcagtctatgattagccgggttaaaagtgctgcgtctgttgatgatattgattcaagggtgcgtaatatggaacatacgatgcagcacacaactttatctctgaatgaagaaaaaggtttcatgcgtgaaataaagcagttgaagcaacttcgcgagcagatatcttcgagtatgggtaccaaggatgaagtaaagcaagcattggatgagaaagagaaaacagaagaacgtttgaaggtgttgaggaaggaactagacgcactcagaaacgatctatcaaaagccgaagaaatcacaaaagctgcgaaaaaaaagtgtgatggggaatgggaagcacagagtaaactgcaagaacagttcagagctgctgatgctgttcgccaggaagcatttgtgcacctacaggatttgaagaaacaacaacgagaaaagaacaaatatttcttcaagtacagagataattcaagggcagcaagtgaaatggctttgaagaaagacagagcagcactgcaaagcctttgttctgaccaggtggagaatttcatgaatatgtggaacaatgacgacgagttccgtaaatactatgtaaaaagcaacacaaggagtacctttagaagactaggaaccctagatggacgatctcttggccctgatgaggagccacctcggatcacttatgctccaagaacggacaaacttagaacttctagtgacagagcagagaaacatgaggcagttccagcacagaaagagaaagtcgttaaatttgaaggttcaaaagttgaaaacaacggtaaggaggttgctaaacccaccgagcaaaagagtcagaccactaaatctaaaaaggccgtcaagccagaccagcctccatcaattgtcacagaattggtttctggaaaagaggagatagagaagtcagcaacaccggaagaagaagagccgcctaagttaacaaaagaggaagaggagttaattaagaaagaagaagagaagagaaaacaaaaggaagctgcaaagatgaaggagcaacatcggttagaggaaatagcaaaagcgaaagaggcaatggagaggaagaagaagagagaggagaaggcaaaagcaagagctgttctcaaggctcagaaggaagccgaagaaagggagaaggtaaaagcatatttttgtcattctgttatccaaattggatttcgatcagtctctctagctagaacgagagaagaagctaaggaagaaggagagaagaaaggggatttttacatcagaagagacagcaacagaaaacccaattccgacagcagaaactgtagtcgaaaccccaagggagatcgaaactccaaagaaacaaaccgtagaggagagtcaacaaatgaagaaatctcacaaaccttcatcacagtttctgaaacaaaacaagtcaaaatcggttcctctgcctttaagaaaccgaggaagcaagagaaaactgcggcaatggatgtggattggactcatagttgtgatcatcatcgcattgttccttctcgaagttctacgattgttcgttcttgtcacataagtcatccaggggtggttcctcatcagtgccaagagatcgtccatctagacttccctagtctttttaaggacagagcagagaaacatgagactgttccaccagtttcagcactggattcagtcttatatttgccccttcatcaaaatcatcttcgggatcaaattttggaacagtctatgaggcgcacgagaactgctagtcgcagtagcgctacgttttgccttgacaaccgcagtagtttgactagaacgccataa

SEQ ID NO: 2058 - protein, 1498 aa, Arabidopsis thaliana
MPVEVERDQGEVSVKVDFENATEIKPEVVVSATKEDVVNGISHGGSNNGNGNDTDGSYDFITENDTVGDDFVESDYVKPVDDANVEKDLKEGENVKVDAPSIADDDVLGVSQDSQTLEKSELESTDDGPEEVVEIPKSEVEDSLEKSVDQQHPGNGHLESGLEGKVESKEEVEQLHDSEVGSKDLTKNNVEEPEVEIESDSETDVEGHQGDKIEAQEKSDRDLDVSQDLKLNENVEKHPVDSDEVRESELVSAKVSPTEPSDGGMDLGQPTVTDPAETINGSESVNDHVGSEPVTVLEPVSVENGHPPVESELERSSDVPFTSVAEKVNASDGEVLPDSGTVDVVVSEVSSDVPAETQALNAISLDSQPSGKDSVVENGNSKSESEDSKMQSEIGAVDDGSVSDGSINTHPESQDASDPTCDQGGKQHISSEVKEVLDAPASEEISDAVIVAKDNGSEAAISDGLSCTNQQGSESDEISGLVEKLPSHALHEVVSSANDTSVIVSDDTKSQGLSEDHGVDTNQTIQDDCSAELEEVTDVNVKHAPNEKVQGDNSEGNLNVGGDVCLNSAEEAKELPTGDLSGNASHESAETLSTNIDEPLSLLDTKTAVSDFAESSAGVAGEIDAVAMESEAAQSIKQCAEAHVAPSIIEDGEIDREVNCGSEVNVTKTTPVAVREDIPPKEVSEMEESDVKERSSINTDEEVATASVASEIKTCAQDLESKVVTSTDTIHTGAKDCVDSQPAENKEGNKLIKNEIRLCTSLVENQKDGVDSIYKLLCSGNVVDRTDDKVASTGEVSVLDASEGLTVAAEIEKRPFYFLPRVPRYDDEKLAEQLKHAEEQVDQKTQNRDALRADIQKIRAICKDYDISYKAVMAEERSARKAMHSKRQEIEALQSMISRVKSAASVDDIDSRVRNMEHTMQHTTLSLNEEKGFMREIKQLKQLREQISSSMGTKDEVKQALDEKEKTEERLKVLRKELDALRNDLSKAEEITKAAKKKCDGEWEAQSKLQEQFRAADAVRQEAFVHLQDLKKQQREKNKYFFKYRDNSRAASEMALKKDRAALQSLCSDQVENFMNMWNNDDEFRKYYVKSNTRSTFRRLGTLDGRSLGPDEEPPRITYAPRTDKLRTSSDRAEKHEAVPAQKEKVVKFEGSKVENNGKEVAKPTEQKSQTTKSKKAVKPDQPPSIVTELVSGKEEIEKSATPEEEEPPKLTKEEEELIKKEEEKRKQKEAAKMKEQHRLEEIAKAKEAMERKKKREEKAKARAVLKAQKEAEEREKVKAYFCHSVIQIGFRSVSLARTREEAKEEGEKKGDFYIRRDSNRKPNSDSRNCSRNPKGDRNSKETNRRGESTNEEISQTFITVSETKQVKIGSSAFKKPRKQEKTAAMDVDWTHSCDHHRIVPSRSSTIVRSCHISHPGVVPHQCQEIVHLDFPSLFKDRAEKHETVPPVSALDSVLYLPLHQNHLRDQILEQSMRRTRTASRSSATFCLDNRSSLTRTP

SEQ ID NO: 2059 - DNA, 435 bp, Arabidopsis thaliana
atggcggtttctctcccgaactcgtttcttcagattagcccatgtgttccttctctgcaattaagaaagccggtgatggcggcagtgaaaggaggaaaacaatcggtgagaagaagcagcaatacggtggttcagataacgtgtcgtaagaaggaattgcatcctgaattccacgaagacgcaaaggtttactgcaatggagagctggtgatgactacaggaggaacaaagaaagagtatgtggttgatgtatggtcaggtaaccatccgttttacctcgggaatcgttcggctttgatggttgatgctgatcaagttgagaagtttcgtaagaggttcgctgggctttctgagattatggagattcctgtgcttaaaggagaaatcattatgcctactaagaaaagtaaaggtcccaaagggaagaagaaatga

SEQ ID NO: 2060 - protein, 144 aa, Arabidopsis thaliana
MAVSLPNSFLQISPCVPSLQLRKPVMAAVKGGKQSVRRSSNTVVQITCRKKELHPEFHEDAKVYCNGELVMTTGGTKKEYVVDVWSGNHPFYLGNRSALMVDADQVEKFRKRFAGLSEIMEIPVLKGEIIMPTKKSKGPKGKKK

SEQ ID NO: 2061 - DNA, 1488 bp, Arabidopsis thaliana
atggacctcacccaaatcctactcctctcctttctctttctcactatctccatcaaactcttgctcacaaaatctaaccggaaacctaatcttcctccttctccggcttaccctttaccggttatcggccacctccacctcctcaagcaaccggtccaccgaacattccactccatctctaagtcccttggaaatgctccaatcttccacctccgcctgggaaaccgcctcgtttacgtcatctcctcacactccatagccgaagaatgtttcaccaaaaacgacgtcgttcttgcgaaccgtcctgatatcatcatggccaaacacgtcggctataactttaccaatatgattgcagcatcttacggcgaccactggaggaatctccgccgcatcgccgccgtcgagatattttcttctcatagaatcagtaccttttcttctatccgtaaagacgagatccgacggctcataacacatctctctagagactccttgcacggatttgttgaagtggagttgaaatcgttattaaccaacttggcattcaacaacatcatcatgatggtagccggaaaacgatattacggtaccggtacagaagacaatgatgaagccaagctcgtgagggaacttatagcggagataatggccggcgccggttctggaaatttggctgattatcttccgtccataaattgggtcacaaactttgagaaccagaccaaaatcttggggaatcgactcgatagagtcctgcaaaaactggttgatgagaaacgtgcagagaaagaaaagggtcaaactttgatcgatcatttgctttctttccaagaaaccgaacccgagtactatactgatgtcatcatcaaaggaatcatactggctttggttcttgcggggacagatacatcttcagtgacgttggaatgggcaatgtcaaatttgctgaaccatccagagatacttgagaaagcgagagcggagatcgatgataaaatcggttcagaccggttagttgaagaatcagatattgtaaatctccattatctccaaaacattgtgtcagaaacattacgtttgtatcctgcggttccactactactccctcatttctcatcggatgaatgtaaagtggcgggctacgatatgccacgtcgcacgttgttattaacaaacgtatgggcgatgcatagagatccaggtttatgggaagagccagagaggttcaagccggagaggttcgagaaagaaggagaggctcgaaagctaatgccgtttgggatgggacgacgagcttgtcctggagctgagcttgggaagcggttagtgagccttgctcttgggtgcttgattcagtctttcgagtgggagagagttggtgcagaacttgtggacatgactgaaggcgaagggatcactatgcctaaagctactccgttgcgagctatgtgcaaggcacgtgccattgttggtaaaacgatataa

SEQ ID NO: 2062 - protein, 495 aa, Arabidopsis thaliana
MDLTQILLLSFLFLTISIKLLLTKSNRKPNLPPSPAYPLPVIGHLHLLKQPVHRTFHSISKSLGNAPIFHLRLGNRLVYVISSHSIAEECFTKNDVVLANRPDIIMAKHVGYNFTNMIAASYGDHWRNLRRIAAVEIFSSHRISTFSSIRKDEIRRLITHLSRDSLHGFVEVELKSLLTNLAFNNIIMMVAGKRYYGTGTEDNDEAKLVRELIAEIMAGAGSGNLADYLPSINWVTNFENQTKILGNRLDRVLQKLVDEKRAEKEKGQTLIDHLLSFQETEPEYYTDVIIKGIILALVLAGTDTSSVTLEWAMSNLLNHPEILEKARAEIDDKIGSDRLVEESDIVNLHYLQNIVSETLRLYPAVPLLLPHFSSDECKVAGYDMPRRTLLLTNVWAMHRDPGLWEEPERFKPERFEKEGEARKLMPFGMGRRACPGAELGKRLVSLALGCLIQSFEWERVGAELVDMTEGEGITMPKATPLRAMCKARAIVGKTI

SEQ ID NO: 2063 - DNA, 2568 bp, Arabidopsis thaliana
atgtttcacgtggaagaagaaagcagtggaggcgatgggtctgagattgatgaggagtttggcggagacgattcaacgacgtcattgtcgcgatgggtgttcgatgagaaagatgattatgaggttaatgaagattacgacgatgatggatatgatgagcataatcacccggaaatggattccgatgaggaggatgacaatgtggagcagcgtttgattcgcactagccctgccgttgactctttcgatgtagatgctcttgagattcctggaactcagaaaaacgaaatcgaggacactggtataggaaagaaactcatacttgctttgcagacacttggggttgtatttggtgatattggaactagcccattgtataccttcactgtcatgttcagaagatctccaattaacgacaaagaagatattattggagccttgtcattggttatatacactttaatattgattcctcttgtaaagtatgtacattttgttctttgggccaatgacgatggcgaaggtgggacgtttgctttgtattcgttgatctgccggcatgcaaatgttagccttatcccaaatcaacttccatcagatgctcgcatatcaggctttggtttgaaggttccgtctccagaacttgaaagatcattgataattaaagaaagacttgaggcgtcaatggccttgaaaaagcttcttctgattttagttcttgccggcactgctatggtgattgctgatgctgttgttacgccagcaatgtcagtaatgtctgctatcggtggtctgaaggttggagttggtgttatagaacaagatcaggtggtcgtgatatcagtcagctttcttgtgatcttgttcagtgtacaaaaatatggaaccagcaaattggggcttgttttgggtcctgctttacttctgtggtttttttgtctagcgggcattggaatttacaacctcgtaaaatatgacagcagcgtttttaaagcgttcaatcctgcatatatctatttctttttcaagagaaactctgtaaatgcttggtatgcacttgggggttgcgttttatgtgcaactggatcggaggccatgtttgcagatcttagctatttctctgttcactctatccagcttacttttatccttctggtgttaccttgcctcttgctgggttatttgggtcaagccgcatacctctctgaaaacttcagcgctgccggggatgctttcttttcgtcagttccaagttctttgttctggccagtctttctcatttctaatgttgctgctttaattgccagtcgtgcaatgacaacagccacatttacatgcatcaaacagtcaatagcactaggctgtttcccacgtcttaaaatcattcacacctcaaagaaattcattggacagatttatataccggttcttaactggtcccttctggtggtgtgtctgatcgttgtctgctctacctcaaatatcttcgcgattggaaacgcttatggcatcgcagagctgggaattatgatgactacaacaattttggtgacccttatcatgcttcttatctggcagacgaacatcatagttgtgagcatgtttgcaattgtttccctgatagtcgaactggttttcttctcatccgtttgttcaagtgtggctgatggaagttggataatcttggtttttgctacaattatgtttctcataatgtttgtttggaactacgggagtaaactgaagtatgaaactgaagtccagaaaaagctaccaatggacctactacgagaactgggcagtaaccttgggacaattagagcacccggtattggtctactttataatgagctagctaaaggagttccggcaatatttggtcattttctaaccacccttcctgcaatccattccatggttatcttcgtgtgtataaagtatgtccctgttccaagtgtgcctcagaccgagagatttcttttcagacgtgtatgcccaagaagctatcatttattccgctgtgtagccaggtatggatacaaagatgtgcggaaggaaagtcaccaggcgtttgagcagatactgattgagagtctagaaaaatttatacgtaaggaagcacaggagcgtgcacttgagagtgacggagaccataatgatacagattctgaggatgatacgactctgtccagagttctgatagcacccaatggaagtgtgtattcacttggagtgcctctcttagctgagcacatgaattcgtcaaacaagcgacccatggagagaagaaaggccagcatagattttggggcaggtccttcatcggcgttggatgtggagcagagtctagaaaaagaattgtcgtttatacacaaagcgaaagagtcaggggtggtgtatctactgggacatggggacataagggctactaaggattcttggtttctgaagaagctggtaataaattacttgtatgctttcttgaggaagaactccaggagagggataacaaacctaagcgttccgcatacacatttgatgcaagttggaatgacttatatggtatga

SEQ ID NO: 2064 - protein, 855 aa, Arabidopsis thaliana
MFHVEEESSGGDGSEIDEEFGGDDSTTSLSRWVFDEKDDYEVNEDYDDDGYDEHNHPEMDSDEEDDNVEQRLIRTSPAVDSFDVDALEIPGTQKNEIEDTGIGKKLILALQTLGVVFGDIGTSPLYTFTVMFRRSPINDKEDIIGALSLVIYTLILIPLVKYVHFVLWANDDGEGGTFALYSLICRHANVSLIPNQLPSDARISGFGLKVPSPELERSLIIKERLEASMALKKLLLILVLAGTAMVIADAVVTPAMSVMSAIGGLKVGVGVIEQDQVVVISVSFLVILFSVQKYGTSKLGLVLGPALLLWFFCLAGIGIYNLVKYDSSVFKAFNPAYIYFFFKRNSVNAWYALGGCVLCATGSEAMFADLSYFSVHSIQLTFILLVLPCLLLGYLGQAAYLSENFSAAGDAFFSSVPSSLFWPVFLISNVAALIASRAMTTATFTCIKQSIALGCFPRLKIIHTSKKFIGQIYIPVLNWSLLVVCLIVVCSTSNIFAIGNAYGIAELGIMMTTTILVTLIMLLIWQTNIIVVSMFAIVSLIVELVFFSSVCSSVADGSWIILVFATIMFLIMFVWNYGSKLKYETEVQKKLPMDLLRELGSNLGTIRAPGIGLLYNELAKGVPAIFGHFLTTLPAIHSMVIFVCIKYVPVPSVPQTERFLFRRVCPRSYHLFRCVARYGYKDVRKESHQAFEQILIESLEKFIRKEAQERALESDGDHNDTDSEDDTTLSRVLIAPNGSVYSLGVPLLAEHMNSSNKRPMERRKASIDFGAGPSSALDVEQSLEKELSFIHKAKESGVVYLLGHGDIRATKDSWFLKKLVINYLYAFLRKNSRRGITNLSVPHTHLMQVGMTYMV

SEQ ID NO: 2065 - DNA, 1398 bp, Arabidopsis thaliana
atggtttcctctcagcgtcctgtccccaacaaaatccagaaacagcaatatctatccatcagcccttcaaattctgtcttgaaagatgatgttgaacttgagttctctgatgtgtttggtccactccccgaagaggccaatgatattgcttacgacgagcctgctgttgtctacagtcgatcccactccttggttggcccgtgttcgctcgatagtcattctttgaagctgaccaagctcaccttactagagactgaggactcaattgacttggtggagtgtctcgaaggtgaatctttaaaagaaaatgatgatttctctggtaatgacgacagtgacaatgagaaagctttagagggagatctggtgaaagtctcaggtgtagtaggcatagatgattttgaggttatgaaggttgttgggaaaggtgcgtttgggaaagtctaccaggtgaggaaaaaggagacctctgagatatacgctatgaaagtcatgaggaaagatcacattatggagaagaaccatgctgaatacatgaaagctgagcgcgatattcttacaaaaattgatcacccattcattgttcaacttaaatactcttttcagaccaagtacaggctgtatcttgtgctcgactttataaacggaggtcatcttttcttccaactctatcaccaagggcttttcagagaggacttggctcgagtgtacactgcagaaatcgtctctgcagtttcccatctccatgagaaaggcataatgcacagagatctgaaacccgaaaacatactcatggatacagatggccacgtgatgctaacagattttggtttagcaaaggaatttgaagaaaacacaagatcaaactccatgtgcggaactacggagtatatggcacctgaaattgttcgaggaaaaggacatgataaagcagctgactggtggagcgtagggattcttctgtatgagatgctcacaggaaagccaccgtttctcgggagcaaaggaaagatacagcagaaaattgtgaaggacaagatcaagcttccgcagtttctgtctaatgaagctcatgcaatactgaaagggctgctgcaaaaagagccagaaaggcgacttggaagtggactgagcggagcagaggagataaaacagcacaaatggttcaagggaataaactggaagaagctggaggctagagaagtgatgccaagtttcaagccggaagtatcgggaaggcaatgcatagcaaattttgacaagtgttggactgacatgtctgttttggattctccggcgagcagtcccagttcggatcctaaggccaacccttttaccaatttcacttacgtcaggcctcctccttcattccttcaccagtccacaactactttgtag

SEQ ID NO: 2066 - protein, 465 aa, Arabidopsis thaliana
MVSSQRPVPNKIQKQQYLSISPSNSVLKDDVELEFSDVFGPLPEEANDIAYDEPAVVYSRSHSLVGPCSLDSHSLKLTKLTLLETEDSIDLVECLEGESLKENDDFSGNDDSDNEKALEGDLVKVSGVVGIDDFEVMKVVGKGAFGKVYQVRKKETSEIYAMKVMRKDHIMEKNHAEYMKAERDILTKIDHPFIVQLKYSFQTKYRLYLVLDFINGGHLFFQLYHQGLFREDLARVYTAEIVSAVSHLHEKGIMHRDLKPENILMDTDGHVMLTDFGLAKEFEENTRSNSMCGTTEYMAPEIVRGKGHDKAADWWSVGILLYEMLTGKPPFLGSKGKIQQKIVKDKIKLPQFLSNEAHAILKGLLQKEPERRLGSGLSGAEEIKQHKWFKGINWKKLEAREVMPSFKPEVSGRQCIANFDKCWTDMSVLDSPASSPSSDPKANPFTNFTYVRPPPSFLHQSTTTL

SEQ ID NO: 2067 - DNA, 912 bp, Arabidopsis thaliana
atgatgatgatgattcagagaagaggaggtgagagacaagactcgtcggcggcggcgtacaacgttgtccataagttgcctcacggagacagtccttatgtccgagcgaagcatgttcagttggtggagaaagatgcagaagcagcgatagagttgttttggatagcgattaaagcgagagatagagttgatagtgctcttaaagacatggccttgttaatgaaacaacagaacagagctgaagaagccattgacgctattcaatcctttagagatctttgttcaagacaagctcaagagtcattagacaatgtcctcatcgatctatataagaaatgtgggagaatagaagagcaagttgagttattgaagcaaaagctttggatgatatatcaaggagaagcattcaatggcaaaccaacaaagactgcgagatctcatggcaagaagtttcaggtcaccgtcgagaaggaaacctctaggatcttggggaacttgggatgggcttatatgcaactaatggactatacagcagctgaagctgtgtatcggaaagctcaattgatagagccagatgcaaacaaggcttgcaatttatgcacatgtctcatcaagcaagggaagcacgatgaggcgaggtcgattctctttcgtgatgtactaatggagaacaaagaagggtctggtgatccgaggttgatggctcgggttcaagagctattgagtgagctaaagccacaggaagaagaagcagcggcttctgtgtctgtggaatgtgaagttggtatagatgagatagcggttgtcgaaggacttgatgagtttgtgaaggaatggaggaggccttataggacaagaagacttccgattttcgaagagatcttaccactgagagatcaattggcttgttga

SEQ ID NO: 2068 - protein, 303 aa, Arabidopsis thaliana
MMMMIQRRGGERQDSSAAAYNVVHKLPHGDSPYVRAKHVQLVEKDAEAAIELFWIAIKARDRVDSALKDMALLMKQQNRAEEAIDAIQSFRDLCSRQAQESLDNVLIDLYKKCGRIEEQVELLKQKLWMIYQGEAFNGKPTKTARSHGKKFQVTVEKETSRILGNLGWAYMQLMDYTAAEAVYRKAQLIEPDANKACNLCTCLIKQGKHDEARSILFRDVLMENKEGSGDPRLMARVQELLSELKPQEEEAAASVSVECEVGIDEIAVVEGLDEFVKEWRRPYRTRRLPIFEEILPLRDQLAC

SEQ ID NO: 2069 - DNA, 705 bp, Arabidopsis thaliana
atggataccaacaaccagcaaccacctccctccgccgccggaatccctcctccaccacctggaaccaccatctccgccgcaggaggaggagcttcttaccaccaccttctccaacaacaacaacaacagctccaactattctggacctaccaacgccaagagatcgaacaagttaacgatttcaaaaaccatcagcttccactagctaggataaaaaagatcatgaaagccgatgaagatgttcgtatgatctccgcagaagcaccgattctcttcgcgaaagcttgtgagcttttcattctcgagctcacgatcagatcttggcttcacgctgaggagaataaacgtcgtacgcttcagaaaaacgatatcgctgctgcgattactaggactgatatcttcgatttccttgttgatattgttcctagagatgagattaaggacgaagccgcagtcctcggtggtggaatggtggtggctcctaccgcgagcggcgtgccttactattatccgccgatgggacaaccagctggtcctggagggatgatgattgggagaccagctatggatccgaatggtgtttatgtccagcctccgtctcaggcgtggcagagtgtttggcagacttcgacggggacgggagatgatgtctcttatggtagtggtggaagttccggtcaagggaatctcgacggccaaggttaa

SEQ ID NO: 2070 - protein, 234 aa, Arabidopsis thaliana
MDTNNQQPPPSAAGIPPPPPGTTISAAGGGASYHHLLQQQQQQLQLFWTYQRQEIEQVNDFKNHQLPLARIKKIMKADEDVRMISAEAPILFAKACELFILELTIRSWLHAEENKRRTLQKNDIAAAITRTDIFDFLVDIVPRDEIKDEAAVLGGGMVVAPTASGVPYYYPPMGQPAGPGGMMIGRPAMDPNGVYVQPPSQAWQSVWQTSTGTGDDVSYGSGGSSGQGNLDGQG

SEQ ID NO: 2071 - DNA, 1317 bp, Arabidopsis thaliana
atgcttgctctcttcctctcttcttcttcgtatccaactctctctttcctctccagatcagtaactctaaacttagccagaacaacaacactctcagctctcacaatgtcgatgaacctaaagactcatgccttcgcaggcaatcccttgaagtcgaaaactccgaaatctaccgatccattctcacccacctccgctttcgaatctctgaaaaccctaattccagtaatccctaatcactcaacaccttcccctgattttaaagtccttccctttagcaagggtcgtccactggtgttctcaagcggtggagatgctaatacgacgccgatttggcatctgggttgggtcagcttggctgattgtaaggttttgttagcaagttgtggggttgatctgaatgaggactcactcgtgtatttaggacccaagttggaagaagatttggtgtattgggctgttgatttggcagaggatggtttcgtttctgaattgggaggtaggaagttgtgttttgttgagcttcgaaccctaatggtagctgctgattgggcggatcaacgtgctatggatgagttggctattgccggcaatgccagggcgttacttgaatggcacaacgtgtcacaattttgtggatcatgtggaagtaaaacttttccaaaggaagcaggaaggagaaaacaatgctcagacgaaacatgcagaaagagggtctatccccgtgttgatccggtggttataatgttagttattgatcgagaaaatgatcgcgcacttttaagcaggcaatctagatatgtaccgagaatgtggagttgtttagctggatttattgagccaggggaaagcttagaagaggctgtgaggcgggaaacatgggaagagacaggcattgaagtaggagatgttgtataccacagctctcagccttggcctgtgggaccaagtagcatgccatgccaattgatgctcggtttctttgctttcgccaagacgctcgacataaacgtagacaaagaagagttagaagatgctcaatggcacagtagagaagaggtgaagaaagcattggcggttgcagaatacaggaaggctcaaagaacagcagctgcaaaggtagagcagatctgtaaaggtgtggagagaagccagagtctatcaactgatttcaatcttgaaagcggtgagcttgctcctatgtttatcccggggccatttgccatcgcgcaccacctgatctcagcatgggtaaatcaggctcctgacgatgttcactcaaaacaacaagcgggtgtctctctctcaagtttgtag

SEQ ID NO: 2072 - protein, 438 aa, Arabidopsis thaliana
MLALFLSSSSYPTLSFLSRSVTLNLARTTTLSALTMSMNLKTHAFAGNPLKSKTPKSTDPFSPTSAFESLKTLIPVIPNHSTPSPDFKVLPFSKGRPLVFSSGGDANTTPIWHLGWVSLADCKVLLASCGVDLNEDSLVYLGPKLEEDLVYWAVDLAEDGFVSELGGRKLCFVELRTLMVAADWADQRAMDELAIAGNARALLEWHNVSQFCGSCGSKTFPKEAGRRKQCSDETCRKRVYPRVDPVVIMLVIDRENDRALLSRQSRYVPRMWSCLAGFIEPGESLEEAVRRETWEETGIEVGDVVYHSSQPWPVGPSSMPCQLMLGFFAFAKTLDINVDKEELEDAQWHSREEVKKALAVAEYRKAQRTAAAKVEQICKGVERSQSLSTDFNLESGELAPMFIPGPFAIAHHLISAWVNQAPDDVHSKQQAGVSLSSL

SEQ ID NO: 2073 - DNA, 816 bp, Arabidopsis thaliana
atgcagctctttccggtcatcctaccgacactatgcgtcttcctccaccttctaataagtggctctggctctactccaccgttgactcactccaatcaacaagtggcagccactcgttggcttcccgccaccgcaacctggtacggaagtgccgagggagacggcagcagcggaggagcttgtggttacggatcgttggtggacgtgaagccgtttaaggctagagtcggagcggtgagtccgattctgttcaaaggtggtgaaggctgcggtgcatgctacaaggtcaggtgtctcgacaagaccatttgctctaagagagcagtcaccattattgccaccgaccagtcaccgtcaggaccatctgctaaagcaaaacacactcatttcgacctcagtggcgccgcctttggacatatggctattcccggccataacggtgtcatccgcaaccgtggcctattaaacatcctctaccgccgaacggcatgcaaatacagagggaagaacatagcgtttcatgtgaacgcaggatcaactgattattggttatcgcttctcattgagtatgaagacggtgaaggagacattggctctatgcacattcgtcaagcgggatctaaggagtggatatcgatgaagcacatatggggagcgaactggtgcatcgtcgaaggaccactcaagggaccattctccgtgaagctcacaactttgtccaacaataagacactctccgccaccgacgtcatccccagtaactgggttcccaaagctacttacacctctcgcctcaacttctcccctgttctctaa

SEQ ID NO: 2074 - protein, 271 aa, Arabidopsis thaliana
MQLFPVILPTLCVFLHLLISGSGSTPPLTHSNQQVAATRWLPATATWYGSAEGDGSSGGACGYGSLVDVKPFKARVGAVSPILFKGGEGCGACYKVRCLDKTICSKRAVTIIATDQSPSGPSAKAKHTHFDLSGAAFGHMAIPGHNGVIRNRGLLNILYRRTACKYRGKNIAFHVNAGSTDYWLSLLIEYEDGEGDIGSMHIRQAGSKEWISMKHIWGANWCIVEGPLKGPFSVKLTTLSNNKTLSATDVIPSNWVPKATYTSRLNFSPVL

SEQ ID NO: 2075 - DNA, 699 bp, Arabidopsis thaliana
atggccaccggtttaggcttctttaagctctccttcctccttagcctcctctccggtggatcagacctattaggtcccgatgccgaatccggagtcgcccaaattgggaagttcccgccgtcgtgtaacagaatcgaatgcccgagctacgagctggttcactccggaaatggatacgaaattcgccggtacaacaacaccgtctgggtttccactgaaccgattccagatatctctctcgttgatgctaccagaaccgctttcttccaattgtttgcatacattcaggggaagaacgagtatcatcagaagatagaaatgactgctccggttatctctcaagtctcaccaagcgacggtccattctgtgaatcttccttcactgtatcattctacgttcctaaaaagaaccagcctgatccagctccgtcggagaatctccacattcagaaatggaactctaggtacgtggccgtgagacaattcagtggattcgtgtctgatgatagcataggagaacaagcggcggcgctagactcgagcctcaaaggtacggcttgggctaatgcaatagcgaaaagcaaagaagacggtggtgttgggtcggattcagcttacacggtcgctcagtataactcacccttcgagttctccggtcgggtcaatgagatttggttaccgttcgagctcgatgtttaa

SEQ ID NO: 2076 - protein, 232 aa, Arabidopsis thaliana
MATGLGFFKLSFLLSLLSGGSDLLGPDAESGVAQIGKFPPSCNRIECPSYELVHSGNGYEIRRYNNTVWVSTEPIPDISLVDATRTAFFQLFAYIQGKNEYHQKIEMTAPVISQVSPSDGPFCESSFTVSFYVPKKNQPDPAPSENLHIQKWNSRYVAVRQFSGFVSDDSIGEQAAALDSSLKGTAWANAIAKSKEDGGVGSDSAYTVAQYNSPFEFSGRVNEIWLPFELDV

SEQ ID NO: 2077 - DNA, 576 bp, Arabidopsis thaliana
atgagccggtgcggctctcttgggctctatgccccaaatgctttgccatctctctccttgaagccacgcagtgtcaaatctcctttctgtattacatctcacaccaaacccaacgacactcttcttcataatgttaacaagatgagagcaaaggcctgtgatatacttggagcaaagaagacaatcttggcagctcaactcggggcagttcttgccacgattgaccatccagccttagcaataacaggagttaacaaccagcaggaattgagcagtgttgtgctcgatatcgggatcatatccgtttggtacttcctagtaatgccaccaatcatcatgaactggctaagagtaagatggtacagaaggaagttcttcgagatgtatttacagttcatgttcgtcttcatgttcttccccgggctactgttatgggcaccatttctcaacttcaggaagttcccaagagatcctaatatgaagaatccttgggacaaaccaacagacccagactctataaagaacgtttacctcaaatacccatatgcgacgccagaagattacgatctcgattaa

SEQ ID NO: 2078 - protein, 191 aa, Arabidopsis thaliana
MSRCGSLGLYAPNALPSLSLKPRSVKSPFCITSHTKPNDTLLHNVNKMRAKACDILGAKKTILAAQLGAVLATIDHPALAITGVNNQQELSSVVLDIGIISVWYFLVMPPIIMNWLRVRWYRRKFFEMYLQFMFVFMFFPGLLLWAPFLNFRKFPRDPNMKNPWDKPTDPDSIKNVYLKYPYATPEDYDLD

SEQ ID NO: 2079 - DNA, 903 bp, Arabidopsis thaliana
atggctgcaactgcaatctcttctctttccttcccagctttgggtcaatcggacaagatctccaatttcgcatcttctcgtcctctcgcctccgcaattcgcatctgcacaaagttttctcgcctttctttgaattcgcgttccacttcgaaatctcttattcactgcatgtccaatgttaccgccgatgtgcctcctgtatcagagacaaagtcgaaattcctaaaagcttacaagcgacccatcccgagtatctacaacacggttttgcaggagctcattgtccagcagcatttgatgaggtataagaagacttatcgttatgatcctgtttttgcccttggatttgtcactgtatatgatcagctcatggaaggatatccgagtgatcaagaccgagatgccatttttaaggcttacattgaagccttgaatgaggatcctaagcaataccgaattgatgctcagaagatggaggaatgggcacgaagtcagacttctgcttcactagttgacttttcctctaaagaaggagatattgaagcagttcttaaggacattgcaggaagagctggtagtaaggaggggtttagttacagcaggttcttcgctgttgggctctttcgtttgcttgagcttgcaagtgctactgatccaactgtcttggacaagctttgtgcatccctaaatatcaacaagaaaagcgtggatcgggacctggatgtgtatcgtaacctgctttcaaagcttgtccaagccaaggaattgcttaaggagtatgtcgagagggagaagaagaagcaaggagaaagagcccaatctcagaaggctaacgaaacaatctccaagtgtctgggagatactctatataacccatctttcttggttgaacggaaatcttag

SEQ ID NO: 2080 - protein, 300 aa, Arabidopsis thaliana
MAATAISSLSFPALGQSDKISNFASSRPLASAIRICTKFSRLSLNSRSTSKSLIHCMSNVTADVPPVSETKSKFLKAYKRPIPSIYNTVLQELIVQQHLMRYKKTYRYDPVFALGFVTVYDQLMEGYPSDQDRDAIFKAYIEALNEDPKQYRIDAQKMEEWARSQTSASLVDFSSKEGDIEAVLKDIAGRAGSKEGFSYSRFFAVGLFRLLELASATDPTVLDKLCASLNINKKSVDRDLDVYRNLLSKLVQAKELLKEYVEREKKKQGERAQSQKANETISKCLGDTLYNPSFLVERKS

SEQ ID NO: 2081 - DNA, 909 bp, Arabidopsis thaliana
atgcaagcgtcgttcgtttggttgtttcaacaagttttctctgctactcctactttgatggtctctgttatgatccttctcgctaatttcacggtttactctattgagagcaactctgctttagccgccgccgtaagtcccccgacaaccctctctttcagcttcgaaacgacggcggagataagtgaaactcaagaaacgaatcagaaattcgattcttcaatggttaagacgttctctgtttcttctccttacgggaaaacatcttttgtcggtggtggcggcgggaacaatataccaccgccggtacaaagcggaacagatggtgatggatctgatcagtttagaaaatctcaattctcatcatcgtctctgggtgcaacaagtgcggattcagatgtatctgtgtcagggcaagaagagatcagactgtggaattcgatattggaggaaactgcgaaaatggaaacgttggatcacgagacgatgaaggggatggtttctccggtggaagctcgattagaagcagaagaatccatggattacttcaagacagagcttctttaccaaacgggattgtctcaggagcctggaaacgttctccttcttgctaattacgcacagtttctctaccttatcattcatgactacgacagagcggaaaagtatttcaagagagcagcaaaagcagagccagcggacgcagaggcattgaacaaatatgcgacgtttctgtggagagcgagaaacgatatttggagagcggaggaaacctacttagaagcgatctccgctgatccaacaaactcagtctactccgcaaactacgcacatttcctctggaacaccggtggtgatgaaacgtgttttcctctcgacgctccatcgcaacagaacaacaccacatga

SEQ ID NO: 2082 - protein, 302 aa, Arabidopsis thaliana
MQASFVWLFQQVFSATPTLMVSVMILLANFTVYSIESNSALAAAVSPPTTLSFSFETTAEISETQETNQKFDSSMVKTFSVSSPYGKTSFVGGGGGNNIPPPVQSGTDGDGSDQFRKSQFSSSSLGATSADSDVSVSGQEEIRLWNSILEETAKMETLDHETMKGMVSPVEARLEAEESMDYFKTELLYQTGLSQEPGNVLLLANYAQFLYLIIHDYDRAEKYFKRAAKAEPADAEALNKYATFLWRARNDIWRAEETYLEAISADPTNSVYSANYAHFLWNTGGDETCFPLDAPSQQNNTT

SEQ ID NO: 2083 - DNA, 753 bp, Arabidopsis thaliana; identical to SEQ ID NO: 1767

SEQ ID NO: 2084 - protein, 250 aa, Arabidopsis thaliana; identical to SEQ ID NO: 1768

SEQ ID NO: 2085 - DNA, 1563 bp, Arabidopsis thaliana
atggcgtctgtatctgcaattggagttctcaaggtacctcctgcttcgacttccaattccaccggaaaagccacggaggcggttcccacgaggactctttctttctcctcctctgttacttcatccgacgacaagatttcactcaaatccaccgtctcccgtctttgtaaatctgttgttcgcaggaatccgatcatcgtctctcccaaagccgtctcagattctcaaaactctcaaacttgtctcgatcctgatgctagcagcagtgttttggggataatcttaggaggtggagctggaactcgtctttatccacttacgaagaagagagcgaaaccagctgtgcctcttggtgctaactataggcttattgatattcctgtgagcaactgtttgaatagcaacatatccaagatctatgttcttactcagttcaattccgcgtctttgaatcgtcatctttcacgagcttatgctagtaacatgggaggttataagaatgaaggattcgttgaagttctcgctgctcaacagagtcctgaaaaccccaactggttccaggggacagctgatgccgtcaggcaatacttgtggttgttcgaggagcataatgtcttggagtatctcattcttgctggggatcatttgtatagaatggactatgagaagtttattcaagcacatagggagactgatgctgatatcacagtagctgcattaccaatggacgagcaacgagccactgcttttgggctgatgaagattgatgaggaaggacgtattattgaatttgctgaaaaaccaaaaggggagcacctaaaggccatgaaggttgacacaacaattctaggtcttgatgatcagagagccaaggagatgcctttcattgctagtatgggtatttatgttgtaagcagagatgtaatgctagacttactacggaatcagtttcctggagctaatgactttggaagtgaagtcattcccggtgccacttcccttggactgagggtgcaagcttacctatatgatggttactgggaagacattggtactatagaggcattttataacgctaatcttggaatcaccaagaaaccagttcctgattttagtttctatgaccgttctgctccgatctacacacagccgcgttatttaccaccgtctaagatgcttgatgctgatgttactgacagtgtcatcggagagggctgtgttatcaagaactgcaaaattcatcactctgtggttggactccgttcctgcatatcagaaggtgctattattgaagattcgttattaatgggagctgattattacgagactgctacggaaaagagcctcttaagcgcgaaaggaagtgtacccataggtattgggaaaaactcgcacatcaaaagggccatcatcgacaaaaacgcacgtatcggtgacaatgtcaagatcataaacagcgacaacgtgcaagaggcagcgagagagactgatggatatttcataaagagcggaattgtaacggttatcaaagacgccttaatcccaaccggcactgtcatctga

SEQ ID NO: 2086 - protein, 520 aa, Arabidopsis thaliana
MASVSAIGVLKVPPASTSNSTGKATEAVPTRTLSFSSSVTSSDDKISLKSTVSRLCKSVVRRNPIIVSPKAVSDSQNSQTCLDPDASSSVLGIILGGGAGTRLYPLTKKRAKPAVPLGANYRLIDIPVSNCLNSNISKIYVLTQFNSASLNRHLSRAYASNMGGYKNEGFVEVLAAQQSPENPNWFQGTADAVRQYLWLFEEHNVLEYLILAGDHLYRMDYEKFIQAHRETDADITVAALPMDEQRATAFGLMKIDEEGRIIEFAEKPKGEHLKAMKVDTTILGLDDQRAKEMPFIASMGIYVVSRDVMLDLLRNQFPGANDFGSEVIPGATSLGLRVQAYLYDGYWEDIGTIEAFYNANLGITKKPVPDFSFYDRSAPIYTQPRYLPPSKMLDADVTDSVIGEGCVIKNCKIHHSVVGLRSCISEGAIIEDSLLMGADYYETATEKSLLSAKGSVPIGIGKNSHIKRAIIDKNARIGDNVKIINSDNVQEAARETDGYFIKSGIVTVIKDALIPTGTVI

SEQ ID NO: 2087 - DNA, 1104 bp, Arabidopsis thaliana
atggagagcgattcagagatggttccgtttcctcaactaccgatgccaatagaaaacaactacagagcttgcacaattccttacagatttccttctgatgatcccaagaaagccactccaaatgaaatctcgtggatcaacgtcttcgccaattccattccttctttcaagaaacgtgcagagagcgatatcactgttccagatgctcctgctagagctgaaaaatttgcagaaagatatgctgggattcttgaagacttgaagaaagatccagagagtcatggcggaccaccagatggcattcttctatgccgacttcgtgagcaagtactcagagagttaggatttagggacatattcaagaaagttaaggatgaggagaatgcaaaggctatatcactatttcctcaagttgtcagtctgagtgatgctattgaagatgacggaaaacggttagagaatttggtgagagggatatttgctggaaacatctttgatcttggttctgcacagcttgctgaagttttctcaagggatggtatgtctttcttggctagctgtcaaaacttggttccacgaccatgggtcattgatgacttggaaaacttccaagccaaatggatcaataagtcttggaagaaggcagtgatttttgttgataattctggtgcagacataattttgggtattttgccgtttgcaagagagttgctccgtcgaggagctcaggtggtgctggctgctaatgagctgccatctatcaatgacataacatgtaccgagcttacagaaatcttgtcacagttgaaggatgaaaatggccaattgctaggtgttgatacttcgaagcttctgattgcaaattcggggaatgacttaccagttatcgatctctcaagagtatcacaggagcttgcttacctttcatctgatgccgacttagtcatcgtagaaggcatgggtcgtggaattgagacaaacctttatgctcagttcaagtgtgattctctcaagattggaatggtgaagcatcttgaagtagcagagtttctcggaggacggctctatgactgtgtcttcaaattcaatgaagttcagagctaa

SEQ ID NO: 2088 - protein, 367 aa, Arabidopsis thaliana
MESDSEMVPFPQLPMPIENNYRACTIPYRFPSDDPKKATPNEISWINVFANSIPSFKKRAESDITVPDAPARAEKFAERYAGILEDLKKDPESHGGPPDGILLCRLREQVLRELGFRDIFKKVKDEENAKAISLFPQVVSLSDAIEDDGKRLENLVRGIFAGNIFDLGSAQLAEVFSRDGMSFLASCQNLVPRPWVIDDLENFQAKWINKSWKKAVIFVDNSGADIILGILPFARELLRRGAQVVLAANELPSINDITCTELTEILSQLKDENGQLLGVDTSKLLIANSGNDLPVIDLSRVSQELAYLSSDADLVIVEGMGRGIETNLYAQFKCDSLKIGMVKHLEVAEFLGGRLYDCVFKFNEVQS

SEQ ID NO: 2089 - DNA, 615 bp, Arabidopsis thaliana
atggcgacagaacaagaagctgaagttggaacagagacatcctctgtttccggaaggtttttgaggaacagagatttatatctcttcttgccttttctcttaggcttctctgatcaagaatcatcaaacggagatgatgatgatgttgcttcatcgcgtgagagaatcattttagtcaacccttttacacaaggaatgattgtgctcgaaggctcatcaggaatgaatcctctgcttcgtagcttactggagtcacgtgaggaaggtcgtcctcctgcgtccaaggcttccatcgatgcgatgccgatcgttgagattgatggctgtgaaggagagtgtgtgatctgtttggaggagtggaagtccgaggagacggtgaaggagatgccgtgtaagcataggtttcacggtggatgtatagagaaatggttagggtttcatgggtcgtgtcctgtttgtaggtacgagatgcctgttgatggagatgagattgggaagaaaagaaacgatgggaatgagatttgggttaggttcagtttcaacgatggtcggagaattagagatttttctgcgcaggacggtggaaacagtgatggtgttgagtccgagaattag

SEQ ID NO: 2090 - protein, 204 aa, Arabidopsis thaliana
MATEQEAEVGTETSSVSGRFLRNRDLYLFLPFLLGFSDQESSNGDDDDVASSRERIILVNPFTQGMIVLEGSSGMNPLLRSLLESREEGRPPASKASIDAMPIVEIDGCEGECVICLEEWKSEETVKEMPCKHRFHGGCIEKWLGFHGSCPVCRYEMPVDGDEIGKKRNDGNEIWVRFSFNDGRRIRDFSAQDGGNSDGVESEN

SEQ ID NO: 2091 - DNA, 3396 bp, Arabidopsis thaliana
atggaggaagatcgtggggaagcgatcgttttagatatttcgccggagattaataatactccggcggtaatgatgagagttccacggaggattcgtgagaggcttttgtctgactgtagtaataagaagacagtatcttctgttcaagatattgaagacaagcttcttcatgcccatctacgaagacagcaattttatcataacgtttcgagaaaggctcgtgctaaacctagaagtccttcacgatcatctgatgaagaacttggccaacgaatcgaagcaagacttctggctgctgaacaaaaaaggttggagattcttgcgaaggcacagatgcgtttggcgaagttagatgagttaagacaagcagcgaaaacaagtgtggagatacggtcggagagggaacgtgtgaagcttggaactcaagtggagtctcgtgttcaaaaggctgaagctaatagaatgaagattctcaaggcgtctcatcagaaaagggcttgtgctaaagagagaacgtcacagtctatgatgaggaggatggctagagagagtaagtataaggaaagagttcgtgcttcgattaatcagaaacgtgtagctgctgagaagaaacgtcttgggttgcttgaagctgagaagaagaaagcacgtgctcgtgtccaacaagtacgtcatgttgccaactctgtttctaatcagcgtgagatagagagaagtaaaatgagggataaacttgaagacaaattgcaaagagcaaagagatatagatcggagtttcttcgtcagagaagaagacaacgtgattccattagtctctattgcgatatgatgcaggaagatgctgatcttctttctagaaagctgtcaaggtgttggaggtgctttgtaaggcagaagaggacaactttggatttggcgaaagcttatgatggtttgaagattaacgagtcattaccgtttgagcagcttgcgatgctacttgaatcgctgaacactcttaaaacggttaaatctttgcttgatcgccttgaaattcgcttagaagcttctaagaatgttaccacggtttctcaaccgtccatattggataatattgatcaccttcttaaaagagttgccacaccaaggagaaaggctacgccgagtactctgaggagcagaaagggaaagaaggtttcttctgttaggaatgtggctgggacatcagtgaagatgtctaggtatcctgtcagagttgttctttctgcctttatgatactcggccatccagatgctgtttttaatggtcaaggtgatcaagaggctgctctcaataacgcggctaaagggtttgtgagggagcttaagttattgataaacgttattcaagagggtcctgttcaggtttcgggtggagaatcaaaacatcggaccttaagatctcagttggacttattcgataaggcttggtgctcctttttgaactcatttgtgatttggaaagtcaaggatgctcggttgttggaagatgacctggttagagcagcttgtcagcttgagctttctatgattcaaaaatgcaagctaactccagaaggggttgacactatgctcactcatgataagaaagcaattcaaatgcaggtaacacaagatcaagaactcctaacagagaaagtacgacacctgagtggagttgcaggagttgagcgcatggaaagtgcgttgttggaaacacgaacaaagtactttcaggcgaaggaggatggaagccctatggctaatcagctcgcacatttcttttctccaagcccagcttcatctccagttcagtctgtgtctagttccagcagcagaagtaaagatagcataggtgttgaaggatcaaatcgtgttaatcgttctttattgaaggatgatactccaccctcatctggaccctctagagtcagtaatggcactgtggacgaggtttcaaatcagaatgagttgatggtgaatgagttcctgcatgatgggaacctcaactttcctggtggatccactgtcaaggatgaagaggacaatcttaagagaaggataaaggagactatggagagagctttctgggataatgtcatggaatccatgaaattggagaagccagactatagctgcatctctaaccttatgaaagaagtgagtgacgaactttgccagatggtaccagatagctggaaagtagaaataactgaaactattgatctggacattctctcacagttgctcaactccggcaccttggatatcgattaccttggaaagatgcttgagtttgcgttggctactctgcggaaactctctgccccagctaatgaccgtgagaatgaaagcacccaccgggatttactcaaggaacttcacaggttgtgtgaagctgaagatgagtctggtaacttccgtgctgttgcaatagtcaaggggatccgcttcattcttgagcaaattcaggaacttaagcgagagataggcataggtcgcatagcaatcatgaaaccctttttgcaaggaccagcaggctttgattaccttacaaaagcatttgaaaagcgttatggacctcccactcaagcctacgaatcactaccagtgacacgaaggtggatatcaactcttttgtctagcaaagaagagtgggaagaacacaacaatacgctttcagccttgaatgtggttgagagatcctccatgggtatttctctcaaaacgggtggaagctttctatccccagtcaataccacgtccaagtcaactgttatggacactgcaggtcaactatcagaatgcaagggagaaagagttgatttggcagtgaggcttgggttgttgaagctggtgaatcaggtagctggtttaacaccagaagttctaccggaaacttttcagctcaacctctttcgcgtgagggatattcaagctgaaattcagaatataattgtggtaaccacaagcttgctcatttggcgtcaaatgcttgcaaagagcgaaagcgaaacagaaagtatggcaaagaaattgttggagttgttagatgggaaggaaggagcaggactaacggagataatcgaaacaacaatgagtgaagaagatggagagaagaagaagatgatgagaggattattggggaagagtttgggagaaggtaacacagtgtatgagagagttacaagttgtatatacaaagcggctcgaggagctttattggctgggaatggagaaaatgggaagagaatggttgaaacagagatgaagaaagtaggaggaggtggaggattgaaagaaagggttttagagacagctcgagcccttggtgttgtagcttgtgtctcagtcagagttcatggtccatggttgactcagctcatgccacaacattga

SEQ ID NO: 2092 - protein, 1131 aa, Arabidopsis thaliana
MEEDRGEAIVLDISPEINNTPAVMMRVPRRIRERLLSDCSNKKTVSSVQDIEDKLLHAHLRRQQFYHNVSRKARAKPRSPSRSSDEELGQRIEARLLAAEQKRLEILAKAQMRLAKLDELRQAAKTSVEIRSERERVKLGTQVESRVQKAEANRMKILKASHQKRACAKERTSQSMMRRMARESKYKERVRASINQKRVAAEKKRLGLLEAEKKKARARVQQVRHVANSVSNQREIERSKMRDKLEDKLQRAKRYRSEFLRQRRRQRDSISLYCDMMQEDADLLSRKLSRCWRCFVRQKRTTLDLAKAYDGLKINESLPFEQLAMLLESLNTLKTVKSLLDRLEIRLEASKNVTTVSQPSILDNIDHLLKRVATPRRKATPSTLRSRKGKKVSSVRNVAGTSVKMSRYPVRVVLSAFMILGHPDAVFNGQGDQEAALNNAAKGFVRELKLLINVIQEGPVQVSGGESKHRTLRSQLDLFDKAWCSFLNSFVIWKVKDARLLEDDLVRAACQLELSMIQKCKLTPEGVDTMLTHDKKAIQMQVTQDQELLTEKVRHLSGVAGVERMESALLETRTKYFQAKEDGSPMANQLAHFFSPSPASSPVQSVSSSSSRSKDSIGVEGSNRVNRSLLKDDTPPSSGPSRVSNGTVDEVSNQNELMVNEFLHDGNLNFPGGSTVKDEEDNLKRRIKETMERAFWDNVMESMKLEKPDYSCISNLMKEVSDELCQMVPDSWKVEITETIDLDILSQLLNSGTLDIDYLGKMLEFALATLRKLSAPANDRENESTHRDLLKELHRLCEAEDESGNFRAVAIVKGIRFILEQIQELKREIGIGRIAIMKPFLQGPAGFDYLTKAFEKRYGPPTQAYESLPVTRRWISTLLSSKEEWEEHNNTLSALNVVERSSMGISLKTGGSFLSPVNTTSKSTVMDTAGQLSECKGERVDLAVRLGLLKLVNQVAGLTPEVLPETFQLNLFRVRDIQAEIQNIIVVTTSLLIWRQMLAKSESETESMAKKLLELLDGKEGAGLTEIIETTMSEEDGEKKKMMRGLLGKSLGEGNTVYERVTSCIYKAARGALLAGNGENGKRMVETEMKKVGGGGGLKERVLETARALGVVACVSVRVHGPWLTQLMPQH

SEQ ID NO: 2093 - DNA, 768 bp, Arabidopsis thaliana
atggaaaacaaagagaccaagcaagaaccagcagcagcagctgagcaaaagaccgttccgttgatcgaagatgagatcgagaggagcaaagtcgggatcatgagagctctctgcgaccgacaagatcctgaaactaaggaggtggatgatctgatgataaggaggtttctgagagcgcgtgacctggacattgaaaaggcttcaacgatgtttctaaattacctgacttggaagagaagcatgctcccaaaggggcacataccagaagcagagattgcaaatgatctatcgcataacaagatgtgtatgcaaggtcatgacaagatgggtcgacctatcgctgttgccattgggaacagacataacccttccaaaggcaaccctgacgagttcaagcgttttgttgtctacacgctcgagaagatttgtgctagaatgccgagaggtcaagagaaattcgtagcaattggagatctgcaaggctggggatattctaattgtgacatccgtggctaccttgctgctctttccactttgcaggattgttacccagagagattagggaaactctatatagttcatgccccctacattttcatgaccgcatggaaggtcatttatccttttatcgacgccaacaccaagaaaaagattgttttcgtggagaacaagaaactcactccaacgctgcttgaagacatagacgaaagccaacttcccgacatctacggaggcaaattgccacttgttcctattcaggagacctga

SEQ ID NO: 2094 - protein, 255 aa, Arabidopsis thaliana
MENKETKQEPAAAAEQKTVPLIEDEIERSKVGIMRALCDRQDPETKEVDDLMIRRFLRARDLDIEKASTMFLNYLTWKRSMLPKGHIPEAEIANDLSHNKMCMQGHDKMGRPIAVAIGNRHNPSKGNPDEFKRFVVYTLEKICARMPRGQEKFVAIGDLQGWGYSNCDIRGYLAALSTLQDCYPERLGKLYIVHAPYIFMTAWKVIYPFIDANTKKKIVFVENKKLTPTLLEDIDESQLPDIYGGKLPLVPIQET

SEQ ID NO: 2095 - DNA, 780 bp, Arabidopsis thaliana; identical to SEQ ID NO: 1057

SEQ ID NO: 2096 - protein, 259 aa, Arabidopsis thaliana; identical to SEQ ID NO: 1058

SEQ ID NO: 2097 - DNA, 1764 bp, Arabidopsis thaliana
atgggttacgacaggctcggtccatccggaccatcaaacccgaaccagaaggaccctgccacgtcactcccggaactacagaagaaaactaaaacgaagctgattctcttcactttggccgttttggtagttggagtagtctgcttcggtatctttgccggcatccgagccgtagactcgggtaaaaccgagccgaaactaacccgtaaaccgacccaagcaatctcccgaacctgtagcaaatccttatacccgaacctatgcatcgacacacttcttgactttccgggatctttaaccgccgacgagaacgagctcattcacatatcattcaacgcaacgcttcaaaaattcagcaaagctctttatacttcttcgacgatcacatacactcagatgcccccacgtgtacggtcagcttacgattcttgccttgagttacttgatgattcagtggacgcgctcacacgcgctctttcctccgtcgttgtcgtctccggagatgagtctcattccgatgtgatgacgtggcttagctctgcgatgactaaccacgacacttgcactgacggattcgatgaaattgaaggtcaaggaggagaagtgaaggatcaagtgatcggagcggttaaagatttgtcggagatggtgagtaattgtttggctatattcgccggaaaagttaaggatttatctggagttccggtggtgaataataggaagttacttgggactgaagaaacagaggaattacctaattggttgaagagagaagacagagagcttcttggtactccaacgtcggcgattcaagctgatatcacggtgtcgaaagacggtagcggaacgtttaagacgatcgcggaggcgatcaagaaagccccggagcatagtagccgacgattcgtcatctacgttaaagcaggaagatacgaagaagagaatctgaaagttggtaggaagaagacaaacttgatgttcatcggggacggcaagggtaaaacggtcataaccggtgggaaaagtatcgccgatgatctaactacttttcacaccgccactttcgctgcgactggtgctggatttatagtgagggacatgacgtttgagaattacgccggaccggctaagcatcaggccgtggcactccgtgttggtggagaccacgcggtggtttaccgttgcaacattatcggttaccaagacgcgctttacgtacattctaaccgacagtttttccgcgaatgcgaaatttatggaacggtcgattttatattcgggaatgcggctgtgatcttacagagttgtaacatttatgcgcgtaaaccaatggctcagcagaagattactattacggctcagaaccgaaaagatccgaatcagaatacggggatttcgattcatgcttgtaagctactagcaacaccggatcttgaagcctctaagggtagttatccgacgtatctcggccgtccgtggaagttgtattctagagttgtgtacatgatgtcggatatgggtgaccatattgacccgcgaggatggttggagtggaatggtccgtttgcattggactcgttgtactatggtgagtatatgaacaaagggttgggttcaggaattggtcaacgagtcaaatggcctggttatcatgttattacctcaacggtagaggctagtaagtttacggtggctcagttcatttctggttcttcgtggttgccatccaccggtgtgtccttcttctccgggttgtcacaatag

SEQ ID NO: 2098 - protein, 587 aa, Arabidopsis thaliana
MGYDRLGPSGPSNPNQKDPATSLPELQKKTKTKLILFTLAVLVVGVVCFGIFAGIRAVDSGKTEPKLTRKPTQAISRTCSKSLYPNLCIDTLLDFPGSLTADENELIHISFNATLQKFSKALYTSSTITYTQMPPRVRSAYDSCLELLDDSVDALTRALSSVVVVSGDESHSDVMTWLSSAMTNHDTCTDGFDEIEGQGGEVKDQVIGAVKDLSEMVSNCLAIFAGKVKDLSGVPVVNNRKLLGTEETEELPNWLKREDRELLGTPTSAIQADITVSKDGSGTFKTIAEAIKKAPEHSSRRFVIYVKAGRYEEENLKVGRKKTNLMFIGDGKGKTVITGGKSIADDLTTFHTATFAATGAGFIVRDMTFENYAGPAKHQAVALRVGGDHAVVYRCNIIGYQDALYVHSNRQFFRECEIYGTVDFIFGNAAVILQSCNIYARKPMAQQKITITAQNRKDPNQNTGISIHACKLLATPDLEASKGSYPTYLGRPWKLYSRVVYMMSDMGDHIDPRGWLEWNGPFALDSLYYGEYMNKGLGSGIGQRVKWPGYHVITSTVEASKFTVAQFISGSSWLPSTGVSFFSGLSQ

SEQ ID NO: 2099 - DNA, 537 bp, Arabidopsis thaliana
atgcagtactacgaaaaccgtgagaaagactactacgaggtggctcaaggccaacgcaatggttatggccagagccagagccacaaccacgagggatatggccagagccagagccgtgggggatatggccagatccataaccgtgagggttataaccaaaaccgtgagggatatagccaaagccagagtcgcccagtatatgggcttagcccgactttgaaccaccgtagccacggtgggtttcttgatgggctcttcaagggtcaaaatggccaaaagggtcagagtgggctaggcacgtttctagggcaacacaagagccaagaggctaaaaagagtcaaggacatgggaagctcttggggcaacatgaccagaagaaaactcatgagacaaacagtggtcttaatggccttggaatgttcattaacaatggtgagaagaaacataggaggaaaagtgagcacaagaagaagaacaaggatgggcatggcagtggtaatgagagtggaagcagcagcggtagcgacagcgactga

SEQ ID NO: 2100 - protein, 178 aa, Arabidopsis thaliana
MQYYENREKDYYEVAQGQRNGYGQSQSHNHEGYGQSQSRGGYGQIHNREGYNQNREGYSQSQSRPVYGLSPTLNHRSHGGFLDGLFKGQNGQKGQSGLGTFLGQHKSQEAKKSQGHGKLLGQHDQKKTHETNSGLNGLGMFINNGEKKHRRKSEHKKKNKDGHGSGNESGSSSGSDSD

SEQ ID NO: 2101 - DNA, 1089 bp, Arabidopsis thaliana
atgctgagtagatcagttgcttctgctgttacaccggtctcatcttcttctctcttaccaaactcaaagcctatcttctgtctgaaaaccctctccggttatcgttcttcttctttctgtggcggctgtattcgtaaaatcaaccataagcctcttcgaatgacgagttccaatattacaccaagagctatggccacacaacagcttgagaacgctgatcagctcattgattctgtcgaaacttttatcttcgattgtgatggtgtgatttggaagggagataaattgatagagggagttcctgaaactcttgatatgcttcgtgccaagggaaagagattggtttttgtgacaaacaactcaacaaaatctaggaaacagtatggaaaaaagttcgagactcttggcctgaatgttaacgaggaggagatatttgcttcatcttttgctgctgctgcatacttgcagtctattaatttcccaaaagataagaaggtctatgtgattggtgaggaaggtatcttgaaagagctagagcttgctggttttcaataccttggaggtccggatgatggtaaaagacagattgaattgaagccaggttttctaatggagcatgatcatgatgttggagctgttgtggttggatttgatcgctatttcaactactacaaaattcagtatggaacactctgtatccgtgaaaacccggggtgtcttttcatcgctacaaaccgagatgctgtcactcaccttactgatgctcaagaatgggcaggtggtggctctatggttggtgctcttgttggatccactcaacgtgagcctcttgttgttggaaaaccctcaacttttatgatggactatttagcagacaaatttggaatccaaaagtcacagatatgcatggttggtgatagattggacactgacattttattcgggcagaatggcggttgtaagactctactcgtcctctcgggtgttacttcaatctctatgttggaaagccctgagaacaagatacaaccagatttctacaccagcaagatctccgattttctgtctccgaaagccgcaactgtataa

SEQ ID NO: 2102 - protein, 362 aa, Arabidopsis thaliana
MLSRSVASAVTPVSSSSLLPNSKPIFCLKTLSGYRSSSFCGGCIRKINHKPLRMTSSNITPRAMATQQLENADQLIDSVETFIFDCDGVIWKGDKLIEGVPETLDMLRAKGKRLVFVTNNSTKSRKQYGKKFETLGLNVNEEEIFASSFAAAAYLQSINFPKDKKVYVIGEEGILKELELAGFQYLGGPDDGKRQIELKPGFLMEHDHDVGAVVVGFDRYFNYYKIQYGTLCIRENPGCLFIATNRDAVTHLTDAQEWAGGGSMVGALVGSTQREPLVVGKPSTFMMDYLADKFGIQKSQICMVGDRLDTDILFGQNGGCKTLLVLSGVTSISMLESPENKIQPDFYTSKISDFLSPKAATV

SEQ ID NO: 2103 - DNA, 1947 bp, Arabidopsis thaliana
atggaattggtcccgtacgattcggagacgaaatcatcgatccccacaaatctcgcgtggcaagagatgtttcgttccgcttcatctcgtaaacctcaagaccctccgtcttcttcttcttcatcgccaccgcgtaaaccttccggcgatggatcatcaagcaaaacatctttatcaaccgttgattcccaagcccgtctcgctatgtacatagcaatggctcacgctggtctcgctttcgccatttgtgttctgtatttcgtcggaaagctattacaagagtatctaagaccgattcaatgggcgattctctgttcgattcctttacgaggtattcaagaaacccttgttgatttctggagcgagcctttgaaattagggcttacggaagttgttctcgctgttcctgtttctgtcttcaatgttttcatcgggtcgattgtggatattaaaaacgtctgctttagggtttttcttaggagatcgaaacctaagagaacgaggaagaagaacgatactgggttttctaaactggttaaatggttagtctcttttggtgtctttgtcattgcttatgagaggattggtggaattgggtctcttgtcattctctctttagggtttttgtttagttccaagaatgttgattcgtctctctctgcggtctcttctctgaggagtaatagttttaggagaagccatttcactgcttatttcactagagggataatgacgagattgaatactatagttgctattggtttgattgtgctcatgattgttggatctttgactggtgtcatcttcttctcgtataagattggtgttgaagggaaagatgctgtttattctctgaaatctcatgttgaagagagtaattacgctgagaagattgggatcaagcaatggatggatgagaatgatgttccgggaatggttgatatgtatacaacgaagttttatgaaacggtttctgagcagattgatagtttggcaatgcagtataatatgacggagttagtcactgggattaagcattttgtgatcgggcatcctcagaacacgtcgacgccttccacggcgcttataactccgtctccttatacagagaagctcatgagtttgaggactcgggttaagaatcgagagtggagtcagatatactcggaggttgatgtgatcttcagggagcttattatcactagagaagatttagtagagaaagctaaaggctttgctgttaaaggaatggatgtatcgcaacgggttttctcgagcagcgcatcggttgttggaggcggtgctaagttcgttttctctattggaaacttgataatctcaggagcagcagagtttttcaactttatctctcagctaatgattttcatttgggttttatacattcttatcacatcagaatcaggcggtgtgactgagcaagtcatgaacatgctcccgatcaacgcaagcgctagaaacagatgtgtcgaagtcttagacttagcgatatccggcgtgcttttagcaacagcggaaatcgccttcttccaaggatgtctcacttggctattgtttagactatacaatatacatttcctttacatgtcaaccgttcttgccttcatcagcgctctgttaccgattttcccttactggttcgcgacaatcccagcggctttgcagctcgtgctagaaggaagatatattgttgcagtgattttatctgtgactcatcttgtgctaatggagtatggtgcttcagagattcaagatgacattcctgggtccaatgcttaccttactggactaagtattattggtggagtcactctgtttccttctgctctagagggagcgataatggggccgttgataacgacggtggtgattgctttgaaggatctgtatgcagagtttgttctgaatgagccaaagaagatcaattag

SEQ ID NO: 2104 - protein, 648 aa, Arabidopsis thaliana
MELVPYDSETKSSIPTNLAWQEMFRSASSRKPQDPPSSSSSSPPRKPSGDGSSSKTSLSTVDSQARLAMYIAMAHAGLAFAICVLYFVGKLLQEYLRPIQWAILCSIPLRGIQETLVDFWSEPLKLGLTEVVLAVPVSVFNVFIGSIVDIKNVCFRVFLRRSKPKRTRKKNDTGFSKLVKWLVSFGVFVIAYERIGGIGSLVILSLGFLFSSKNVDSSLSAVSSLRSNSFRRSHFTAYFTRGIMTRLNTIVAIGLIVLMIVGSLTGVIFFSYKIGVEGKDAVYSLKSHVEESNYAEKIGIKQWMDENDVPGMVDMYTTKFYETVSEQIDSLAMQYNMTELVTGIKHFVIGHPQNTSTPSTALITPSPYTEKLMSLRTRVKNREWSQIYSEVDVIFRELIITREDLVEKAKGFAVKGMDVSQRVFSSSASVVGGGAKFVFSIGNLIISGAAEFFNFISQLMIFIWVLYILITSESGGVTEQVMNMLPINASARNRCVEVLDLAISGVLLATAEIAFFQGCLTWLLFRLYNIHFLYMSTVLAFISALLPIFPYWFATIPAALQLVLEGRYIVAVILSVTHLVLMEYGASEIQDDIPGSNAYLTGLSIIGGVTLFPSALEGAIMGPLITTVVIALKDLYAEFVLNEPKKIN

SEQ ID NO: 2105 - DNA, 1338 bp, Arabidopsis thaliana
atggaggaagaacggcgagttctgttcggaaagtacgagatgggaaggttattaggcaaaggaaccttcgccaaagtctattacggcaaagagatcatcggcggcgagtgcgtcgcaatcaaagtcatcaacaaggatcaagtaatgaagagacctggaatgatggaacaaatcaaacgcgagatttcaatcatgaagctcgttcgtcatcccaacatagttgaattgaaagaagtcatggctacgaagaccaagatcttcttcgtcatggagttcgttaaaggcggcgagcttttctgcaaaatctctaaaggtaagttacacgaagacgctgctcgtagatatttccagcaattgatctcagccgttgattattgccatagtagaggcgtttctcatcgcgatctgaaacctgagaatcttcttttagatgagaatggagatttgaaaatctccgatttcggattatctgcgttaccggaacagattcttcaagacggattgcttcatacgcagtgtggaactccggcgtatgttgcgccggaggtattaaagaagaaaggatacgacggcgcgaaagctgatatctggtcgtgcggcgtcgttttgtatgttcttctcgccggatgtttgccgtttcaagatgagaatctgatgaatatgtatcggaagattttcagagcggattttgaatttccgccgtggttttctccggaagcgaggaggttgatttcgaaactcctcgttgtagatccagatcgacggatctcgattccggcgattatgagaacgccttggctccggaaaaacttcactccgccgttagctttcaaaatcgacgaaccgatttgttctcaaagcagcaaaaacaacgaagaagaagaagaagacggagattgtgaaaatcaaacagagccgatatcgccgaaattcttcaacgctttcgaattcatatcctcgatgtcttccggatttgacttatcgagcttgttcgagagcaagaggaaagtgcaatcggtgtttacgtcacggtcgtcggcgacggaggtaatggagaagatagaaacggttacgaaggagatgaacatgaaagtgaagagaacgaaggattttaaagtgaagatggaagggaaaacggaagggagaaaaggacggttgtcgatgacggcggaagtgtttgaagtagcgccggagatatcggtggtggagttttgcaaatcggcgggagatactttggagtacgataggttatacgaagaagaagtacggccggcgttaaacgacatcgtctggtcatggcacggtgataataataacacttcttccgaggattgttga

SEQ ID NO: 2106 - protein, 445 aa, Arabidopsis thaliana
MEEERRVLFGKYEMGRLLGKGTFAKVYYGKEIIGGECVAIKVINKDQVMKRPGMMEQIKREISIMKLVRHPNIVELKEVMATKTKIFFVMEFVKGGELFCKISKGKLHEDAARRYFQQLISAVDYCHSRGVSHRDLKPENLLLDENGDLKISDFGLSALPEQILQDGLLHTQCGTPAYVAPEVLKKKGYDGAKADIWSCGVVLYVLLAGCLPFQDENLMNMYRKIFRADFEFPPWFSPEARRLISKLLVVDPDRRISIPAIMRTPWLRKNFTPPLAFKIDEPICSQSSKNNEEEEEDGDCENQTEPISPKFFNAFEFISSMSSGFDLSSLFESKRKVQSVFTSRSSATEVMEKIETVTKEMNMKVKRTKDFKVKMEGKTEGRKGRLSMTAEVFEVAPEISVVEFCKSAGDTLEYDRLYEEEVRPALNDIVWSWHGDNNNTSSEDC

SEQ ID NO: 2107 - DNA, 1473 bp, Arabidopsis thaliana
atggctgaagaacctactactaccactctcgttacaccggaaaagctaccttctccgagcctcacgccttctgaagtatctgaatctactcaagatgccctaccgacagagacagaaactctggagaaagtgactgagactaatccaccggaaactgcagataccaccaccaagccagaagaagaaaccgcggcagagcatcatccaccgacagtgacggaaacagaaactgcatcgacggagaaacaagaggttaaagacgaagcatcgcagaaagaagtagctgaagagaaaaagagtatgattccacagaatcttggttcattcaaagaagaaagcagcaaactttctgatctatctaattccgagaagaaatcactcgatgaactaaaacatctagttcgagaagctctagacaatcaccaattcaccaacacaccagaagaagtcaagatttgggggattccattacttgaagacgatagaagcgacgtcgttttgttaaaattcctaagagctagggagttcaaggtgaaagattcgtttgctatgctcaagaacacaatcaagtggagaaaggagttcaagatcgatgaattggtcgaggaagatcttgtggatgatcttgacaaggttgtgtttatgcatggacatgaccgagaaggtcaccctgtttgttacaatgtctatggtgagtttcagaacaaggagctttataataagacgttttctgatgaggaaaagaggaaacatttcttgaggactaggattcagttcttggagaggagtataaggaagctagattttagctctggtggggtttctactatttttcaggttaatgatatgaagaattctccggggttagggaagaaagagcttagatcagctactaagcaagctgttgagttgcttcaggacaattaccctgagtttgtcttcaaacaggcttttatcaatgttccttggtggtaccttgtgttttatactgtgattggtccgttcatgacaccaagatcaaagagcaagcttgtgtttgctggtccttcgcgttcagctgaaaccctattcaaatacatatcacccgagcaagttccagtacaatatggtggattgagtgttgatccttgcgactgcaatccagacttttcgttggaagattcagcctctgagatcactgttaagcccggaacaaaacaaactgttgagatcataatctatgagaaatgtgaacttgtgtgggagataagggtaactggatgggaagtgagctacaaggctgaatttgtgccggaagagaaagatgcttacacggtggttatacaaaaaccgaggaagatgagaccatccgatgaaccggtgttaacccatagcttcaaagtgaatgagcttggcaaggttttactcacagtagacaacccaacctctaagaagaagaagctcgtttacaggttcaatgtcaaacctctctaa

SEQ ID NO: 2108 - protein, 490 aa, Arabidopsis thaliana
MAEEPTTTTLVTPEKLPSPSLTPSEVSESTQDALPTETETLEKVTETNPPETADTTTKPEEETAAEHHPPTVTETETASTEKQEVKDEASQKEVAEEKKSMIPQNLGSFKEESSKLSDLSNSEKKSLDELKHLVREALDNHQFTNTPEEVKIWGIPLLEDDRSDVVLLKFLRAREFKVKDSFAMLKNTIKWRKEFKIDELVEEDLVDDLDKVVFMHGHDREGHPVCYNVYGEFQNKELYNKTFSDEEKRKHFLRTRIQFLERSIRKLDFSSGGVSTIFQVNDMKNSPGLGKKELRSATKQAVELLQDNYPEFVFKQAFINVPWWYLVFYTVIGPFMTPRSKSKLVFAGPSRSAETLFKYISPEQVPVQYGGLSVDPCDCNPDFSLEDSASEITVKPGTKQTVEIIIYEKCELVWEIRVTGWEVSYKAEFVPEEKDAYTVVIQKPRKMRPSDEPVLTHSFKVNELGKVLLTVDNPTSKKKKLVYRFNVKPL

SEQ ID NO: 2109 - DNA, 501 bp, Arabidopsis thaliana
atggctgcatttgcaacggcagaagcgtgtgacagcaacgcagaactaatatcaaatggagacttacgcgctcttcacccaatcttcaagatctatggccaaagaagatgcttctcaggaccaatcgtgactctcaaggtctttgaagacaatgtcctcgtcagaaaccaactagaaacgaaaggagaaggcggagtcttagttatagacggtggtggaagcatgagatgcgcgcttgttggaggaaacctcggacagttagctcagaacaacgggtggtcggggattgttgtgaatggatgcgttagagatgtggatgagatcaatgactgcgatgttggggtcagggcattgggatctaacccgttgaaatctactaagaaaggtcatggtgagaagaatgtgccggttcatattggaggaactttgattagagatggagagtggctatatgctgatagtgatggtatcttgatctccaagaccgaactctctgtttga

SEQ ID NO: 2110 - protein, 166 aa, Arabidopsis thaliana
MAAFATAEACDSNAELISNGDLRALHPIFKIYGQRRCFSGPIVTLKVFEDNVLVRNQLETKGEGGVLVIDGGGSMRCALVGGNLGQLAQNNGWSGIVVNGCVRDVDEINDCDVGVRALGSNPLKSTKKGHGEKNVPVHIGGTLIRDGEWLYADSDGILISKTELSV

SEQ ID NO: 2111 - DNA, 1299 bp, Arabidopsis thaliana
atgtttcgtcccaattctcttttaataccttcaaatttatcaacaacaaaaagccaaagaaacacaatgctaaattcttcatatctatccttcgcacttatctttttctgctgcattttgttctccgctctcgcttcgtctttgcccgtttccgaccctgagcttgttgtcgaggaagtacacagaaaaataaacgagtccatatcaagaaggaagctagggttcttctcgtgcgggagtggtaatccaatcgatgattgttggcgatgcgacaaggattgggagaaaaaccgaaaacggttagcagactgtggtatcggttttggcaagaacgctattggcggtcgtgatggtgaaatctatgtggtcacggatccaggaaacgatgatccagtaaaccctagaccgggaacactaagatacgcagtcattcaagatgaaccgctatggatcatttttaagcgagacatgacgatccaactaaaagaagaactcatcatgaattctttcaaaaccctagacggacgaggagcctccgtacacatctccggtgggccatgtataaccatacaatatgtaaccaacatcatcatccatggtttacacatacatgactgcaagcaaggtgggaatacttacgtacgtgactcaccagagcattacggatatagaacggtatccgacggtgacggtgtgtcaatattcggtggaagccacgtgtgggttgatcattgctcgctatcgaattgcaacgacgggttaattgatgcaattcgtggatcaacggctataacgatctcgaacaattatttgacgcatcataataaggttatgttattgggacacagtgatacgtacgaacaagacaagaacatgcaagtcactatcgcttttaaccattttggagaaggcctcgtccaaagaatgccaaggtgtagacatggatatttccatgtggtgaacaatgactatacacattgggaaatgtatgcaattggaggaagtgctaatcctaccatcaactctcaaggcaaccgttttcttgctcctgatgactcatctagcaaagaggtaacaaagcacgaggatgcgccggaagacgaatggagaaattggaattggagatctgaaggagatctactgcttaatggtgcattcttcacctattctggtgctggaccagctaaatcatcaagctattcaaaagcttcgagtctagccgcgagaccgtcctctcatgttggtgagataactatagcctcgggtgcactcagctgcaaaaggggttctcattgttga

SEQ ID NO: 2112 - protein, 432 aa, Arabidopsis thaliana
MFRPNSLLIPSNLSTTKSQRNTMLNSSYLSFALIFFCCILFSALASSLPVSDPELVVEEVHRKINESISRRKLGFFSCGSGNPIDDCWRCDKDWEKNRKRLADCGIGFGKNAIGGRDGEIYVVTDPGNDDPVNPRPGTLRYAVIQDEPLWIIFKRDMTIQLKEELIMNSFKTLDGRGASVHISGGPCITIQYVTNIIIHGLHIHDCKQGGNTYVRDSPEHYGYRTVSDGDGVSIFGGSHVWVDHCSLSNCNDGLIDAIRGSTAITISNNYLTHHNKVMLLGHSDTYEQDKNMQVTIAFNHFGEGLVQRMPRCRHGYFHVVNNDYTHWEMYAIGGSANPTINSQGNRFLAPDDSSSKEVTKHEDAPEDEWRNWNWRSEGDLLLNGAFFTYSGAGPAKSSSYSKASSLAARPSSHVGEITIASGALSCKRGSHC

SEQ ID NO: 2113 - DNA, 1878 bp, Arabidopsis thaliana
atgggtttagtcaacgggagagcttcgttgacctttctcctcgcggcgttgaccatcatcgctatggtcgtcgaggctaggtttgtggtggagaaagaaagcataagcgtgctgaatccagaggagatgaggtcgaagcacgacggctcgatagccaatttcggtttacccgattacggtgggtttttaatcgggtcagtggtttatccggatagtaaaaccgatggatgctctgcttttggtaaaaccttcaagcccaagtttcctcgtcccactattctgcttcttgatcgtggaggttgctactttgccttaaaagcgtggcacgcgcagcaagcaggcgcggctgcagttcttgtggcggataatgtagacgagccattgttgacaatggattcaccagaggagagcaaagatgcggatggtttcatagagaagctaacaatcccatcggtgttaatcgataaatcatttggagatgacttaagacaagggtttcagaaagggaaaaacatagttataaaactagattggagagagtctgtgcctcatcctgataagagagtagaatatgagctgtggactaatagcaatgatgagtgtggtgcacggtgtgatgaacagatggactttgtcaagaactttaaaggtcatgctcagatactcgaaaaaggcggttataccgcgtttacgccgcattatattacttggttttgcccttttcagtttataaacagtccacattgtaagtctcagtgtataaaccatgggaggtattgtgctcctgaccctgaggataatttcagagaagggtatgaagggaaagatgttgtgcttgagaatctgagacagctttgtgtgcatagagttgcgaatgagagtagcaggccttgggtttggtgggattatgttaccgattttcattctcgatgttcgatgaaggagaagaaatacagcatagattgtgctgagagtgtcatcaaatctctgaatttacctattgagaagatcaagaaatgcattggtgatcctgaggctgatacagagaaccaagttctgagaactgagcaagtatctcagattggccgaggaaaccggggagatgttacgatattgccaacattagtcatcaataacgctcaatatcgagggagattggagagaaccgcggttttaaaggcgatatgcgctggttttaatgaaacatcggagcctgccatttgcttaaacacaggtctagagacaaatgagtgccttgaaaacaatggtggttgctggcaggatacaaaagcaaacatcactgcttgtcaagacacattcagaggaagactctgcgagtgtccggttgtaaaaggtgttcaatataaaggagacgggtacacttcatgtacaccttatgggcctgcgaggtgtactatgaacaatggaggttgctggtctgacacaaggaacggcttaactttctctgcttgctcagactctgtatctactggctgcaaatgtcctgaaggtttccaaggcgacggtttgacgtgtgaagatattaacgaatgtaaagagcgttcggtatgtcaatgtagcggttgcagatgcaagaactcatggggtggatacaaatgcagctgttctggtgaccggctttacataaacgatcaagatacttgtatagagagatatggatccaaaacggcatggtggctcacattcttgatactggctatcgttgcagtagccggtttagctggttatatattctacaaataccggttcaggtcttacatggactcagagattatgacgatcatgtcacagtatatgccacttgagagccaaagagctcgtgaagttccatcagaagccgagccttttacactctaa

SEQ ID NO: 2114 - protein, 625 aa, Arabidopsis thaliana
MGLVNGRASLTFLLAALTIIAMVVEARFVVEKESISVLNPEEMRSKHDGSIANFGLPDYGGFLIGSVVYPDSKTDGCSAFGKTFKPKFPRPTILLLDRGGCYFALKAWHAQQAGAAAVLVADNVDEPLLTMDSPEESKDADGFIEKLTIPSVLIDKSFGDDLRQGFQKGKNIVIKLDWRESVPHPDKRVEYELWTNSNDECGARCDEQMDFVKNFKGHAQILEKGGYTAFTPHYITWFCPFQFINSPHCKSQCINHGRYCAPDPEDNFREGYEGKDVVLENLRQLCVHRVANESSRPWVWWDYVTDFHSRCSMKEKKYSIDCAESVIKSLNLPIEKIKKCIGDPEADTENQVLRTEQVSQIGRGNRGDVTILPTLVINNAQYRGRLERTAVLKAICAGFNETSEPAICLNTGLETNECLENNGGCWQDTKANITACQDTFRGRLCECPVVKGVQYKGDGYTSCTPYGPARCTMNNGGCWSDTRNGLTFSACSDSVSTGCKCPEGFQGDGLTCEDINECKERSVCQCSGCRCKNSWGGYKCSCSGDRLYINDQDTCIERYGSKTAWWLTFLILAIVAVAGLAGYIFYKYRFRSYMDSEIMTIMSQYMPLESQRAREVPSEAEPFTL

SEQ ID NO: 2115 - DNA, 447 bp, Arabidopsis thaliana
atgccttcaagcacattctccgggactgttagcacgccgaagctgtcggtggcagtggacatgggaaacccttttctcaatctcaccgttgatgccttcctcaagatcggagctgttggagtcactaaatctcttgcagaagacacttacaaggccatcgacaaagggagtctctccaagagcactttggagcatgcgcttaagaagttgtgtaaagaaggtgtttactggggagctgctggtggagtgtacattggaacagaatacggaatcgaacgtatccgtggcagcagagattggaaaaacgcaatgttagcaggcgcggcgacaggagcagtgctctcagcggttggtaagaaaggcaaagacactattgtgatcgatgccattcttggtggcgcgcttgcaaccgcttctcagttcgttaacaatcattatttctactga

SEQ ID NO: 2116 - protein, 148 aa, Arabidopsis thaliana
MPSSTFSGTVSTPKLSVAVDMGNPFLNLTVDAFLKIGAVGVTKSLAEDTYKAIDKGSLSKSTLEHALKKLCKEGVYWGAAGGVYIGTEYGIERIRGSRDWKNAMLAGAATGAVLSAVGKKGKDTIVIDAILGGALATASQFVNNHYFY

SEQ ID NO: 2117 - DNA, 1314 bp, Arabidopsis thaliana
atggcggcggcgtttgcctctcttcccacatttagtgtcgtcaattcctccagatttcccagaagaagaatcggtttttcttgctccaaaaagcccctcgaagttcgttgttcttccggcaatactcgttacactaagcagagaggggcatttacatcactgaaagaatgtgcgatttcattagctttatcggttggtttaatggtttcagtaccttcgattgctttgcctcccaatgctcacgcagtggcgaatccagtgattccagatgtttcagtgttgatctccggtcctccgattaaagatccggaagctttactaagatatgcattgcctattgacaacaaagccatcagggaagtgcagaagcctcttgaggatatcactgatagcctcaagattgctggcgttaaggctctagattctgttgaacggaatgtgaggcaggcaagtagaacattgcagcaagggaaaagtataattgtggcaggttttgctgaatcgaagaaggatcatggtaatgaaatgattgaaaagttggaagctgggatgcaagatatgcttaagatagtggaagatcgaaaaagagacgcagttgctccaaaacagaaagaaattctcaaatatgttggcggaatagaagaggatatggttgatggctttccatatgaagtgccggaagagtatcggaacatgcctctcctcaagggaagagctagtgtggacatgaaggtcaagatcaaggacaatcccaacatcgaggactgtgtgttccgcattgttcttgatggttataacgcccctgttaccgccggaaactttgtggacttggtagagaggcatttctacgatggcatggagatccagagatctgatggatttgtggtacaaacgggagatccagagggtcctgcggaaggatttatcgatccaagcacagagaaaacgaggacggttcctctagagattatggtgactggagagaaaacgcctttttacggctcaactcttgaagaacttggtctttacaaggctcaggttgtgattcctttcaacgcttttgggacaatggcaatggcaagagaagagtttgagaatgactcaggatcaagccaagtgttttggctgctaaaagagagtgagctgacaccaagcaattccaacatcttggatggtcgttacgctgtctttggttacgttactgataacgaagattttctagctgatcttaaagttggtgatgttatcgaatccattcaagttgtctccggtttagagaacctcgctaacccgagttacaaaatcgccggttaa

SEQ ID NO: 2118 - protein, 437 aa, Arabidopsis thaliana
MAAAFASLPTFSVVNSSRFPRRRIGFSCSKKPLEVRCSSGNTRYTKQRGAFTSLKECAISLALSVGLMVSVPSIALPPNAHAVANPVIPDVSVLISGPPIKDPEALLRYALPIDNKAIREVQKPLEDITDSLKIAGVKALDSVERNVRQASRTLQQGKSIIVAGFAESKKDHGNEMIEKLEAGMQDMLKIVEDRKRDAVAPKQKEILKYVGGIEEDMVDGFPYEVPEEYRNMPLLKGRASVDMKVKIKDNPNIEDCVFRIVLDGYNAPVTAGNFVDLVERHFYDGMEIQRSDGFVVQTGDPEGPAEGFIDPSTEKTRTVPLEIMVTGEKTPFYGSTLEELGLYKAQVVIPFNAFGTMAMAREEFENDSGSSQVFWLLKESELTPSNSNILDGRYAVFGYVTDNEDFLADLKVGDVIESIQVVSGLENLANPSYKIAG

SEQ ID NO: 2119 - DNA, 1275 bp, Arabidopsis thaliana
atgcaagccgcaacgtcgtgtgatctcaagttccgatcaacagatccgacgtctaggaacaaatgtttctcccacgcgattccaaagcgcgtggctgttacgtgcggttataggtcggagtcgtttagcttccctaacggtgtctccgtgagtcgatctgattggcaaagctcatgtgccattttatctagtaaagttgcttctgttgaaaataccggtggtttagcggacaaaatcgccgccgttaatggtcacacgaacggctctgtgaatcttggtctcgtcgccgttgagtcaactaacggaaagttagctcctgctcagccgttgactattactgatctatctccggcaccgttgcatggttctagtctacgtgtagcttaccaaggcgttcccggagcttactcggaagcagctgccggaaaagcttatcccaattgcgacgccattccttgtgaccagtttgacgttgcttttcaggcggtggagctttggatcgctgatcgagctgtgcttccggtggagaactcactcggtggttcgatccatcgaaactatgatcttcttctccgtcaccgtcttcacatcgttggagaagttcagattccggtccaccattgcctcctcgcactcccgggagtccgaactgactgtgtttcgcgggtgatctctcacccgcaagccctagcgcagacggaacactccctcgacgtccttacaccacatgcagcgcgtgaggctttccatgacacagcggctgctgcggagtatatctcagctaacgacctacatgacacggcggctgtggcgagcgcacgcgccgctgagctttacaacctccagatattagcggatgggattcaagacgacccggggaacgtcactcgtttcctaatgttggcgcgtgagcctataatcccacgcacggaccggccattcaagactagcatcgtctttgctgcccaagagcacaaaggaactagcgtcctctttaaagtcctctcggctttcgctttcagagacattagcctgaccaagatcgagtcccggcctcaccataaccgcccgcttagggttgttggtgacgggagctttgggacgtcgaagaacttcgagtacatgttttacgtggattttgaggcatcgatggctgagccgcgtgcacagaacgcgcttgcggaggttcaagagtacacgtcgttcctaagggtgctgggaagttaccccatggatatgacaccatggtccatgacatccacagaagaagcatga

SEQ ID NO: 2120 - protein, 424 aa, Arabidopsis thaliana
MQAATSCDLKFRSTDPTSRNKCFSHAIPKRVAVTCGYRSESFSFPNGVSVSRSDWQSSCAILSSKVASVENTGGLADKIAAVNGHTNGSVNLGLVAVESTNGKLAPAQPLTITDLSPAPLHGSSLRVAYQGVPGAYSEAAAGKAYPNCDAIPCDQFDVAFQAVELWIADRAVLPVENSLGGSIHRNYDLLLRHRLHIVGEVQIPVHHCLLALPGVRTDCVSRVISHPQALAQTEHSLDVLTPHAAREAFHDTAAAAEYISANDLHDTAAVASARAAELYNLQILADGIQDDPGNVTRFLMLAREPIIPRTDRPFKTSIVFAAQEHKGTSVLFKVLSAFAFRDISLTKIESRPHHNRPLRVVGDGSFGTSKNFEYMFYVDFEASMAEPRAQNALAEVQEYTSFLRVLGSYPMDMTPWSMTSTEEA

SEQ ID NO: 2121 - DNA, 1422 bp, Arabidopsis thaliana
atgcaagctcttcaatcttcatctctccgtgcttctcctccaaacccacttcgcttaccatcaaatcgtcaatcacatcagctaattaccaatgcgagacctttgcgaagacaacaacgttccttcatctccgcatcagcatccactgtctccgctcctaaacgcgaaacagatccgaagaaacgagttgtcattactggtatgggtctcgtctctgtgtttggtaacgatgttgatgcttactacgagaaattgttgtctggtgagagtggaatcagtttgattgatcgtttcgatgcttccaagttccctactcgattcggtggtcagatccgtgggtttagctctgaaggttatattgatggcaagaatgagcgtaggcttgatgattgtttgaaatattgcattgttgctggtaaaaaagctcttgaaagtgccaatcttggtggtgataagcttaacacgattgataagaggaaagctggagtactagttgggactggaatgggaggtttaactgtgttttcagaaggtgttcagaatttgattgagaagggtcataggaggattagtccattttttataccttatgctataacaaatatgggttctgctttgttggcgattgatcttggtcttatgggtcctaactattcgatttcaactgcttgtgctacttcgaattactgcttttacgctgctgcgaatcacattcgtcgtggtgaagctgatatgatgattgctggtgggactgaggctgctattattcctattgggttgggaggttttgttgcttgtagggcattgtcccagagaaatgatgaccctcaaactgcttccaggccgtgggataaagcaagagatgggtttgttatgggtgaaggagctggtgttctggtgatggaaagcttggaacatgcaatgaaacgtggtgctccaattgtagcagaatatcttggaggtgctgttaattgtgatgctcaccatatgactgatccaagagctgatggtcttggggtttcttcatgcattgaaagatgcctggaagatgctggtgtatcacctgaggaggtaaattacatcaatgcacatgcaacttccactcttgctggtgatcttgctgagattaatgccattaaaaaggtattcaagagcacttcagggatcaaaatcaacgccaccaagtctatgataggtcactgcctcggtgcagctggaggtctagaagccatcgccaccgtgaaggctatcaacactggatggctgcatccttccatcaaccaatttaacccagaacaagctgtggactttgacacggtcccaaacgagaagaagcaacacgaggttgatgttgccatatcaaactcgttcgggttcggtggacacaactcggtagtcgccttctctgccttcaaaccctga

SEQ ID NO: 2122 - protein, 473 aa, Arabidopsis thaliana
MQALQSSSLRASPPNPLRLPSNRQSHQLITNARPLRRQQRSFISASASTVSAPKRETDPKKRVVITGMGLVSVFGNDVDAYYEKLLSGESGISLIDRFDASKFPTRFGGQIRGFSSEGYIDGKNERRLDDCLKYCIVAGKKALESANLGGDKLNTIDKRKAGVLVGTGMGGLTVFSEGVQNLIEKGHRRISPFFIPYAITNMGSALLAIDLGLMGPNYSISTACATSNYCFYAAANHIRRGEADMMIAGGTEAAIIPIGLGGFVACRALSQRNDDPQTASRPWDKARDGFVMGEGAGVLVMESLEHAMKRGAPIVAEYLGGAVNCDAHHMTDPRADGLGVSSCIERCLEDAGVSPEEVNYINAHATSTLAGDLAEINAIKKVFKSTSGIKINATKSMIGHCLGAAGGLEAIATVKAINTGWLHPSINQFNPEQAVDFDTVPNEKKQHEVDVAISNSFGFGGHNSVVAFSAFKP

SEQ ID NO: 2123 - DNA, 3114 bp, Arabidopsis thaliana
atggagcgcgcaaggagacttgcttacagaggaatcgtcaaacgtctcgttaacgacacaaaacgacaccgtaacgctgaaacacctcaccttgttcctcacgctccggcgaggtatgtctcttccctttcccctttcatctccacccctcgatctgtcaaccacacggcggctttcgggaggcaccagcagacgcgttccatctccgtcgatgctgttaaacccagcgatactttccctcgtcgtcacaactctgcaacaccagacgaacaaacccacatggctaaattctgtggctttgaccatatcgattcactcatcgatgctacggtgcccaaatcgattcgattagattccatgaagttctccaaattcgacgctggtttaaccgagagccaaatgattcaacacatggttgatttagcttccaagaacaaggttttcaaatccttcatcgggatgggttactacaacactcatgtccctactgtcattctccgtaacatcatggagaatccagcttggtacactcaatacactccttatcaagctgagatctctcaaggtcgtctcgaatcgctcctcaatttccagaccgtgatcacagatctcacgggtcttcctatgtccaatgcgtcgcttctggatgaaggcactgctgctgcggaggcaatggccatgtgtaacaacattcttaagggtaaaaagaagacctttgtcattgctagtaactgtcaccctcagactattgatgtttgtaagactagagctgatgggtttgatttgaaagttgtcacctctgatcttaaggatatagattacagctctggtgatgtttgtggggttcttgttcagtatcctggtactgaaggtgaagtcttggattatgctgagtttgttaagaatgctcatgctaatggtgttaaggttgtgatggctacggatttgctggctttgactgtgttgaaacctcctggagaatttggggcggatattgttgttggctctgctcaaaggtttggtgttccgatgggttatggtggtcctcatgctgcgttcttggctacttcacaagagtataagagaatgatgcctgggaggattattggtattagtgttgattcttcaggaaagcaagctctgcgtatggctatgcagactagagaacagcatattaggagggacaaagccactagcaacatctgtactgctcaagcgttgcttgccaacatggctgccatgtatgctgtttaccatggacctgcaggtctaaaatctattgcccagcgtgtccatggtctcgctggtatattttccttagggttgaacaagcttggggttgcagaagttcaagaacttcctttctttgacactgttaaaattaagtgttcggatgcacatgcaattgctgatgcagcttccaaaagtgaaattaatctgcgtgttgtggactcaaccactattactgcttcctttgacgaaacaaccaccttggatgatgtcgataaacttttcaaagtttttgcttctggcaagcctgttccatttacggctgaatctctagcacccgaggttcagaattccattccttctagcctaacaagagagagtccttatcttacccacccaatcttcaacatgtaccacacagagcatgagttgcttaggtacatccacaagttacagtcaaaggatctatcactgtgccacagcatgattccgttgggatcttgtacgatgaaactaaatgcaacaactgaaatgatgccagtcacatggccaagtttcactgacattcacccttttgctcctgttgaacaagcacaaggttatcaggaaatgttcgaaaatttgggtgacctcttgtgtacgatcactgggtttgactctttctcgttgcaacctaatgctggtgctgctggtgagtatgccgggcttatggttatccgcgcatatcacatgtcaagaggagatcatcaccgtaatgtgtgtatcatacctgtctctgcacacggtacaaaccctgcaagtgctgctatgtgcgggatgaaaattattacagttggaactgatgctaagggaaacattaacattgaggaggtgagaaaagctgcagaagccaacaaagacaacttagctgctcttatggttacatacccttcaactcatggagtctatgaagagggcatcgacgagatttgcaacataatacacgaaaatggaggtcaagtgtacatggatggtgccaacatgaatgcacaggttggtttgacgagccctggttttattggagcggatgtgtgccatctcaatctccacaagaccttctgtattcctcatggaggtggtggtcctggtatgggtcccattggtgtgaagaatcatttggcaccatttcttccttctcaccccgtgataccgactggtggtatcccacaacccgagaagacagcacctttgggtgcaatatccgctgcaccatggggatctgcgcttatcttgcctatatcttatacttacattgccatgatgggatctggtgggctcactgatgcctctaagattgcaattttgaatgccaattacatggcaaagcgcctagagaaacactacccagttcttttccgtggtgttaacggaacagtagcacacgaattcatcatagacttgagaggcttcaagaacactgctggaatagaaccagaggatgtggcgaaacggctaatggactatggattccatggacccacaatgtcttggcctgtccctggaactcttatgattgagccaaccgagagtgaaagcaaggcggagctagacaggttctgcgatgctctcatttcaatcagggaagaaattgcacagattgaaaaaggaaatgcagatgtccagaacaacgttctcaagggagctccacatcccccatcgttgctaatggcagacacatggaaaaagccgtattctcgagagtatgctgctttccctgcgccttggctccgctcctccaagttctggcccaccacagggcgtgtggacaatgtatatggagacaggaaactggtgtgcactctcctcccagaggaagaacaagtcgcagctgcagtgtctgcttga

SEQ ID NO: 2124 - protein, 1037 aa, Arabidopsis thaliana
MERARRLAYRGIVKRLVNDTKRHRNAETPHLVPHAPARYVSSLSPFISTPRSVNHTAAFGRHQQTRSISVDAVKPSDTFPRRHNSATPDEQTHMAKFCGFDHIDSLIDATVPKSIRLDSMKFSKFDAGLTESQMIQHMVDLASKNKVFKSFIGMGYYNTHVPTVILRNIMENPAWYTQYTPYQAEISQGRLESLLNFQTVITDLTGLPMSNASLLDEGTAAAEAMAMCNNILKGKKKTFVIASNCHPQTIDVCKTRADGFDLKVVTSDLKDIDYSSGDVCGVLVQYPGTEGEVLDYAEFVKNAHANGVKVVMATDLLALTVLKPPGEFGADIVVGSAQRFGVPMGYGGPHAAFLATSQEYKRMMPGRIIGISVDSSGKQALRMAMQTREQHIRRDKATSNICTAQALLANMAAMYAVYHGPAGLKSIAQRVHGLAGIFSLGLNKLGVAEVQELPFFDTVKIKCSDAHAIADAASKSEINLRVVDSTTITASFDETTTLDDVDKLFKVFASGKPVPFTAESLAPEVQNSIPSSLTRESPYLTHPIFNMYHTEHELLRYIHKLQSKDLSLCHSMIPLGSCTMKLNATTEMMPVTWPSFTDIHPFAPVEQAQGYQEMFENLGDLLCTITGFDSFSLQPNAGAAGEYAGLMVIRAYHMSRGDHHRNVCIIPVSAHGTNPASAAMCGMKIITVGTDAKGNINIEEVRKAAEANKDNLAALMVTYPSTHGVYEEGIDEICNIIHENGGQVYMDGANMNAQVGLTSPGFIGADVCHLNLHKTFCIPHGGGGPGMGPIGVKNHLAPFLPSHPVIPTGGIPQPEKTAPLGAISAAPWGSALILPISYTYIAMMGSGGLTDASKIAILNANYMAKRLEKHYPVLFRGVNGTVAHEFIIDLRGFKNTAGIEPEDVAKRLMDYGFHGPTMSWPVPGTLMIEPTESESKAELDRFCDALISIREEIAQIEKGNADVQNNVLKGAPHPPSLLMADTWKKPYSREYAAFPAPWLRSSKFWPTTGRVDNVYGDRKLVCTLLPEEEQVAAAVSA

SEQ ID NO: 2125 - DNA, 1617 bp, Arabidopsis thaliana
atgttggattctctagtgtcgaaactgccttcgttatcgacatctgatcacgcttctgtggttgcgttgaatctctttgttgcacttctttgtgcttgtattgttcttggtcatcttttggaagagaatagatggatgaacgaatccatcaccgccttgttgattgggctaggcactggtgttaccattttgttgattagtaaaggaaaaagctcgcatcttctcgtctttagtgaagatcttttcttcatatatcttttgccacccattatattcaatgcagggtttcaagtaaaaaagaagcagtttttccgcaatttcgtgactattatgctttttggtgctgttgggactattatttcttgcacaatcatatctctaggtgtaacacagttctttaagaagttggacattggaacctttgacttgggtgattatcttgctattggtgccatatttgctgcaacagattcagtatgtacactgcaggttctgaatcaagacgagacacctttgctttacagtcttgtattcggagagggtgttgtgaatgatgcaacgtcagttgtggtcttcaacgcgattcagagctttgatctcactcacctaaaccacgaagctgcttttcatcttcttggaaacttcttgtatttgtttctcctaagtaccttgcttggtgctgcaaccggtctgataagtgcgtatgttatcaagaagctatactttggaaggcactcaactgaccgagaggttgcccttatgatgcttatggcgtatctttcttatatgcttgctgagcttttcgacttgagcggtatcctcactgtgtttttctgtggtattgtgatgtcccattacacatggcacaatgtaacggagagctcaagaataacaacaaagcatacctttgcaactttgtcatttcttgcggagacatttattttcttgtatgttggaatggatgccttggacattgacaagtggagatccgtgagtgacacaccgggaacatcgatcgcagtgagctcaatcctaatgggtctggtcatggttggaagagcagcgttcgtctttccgttatcgtttctatctaacttagccaagaagaatcaaagcgagaaaatcaactttaacatgcaggttgtgatttggtggtctggtctcatgagaggtgctgtatctatggctcttgcatacaacaagtttacaagggccgggcacacagatgtacgcgggaatgcaatcatgatcacgagtacgataactgtctgtctttttagcacagtggtgtttggtatgctgaccaaaccactcataagctacctattaccgcaccagaacgccaccacgagcatgttatctgatgacaacaccccaaaatccatacatatccctttgttggaccaagactcgttcattgagccttcagggaaccacaatgtgcctcggcctgacagtatacgtggcttcttgacacggcccactcgaaccgtgcattactactggagacaatttgatgactccttcatgcgacccgtctttggaggtcgtggctttgtaccctttgttccaggttctccaactgagagaaaccctcctgatcttagtaaggcttga

SEQ ID NO: 2126 - protein, 538 aa, Arabidopsis thaliana
MLDSLVSKLPSLSTSDHASVVALNLFVALLCACIVLGHLLEENRWMNESITALLIGLGTGVTILLISKGKSSHLLVFSEDLFFIYLLPPIIFNAGFQVKKKQFFRNFVTIMLFGAVGTIISCTIISLGVTQFFKKLDIGTFDLGDYLAIGAIFAATDSVCTLQVLNQDETPLLYSLVFGEGVVNDATSVVVFNAIQSFDLTHLNHEAAFHLLGNFLYLFLLSTLLGAATGLISAYVIKKLYFGRHSTDREVALMMLMAYLSYMLAELFDLSGILTVFFCGIVMSHYTWHNVTESSRITTKHTFATLSFLAETFIFLYVGMDALDIDKWRSVSDTPGTSIAVSSILMGLVMVGRAAFVFPLSFLSNLAKKNQSEKINFNMQVVIWWSGLMRGAVSMALAYNKFTRAGHTDVRGNAIMITSTITVCLFSTVVFGMLTKPLISYLLPHQNATTSMLSDDNTPKSIHIPLLDQDSFIEPSGNHNVPRPDSIRGFLTRPTRTVHYYWRQFDDSFMRPVFGGRGFVPFVPGSPTERNPPDLSKA

SEQ ID NO: 2127 - DNA, 3036 bp, Arabidopsis thaliana
atgaaactatttcttttactttctttcagtgctcatttgttactgggagcagatgggtttaccgatgaaactgataggcaagcattgttggagttcaagtctcaagtttctgaaggcaaaagagatgtcttatcctcatggaataactcattccctctatgcaactggaagtgggttacatgtggtcgtaaacacaagagagttactcatttgaacctcgggggattacagttgggcgggatagtatcaccatctatcggtaatgtatcgtttctcatatcacttgatctgtctgataacgcttttgggggtatcatccctcgagaggtgggaaacttgtttagacttgaacacttgtatatggccttcaattctctagagggagggattccagccactctatctaactgctctagattgttgaaccttgatttatattcaaatcctcttagacaaggtgttccttctgaactagggtcattgacgaaactcgttattttagatcttggtcgaaacaacctgaaaggcaagctccctagatctctaggaaacttgacctctttaaaatcgcttggcttcacagataacaatatagaaggagaagttccagatgaattagctagactgagtcaaatggtgggtcttgggttatcaatgaacaaattctttggcgtttttcctcccgccatctacaatttgtccgcacttgaggacttattcctctttggtagtggcttctcgggtagcctaaagcctgattttggtaatctgctaccaaacattcgtgagttaaatctgggagaaaatgatctagtgggagccattccaacaacactttccaatatttcaactctacaaaagtttggaatcaacaaaaacatgatgacaggaggtatatatccgaactttggaaaagtaccgagtttgcaatacctagatcttagtgagaatcctctaggaagttacacttttggagatcttgaatttattgattctttgactaattgcacccatttgcaactcttaagtgttggttacactaggcttgggggtgccttgcctacatccattgccaatatgtccacagaactcatcagtttaaaccttataggaaaccacttttttggaagcattcctcaagatattgggaatctcataggcctacaaagacttcagttgggaaaaaatatgttgaccggaccactcccaacttctttgggaaagcttctaagattggggttattaagtctatattcaaataggatgtcaggagagattccatcttttataggcaacctaactcaattagaaatactatatttgtccaacaatagttttgagggaattgttcctccgagtctcgggaagtgtagtcacatgcttgatttacgcattgggtataacaagttgaatgggactataccgaaggaaattatgcaaatcccaacccttgttaacctaagcatggaaggtaactctttgagcggctctctaccaaatgatattggaagtctacaaaatcttgtaaaactatcacttgagaacaataagttttcaggacatctcccacaaaccttgggaaattgtctcgcgatggaacaactttttctacaaggaaattcttttgatggagcaattccaaatataagagggttgatgggtgtaagaagagttgatttgtcaaacaatgatctatcgggaagtatacctgaatattttgcaaacttctccaagttggaatatctcaatctatctattaacaattttacgggaaaggtgccttccaaaggaaattttcagaactctacaatagtttttgtatttggaaacaaaaacctatgtggaggcatcaaggatctgaaactaaagccatgcctcgcccaagaaccaccagtggagacaaagcattcctctcatttaaagaaagttgcaattttagtaagcataggcatagctttgctattgctgttggtcatagcttcgatggttctgtgttggttcagaaaaagaaggaagaaccagcagacaaataacctggttccttctaagttggagattttccatgagaagataagctatggagatctacgaaatgcgacaaatggcttctcttcaagcaatatggttgggtcaggtagttttggtactgtgttcaaggcattgctcccgacggagagcaagattgttgcagtgaaagttctaaacatgcagagacgtggagctatgaagagctttatggcagaatgtgaatccttgaaagacacaaggcatcgtaatcttgtgaaattactgacagcttgcgctagtactgatttccaaggaaacgaattcagagcgcttatctatgagtacttgccgaatggaagcgtggatatgtggctgcacccagaggaagtcgaagagatacgtaggcccccacgaaccttgacacttcttgaaaggcttaatattgtcatagacgtggcttctgttttggactatcttcatgttcactgtcatgagcctatagctcattgcgatctcaagccaagcaacgtccttctagaagatgatttgaccgcccatgttagtgattttggtctggctcggcttctactcaaattcgacaaggagtcattccttaaccaactaagctcagccggagttagaggaaccatcggctatgccgcaccagaatatggaatgggaggacaaccatcaatacatggtgatgtgtatagctttggggttctccttttagaaatgttcaccgggaaacgaccaactgatgagttatttgggggaaatttaacactacatagctacaccaagttagcgttgccagaaaaagtattcgaaattgcagacaaagcgattcttcacattggtcttagagttggtttccgtactgctgagtgcttgacactggttttggaggtgggacttaggtgctgtgaagaatatcctacgaaccggttggcaacgagtgaagtcgcaaaagagttgatctcaatcagagaaaggttctttaaaaccagaagaacacctagacgttga

SEQ ID NO: 2128 - protein, 1011 aa, Arabidopsis thaliana
MKLFLLLSFSAHLLLGADGFTDETDRQALLEFKSQVSEGKRDVLSSWNNSFPLCNWKWVTCGRKHKRVTHLNLGGLQLGGIVSPSIGNVSFLISLDLSDNAFGGIIPREVGNLFRLEHLYMAFNSLEGGIPATLSNCSRLLNLDLYSNPLRQGVPSELGSLTKLVILDLGRNNLKGKLPRSLGNLTSLKSLGFTDNNIEGEVPDELARLSQMVGLGLSMNKFFGVFPPAIYNLSALEDLFLFGSGFSGSLKPDFGNLLPNIRELNLGENDLVGAIPTTLSNISTLQKFGINKNMMTGGIYPNFGKVPSLQYLDLSENPLGSYTFGDLEFIDSLTNCTHLQLLSVGYTRLGGALPTSIANMSTELISLNLIGNHFFGSIPQDIGNLIGLQRLQLGKNMLTGPLPTSLGKLLRLGLLSLYSNRMSGEIPSFIGNLTQLEILYLSNNSFEGIVPPSLGKCSHMLDLRIGYNKLNGTIPKEIMQIPTLVNLSMEGNSLSGSLPNDIGSLQNLVKLSLENNKFSGHLPQTLGNCLAMEQLFLQGNSFDGAIPNIRGLMGVRRVDLSNNDLSGSIPEYFANFSKLEYLNLSINNFTGKVPSKGNFQNSTIVFVFGNKNLCGGIKDLKLKPCLAQEPPVETKHSSHLKKVAILVSIGIALLLLLVIASMVLCWFRKRRKNQQTNNLVPSKLEIFHEKISYGDLRNATNGFSSSNMVGSGSFGTVFKALLPTESKIVAVKVLNMQRRGAMKSFMAECESLKDTRHRNLVKLLTACASTDFQGNEFRALIYEYLPNGSVDMWLHPEEVEEIRRPPRTLTLLERLNIVIDVASVLDYLHVHCHEPIAHCDLKPSNVLLEDDLTAHVSDFGLARLLLKFDKESFLNQLSSAGVRGTIGYAAPEYGMGGQPSIHGDVYSFGVLLLEMFTGKRPTDELFGGNLTLHSYTKLALPEKVFEIADKAILHIGLRVGFRTAECLTLVLEVGLRCCEEYPTNRLATSEVAKELISIRERFFKTRRTPRR

SEQ ID NO: 2129 - DNA, 2352 bp, Arabidopsis thaliana
atggcttcgccgtgtttgaccaagtccgattccggtatcaatggcgttgactttaccgaaaaattccggttagaagattccactctcttagccaatggtcaagtcgtcttaaccgatgttccggttaacgttactctcacctcttcaccttacttagtcgacaaagacggtgtaccactcgacgtctctgccggttcattcatcgggtttaacctcgacggagagcccaaaagccaccacgtggcatccatcggaaaactcaagaacattcgtttcatgagcatattccgtttcaaggtttggtggactactcattgggtcggatcaaacggacgtgacatcgagaacgagactcaaatcatcattcttgatcaatccgggtcggattctggacccggatccgggtcgggtcgtccttatgttctcttgctacctcttcttgaaggctccttccgttcatcattccaatccggagaagacgatgacgtggcggtctgtgtcgaatccgggtcgaccgaagtaaccgggtcggagtttcgtcagattgtgtatgtccatgccggggatgacccgttcaagctcgtgaaagacgccatgaaagtgattagggttcatatgaatacgttcaagcttcttgaagagaaatcgccgccgggaattgtcgataaattcgggtggtgcacttgggatgctttttacttgacggtgaatcctgacggagttcataaaggtgttaagtgtctcgtcgacggtggttgtcctccgggattggttcttatcgacgacggttggcaatcgattggacatgattccgatggtattgatgtcgaagggatgaatattaccgtcgccggtgaacaaatgccttgcaggcttctgaagtttgaagagaaccacaaattcaaagactacgtttctccaaaagatcaaaacgacgtcggaatgaaagctttcgtcagagatctgaaagatgaattctccaccgttgattacatctacgtttggcacgcactttgcggttactggggaggtctccgtcctgaagctccggctctgccgccgtcgaccattatccggcccgagctctctccaggacttaaactaacaatggaagatctcgccgtcgataagatcatagagaccggaatcggatttgcctcgccggacttggcgaaagagttctacgaaggtcttcactctcatcttcaaaacgccggtattgacggcgttaaagttgatgtcatccacatattggagatgttatgccagaaatatggcgggagagttgacttggccaaagcttacttcaaggcgttaacgtcgtcagtgaataagcattttaacggtaacggcgttatcgccagcatggagcattgcaatgactttatgttccttggaactgaagccatctctcttggtcgtgtcggtgatgacttttggtgcacggatccatcaggcgatccaaacggtacgttttggctacaaggatgtcacatggtccactgtgcatacaacagtctctggatgggaaatttcattcagcctgattgggacatgtttcagtccacacatccttgtgctgagttccatgctgcttctcgggccatttccggtgggccgatttacatcagtgattgtgtgggcaagcatgattttgatctcttgaagcgtcttgttttgcccaacggttcgattttgaggtgtgagtactatgctctcccaactcgtgaccgtctctttgaggatcctcttcatgatggcaaaaccatgctcaagatttggaacttgaacaagtacactggagttattggagcattcaactgtcaaggaggaggatggtgcagagaaaccagacgtaaccaatgtttctctgaatgcgtcaacacgttaaccgccaccacaagccctaaagacgttgaatggaacagtggaagcagcccaatctccattgcaaacgttgaagagtttgctttgttcttgtctcaatccaagaagcttttgttgtctggactaaacgatgatcttgagctgactttggagcctttcaagtttgagctgatcactgtctctcctgttgtgaccattgagggtaattcagtccggtttgctccgattggactggttaacatgctaaacacaagcggtgcgatccggtctttggtgtataatgatgaatctgttgaggtcggagtttttggtgccggagagtttagggtttatgcatcgaaaaaacctgtgagctgcttaattgatggtgaagttgttgagtttggttatgaagactcaatggtgatggtgcaagtcccttggtctggtccagatggtttgtcttctattcagtatttgttttag

SEQ ID NO: 2130 - protein, 783 aa, Arabidopsis thaliana
MASPCLTKSDSGINGVDFTEKFRLEDSTLLANGQVVLTDVPVNVTLTSSPYLVDKDGVPLDVSAGSFIGFNLDGEPKSHHVASIGKLKNIRFMSIFRFKVWWTTHWVGSNGRDIENETQIIILDQSGSDSGPGSGSGRPYVLLLPLLEGSFRSSFQSGEDDDVAVCVESGSTEVTGSEFRQIVYVHAGDDPFKLVKDAMKVIRVHMNTFKLLEEKSPPGIVDKFGWCTWDAFYLTVNPDGVHKGVKCLVDGGCPPGLVLIDDGWQSIGHDSDGIDVEGMNITVAGEQMPCRLLKFEENHKFKDYVSPKDQNDVGMKAFVRDLKDEFSTVDYIYVWHALCGYWGGLRPEAPALPPSTIIRPELSPGLKLTMEDLAVDKIIETGIGFASPDLAKEFYEGLHSHLQNAGIDGVKVDVIHILEMLCQKYGGRVDLAKAYFKALTSSVNKHFNGNGVIASMEHCNDFMFLGTEAISLGRVGDDFWCTDPSGDPNGTFWLQGCHMVHCAYNSLWMGNFIQPDWDMFQSTHPCAEFHAASRAISGGPIYISDCVGKHDFDLLKRLVLPNGSILRCEYYALPTRDRLFEDPLHDGKTMLKIWNLNKYTGVIGAFNCQGGGWCRETRRNQCFSECVNTLTATTSPKDVEWNSGSSPISIANVEEFALFLSQSKKLLLSGLNDDLELTLEPFKFELITVSPVVTIEGNSVRFAPIGLVNMLNTSGAIRSLVYNDESVEVGVFGAGEFRVYASKKPVSCLIDGEVVEFGYEDSMVMVQVPWSGPDGLSSIQYLF

SEQ ID NO: 2131 - DNA, 858 bp, Arabidopsis thaliana
atggagacccttctctcccctcgtgcgctctctcctcctctcaatcccaaacctttgtcccttcaccagaccaaacccacttcacattcattgtctctctcaaaacccaccaccttctccggtcctaaacacctctccacccggttcactaaaccggaatcaagaaactggttaatagatgcaaagcaaggactagctgctttagctttatctctaactctcactttctcacctgttggcactgctttagcctctgagttcaatatcctcaacgatggtccacctaaagaaacttacgtagtcgatgacgctggtgttcttagtcgagtgacgaagtcagatcttaagaagcttttgtctgatcttgaatacagaaagaaactgagactcaatttcatcactgtccgaaagctcaccagtaaagcagatgcgtttgagtatgcagaccaggttttggaaaaatggtatccttctattgaagaaggtaacaataagggtattgttgttttgataacaagtcagaaggaaggagctattactggtggtcctgcttttattgaagctgttggtgaaaacattcttgatgctaccgtctccgaaaatcttcccgtactagcaacggacgaaaaatacaacgaggcggtatatagcagtgcgaaaaggttggttgcagctatagacggtcaaccagatcccgggggtccaaccgtaaaggatagcaagagagaatcaaatttcaagacgaaagaagaaaccgatgagaagcgaggacagttcagtcttgtcgttggaggattacttgtaattgcctttgtagttcccatggcacaatactttgcttatgtctccaggaagtaa

SEQ ID NO: 2132 - protein, 285 aa, Arabidopsis thaliana
METLLSPRALSPPLNPKPLSLHQTKPTSHSLSLSKPTTFSGPKHLSTRFTKPESRNWLIDAKQGLAALALSLTLTFSPVGTALASEFNILNDGPPKETYVVDDAGVLSRVTKSDLKKLLSDLEYRKKLRLNFITVRKLTSKADAFEYADQVLEKWYPSIEEGNNKGIVVLITSQKEGAITGGPAFIEAVGENILDATVSENLPVLATDEKYNEAVYSSAKRLVAAIDGQPDPGGPTVKDSKRESNFKTKEETDEKRGQFSLVVGGLLVIAFVVPMAQYFAYVSRK

SEQ ID NO: 2133 - DNA, 768 bp, Arabidopsis thaliana
atggcggaagaaattgaaaaatctgtgccgacagaggaatctctgatggagaagatctccgagaagattcaccatcacgattcgtcgtcatcgtctgaatccgagtacgagaaacctgattctccttcggctgtgaaggcgaagatctatcgtatgtttggcagagagaagcctgttcacaaggttctcggtggtggaaagcctgctgatgtgttcttgtggagggataaaaaactatcaggtgctgttcttggtgtcgcgactgctatttgggttctgttcgagctggttgagtatcatttgttgagtcttttgtgtcacatttcgatactcgctcttggaggcctctttttgtggtccaatgctcacacacttatcaacaagacttcaccacaaattccagaaatccatgttcccgaggaggctttccttgtggttgcttcttctctgagaaacgaactaaaccaagcttttgttatcctacgaagcattgctttaggaagggacctaaaaaaattcctgatggttgttgtcggtctatggatcatctcggtggtgggcaattggttcaatttcctgactttggtgtacatttgcttcgtgatattgcacacagtcccaatgttgtatgagaaacacgaggacaaggttgatccattggcagagaaagcaatgaaggagttgcagaaacagtatgtggttttcgatgaaaaggttctctctaagattcccattgcttctctcaaggcaaaggcaaaattgggttaa

SEQ ID NO: 2134 - protein, 255 aa, Arabidopsis thaliana
MAEEIEKSVPTEESLMEKISEKIHHHDSSSSSESEYEKPDSPSAVKAKIYRMFGREKPVHKVLGGGKPADVFLWRDKKLSGAVLGVATAIWVLFELVEYHLLSLLCHISILALGGLFLWSNAHTLINKTSPQIPEIHVPEEAFLVVASSLRNELNQAFVILRSIALGRDLKKFLMVVVGLWIISVVGNWFNFLTLVYICFVILHTVPMLYEKHEDKVDPLAEKAMKELQKQYVVFDEKVLSKIPIASLKAKAKLG

SEQ ID NO: 2135 - DNA, 1611 bp, Arabidopsis thaliana
atgaagcctccacgaagcagtgaaacgaaaggattattacaatttagccgctctgtcgaagatgactctgatgaagaatggaaaatagatggaagtggatccataagagaaatgacacagagaattcagcttcacgaaggaaacatttacagcttctctgcttgggtgaagttgagagaaggaaacaataagaaagtaggagttgtgtttaggacagaaaatggaagatttgttcatggaggtgaagttagggcaaagaaaagatgttggactttgcttaaaggtggcattgtgccagatgtttcaggctctgtagatattttcttcgaggtacaacaactagctatatatagtgatgacaaagaagcaaagatttctgcaagcgatgtgtccctgaaacagttcagtaaacaagaatggaaactgaaacaagaccaactaattgaaaagataaggaagagcaaggtgagatttgaagtaacttatcagaacaaaactgcggtaaaaggcgcagtgatatctatagaacaaaccaaaccatctttcctattaggctgcgcaatgaatttccggatcctacaaagcgaagggtacagaaattggtttgcgtcgcggtttaaaatcacatccttcaccaatgaaatgaaatggtatacaacggagaaagaacgtggtcacgagaactacacggcagctgattcaatgttaaaatttgcggaagagaatggaatattggttagaggtcatactgtgttgtgggatgaccctttaatgcagccaacttgggtgccaaaaatagaagatccaaacgatttgatgaatgtgacattgaaccggataaactcggttatgacgagatacaaagggaagttaaccgggtgggacgtggttaatgagaacgtgcattgggattactttgagaaaatgcttggtgccaacgcttcgtcaagtttctacaatttggcttttaagcttgatcctgatgtgacaatgttcgttaacgagtacaacacgatagagaaccgtgtagaggttaccgcgacgccggttaaggtgaaggagaagatggaggagattcttgcttacccaggtaacatgaacattaaaggagctattggagctcaaggtcactttcgtccaactcagcctaacttagcttacatgagatctgcattggatactttaggctcactaggtttgcctatctggcttacagaggttgatatgcctaagtgccctaatcaggaggtatacattgaagaaattttgagggaagcgtattcgcatcctgcggttaaaggcatcataatatttgctgggcctgaggtgtctggtttcgacaagctgacacttgcggacaaatacttcaacaacactgcaacaggagatgtaattgacaagttgctcaaggagtggcagcaatcttcagagattcccaagattttcatgacggattccgagaatgatgaagaagaggtctcattgttgcatggacattacaatgtgaatgtaagtcatccatggatgaagaacatgtcaaccagtttcagcttggaggtaactaaggagatgggtcagcgtcaggtggttagagttgtaattaatgcttga

SEQ ID NO: 2136 - protein, 536 aa, Arabidopsis thaliana
MKPPRSSETKGLLQFSRSVEDDSDEEWKIDGSGSIREMTQRIQLHEGNIYSFSAWVKLREGNNKKVGVVFRTENGRFVHGGEVRAKKRCWTLLKGGIVPDVSGSVDIFFEVQQLAIYSDDKEAKISASDVSLKQFSKQEWKLKQDQLIEKIRKSKVRFEVTYQNKTAVKGAVISIEQTKPSFLLGCAMNFRILQSEGYRNWFASRFKITSFTNEMKWYTTEKERGHENYTAADSMLKFAEENGILVRGHTVLWDDPLMQPTWVPKIEDPNDLMNVTLNRINSVMTRYKGKLTGWDVVNENVHWDYFEKMLGANASSSFYNLAFKLDPDVTMFVNEYNTIENRVEVTATPVKVKEKMEEILAYPGNMNIKGAIGAQGHFRPTQPNLAYMRSALDTLGSLGLPIWLTEVDMPKCPNQEVYIEEILREAYSHPAVKGIIIFAGPEVSGFDKLTLADKYFNNTATGDVIDKLLKEWQQSSEIPKIFMTDSENDEEEVSLLHGHYNVNVSHPWMKNMSTSFSLEVTKEMGQRQVVRVVINA

SEQ ID NO: 2137 - DNA, 1686 bp, Arabidopsis thaliana
atgtcaggaagatctgcattttccagaaccggaggtttccgacctgagaatctagggcaaaacgcagtatccttaatcggaagcataggcttctctgtactcgtaatcggagtcgtagttttcaccattatcgctgctacatatgaaccagaagatccactatttcacccatctgacaaaatcacaactttcctcacatccaattcaaacgctactcttaaatccgacgacagtattgtcaaaaccggtgaagatttcatggcggcgaaccaaaccgcgtttggcggattcatcaatatagctgatgttgaaacatctgagaatgactctgatggtaatcaattggattgtgataccaatatcccaattgattgcaaagatcctgaagtttttcacttgatgatgaaagctactatggagaagtttaaagacagtcacttttataagtttggtaaacctgtgattgtggaaggtagtagtagttcttgtgatatggcttggcgttatagacctaaggatggtaaagcggctgcgttttataaggattataggaggtttgtgattgaaaagtctgggaattgtagtgttagtgtgatggggattggtgagtatcattcgggtgtgaatgcgaggaagcggaagaggcccgggtttcgaaattcgagtggtggtaaggttgatgatttcgcattgcctgtagttggtgaagcagtgaatgattcacttcctgttgttgagtctgaaaatgtgtttaaagaaggtcattacttggtttattctggtggaggagataggtgtaagagtatgaaccatttcttgtggagtttcttgtgtgctttaggggaagctcagtatttgaatagaacattagtgatggatttgactctttgtttgtcttctgtttatacattgtctggtcaaaacgaggaagggaaggactttaggttttactttgatttcgagcatttgaaagaggctgcttctatgttagaccaggtgcagttttgggctgattgggggaaatggtataagaagaatggattaaagcttcatcttgtggaagattttcgggtcacaccgatgaagcttgttgatgtgaaggacacgttgataatgaggaagttcgggacagtagaaccagataactattggtatagagtatgcgaaggggagacagaatctgttgtgcaaaggccttggaatctattgtggaaatctaaacgactgatggagattgtttctgcgattgcttcgaggttaaactgggattatgatgctattcacattgagagaggagacaaggcgagaaacaaggaagtttggcctaatcttgaaaaggatacttcaccaagctccattttatctaccctccaggacaaaatcgaacaaggaaggaatctttatattgcaacaaatgaaccagagttatctttctttaaccccttgaaagacaagtacaaaccccattttctggatgagtttaaggatctctgggacgagagcagcgaatggtattcagagacaacgaagcttaatggaggaaacccagttgagtttgacggttacatgagagcgtctgttgatacagaggtgttcttgagagggaagaagcagattgaaacattcaatgatcttaccaatgactgtagagatggaatcggcacttgcaacgtagcagcaagctga

SEQ ID NO: 2138 - protein, 561 aa, Arabidopsis thaliana
MSGRSAFSRTGGFRPENLGQNAVSLIGSIGFSVLVIGVVVFTIIAATYEPEDPLFHPSDKITTFLTSNSNATLKSDDSIVKTGEDFMAANQTAFGGFINIADVETSENDSDGNQLDCDTNIPIDCKDPEVFHLMMKATMEKFKDSHFYKFGKPVIVEGSSSSCDMAWRYRPKDGKAAAFYKDYRRFVIEKSGNCSVSVMGIGEYHSGVNARKRKRPGFRNSSGGKVDDFALPVVGEAVNDSLPVVESENVFKEGHYLVYSGGGDRCKSMNHFLWSFLCALGEAQYLNRTLVMDLTLCLSSVYTLSGQNEEGKDFRFYFDFEHLKEAASMLDQVQFWADWGKWYKKNGLKLHLVEDFRVTPMKLVDVKDTLIMRKFGTVEPDNYWYRVCEGETESVVQRPWNLLWKSKRLMEIVSAIASRLNWDYDAIHIERGDKARNKEVWPNLEKDTSPSSILSTLQDKIEQGRNLYIATNEPELSFFNPLKDKYKPHFLDEFKDLWDESSEWYSETTKLNGGNPVEFDGYMRASVDTEVFLRGKKQIETFNDLTNDCRDGIGTCNVAAS

SEQ ID NO: 2139 - DNA, 831 bp, Arabidopsis thaliana
atggcttccttatccttcgtttcctcttctcaccttacgctacgcactccttctattgccctacgcagcactggctcttctcctcgaacctccgtttcattctccgtcaaggctcaatccgtcgcgctttcacaggacgatttgaagaagctcgcggcggagaaagctgtggaggcaattaaacctgggatggttctagggctcggaaccggatccaccgcagctttcgctgttgatcagatcgggaaactactctcttccggtgaactctacgatattgtcggtatcccaacgtcgaaacgaacggaggaacaagcacggtcgttagggattcctcttgttgggttagatacacatccgagaatcgatctcgctattgacggagcagacgaggtagatccgaatcttgatttagtcaaaggtcgtggaggtgctcttctccgtgagaaaatggtggaagctgtggctgacaagtttattgttgtggctgatgataccaaactcgttacaggactcggtggaagtggattagctatgccggtggaagttgttcaattctgctggaactttaatttgattagattgcaagacctcttcaaggaatttggatgtgaatcaaagcttagagttgatggtgatggcaagccttatgtgactgataacagtaattacattattgatttgtattttaagactcctttgaaggatggattcgctgcggctaaagagattgggaagtttcaaggagtggtggagcatggtctgtttctcggaatggctacttctgtcattatcgctggaaagaatggcgttgaagttatgaccaagtga

SEQ ID NO: 2140 - protein, 276 aa, Arabidopsis thaliana
MASLSFVSSSHLTLRTPSIALRSTGSSPRTSVSFSVKAQSVALSQDDLKKLAAEKAVEAIKPGMVLGLGTGSTAAFAVDQIGKLLSSGELYDIVGIPTSKRTEEQARSLGIPLVGLDTHPRIDLAIDGADEVDPNLDLVKGRGGALLREKMVEAVADKFIVVADDTKLVTGLGGSGLAMPVEVVQFCWNFNLIRLQDLFKEFGCESKLRVDGDGKPYVTDNSNYIIDLYFKTPLKDGFAAAKEIGKFQGVVEHGLFLGMATSVIIAGKNGVEVMTK

SEQ ID NO: 2141 - DNA, 852 bp, Arabidopsis thaliana
atgacgggctgtgtgaattctatttctccgccgccggtgactttataccggcatcgtgcctctccgtcacggtcgtccttctcattatccggcgatgccttacactctctttaccggcaccgacgtgtatcaagatctccgtcgattatcgctcccaaatttcagattgtggcggctgaaaaatcggagcctctgaaaattatgatatcaggagctcctgcttctggtaaaggtacacaatgcgagctgattactcacaaatatggtttggtgcatatctctgctggagatttgctgagggctgaaatcgcttctggaagtgaaaatggaagacgtgctaaagaacatatggagaaaggacaattggtccctgatgaaatagttgtaatgatggtaaaagatcgtttatcacagacagattcagagcaaaaaggatggcttttggatggatatccaaggagtgcatcacaggcaacagctctcaagggatttggattccagcctgatctattcattgtcctcgaagttcctgaagaaattctaattgaaagagttgttgggcgtcgattggatcctgtcacaggaaagatctaccacttgaagtattcgcctccagagacagaagagattgctgttagactcacccaacgttttgatgataccgaagagaaggcaaaactgcggctgaagactcataaccaaaatgtgagtgatgtgctttctatgtacgacgatataacaattaagatcgagggaaaccgctcaaaagaggaagtgtttgcccagatcgattcttctctgtccgaattgcttcaagagaggaacactgctccaagttcacttttaagttga

SEQ ID NO: 2142 - protein, 283 aa, Arabidopsis thaliana
MTGCVNSISPPPVTLYRHRASPSRSSFSLSGDALHSLYRHRRVSRSPSIIAPKFQIVAAEKSEPLKIMISGAPASGKGTQCELITHKYGLVHISAGDLLRAEIASGSENGRRAKEHMEKGQLVPDEIVVMMVKDRLSQTDSEQKGWLLDGYPRSASQATALKGFGFQPDLFIVLEVPEEILIERVVGRRLDPVTGKIYHLKYSPPETEEIAVRLTQRFDDTEEKAKLRLKTHNQNVSDVLSMYDDITIKIEGNRSKEEVFAQIDSSLSELLQERNTAPSSLLS

SEQ ID NO: 2143 - DNA, 1137 bp, Arabidopsis thaliana
atggcgaagatgatgatgttgcaacagcatcagccttctttctctctccttacttcttctctgtctgacttcaatggcgctaagctccatttacaagtccagtacaagaggaaggttcatcagccaaaaggagcactctatgtttcagcgtcgagcgaaaagaagattctgataatgggtggtactcgattcattggtctgttcttgtccaggatccttgtcaaagagggacatcaggttacattgttcacaaggggtaaatctcctattgccaaacaattgcccggtgaatctgaccaagactttgctgatttctcttctaagattcttcacttgaaaggagacagaaaggactatgactttgtgaagtcaagtctttcagcagaaggcttcgatgttgtttatgatatcaacgggagggaggccgaagaagttgagcccatactagaagcactacccaaactagagcagtacatctactgttcttcagctggtgtttatctgaaatctgatatcttgccacattgtgaggaggatgcagttgatccgaagagcaggcacaaggggaagctggagactgagagcttactgcaatcaaaaggtgtaaactggacttctatacgtcctgtctacatctacggtccattgaattacaaccccgtcgaagaatggtttttccaccgtctaaaggcaggtcgcccaatcccggttccaaactctgggatacagatctcacaactcggtcacgttaaggacttggcaacagcctttctcaacgtgcttggtaacgagaaagccagcagagagatattcaacatctcgggggagaaatatgttacctttgatgggttagcaaaagcttgcgcaaaggccggtgggtttccggagccagagattgttcattacaacccgaaagagttcgactttgggaagaagaaggcattccctttccgtgatcagcatttctttgcatcggtggagaaagcaaagcatgtcctcggatggaaaccggagttcgacttagtggagggtctcactgactcatacaaccttgatttcggtcgcggaacattccggaaagaagcggatttcaccactgacgacatgattctgagcaagaaacttgttcttcaataa

SEQ ID NO: 2144 - protein, 378 aa, Arabidopsis thaliana
MAKMMMLQQHQPSFSLLTSSLSDFNGAKLHLQVQYKRKVHQPKGALYVSASSEKKILIMGGTRFIGLFLSRILVKEGHQVTLFTRGKSPIAKQLPGESDQDFADFSSKILHLKGDRKDYDFVKSSLSAEGFDVVYDINGREAEEVEPILEALPKLEQYIYCSSAGVYLKSDILPHCEEDAVDPKSRHKGKLETESLLQSKGVNWTSIRPVYIYGPLNYNPVEEWFFHRLKAGRPIPVPNSGIQISQLGHVKDLATAFLNVLGNEKASREIFNISGEKYVTFDGLAKACAKAGGFPEPEIVHYNPKEFDFGKKKAFPFRDQHFFASVEKAKHVLGWKPEFDLVEGLTDSYNLDFGRGTFRKEADFTTDDMILSKKLVLQ

SEQ ID NO: 2145 - DNA, 552 bp, Arabidopsis thaliana
atgtcgggaaacaaagaagaagaggatcctcgtatccatggaatcaaaactaagatccgtgtcgttccagattttcccaagaaaggaataatgtttcaagacataacaacagtgttgttggatccgaaagccttcaaagacacaattgatctgtttgtggagaggtacagagacaagaacatctcagtggttgcaggaatagaggctcgtggtttcctattcggtccaccgatcgcgctagccattggagcaaaatttgttcctctgcgcaaacccaagaaactacctggtgaaacaatatttgaggaatacgagttggaatatggaaatgaccgcctagagatgcacataggagccgtcgaggctggcgatcgagctttggtcgttgatgatcttatcgcgactggtggtactctctgcgctgccattaacttgctcgagagggttggagcagaagttgtggaatgtgcatgtgtgatcgagttacccgaattaaagggaaggcagagacttaaggggaagccactatgtatgcttgtggagtaccgatga

SEQ ID NO: 2146 - protein, 183 aa, Arabidopsis thaliana
MSGNKEEEDPRIHGIKTKIRVVPDFPKKGIMFQDITTVLLDPKAFKDTIDLFVERYRDKNISVVAGIEARGFLFGPPIALAIGAKFVPLRKPKKLPGETIFEEYELEYGNDRLEMHIGAVEAGDRALVVDDLIATGGTLCAAINLLERVGAEVVECACVIELPELKGRQRLKGKPLCMLVEYR

SEQ ID NO: 2147 - DNA, 2319 bp, Arabidopsis thaliana
atgggaacaaagtttttagctctgggtttgtctctgtgtcttgttctctcaagcttctatcaagtttcttgccaggatgaaggaactggaagtttgagtactttagatctaattgagcatgaatatcaaactagtgtcaattctctccaaggcaatgaagcagtagatcaaactgagaccagtggtcagaaaaacagtacagtgtctgataacaacactatttctttgtctctatctgaagaacctgcattggaaactcttaaagaatctgttgatacatcagctgagttaggagctgttactgatgaagtcgataaaccttcaagtatgttggaccatattgaacttgagttcgaagcacatatcaatgaacttaaagaagctggatctgatggtatcaacaaagttgaggaatctaaagatgatgaagaagctgcaaggagacataaaatgttggaagccattgaacgtgaatttgaagctgctcatgctggatttgaacaactaaagactgatgattccgcccaaggattagatgatgaacaatctgcaaagagacaaagcatgttggacgagattgaacgtgattttgaagctgctacaaaaggtcttgagcaactaaaggctgatgatttaactggaatcaacgatgaagaacacgctgcaaagagacaaaagatgcttgaagagatcgaaagagagtttgaagaagctacaaaaggtcttgaagaactaaggcattctacctcaagcacagatgatgaagcacaatctgcaaagagacagaatatgctagatgagatcgaacgggagtttgaagctgctacaagtggtcttaaagagctaaagattaatgctcacactgtcaaagatgatgttgatgataaagaacaagatgccaaaagacaaagtatgctagatgcaattgaacgtgagtttgaagccgttaccgagagttttaaacaacttgaagatatcgccgataacaaagctgaaggagacgacgaatctgcaaagaggcaaagtatgttggatgagattgaacgtgaatttgaagctgctacaaatagtcttaagcaactaaaccttgacgatttcagtgaaggagatgacagtgcagaatctgcaaggagaaatagtatgcttgaagctatcgaacgcgagtttgaagctgctacaaaaggtcttgaagagctaaaggctaatgattcaaccggcgacaaggatgatgatgaacacgttgcaaggagaaaaattatgcttgaagctattgaacgcgagtttgaagccgcgacaaaaggccttgaagagttaaagaatgaatcagaacaagctgaaaacaagagaaacagtatgttggaagcattcgaacgcgaatttgaagctgctacaaatgcaaaggctaatggagaaaactctgcaaagaatccatcaaccataagtactacagtgcagaaatcttctggcggatacaatgctggtttagaaggtcttctaaagcctgcagatggtgtatgtggttgtttcaacaaggataaagatggtcttcaggcagacactgattcttcgattaacatagcggagatactcgcagaagaatccaaattacagggctcagggacctctcggctcaccacatcattgaacaatcttgttgatactcatagaaaagaaacgtcctcaaaggtaggctcagtccttggctcatcttcatcagttacttctaccacaagcgaatcagcggctacatcagagagcatagagagcttaaagcaaacactaaggaagctacgcggtctaagcgcacgtgatctcgtaaaccacccgaatttcgatgcgattatagcagccggtacacgttacgaggtactcagctcagcttctattggttacatctctttgctagccaaatacaaaaccgtcattaaagaaggactcgaggcttctcagagagtccagattgctcaaacccgagccaaactgctaaaagaaaccgcaatggagaagcagagaaccgtagactcggttttcgcagcagcaaagaccactgctcaaagaggagacgcgttgcacatcagaatcgtagcgatcaagaaactgttggcaaagctagaagcagagaaagtggacgttgattcaaagttcacctctttaacgacgagtctgtcagagcttctcaaggaggcgtcacaggcttacgaagagtatcacgaggcggtgcataaggcaaaggacgagcaagcggctgaggaatttgcggtggagacgacaaagagagcagaacatatttgggttgagtttcttagttcacttaattga

SEQ ID NO: 2148 - protein, 772 aa, Arabidopsis thaliana
MGTKFLALGLSLCLVLSSFYQVSCQDEGTGSLSTLDLIEHEYQTSVNSLQGNEAVDQTETSGQKNSTVSDNNTISLSLSEEPALETLKESVDTSAELGAVTDEVDKPSSMLDHIELEFEAHINELKEAGSDGINKVEESKDDEEAARRHKMLEAIEREFEAAHAGFEQLKTDDSAQGLDDEQSAKRQSMLDEIERDFEAATKGLEQLKADDLTGINDEEHAAKRQKMLEEIEREFEEATKGLEELRHSTSSTDDEAQSAKRQNMLDEIEREFEAATSGLKELKINAHTVKDDVDDKEQDAKRQSMLDAIEREFEAVTESFKQLEDIADNKAEGDDESAKRQSMLDEIEREFEAATNSLKQLNLDDFSEGDDSAESARRNSMLEAIEREFEAATKGLEELKANDSTGDKDDDEHVARRKIMLEAIEREFEAATKGLEELKNESEQAENKRNSMLEAFEREFEAATNAKANGENSAKNPSTISTTVQKSSGGYNAGLEGLLKPADGVCGCFNKDKDGLQADTDSSINIAEILAEESKLQGSGTSRLTTSLNNLVDTHRKETSSKVGSVLGSSSSVTSTTSESAATSESIESLKQTLRKLRGLSARDLVNHPNFDAIIAAGTRYEVLSSASIGYISLLAKYKTVIKEGLEASQRVQIAQTRAKLLKETAMEKQRTVDSVFAAAKTTAQRGDALHIRIVAIKKLLAKLEAEKVDVDSKFTSLTTSLSELLKEASQAYEEYHEAVHKAKDEQAAEEFAVETTKRAEHIWVEFLSSLN

SEQ ID NO: 2149 - DNA, 711 bp, Arabidopsis thaliana
atggtttccatgactacttcatcttcttcgtacggaacattctctacagtcgtcaacagttctagacctaattcctcagcaacctttctcgtcccttccttgaaattctccaccggaatatcgaatttcgcgaatctgagtaatgggttttctctaaaatctccaattaatcctgggtttctcttcaagtctcgtcctttcactgtccaagctagagctgctgcagaaaaaaccgttcacgatttcaccgttaaggacattgatgggaaggatgttgctttgaacaaattcaaggggaaagttatgttgattgtcaatgttgcttcaagatgtggtttgacatcatcaaattactcagagctttcacatctgtacgagaaatacaaaactcaaggatttgagattctagcttttccctgcaatcagtttggtttccaagagcccgggtcaaactccgagatcaaacaattcgcttgcacccggtttaaagcagagttccctatatttgataaggttgacgtgaatggaccaagcacagcgccgatctacgagttcttgaaatcaaacgcaggaggattcttgggtggtctcattaaatggaactttgagaagttcttgattgataaaaagggaaaggtcgttgagaggtaccctcccaccacatcccctttccaaatcgagaaagacatccagaagttgcttgccgcttaa

SEQ ID NO: 2150 - protein, 236 aa, Arabidopsis thaliana [sequence omitted]

SEQ ID NO: 2151 - DNA, 1164 bp, Arabidopsis thaliana
atggctatggcggaaatggcaacgaagtcttcactatctgcaaaactcactcttccttcttcttctactaagaagacactgagtctgagacaagtctctgtttcacttccaacatcaacttcaatctctctgttatctctctttgcatctcctcctcatgaagctaaagctgctgtttccattcccaaggaccaaatcgtctcctctctcactgaagtggagaaaacaatcaaccaagttcaagaaactggttctagtgtatttgatgcaacgcagcgtgtgttccaagtagtaggagatgctcttaaaccagctttggacactgctttacccattgcaaagcaagctggtgaagaagctatgaagcttgcttctcctgctttctctgaagcttcaaagaaagctcaagaagcaatgcagagctctggttttgattctgagcctgtctttaatgctgcaaagacagtaacagatgtagcacaacagacgtcaaaagcgatagaagatgctaaaccgattgcttcatcgaccatggatacgatttcttcagctgaccctagtgtcattgttgttgctgctggtgctgcgtttcttgcttaccttcttctccctcctgttttctctgccatctcttttaacttccgtggttacaaaggtgatcttacgccggctcaaacgcttgaccttctttgcaccaagaactacttgatggtggatataagatcagagaaagacaaggagaaagccgggattccacggctcccttcgaatgctaagaaccgcgtgatctccattccattagaagaactaccaaacaaagtaaaaggaatcgtgaggaactctaaacgagttgaagcagagatagcagcattaaagatttcttacctcaagaaaatcaacaaaggctccaatatcatcatcttggactcgtacacggattcggctaagatagtggcgaaaacgttaaaggttctcgggtacaagaattgctatattgtgacagatggattctctggtggcagaggatggttgcagagccgtttaggcactgattcttacaacttctcgtttgcacaagtcttgtctccatcgcggattatcccggcagcttcgagaagctttggcactaggtccggaaccaagttccttcctagctccgactga

SEQ ID NO: 2152 - protein, 387 aa, Arabidopsis thaliana
MAMAEMATKSSLSAKLTLPSSSTKKTLSLRQVSVSLPTSTSISLLSLFASPPHEAKAAVSIPKDQIVSSLTEVEKTINQVQETGSSVFDATQRVFQVVGDALKPALDTALPIAKQAGEEAMKLASPAFSEASKKAQEAMQSSGFDSEPVFNAAKTVTDVAQQTSKAIEDAKPIASSTMDTISSADPSVIVVAAGAAFLAYLLLPPVFSAISFNFRGYKGDLTPAQTLDLLCTKNYLMVDIRSEKDKEKAGIPRLPSNAKNRVISIPLEELPNKVKGIVRNSKRVEAEIAALKISYLKKINKGSNIIILDSYTDSAKIVAKTLKVLGYKNCYIVTDGFSGGRGWLQSRLGTDSYNFSFAQVLSPSRIIPAASRSFGTRSGTKFLPSSD

SEQ ID NO: 2153 - DNA, 1227 bp, Arabidopsis thaliana
atgagaatgacacttgttcacttgtctctctccctcttctcatgtctcctccttgtcctttctccgaccttcattgcctccactcccgtctccgaacccgaactcgtagttcaagaagttaacgaaaagattaatgcgtctaggaggaatctaggcgtgctctcatgtgggaccggaaatccaattgacgactgttggagatgcgacccgaaatgggagaaaaaccgacaacggttagccgattgcgcgatcgggtttggcaaacacgcaatcggtggtcgtgacggtaaaatctacgtggtgactgactcgagtgacaaagacgtggttaaccctaaacccggaacccttagacacgcggtgatccaagacgagccactatggatcatcttcgcgcgtgacatggtcataaaactaaaagaagagctgattatgaactctttcaagactatagacggccgtggagcgagcgtccacattgctggtggcgcgtgtatcaccgtccagtacgtgaccaacatcatcatccacggtgttaacatccatgactgtaaaagaaaggggaatgcttacgttagagactctccgtcgcattatgggtggaggacagcgtctgacggtgacgccgtctcgatttttggtggctcccacgtgtgggtagaccattgctcgttgtccaactgcgctgacggtctgatagacgccattcatggatcaacggccattactatctctaataactatttgagtcaccacaataaagtcatgcttttgggacacagtgattcgtacacgagagacaagaacatgcaagtcaccattgcctttaatcactttggagaaggtcttgttcagagaatgccaagatgtagacatggatattttcatgtggtgaataatgattatacacattggcaaatgtatgcaattggtggaagtgcagctccaacgattaacagtcaaggcaataggtttcttgctccaaacgaccatgtctttaaagaggtgactaaatacgaagatgcaccacgaagcaaatggaagaaatggaattggagatcggaaggtgatttgttcctaaacggtgcgttttttacgccttcgggtggaggagcctcttcaagctatgctaaggcttcgagtttgtcggctagaccgtcctcattggtggcttcagtcacgtccaatgctggtgcactcttttgtagaaaaggatcacgatgttaa

SEQ ID NO: 2154 - protein, 408 aa, Arabidopsis thaliana
MRMTLVHLSLSLFSCLLLVLSPTFIASTPVSEPELVVQEVNEKINASRRNLGVLSCGTGNPIDDCWRCDPKWEKNRQRLADCAIGFGKHAIGGRDGKIYVVTDSSDKDVVNPKPGTLRHAVIQDEPLWIIFARDMVIKLKEELIMNSFKTIDGRGASVHIAGGACITVQYVTNIIIHGVNIHDCKRKGNAYVRDSPSHYGWRTASDGDAVSIFGGSHVWVDHCSLSNCADGLIDAIHGSTAITISNNYLSHHNKVMLLGHSDSYTRDKNMQVTIAFNHFGEGLVQRMPRCRHGYFHVVNNDYTHWQMYAIGGSAAPTINSQGNRFLAPNDHVFKEVTKYEDAPRSKWKKWNWRSEGDLFLNGAFFTPSGGGASSSYAKASSLSARPSSLVASVTSNAGALFCRKGSRC

SEQ ID NO: 2155 - DNA, 948 bp, Arabidopsis thaliana
atggcagctacctctctcactgcccctccttctttctccggtctccgccgcatttctcccaagctcgacgctgccgccgtctcctcccaccaatccttcttccaccgcgtcaattcctctacccgtctcgtttcttcctcttcttcttctcatcgctcccccagaggtgttgttgccatggctggatccggaaagtttttcgttggaggaaactggaagtgtaacgggactaaggactccatcgccaagcttatctccgatctcaacagtgcaaccttggaagcagatgtagatgttgttgtgtcacctccatttgtctacatcgaccaggtcaaatcctcgttgacagaccgtattgacatatcaggtcagaactcttgggttgggaaaggtggagccttcactggtgaaatcagcgtggaacagctcaaagaccttggctgcaagtgggtcattcttgggcattccgaacggagacatgtcatcggagaaaaagatgagtttatcgggaagaaagctgcatatgcattgagtgagggtcttggagtgatagcttgtattggggaaaagctagaagagagggaagcaggcaagacgtttgatgtttgcttcgcgcaactgaaggcgtttgctgatgctgtgcctagctgggacaatatagttgttgcatacgagcctgtatgggcaattggaactggtaaagttgcatctcctcagcaagcacaagaagtccatgtagctgtccgcggttggctaaagaagaatgtctctgaggaagttgcttccaaaacgagaatcatatatggaggttctgtcaatggaggcaacagtgcagagcttgccaaagaagaagacattgatggatttcttgttggtggtgcctccttgaagggtcctgagtttgcaaccattgtgaactcagtcacgtcgaagaaagttgctgcttga

SEQ ID NO: 2156 - protein, 315 aa, Arabidopsis thaliana
MAATSLTAPPSFSGLRRISPKLDAAAVSSHQSFFHRVNSSTRLVSSSSSSHRSPRGVVAMAGSGKFFVGGNWKCNGTKDSIAKLISDLNSATLEADVDVVVSPPFVYIDQVKSSLTDRIDISGQNSWVGKGGAFTGEISVEQLKDLGCKWVILGHSERRHVIGEKDEFIGKKAAYALSEGLGVIACIGEKLEEREAGKTFDVCFAQLKAFADAVPSWDNIVVAYEPVWAIGTGKVASPQQAQEVHVAVRGWLKKNVSEEVASKTRIIYGGSVNGGNSAELAKEEDIDGFLVGGASLKGPEFATIVNSVTSKKVAA

SEQ ID NO: 2157 - DNA, 906 bp, Arabidopsis thaliana
atggcagccactcccacacacttctctgtctcccatgatcctttttcttccacgtctctccttaatctccaaactcaagcgatctttggtcccaatcacagtttaaagacaacccagttgagaattccagcttctttcagaagaaaagctacaaacttgcaagtgatggcttcaggaaagacacctggactgactcaggaagctaatggggttgcaattgatagacaaaacaacactgatgtatttgacgacatgaaacagcggttcctggccttcaagaagcttaagtacatggatgactttgaacactacaaaaatctggcagatgctcaagctccaaagtttctggtgattgcttgtgcagactctagagtttgtccttctgctgtcctgggattccaaccgggtgacgcattcactgttcgtaacattgcaaatttagtacctccatatgagtctggacctactgaaaccaaagctgctctagagttctctgtgaatactcttaatgtggaaaacatcttagtcattggtcatagccggtgtggaggaattcaagctttaatgaaaatggaagacgaaggagattccagaagtttcatacacaactgggtagttgtgggaaagaaggcaaaggaaagcacaaaagctgttgcttcaaacctccattttgatcatcagtgccaacattgtgaaaaggcatcgataaatcattcattagaaaggctgcttgggtacccgtggatagaagagaaagtgcggcaaggttcactgtctctccatggtggatactataattttgttgattgtacgttcgagaaatggacagtggattatgcagcaagcagaggtaagaagaaggaaggcagtggaatcgctgttaaagaccggtcagtttggtcttga

SEQ ID NO: 2158 - protein, 301 aa, Arabidopsis thaliana
MAATPTHFSVSHDPFSSTSLLNLQTQAIFGPNHSLKTTQLRIPASFRRKATNLQVMASGKTPGLTQEANGVAIDRQNNTDVFDDMKQRFLAFKKLKYMDDFEHYKNLADAQAPKFLVIACADSRVCPSAVLGFQPGDAFTVRNIANLVPPYESGPTETKAALEFSVNTLNVENILVIGHSRCGGIQALMKMEDEGDSRSFIHNWVVVGKKAKESTKAVASNLHFDHQCQHCEKASINHSLERLLGYPWIEEKVRQGSLSLHGGYYNFVDCTFEKWTVDYAASRGKKKEGSGIAVKDRSVWS

SEQ ID NO: 2159 - DNA, 1446 bp, Arabidopsis thaliana
atgaaagcggaaaaagttatggagagagagatcgagacaacgccaatagagcctcttagcccaatgtcacatatgctaagttcgccaaatttcttcattgtcataacttttgggtttaaaactcgatgcaaccgatcggcctttgttgatggcatcaacaacacattgatcaatgctcccagattctccagtaaaatggagataaattataagaaaaaaggagaaccggtctggattcctgttaaacttcgagtagatgatcatattattgtgccggatcttgaatattccaacattcaaaatcctgatcagttcgtagaagactatacttcaaacatagctaatattccaatggacatgtccaaacctctttgggaatttcatttactcaacatgaagacatcaaaagcagaatctttggctatagtaaaaatacatcactccattggtgatgggatgtctcttatgtccctactacttgcttgttcacgaaaaatatcagaccctgacgcgctagtttctaataccacggctacaaaaaagccagctgattccatggcttggtggttgtttgttgggttttggtttatgataagagtcaccttcaccactattgttgagttttccaagttaatgcttacagtatgctttttggaagataccaaaaaccctcttatgggtaacccgagtgatggatttcaatcttggaaggttgtccatcggataataagttttgaggatgtcaagttaataaaggacacaatgaacatgaaggtgaatgatgttcttcttggaatgacacaagcaggtctttcaagatatttgagtagcaaatatgatggatcaacggctgagaagaaaaagatcttagaaaaactccgtgttcgtggtgccgtagctataaacttaagaccagcaacaaagatagaggatttggctgatatgatggcgaagggttcaaagtgtagatggggaaacttcataggaacggttatatttccgttgtgggtgaaatcagagaaagatccgttggagtacattcgacgagccaaagctacgatggataggaaaaaaatatctctggaagctttttttttctatggaattattaaattcaccttgaaattttttggaggaaaggcagtagaagcttttggaaagaggatatttggtcacacatcattggcattttcaaatgtgaaaggtcccgatgaagaaataagtttttttcaccatccgatttcatatatcgcaggaagtgcattagttggagcacaagctctcaatatccattttataagctacgtagacaagattgtcatcaatctagctgttgacacaacaacgattcaagatcctaatcgactatgtgatgatatggtggaagcacttgagatcatcaaatctgccacacaaggggaaatatttcacaaaacggaagtttga

SEQ ID NO: 2160 - protein, 481 aa, Arabidopsis thaliana
MKAEKVMEREIETTPIEPLSPMSHMLSSPNFFIVITFGFKTRCNRSAFVDGINNTLINAPRFSSKMEINYKKKGEPVWIPVKLRVDDHIIVPDLEYSNIQNPDQFVEDYTSNIANIPMDMSKPLWEFHLLNMKTSKAESLAIVKIHHSIGDGMSLMSLLLACSRKISDPDALVSNTTATKKPADSMAWWLFVGFWFMIRVTFTTIVEFSKLMLTVCFLEDTKNPLMGNPSDGFQSWKVVHRIISFEDVKLIKDTMNMKVNDVLLGMTQAGLSRYLSSKYDGSTAEKKKILEKLRVRGAVAINLRPATKIEDLADMMAKGSKCRWGNFIGTVIFPLWVKSEKDPLEYIRRAKATMDRKKISLEAFFFYGIIKFTLKFFGGKAVEAFGKRIFGHTSLAFSNVKGPDEEISFFHHPISYIAGSALVGAQALNIHFISYVDKIVINLAVDTTTIQDPNRLCDDMVEALEIIKSATQGEIFHKTEV

SEQ ID NO: 2161 - DNA, 921 bp, Arabidopsis thaliana
atgtcgtcttccaccaccacaacaaccaccgtccacggcgagcctgaacgacgaacttactggtgtcatgaatgcgatatgagtttatccctcctctcctcctccgattccgattccgattcctctcctctgttatgtccccaatgccgtgtcgatttcctcgaacgtatggatcacgattcttcttcttctaatctctttgacgttaccatcggtgattttgaagaacaagacggagaaaacgatgatgaagacgacgaagaagattggtgtttcgttgatccagctgttaattccgatgataatttcctcctcgatagtccttaccttcaccgtcttcttcgtcatctcgcttccgataattcaggatcgtcttcttcttcctcgtcttcatcttcttcttcgttattgaaatcttcagatatcgattcgatccccacgattcagatctcgtcttctttgctctgttccaccgatgattcagatccagattccgttttactctgcgccgtttgcaaagaggatttcatcatcggagaatctgctcggagattaccgtgtagtcatatataccactccgattgcatcgtcccttggctctcggatcataactcgtgtccgctttgtagatttgagctccctacgacggcgaaggtgggaatcggtggctcagaggctgagatgagaatcagattatcggatctggctacgattgctgcagatggtgatgatgtggaagatgattggcttggaatcagaaacgcgttgagaagactggctcgtcgtcatgagcagatgagattgggagtgggagagatggagaggaatttggctaggactgtttcaggtcttggaattggtatgagaagaagagaagagattgaagcagacagaagcaacgtcacaacgacgcctttgtaa

SEQ ID NO: 2162 - protein, 306 aa, Arabidopsis thaliana
MSSSTTTTTTVHGEPERRTYWCHECDMSLSLLSSSDSDSDSSPLLCPQCRVDFLERMDHDSSSSNLFDVTIGDFEEQDGENDDEDDEEDWCFVDPAVNSDDNFLLDSPYLHRLLRHLASDNSGSSSSSSSSSSSSLLKSSDIDSIPTIQISSSLLCSTDDSDPDSVLLCAVCKEDFIIGESARRLPCSHIYHSDCIVPWLSDHNSCPLCRFELPTTAKVGIGGSEAEMRIRLSDLATIAADGDDVEDDWLGIRNALRRLARRHEQMRLGVGEMERNLARTVSGLGIGMRRREEIEADRSNVTTTPL

SEQ ID NO: 2163 - DNA, 306 bp, Arabidopsis thaliana
atggcggatcaacaagcaggaacaatcgtcggaggagttcgcgatattgatgcaaatgctaatgatcttcaagtcgagagtctcgctcgtttcgctgtcgatgagcataacaagaacgagaacttgactctggagtacaagaggctccttggtgcgaaaacacaggttgtggcaggaacaatgcaccatctaactgtggaggtggctgatggtgagaccaataaggtctatgaggccaaggttttggagaaagcttgggagaatctcaagcagttggagagtttcaaccaccttcacgatgtttaa

SEQ ID NO: 2164 - protein, 101 aa, Arabidopsis thaliana
MADQQAGTIVGGVRDIDANANDLQVESLARFAVDEHNKNENLTLEYKRLLGAKTQVVAGTMHHLTVEVADGETNKVYEAKVLEKAWENLKQLESFNHLHDV

SEQ ID NO: 2165 - DNA, 399 bp, Arabidopsis thaliana
atggcgaatctaatttcgtttcacgatgtggctaaacataagtgcaagaacgattgttggattctcatccatggaaaggtctatgacatcagcactttcatggacgaacatcccggaggtgacaatgttctcctcgccgtcaccgggaaagacgcgtcgatcgatttcgaagatgtgaaccatagcaaagatgccaaggagctaatgaagaaatactgtatcggtgacgttgaccagtcaacggttccggtgacgcaacagtatattccgccgtgggagaaggaatctacggcggcggaaacaactaaagaagaatctggaaagaagctgcttatctacttaattcctctcttgatactcggcgttgctttcgctctcagattctacaacaacaagtag

SEQ ID NO: 2166 - protein, 132 aa, Arabidopsis thaliana
MANLISFHDVAKHKCKNDCWILIHGKVYDISTFMDEHPGGDNVLLAVTGKDASIDFEDVNHSKDAKELMKKYCIGDVDQSTVPVTQQYIPPWEKESTAAETTKEESGKKLLIYLIPLLILGVAFALRFYNNK

SEQ ID NO: 2167 - DNA, 978 bp, Arabidopsis thaliana
atggccgtcgatctaatgcgtttccctaagatagatgatcaaacggctattcaggaagctgcatcgcaaggtttacaaagtatggaacatctgatccgtgtcctctctaaccgtcccgaacaacaacacaacgttgactgctccgagatcactgacttcaccgtttctaaattcaaaaccgtcatttctctccttaaccgtactggtcacgctcggttcagacgcggaccggttcactccacttcctctgccgcatctcagaaactacagagtcagatcgttaaaaatactcaacctgaggctccgatagtgagaacaactacgaatcaccctcaaatcgttcctccaccgtctagtgtaacactcgatttctctaaaccaagcatcttcggcaccaaagctaagagcgccgagctggaattctccaaagaaaacttcagtgtttctttaaactcctcattcatgtcgtcggcgataaccggagacggcagcgtctccaatggaaaaatcttccttgcttctgctccgttgcagcctgttaactcttccggaaaaccaccgttggctggtcatccttacagaaagagatgtctcgagcatgagcactcagagagtttctccggaaaagtctccggctccgcctacggaaagtgccattgcaagaaaagcaggaaaaatcggatgaagagaaccgtgagagtaccggcgataagtgcaaagatcgccgatattccaccggacgaatattcgtggaggaagtacggacaaaaaccgatcaagggctcaccacacccacgtggttactacaagtgcagtacattcagaggatgtccagcgaggaaacacgtggaacgagcattagatgatccagcgatgcttattgtgacatacgaaggagagcaccgtcataaccaatccgcgatgcaggagaatatttcttcttcaggcattaatgatttagtgtttgcctcggcttga

SEQ ID NO: 2168 - protein, 325 aa, Arabidopsis thaliana
MAVDLMRFPKIDDQTAIQEAASQGLQSMEHLIRVLSNRPEQQHNVDCSEITDFTVSKFKTVISLLNRTGHARFRRGPVHSTSSAASQKLQSQIVKNTQPEAPIVRTTTNHPQIVPPPSSVTLDFSKPSIFGTKAKSAELEFSKENFSVSLNSSFMSSAITGDGSVSNGKIFLASAPLQPVNSSGKPPLAGHPYRKRCLEHEHSESFSGKVSGSAYGKCHCKKSRKNRMKRTVRVPAISAKIADIPPDEYSWRKYGQKPIKGSPHPRGYYKCSTFRGCPARKHVERALDDPAMLIVTYEGEHRHNQSAMQENISSSGINDLVFASA

SEQ ID NO: 2169 - DNA, 1263 bp, Arabidopsis thaliana
atggcggcgaatctccaagacggtgtttctgatgactttgactacgagcattggtctccaatcgcgaaaaagagactcgtggaaaatggagtttgggatgttgttcaaaatggagtctcgccaaatccaacgaagattccacagttagcggcgactatccaagccgtagatctagcacaatggagaaatcgtgtgattaaagacaacaaagcgcttaagataatgcaatcttctctcccagattcggttttcaggaagactatctcgattgcttcagccaaggaactttgggatttgctcaaaaaaggtaacgataccaaagaagctaagctacgtagattagagaaacaatttgagaagcttatgatgtacgaaggagaaccaatggatttgtacttgaagagagttgaggaaatcactgaacggttcgaagttttgggaaatccgatatcggatgataaggttatcaccaagctgttaacttcgttgtcatggccatatgatgattctattcctgtgttgaaggaattcatgactttgcctgatctgactcttcgcgatcttcttaaggcttttgaattgtttggatcacatcctgaaactatgcctcaggagttgatgaagttcattaacattcttagaaaagctcactctgagcggatgccgtgtggtatctgcgtgaagaacaatcacaaccaagaagaagacttgtattacaaccataggcctagggtagtgaatttaagtggagccaatcaatttagaggacaagggcattatgcaagagattgcagcaacactagaaatctgcaacaagctgagaagaggatccaaaaacctgagcatctgatgttaggggtaactgttggtggtatcacatttgatgagggcatgtggatggtacacaccactacaacggatcacatgactccatatgagaagtttttcacgactttagaccgatcatacagagctagggttggactggcggacgggaaagttgtcatggcagaagggaaaggagatgtcatgattatgacgagggaagggaagaagaggatcaagaatgtgctttttgttcccgggatcaacaaaaacgctttgagtgttgctcagatgacagaccaaggctgttcagtaacatttggaggaggcaaatgcattatgaagaatcacactgggaaagtatttggagaagccatgttggaagagacaggttatgttattcgtttgcaggtgattaaagaagttatctggcactag

SEQ ID NO: 2170 - protein, 420 aa, Arabidopsis thaliana
MAANLQDGVSDDFDYEHWSPIAKKRLVENGVWDVVQNGVSPNPTKIPQLAATIQAVDLAQWRNRVIKDNKALKIMQSSLPDSVFRKTISIASAKELWDLLKKGNDTKEAKLRRLEKQFEKLMMYEGEPMDLYLKRVEEITERFEVLGNPISDDKVITKLLTSLSWPYDDSIPVLKEFMTLPDLTLRDLLKAFELFGSHPETMPQELMKFINILRKAHSERMPCGICVKNNHNQEEDLYYNHRPRVVNLSGANQFRGQGHYARDCSNTRNLQQAEKRIQKPEHLMLGVTVGGITFDEGMWMVHTTTTDHMTPYEKFFTTLDRSYRARVGLADGKVVMAEGKGDVMIMTREGKKRIKNVLFVPGINKNALSVAQMTDQGCSVTFGGGKCIMKNHTGKVFGEAMLEETGYVIRLQVIKEVIWH

SEQ ID NO: 2171 - DNA, 663 bp, Arabidopsis thaliana
atggctactacttctaactcggtacttttcctaagttctgactcactgattcatcatcatcatcatcaacctctccatctatcttcctccagatctcactctgtttctctcccacccaacaagcgatccaattctctcacgcttcgttgttcaacaaatggcgatagcacctcaaccgaaaaggaaacaccaatcgaactcaaattcccagcatttccaacggtaatggacattaaccaaatcagagagatattgcctcacaggtttccgtttctgctggtagatagagtgatagagtatacgcctggtgtttcagctgtagctattaagaatgtcaccatcaatgacaatttcttccctggccatttccctgaacgaccaatcatgcctggtgttctcatgattgaggcaatggcgcaagtcggaggtatagtaatgctgcagccggaagtaggaggctctcaagataacttcttctttgctggtattgataaagtgagatttcgcaaaccagtgattgcaggagacacgctagtcatgaggatgactcttctcaagttccagaagcggttcgggctcgctaaaatggaaggtaaagcttatgtgggtggtgctctggtgtgtgaaggcgagttcatgatggtttctgctggtagttcttga

SEQ ID NO: 2172 - protein, 220 aa, Arabidopsis thaliana
MATTSNSVLFLSSDSLIHHHHHQPLHLSSSRSHSVSLPPNKRSNSLTLRCSTNGDSTSTEKETPIELKFPAFPTVMDINQIREILPHRFPFLLVDRVIEYTPGVSAVAIKNVTINDNFFPGHFPERPIMPGVLMIEAMAQVGGIVMLQPEVGGSQDNFFFAGIDKVRFRKPVIAGDTLVMRMTLLKFQKRFGLAKMEGKAYVGGALVCEGEFMMVSAGSS

SEQ ID NO: 2173 - DNA, 1692 bp, Arabidopsis thaliana
atggagagtttcgctcttcactctctctccaccaccgccacttccaccttactctcccatcatcatcatcaccatccctcacgtctctctcttctccgtcgtacctcttcgagatctccgccttcaacaatctccctccgatctctctccgttcaacctctctccttccctcttctcaaaccaattcctcgattctccacacgaatcgccgccgcaccgcaagacaacgctcctcctcctcctcccccatctccgtctccgtctccgtctcctcaaggagcgaaactcatccctctgattctctcaatctccgtcggcctaatcctccgattcgctgttcctgtaccagaaggagtcacaccacaaggctggcaattactctcaatcttcctctcaacaatcgctggtctcgtccttagtcctctcccagtcggagcttgggctttcattggtctcaccgcttcaatcgtcaccaaaacgctttctttctccgccgctttctcagctttcacaagcgaggttatctggttgatcgttatctctttcttcttcgctcgtggattcgtcaaaacaggtcttggtgatagaatcgctacttactttgtcaaatggcttgggaagagtactttaggtctatcttatggtctcacgcttagtgaggctttaattgctcctgcgatgcctagtactactgctagagctggtggcattttcttgcccatcatcaagtctctatcgctctcggctggaagtaaaccgaatgattcttcttcgaggaaactaggctcttacttgattcaatctcaattccagtgcgccggaaactctagtgcgcttttcttgactgctgcagctcaaaatttgctgtgtctcaagttagcagaggagcttggagtagtgatctcaaacccgtgggtttcttggtttaaggctgctagtctacctgcaatcatatcacttctttgtactccacttatcctctataagctttatcctccagaaacaaaggacacacctgaggctccaggtattgctgcaacgaaactcaagcaaatgggccctgtcactaaaaacgaatggatcatggtcggtacaatgcttcttgctgtcactctttggatctgcggagagactctgggaataccaagtgttgtagctgccatgatcggtctctccatacttcttgtgctaggtgtccttaattgggacgattgcctaagcgaaaaatcggcatgggacacattagcttggtttgctgtcttggtgggaatggcaggacagcttacaaacctcggtgttgtaacgtggatgtctgattgtgtagctaaagttctacaatctctctccttgagttggcctgctgcgtttggacttcttcaagcagcctacttcttcattcactaccttttcgcaagccaaaccggtcatgttggagctctcttctcagctttccttgctatgcatatagcagcaggtgttccaggaattctagctgcacttgctttagcatacaacaccaatctttttggtgctttgactcattacagtagcggtcaagccgctgtctactatggagcgggttatgttgatctgcctgatgtattcaagattggattcgtgatggcgacgattaatgcgataatctggggagtagttgggactttctggtggaaatttttgggtctctactaa

SEQ ID NO: 2174 - protein, 563 aa, Arabidopsis thaliana
MESFALHSLSTTATSTLLSHHHHHHPSRLSLLRRTSSRSPPSTISLRSLSVQPLSFPLLKPIPRFSTRIAAAPQDNAPPPPPPSPSPSPSPQGAKLIPLILSISVGLILRFAVPVPEGVTPQGWQLLSIFLSTIAGLVLSPLPVGAWAFIGLTASIVTKTLSFSAAFSAFTSEVIWLIVISFFFARGFVKTGLGDRIATYFVKWLGKSTLGLSYGLTLSEALIAPAMPSTTARAGGIFLPIIKSLSLSAGSKPNDSSSRKLGSYLIQSQFQCAGNSSALFLTAAAQNLLCLKLAEELGVVISNPWVSWFKAASLPAIISLLCTPLILYKLYPPETKDTPEAPGIAATKLKQMGPVTKNEWIMVGTMLLAVTLWICGETLGIPSVVAAMIGLSILLVLGVLNWDDCLSEKSAWDTLAWFAVLVGMAGQLTNLGVVTWMSDCVAKVLQSLSLSWPAAFGLLQAAYFFIHYLFASQTGHVGALFSAFLAMHIAAGVPGILAALALAYNTNLFGALTHYSSGQAAVYYGAGYVDLPDVFKIGFVMATINAIIWGVVGTFWWKFLGLY

SEQ ID NO: 2175 - DNA, 549 bp, Arabidopsis thaliana
atggcgtcgtcgctgcaaagctcggggatgttgacgaaagagcaaatggtttatctctttgatcgattcgattacttgacttcacaatctgatgtgaagaaacgaatctccgacgctgtggatgacaaacaggaagctgtagcggtaacaactgctattcaagaggagatattcttggagatggggattgacccgggatttggtattggctgcttgggaaagctgaactctgcatacgaaaacgataaagagttgatgattggtttctacaagtttctcgcaaaggaggagatggcatgtgaagaagctgagcttggacaagatggatttgaacagaaaatgaaagcactacaacaattacaagaacagcaactagagatgcttaagtatatgcgtaaattctctctggatgatcaatctgctatccttcaaaagcttcagaagcaattagaaaatgcgggttttgagccggaggcgtctcttttgtcaggagaggaaatggaggaagctggaagaagaagagtttcacctgtttttggaagcagatag

SEQ ID NO: 2176 - protein, 182 aa, Arabidopsis thaliana
MASSLQSSGMLTKEQMVYLFDRFDYLTSQSDVKKRISDAVDDKQEAVAVTTAIQEEIFLEMGIDPGFGIGCLGKLNSAYENDKELMIGFYKFLAKEEMACEEAELGQDGFEQKMKALQQLQEQQLEMLKYMRKFSLDDQSAILQKLQKQLENAGFEPEASLLSGEEMEEAGRRRVSPVFGSR

SEQ ID NO: 2177 - DNA, 948 bp, Arabidopsis thaliana
atggcaaatgcgatcacatttttcaagctcaacaccggcgctaagttcccttcggtgggtcttggaacatggcaagcttctcctggcctcgtcggtgatgcagtcgccgcggctgttaagattggctatcgtcacattgattgtgctcagatctatggcaacgaaaaagagattggggcagttctgaaaaaattgtttgaagacagagtagtgaaacgcgaggatttgttcatcacctccaaactctggtgtactgatcatgaccctcaagatgtcccggaggcattgaacagaactctcaaggatctgcagcttgaatacgtcgatctttatctgatacactggcctgcacggataaagaaaggttctgttggaataaagccagagaaccttttgcctgtagatattcctagtacatggaaagcgatggaagcactatacgattcgggcaaggcacgagccataggtgtaagcaatttctctaccaagaaactagctgatctcttggagttagctcgtgttcctcctgctgttaatcaggtcgaatgtcatccttcttggcgacaaactaagctacaagaattctgcaaatccaaaggggttcacctaagtgcatactcgccattaggttctccagggacaacatggctgaagagcgatgttttgaagaacccgatactgaatatggttgcggaaaaactcggaaagagtcctgcgcaagtcgcccttcgttggggactccaaatgggtcacagtgtgcttcccaagagtacaaatgaaggaaggatcaaagagaactttaatgttttcgactggtcaatacccgattacatgttcgctaagtttgctgagattgaacaggctaggttagtcactggttccttccttgttcatgagacactaagcccttacaagtctattgaagaattatgggatggcgagatatga

SEQ ID NO: 2178 - protein, 315 aa, Arabidopsis thaliana
MANAITFFKLNTGAKFPSVGLGTWQASPGLVGDAVAAAVKIGYRHIDCAQIYGNEKEIGAVLKKLFEDRVVKREDLFITSKLWCTDHDPQDVPEALNRTLKDLQLEYVDLYLIHWPARIKKGSVGIKPENLLPVDIPSTWKAMEALYDSGKARAIGVSNFSTKKLADLLELARVPPAVNQVECHPSWRQTKLQEFCKSKGVHLSAYSPLGSPGTTWLKSDVLKNPILNMVAEKLGKSPAQVALRWGLQMGHSVLPKSTNEGRIKENFNVFDWSIPDYMFAKFAEIEQARLVTGSFLVHETLSPYKSIEELWDGEI

SEQ ID NO: 2179 - DNA, 528 bp, Arabidopsis thaliana
atggctgaagctttcacaagtttcaccttcacaaatcttcatattccttcttcctacaatcactcgccgaagcagaattcaggaccgaatcatggatattggctatctaagaatgttaatgagaagagggaaaggaatttgatgagaggaagcttatgtgtaagaaaggcattgccacatgatttgccattaatggctgtgatggttcaacaaatagaaggaatgcgtgatatcattacagagaaacacgtgtggcatctaagtgataaagctatcaagaatgtttatatgttctacatcatgttcacttgttggggatgtttgtacttcggttcagcaaaagatccattctacgactcagaggagtaccgtggagatggaggggatggaactggatattgggtctatgaaactcaagaagacatagaagagaaagcaagagcggagctatggcgtgaagaacttatcgaagaaattgaacagaaggttggtggcttaagagagcttgaagaagctgttactaagtag

SEQ ID NO: 2180 - protein, 175 aa, Arabidopsis thaliana
MAEAFTSFTFTNLHIPSSYNHSPKQNSGPNHGYWLSKNVNEKRERNLMRGSLCVRKALPHDLPLMAVMVQQIEGMRDIITEKHVWHLSDKAIKNVYMFYIMFTCWGCLYFGSAKDPFYDSEEYRGDGGDGTGYWVYETQEDIEEKARAELWREELIEEIEQKVGGLRELEEAVTK

SEQ ID NO: 2181 - DNA, 1194 bp, Arabidopsis thaliana
atgttcaagttgaagcaatggttgatttatttggtgtgttcgttagtaataatgaacacagaaggactgtttgtcaatattacatttgttcgaaacgcagtcgctaaaggggccgtttgtttagatggaagtccaccagcttatcatttggatagaggttctggaactggaatcaatagttggttgatacagcttgagggaggaggatggtgcaataatgtaacaaattgcgttagtcggatgcatactcgattaggttcatcgaagaaaatggtggagaaccttgctttctcagctattcttagcaataagaaacaatataatcctgatttttacaattggaatagagtgaaagttagatactgtgacggggcatcattcacaggagatgtagaagcagtgaaccctgctactaatcttcacttcagaggtgctcgagtttggttagccgttatgcaagagctgctagctaaaggcatgataaacgccgagaatgctgttttgtctggctgttctgctggcgggttagcttcgctgatgcattgtgatagtttccgtgctctattaccgatgggaaccaaagtaaaatgtctttcagatgctggtttttttctcaacacaagagacgtctcaggagttcaatacattaaaacatacttcgaagatgttgttactcttcatggatcagcaaagaacttgccgaggtcatgcacatcaagattaactcctgcaatgtgtttctttccgcaatatgtggctcgccagattagaactcctctgttcattcttaatgccgcttatgactcttggcagataaagaacattttggctccgcgagcagctgatccttacggaaaatggcaaagttgtcaactagacatcaagaattgccatccaagtcagatcaaagttatgcaagatttcaggttagagttcttgagtgcagtgataggtttagggagatcttcatcaagagggatgttcatagattcttgctacactcactgccaaaccgagacacaaacttcatggttctggcaagattctccaattctaaaccgaacgacaatagcaaaagctgttggagattgggtttatgacagaacattgtttcagaagatagattgtccttacccttgtaaccctacttgccaccacagggttttcactcctctagatgctcctccaatttaa

SEQ ID NO: 2182 - protein, 397 aa, Arabidopsis thaliana
MFKLKQWLIYLVCSLVIMNTEGLFVNITFVRNAVAKGAVCLDGSPPAYHLDRGSGTGINSWLIQLEGGGWCNNVTNCVSRMHTRLGSSKKMVENLAFSAILSNKKQYNPDFYNWNRVKVRYCDGASFTGDVEAVNPATNLHFRGARVWLAVMQELLAKGMINAENAVLSGCSAGGLASLMHCDSFRALLPMGTKVKCLSDAGFFLNTRDVSGVQYIKTYFEDVVTLHGSAKNLPRSCTSRLTPAMCFFPQYVARQIRTPLFILNAAYDSWQIKNILAPRAADPYGKWQSCQLDIKNCHPSQIKVMQDFRLEFLSAVIGLGRSSSRGMFIDSCYTHCQTETQTSWFWQDSPILNRTTIAKAVGDWVYDRTLFQKIDCPYPCNPTCHHRVFTPLDAPPI

SEQ ID NO: 2183 - DNA, 546 bp, Arabidopsis thaliana
atggggctttcatttgcaaagctttttagccggctttttgccaagaaggagatgcgaatccttatggttggtcttgatgctgctggtaagaccaccattttgtacaagctcaagcttggtgagattgtcaccaccattcccaccatcgggtttaatgtggagacggttgagtacaagaacatcagcttcacggtttgggatgtcgggggtcaggacaagatccgtcccttgtggagacactacttccaaaacactcaaggtctgatatttgttgttgatagcaatgacagagaccgtgttgttgaagccagagatgaacttcacaggatgttgaatgaagatgagcttcgggatgcagtattgcttgtgtttgccaacaagcaggatcttccaaacgctatgaatgctgctgagattactgataagcttggccttcactcactccggcaacgccactggtacatccaaagcacatgcgcaactagcggtgaagggctctatgaaggtctggattggctttccaacaacattgctagcaaagcttga

SEQ ID NO: 2184 - protein, 181 aa, Arabidopsis thaliana
MGLSFAKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIASKA

SEQ ID NO: 2185 - DNA, 1239 bp, Arabidopsis thaliana
atggcgtcatcttacgtcacctactcaacggtcactccggtggtcagcagcagtaacattcgaggagtctttcgtttggcattcacgcgccgccgtgttactctatcgccgaatgctcggaggagaatattgagagtttcggcgaaagcgtcgacgaagaatgctatggagtataggaaattaggagattccgatctcaacatcagcgaagttactatgggcactatgacatttggggagcaaaatactgagaaagaatctcatgagatgctgagttatgcaattgaagagggcatcaattgcattgacactgctgaagcttatcccataccgatgaagaaggagacgcaaggtaaaacggatctttatatcagtagctggttgaagtctcagcaacgtgacaagatagttttggcaactaaagtatgtgggtactcagaaaggtcagcttacataagggacagtggtgagattctgcgtgtagatgctgctaatatcaaagaaagtgttgagaaaagtcttaagcgccttggaactgattacattgacttgcttcaaatacactggccagatcgatacgtaccactcttcggtgatttttactatgaaacgtcgaaatggagacctagtgtgccattcgctgagcaactaagagcctttcaggatctcatagttgaaggaaaggttcgctatatcggtgtctcgaatgaaacttcatacggagtgacggagtttgttaacacagcaaaactcgaaggactaccaaagattgtgagcatccagaatggttacagcttgctagttagatgtcggtatgaagttgatctggtagaagtatgccacccaaaaaattgcaatgttggcttgcttgcttattcccctcttggaggcggctcgttgtctgggaaatacttggctacagaccaagaagctacaaaaaatgcaaggctgaatcttttcccaggatatatggaacgttacaagggatcactagccaaggaagcaaccatacaatacgttgaggtggcgaagaagtacggtttaactccggttgagttagcactcgggtttgtacgtgacaggccctttgtgacgagcacgatcatcggggccacatcggtaaaacaacttaaagaagacattgatgcttttctgatgacggagcggccgttttcgcaggaagttatggcagacattgacgccgttttcaagaggttcaaagacccttctttcgtttga

SEQ ID NO: 2186 - protein, 412 aa, Arabidopsis thaliana
MASSYVTYSTVTPVVSSSNIRGVFRLAFTRRRVTLSPNARRRILRVSAKASTKNAMEYRKLGDSDLNISEVTMGTMTFGEQNTEKESHEMLSYAIEEGINCIDTAEAYPIPMKKETQGKTDLYISSWLKSQQRDKIVLATKVCGYSERSAYIRDSGEILRVDAANIKESVEKSLKRLGTDYIDLLQIHWPDRYVPLFGDFYYETSKWRPSVPFAEQLRAFQDLIVEGKVRYIGVSNETSYGVTEFVNTAKLEGLPKIVSIQNGYSLLVRCRYEVDLVEVCHPKNCNVGLLAYSPLGGGSLSGKYLATDQEATKNARLNLFPGYMERYKGSLAKEATIQYVEVAKKYGLTPVELALGFVRDRPFVTSTIIGATSVKQLKEDIDAFLMTERPFSQEVMADIDAVFKRFKDPSFV

SEQ ID NO: 2187 - DNA, 213 bp, Arabidopsis thaliana
atggcttttgttgtaacatccctgatattcgctgtcgtaggcatcattgcttcgatatgcactagaatctgcttcaacaaaggcccctccaccaatctgttacatcttacattggtcatcaccgcaactgtctgctgttggatgatgtgggcaattgtatacattgcgcagatgaaccctctcattgtccctatcttaagcgaggtggagtag

SEQ ID NO: 2188 - protein, 70 aa, Arabidopsis thaliana
MAFVVTSLIFAVVGIIASICTRICFNKGPSTNLLHLTLVITATVCCWMMWAIVYIAQMNPLIVPILSEVE

SEQ ID NO: 2189 - DNA, 600 bp, Arabidopsis thaliana
atggcgcagcgatctagggttatcaccatgtctcctctcattctcgatcaagaagttgatctcgatctctgggaagttgttaatccttctgatggcgagttctccgacgattctttctccgtcgatagtctttccgacgatgacgtcatatctcttgacgacgcttcctttgtcgcaccctctgtcatttctccgccgcatgagataattcctattgctgacggtggtgatctcgccgtggatctggatggtgatgatgatgttggcgatgatgtcgttcgcgatgaagttgatgagaatgatcttggatggtctcagcagcggatgatgtttctcggtggaggttctggttattctgttggaattacgtacggagatagtgttaatgacgacggcgaagaagatcgcgagtacgacgattcgtatgatcttgacgaagagttggttccgcgtagcgtgagtaagaaggtggggagacaaaggatgaggaaactggggaaaagagcaatcgccaaggtctatgcctcgaagatatctccgtttttgaagcctggtatcgttcgtggtaagcatggtctcggcatgaaattcaagtgctga

SEQ ID NO: 2190 - protein, 199 aa, Arabidopsis thaliana
MAQRSRVITMSPLILDQEVDLDLWEVVNPSDGEFSDDSFSVDSLSDDDVISLDDASFVAPSVISPPHEIIPIADGGDLAVDLDGDDDVGDDVVRDEVDENDLGWSQQRMMFLGGGSGYSVGITYGDSVNDDGEEDREYDDSYDLDEELVPRSVSKKVGRQRMRKLGKRAIAKVYASKISPFLKPGIVRGKHGLGMKFKC

SEQ ID NO: 2191 - DNA, 477 bp, Arabidopsis thaliana
atggcagaagcgtctagtttggtggggaaacttgagacagaagtggagatcaaagcttcggccaaaaagttccatcacatgtttaccgagagaccacaccatgtctccaaagcaactccagataaaattcatggatgtgagctgcacgaaggcgactggggcaaagtcggctctatcgtcatctggaaatacgttcatgatggaaagttaacagtggggaagaataagatcgaggcggtggatccggagaagaacctgatcacgttcaaggttttagaaggtgatctgatgaatgagtacaagagcttcgcatttacactccaagtgacccctaagcaaggggagtcagggagtattgcgcactggcacctggagtatgagaaaattagcgaggaggtagctcatcccgaaacccttctccaattctgtgtcgagatctccaaagagatcgacgaacatctcttggccgaggaatag

SEQ ID NO: 2192 - protein, 158 aa, Arabidopsis thaliana
MAEASSLVGKLETEVEIKASAKKFHHMFTERPHHVSKATPDKIHGCELHEGDWGKVGSIVIWKYVHDGKLTVGKNKIEAVDPEKNLITFKVLEGDLMNEYKSFAFTLQVTPKQGESGSIAHWHLEYEKISEEVAHPETLLQFCVEISKEIDEHLLAEE

SEQ ID NO: 2193 - DNA, 363 bp, Arabidopsis thaliana
atggcctcaaagagctcaaccaccatttccctcatcatcatcctcctcatcagcctcgcagaagcaaacctcttaagctcgcctacaccgaccaacaactttggctcatgtcccagaaacccattgcaactaggcgtatgtgccaacgtccttggcctagccaatgttacagctggcgaccccagagcacgacagtgttgcactgccctcaatggcctcactaatgttcaagtaaccgattgtctctgctttatcttcaggccgattccgttggttttcggtattgatgtggccgttagagaaatcttttttgcttgcaatagggtttttcctatcggtttccagtgtccaccaccacagtaa

SEQ ID NO: 2194 - protein, 120 aa, Arabidopsis thaliana
MASKSSTTISLIIILLISLAEANLLSSPTPTNNFGSCPRNPLQLGVCANVLGLANVTAGDPRARQCCTALNGLTNVQVTDCLCFIFRPIPLVFGIDVAVREIFFACNRVFPIGFQCPPPQ

SEQ ID NO: 2195 - DNA, 783 bp, Arabidopsis thaliana
atggcagaagagtacaagaacaccgttccagagcaggagacccctaaggttgcaacagaggaatcatcggcgccagagattaaggagcggggaatgttcgatttcttgaagaaaaaggaggaagttaaacctcaagaaacgacgactctcgcgtctgagtttgagcacaagactcagatctctgaaccagagtcgtttgtggccaagcacgaagaagaggaacataagcctactcttctcgagcagcttcaccagaagcacgaggaggaagaagaaaacaagccaagtctcctcgacaaactccaccgatccaacagctcttcttcctcttcgagtgatgaagaaggtgaagacggtgagaagaagaagaaggagaaaaagaagaagattgttgaaggagatcatgtgaaaacagtggaagaagagaatcaaggagtaatggacaggattaaggagaagtttccactcggagagaaaccagggggtgatgatgtaccagtcgtcaccaccatgccagcaccacattcggtagaggatcacaaaccagaggaagaagagaagaaagggtttatggataagatcaaggagaagcttccaggccacagcaagaaaccagaggattcacaagtcgtcaacaccacaccgctggttgaaacagcaacaccgattgctgacatcccggaggagaagaagggatttatggacaagatcaaagagaagcttccaggttatcacgccaagaccactggagaggaagagaagaaagaaaaagtgtctgattaa

SEQ ID NO: 2196 - protein, 260 aa, Arabidopsis thaliana
MAEEYKNTVPEQETPKVATEESSAPEIKERGMFDFLKKKEEVKPQETTTLASEFEHKTQISEPESFVAKHEEEEHKPTLLEQLHQKHEEEEENKPSLLDKLHRSNSSSSSSSDEEGEDGEKKKKEKKKKIVEGDHVKTVEEENQGVMDRIKEKFPLGEKPGGDDVPVVTTMPAPHSVEDHKPEEEEKKGFMDKIKEKLPGHSKKPEDSQVVNTTPLVETATPIADIPEEKKGFMDKIKEKLPGYHAKTTGEEEKKEKVSD

SEQ ID NO: 2197 - DNA, 1605 bp, Arabidopsis thaliana
atggacggtgtatcaccaaagtttgtgttgccggagacattcgacggcgtgaggatggagatcacaggccaactaggcatgatctgggagcttgtaaaagcaccagtgattgtccctcttcttcaattagctgtttacatctgtttgcttatgtctgtcatgcttttatgtgagagggtttacatgggaatcgtcatcgtcctcgtcaaactcttctggaaaaaaccagacaaacgttacaagttcgagcccattcacgatgatgaagagcttggtagctccaatttccccgtcgtcctcgtacaaatccccatgttcaacgaacgagaggtttataagctatcaataggagcggcgtgtggactttcctggccgtccgatcgtctcgtgattcaagtgttagatgactctacagatcctactgttaagcaaatggtggaagtggagtgtcaaagatgggcaagtaaaggaatcaatattaggtatcaaataagagagaatagagttggttacaaagccggtgctttaaaggaaggactcaaacgtagttatgtcaagcattgcgagtatgttgtcatcttcgacgccgattttcagcccgaacctgattttcttcgccgtagcattcctttcctcatgcacaatcccaacattgccttggttcaggctcgatggcggttcgtaaattctgatgagtgcttattgacgagaatgcaagaaatgtcattggattaccatttcactgttgagcaagaagtgggttcatcaacacatgcttttttcggcttcaacggaaccgccggaatatggagaatagcggcgataaatgaagctggtgggtggaaagatcggaccaccgtggaagatatggatctcgccgtccgagcaagtcttcgcggctggaaatttctctacctcggtgaccttcaggtgaaaagtgagcttccaagtacttttagagccttccgttttcagcaacatagatggtcttgtggacctgcaaatctctttaggaaaatggttatggagatcgtaagaaacaagaaagtgagattctggaagaaagtgtacgtgatatacagcttcttctttgtgaggaaaatcattgcacattgggtcacattttgtttctactgcgttgttcttcctctcacaattctcgtcccggaggttaaagttccgatttggggttcggtttatatcccatccatcatcactatcctcaattccgtcggtactccaaggtcaattcatctgctgttctattggattctattcgagaatgtgatgtcgctgcaccggacaaaggccactctcattggtctgtttgaggcaggaagggctaacgagtgggtagtgactgctaagcttggaagcggtcagagcgctaaaggaaacactaaagggatcaaaaggttcccaagaatcttcaaattgcctgatcgattgaatacattggagcttggatttgcggctttcttgttcgtgtgcggatgctatgactttgtgcacgggaagaacaattacttcatctacctgtttcttcagacaatgtctttcttcatcagtgggctgggctggatcgggacttatgtcccgagttag

SEQ ID NO: 2198 - protein, 534 aa, Arabidopsis thaliana
MDGVSPKFVLPETFDGVRMEITGQLGMIWELVKAPVIVPLLQLAVYICLLMSVMLLCERVYMGIVIVLVKLFWKKPDKRYKFEPIHDDEELGSSNFPVVLVQIPMFNEREVYKLSIGAACGLSWPSDRLVIQVLDDSTDPTVKQMVEVECQRWASKGINIRYQIRENRVGYKAGALKEGLKRSYVKHCEYVVIFDADFQPEPDFLRRSIPFLMHNPNIALVQARWRFVNSDECLLTRMQEMSLDYHFTVEQEVGSSTHAFFGFNGTAGIWRIAAINEAGGWKDRTTVEDMDLAVRASLRGWKFLYLGDLQVKSELPSTFRAFRFQQHRWSCGPANLFRKMVMEIVRNKKVRFWKKVYVIYSFFFVRKIIAHWVTFCFYCVVLPLTILVPEVKVPIWGSVYIPSIITILNSVGTPRSIHLLFYWILFENVMSLHRTKATLIGLFEAGRANEWVVTAKLGSGQSAKGNTKGIKRFPRIFKLPDRLNTLELGFAAFLFVCGCYDFVHGKNNYFIYLFLQTMSFFISGLGWIGTYVPS

SEQ ID NO: 2199 - DNA, 675 bp, Arabidopsis thaliana
atggctgagaaagaagaagtgaagcttttggggatatgggcgagcccttttagccgtcgggtcgagatggctctcaaactcaaaggcataccgtacgagtacgtggaagagatactggagaacaaaagccctttgcttcttgctcttaaccctattcacaagaaagtccctgttcttgtccacaatggtaaaaccattctcgagtctcatgtgattcttgaatacatcgatgagacttggccacaaaatccaattctccctcaagatccttatgaaagatccaaagctcgtttctttgctaaactcgtcgatgaacagattatgaacgtggggtttatatcaatggcaagagcagacgagaaaggaagagaagttttagccgagcaggtaagagaactgattatgtatctcgagaaagaacttgtcggaaaagattacttcggaggcaagactgtcggattcttggactttgtcgccggaagtttaattccgttttgtttggagagaggttgggaaggaataggattggaagtgattacagaggagaagtttccagagttcaagagatgggttaggaatttggagaaggttgagattgttaaagattgtgttccaccaagagaggaacatgtagaacacatgaactatatggcagagagagtgagatcttcttaa

SEQ ID NO: 2200 - protein, 224 aa, Arabidopsis thaliana
MAEKEEVKLLGIWASPFSRRVEMALKLKGIPYEYVEEILENKSPLLLALNPIHKKVPVLVHNGKTILESHVILEYIDETWPQNPILPQDPYERSKARFFAKLVDEQIMNVGFISMARADEKGREVLAEQVRELIMYLEKELVGKDYFGGKTVGFLDFVAGSLIPFCLERGWEGIGLEVITEEKFPEFKRWVRNLEKVEIVKDCVPPREEHVEHMNYMAERVRSS

SEQ ID NO: 2201 - DNA, 351 bp, Arabidopsis thaliana
atgaagaacaccaatttgcctgaagaaaccaaggaaccaatctctccaggatcttctcaccggaaacaaaacaagacaggtacaaagacatgtttcccggaaacaacggtgttgtcaggacgtgataggctaaagagacatagagaagaggttgccggaaaagttcctataccggatagttggggaaaagaaggattgcttatgggatggatggatttttcgaccttcgacgctgcttttacgtctagccagattgtctctgctcgagctgcgttaatggctgactcaggagacgatgccggagctagaggaagtaggcctcaacgccttcgagttgagagttcttgttga

SEQ ID NO: 2202 - protein, 116 aa, Arabidopsis thaliana
MKNTNLPEETKEPISPGSSHRKQNKTGTKTCFPETTVLSGRDRLKRHREEVAGKVPIPDSWGKEGLLMGWMDFSTFDAAFTSSQIVSARAALMADSGDDAGARGSRPQRLRVESSC

SEQ ID NO: 2203 - DNA, 972 bp, Arabidopsis thaliana
atggaagatcggtgcttgatcaagaacgatatcactgaattgattggtaacacaccaatggtgtatctgaacaatgttgttgatggttgcgtggctcgtatcgctgcgaagcttgagatgatggagccttgttctagcgtcaaagacagaatcgcgtatagtatgatcaaagatgcagaagacaaaggattgattactcccggaaagagtacattgatagagccaactgctggtaacaccgggattggtttagcttgcatgggagctgcaagaggctataaagtgatccttgtgatgccttcaactatgagcttagagagaagaatcattctgagggcactaggtgcagagcttcatctctcggaccagcgcataggccttaaaggaatgttggagaaaactgaagcgattttaagcaaaactcctggtggttacattccacaacaatttgaaaatcctgcaaaccccgagattcattaccgaaccacgggaccggaaatatggagagattcagccgggaaagtagatatattggtcgctggcgtagggactggtggaactgctactggagtagggaagttcctcaaggagcagaacaaagacatcaaggtttgtgtggtggaaccagtagaaagtccggtacttagcggaggtcaaccaggtccacatttgattcagggaattggctctggtatcgtcccattcaatttggacttaaccattgttgatgaaattattcaagtggcaggtgaagaggctattgaaacagccaagcttcttgccctcaaagaaggattactggtgggaatatcctctggagccgcagcagcggctgcgttaaaggttgcaaagcggccagaaaacgcggggaaactcattgtggtggtttttcctagtggaggagaacgttatttatcgactaaactgttcgattcgattagatatgaagcagagaatttgcctattgaatga

SEQ ID NO: 2204 - protein, 323 aa, Arabidopsis thaliana
MEDRCLIKNDITELIGNTPMVYLNNVVDGCVARIAAKLEMMEPCSSVKDRIAYSMIKDAEDKGLITPGKSTLIEPTAGNTGIGLACMGAARGYKVILVMPSTMSLERRIILRALGAELHLSDQRIGLKGMLEKTEAILSKTPGGYIPQQFENPANPEIHYRTTGPEIWRDSAGKVDILVAGVGTGGTATGVGKFLKEQNKDIKVCVVEPVESPVLSGGQPGPHLIQGIGSGIVPFNLDLTIVDEIIQVAGEEAIETAKLLALKEGLLVGISSGAAAAAALKVAKRPENAGKLIVVVFPSGGERYLSTKLFDSIRYEAENLPIE

SEQ ID NO: 2205 - DNA, 1122 bp, Arabidopsis thaliana
atggcttgctctaatctaacaacaatgtgggtttcatcaaaaccatctctttctgctgattcatcttccttatcattccgatctgttctcaagtgcccaactaacacttcctcacctccttcacgagcttcctctgtttcaccactccaagcgtctcttcgtgagctcagagaccgtatcgattcagtcaaaaacactcaaaagatcaccgaagctatgaagcttgtcgctgcagctaaagtcaggagagctcaagaagctgttgtcaatggacgaccattctcagaaaccctagttgaagttctttacaacatcaacgaacagcttcaaaccgatgatgtcgatgttcccttaaccaaagtcagaccggttaagaaagtagctctcgttgtcgtcaccggtgatcgtggattatgtggtggattcaacaatttcatcattaagaaagcagaggcaagaatcaaagagcttaaaggtctaggtcttgaatacacagtcattagcgtgggcaagaagggaaattcttatttcctccgtcgcccgtacatccccgtcgacaaatacctagaagccggaactttacctacggctaaagaagctcaagctgtggctgatgatgtcttctctctgtttataagtgaagaagtcgacaaagtcgagctcttgtacacaaagtttgtctctttggtcaaatcagaacccgtgatccacacgctactgcctttatcacctaaaggagagatctgtgacattaatggaacctgtgtggatgctgcggaagatgagtttttcaggttaacgacaaaagaagggaaattgacagttgaaagagagacttttaggacaccaacagctgatttctcgccgatcttgcaattcgagcaagaccctgttcagattcttgatgctttgttgcctctgtatcttaacagtcagattcttagggcattacaggagtcattggctagtgagcttgcagctagaatgagtgcaatgagtagtgcttcggataatgcatcggatctcaagaaatcgctttcgatggtgtataatagaaagcgtcaagctaagattactggagagattcttgagattgttgctggagctaatgcacaggtttga

SEQ ID NO: 2206 - protein, 373 aa, Arabidopsis thaliana
MACSNLTTMWVSSKPSLSADSSSLSFRSVLKCPTNTSSPPSRASSVSPLQASLRELRDRIDSVKNTQKITEAMKLVAAAKVRRAQEAVVNGRPFSETLVEVLYNINEQLQTDDVDVPLTKVRPVKKVALVVVTGDRGLCGGFNNFIIKKAEARIKELKGLGLEYTVISVGKKGNSYFLRRPYIPVDKYLEAGTLPTAKEAQAVADDVFSLFISEEVDKVELLYTKFVSLVKSEPVIHTLLPLSPKGEICDINGTCVDAAEDEFFRLTTKEGKLTVERETFRTPTADFSPILQFEQDPVQILDALLPLYLNSQILRALQESLASELAARMSAMSSASDNASDLKKSLSMVYNRKRQAKITGEILEIVAGANAQV

SEQ ID NO: 2207 - DNA, 453 bp, Arabidopsis thaliana
atgtcaaagagaaagactaaagagccaaaggtcgatgttgtgactcttggaccatctgttcgtgagggagagcaagttttcggtgttgtccacatctttgcttcattcaacgacactttcattcatgttactgatttgtctggtcgtgaaactcttgtccgtatcaccggtggaatgaaggtgaaagctgatagagatgagtcctcaccttacgcagctatgcttgcagcacaggatgttgctcagcgatgcaaggaacttggtatcactgccatgcatgtgaagctccgtgccacaggtggaaacaagaccaagacacctggtcctggagcacagtctgcccttagagcccttgctcgttccggcatgaaaataggccgtattgaggatgttactcccatcccaacagacagtacccgcagaaagggtggtagaagaggaagaaggctctga

SEQ ID NO: 2208 - protein, 150 aa, Arabidopsis thaliana
MSKRKTKEPKVDVVTLGPSVREGEQVFGVVHIFASFNDTFIHVTDLSGRETLVRITGGMKVKADRDESSPYAAMLAAQDVAQRCKELGITAMHVKLRATGGNKTKTPGPGAQSALRALARSGMKIGRIEDVTPIPTDSTRRKGGRRGRRL

SEQ ID NO: 2209 - DNA, 645 bp, Arabidopsis thaliana
atggcttctgtaccatgttccttcaagctctctgctcatcgtagatcttcttccaagcttgatggaaacaacaaacagtgtagtagtttagtagaaagactgagagataaaacgaagagtcaagttcctaagtccattacttgcattaaccgcttagagatatcgcgtatagcaccattacacgcaacgatgaatagcccgaaaggatttggacctcctcctaagaaaaccaagaagtcgaaaaagccaaaacccggaaaccaaagtgatgaagacgacgacgatgaagacgaagatgatgatgatgaagaagatgaacgtgagagaggtgtaattccagagatagtgaccaacagaatgataagcagaatgggatttacagtggggttaccactcttcattggtcttttgttcttcccattcttttactatctcaaagtgggattgaaagttgatgtgcctacatgggttccgtttattgtttcgttcgtcttctttggtacggctttagctggtgtgagctatgggatcgtgtcttcgagctgggatccgttgagagaaggttccttgttaggctggaacgaagctaagaagaactggcctgtcttttggcagtccttttggaattcctcagacaagagatag

SEQ ID NO: 2210 - protein, 214 aa, Arabidopsis thaliana
MASVPCSFKLSAHRRSSSKLDGNNKQCSSLVERLRDKTKSQVPKSITCINRLEISRIAPLHATMNSPKGFGPPPKKTKKSKKPKPGNQSDEDDDDEDEDDDDEEDERERGVIPEIVTNRMISRMGFTVGLPLFIGLLFFPFFYYLKVGLKVDVPTWVPFIVSFVFFGTALAGVSYGIVSSSWDPLREGSLLGWNEAKKNWPVFWQSFWNSSDKR

SEQ ID NO: 2211 - DNA, 1857 bp, Arabidopsis thaliana
atgatccctcaccaggaggtcaatgaggaagaagcttccctctttgactttttgtggttactgctagcaagcgtcatatttgtgcctctatttcagaaaattcctggaggcagccctgttcttgggtatttggcagctggaattctgattggtccgtatggtctttcgataatccgtaatgtgcacggaaccagggccatcgcagaatttggagtagttttcttgcttttcaacatcggccttgagctatctgttgaaagactgagttccatgaagaaatatgtttttggattaggctcagctcaggttctggtgacggcagcagtagttggattgcttgcccattatgttgctggtcaggctggtccagcagcaatagtgattggaaatggcctggctctgtcgtccactgctgttgtccttcaggttctacaagaacgaggcgagagtacatctagacatggaagggcttcattttccgtcttgcttttccaggatctagctgtagttgttttactgattctcatcccacttatttcacctaattcatcgaaaggagggattggatttcaagccattgctgaagctcttgggcttgctgcagtcaaagcagcagtggctattactgcaataattgctggtggccgtctacttcttcgaccaatctacaagcaaattgcagaaaatcgaaacgccgagatattctctgccaacacgcttctcgttattcttgggactagtttactgacagctagggctggactttccatggcattaggagcgtttttggctggtctactccttgcagagacagaattttcgttgcaagtagaatcagatattgctccatatcgtggtcttctgttgggactcttcttcatgacggttggaatgtcaattgatccgaaattacttctctccaacttccctgtcatagtgggaactttgggactcttgatagtgggcaaaactatgttagtcgtgattatgggaaaattgttcggcatatcaataatatctgcaattcgggtcggtctactattggccccaggcggagagtttgcatttgttgctttcggagaagctgttaatcagggtataatgtctcctcagttatcttcgttgctattccttgtcgtgggaatctcaatggctatcacaccctggttagctgctggtggccagttaattgcatctcgttttgagttgcatgatgttcgaagtttattgcccgtcgagagtgagacagatgatttgcagggtcacataattatttgtggatttggtcgagttggtcagataattgctcaacttctctcggaaagacttatcccatttgttgcccttgatgtcagcagtgatagagtgactatcgggcgttccttggatcttcctgtttatttcggagacgctggtagtaaagaggttctccacaaaattggagctgggagagcatgtgctgctgtggttgccttagacgcaccaggagcaaactacagatgtgtttgggctttgagcaagttttaccccaatgtcaaaacttttgtccgtgctcacgatgttgttcatggtcttaatctagaaaaagccggtgctactgcagttgtcccggagactctggagcctagtctacagttggcagctgctgttcttgctcaggcaaaattaccgacatcggaaattgcaaacacgattaacgagttcagaacccgtcacttgtctgaactgaccgagctatgtgaagcaagcggaagctctctaggctatgggtactctaggacgagtaagcctaaacctcaaccatcggatgcatctggcgataaccagataatcgaaggaggcacagtcgtaatctga

SEQ ID NO: 2212 - protein, 618 aa, Arabidopsis thaliana
MIPHQEVNEEEASLFDFLWLLLASVIFVPLFQKIPGGSPVLGYLAAGILIGPYGLSIIRNVHGTRAIAEFGVVFLLFNIGLELSVERLSSMKKYVFGLGSAQVLVTAAVVGLLAHYVAGQAGPAAIVIGNGLALSSTAVVLQVLQERGESTSRHGRASFSVLLFQDLAVVVLLILIPLISPNSSKGGIGFQAIAEALGLAAVKAAVAITAIIAGGRLLLRPIYKQIAENRNAEIFSANTLLVILGTSLLTARAGLSMALGAFLAGLLLAETEFSLQVESDIAPYRGLLLGLFFMTVGMSIDPKLLLSNFPVIVGTLGLLIVGKTMLVVIMGKLFGISIISAIRVGLLLAPGGEFAFVAFGEAVNQGIMSPQLSSLLFLVVGISMAITPWLAAGGQLIASRFELHDVRSLLPVESETDDLQGHIIICGFGRVGQIIAQLLSERLIPFVALDVSSDRVTIGRSLDLPVYFGDAGSKEVLHKIGAGRACAAVVALDAPGANYRCVWALSKFYPNVKTFVRAHDVVHGLNLEKAGATAVVPETLEPSLQLAAAVLAQAKLPTSEIANTINEFRTRHLSELTELCEASGSSLGYGYSRTSKPKPQPSDASGDNQIIEGGTVVI

SEQ ID NO: 2213 - DNA, 1584 bp, Arabidopsis thaliana
atgtcgaccaaactcagtatatttcttcttggcctgattttgttctctgtctcaccattttccggagactgtagaactctttcagggaaacatgagcattactcttcatcccttaacatgtttaattcccaagatacgatgcgtttcagttctgcttcttcttcaacaagcaacgattgcggtttctcctccaaggaacatgatccttccaaggaacataccagagaatcggtgaagcctcaatcaaggattaaacaagaaacaaagagaacaacacattcagttgttgatcttcaaatccaagacctcacaagaattaagacgcttcatgctcggttcaacaaatcgaagaaacagaaaaacgagaaggttaggaagaagattacctcagatatttctttggtgggagctccagaggtttcaccggggaagctgatagcaacacttgagtctggtatgacgctcggttctggtgaatacttcatggacgtgcttgtgggcacaccaccaaaacacttctcattgattcttgacacagggagtgacttaaactggctccaatgccttccttgctacgactgtttccatcaaaacggtatgttttatgatccaaaaacgtccgcttcattcaagaacataacatgcaatgaccctagatgcagccttatctcatcacccgatcctccagtacagtgcgaatcagataaccaatcgtgcccttatttctactggtatggagacaggtcgaacacaactggagatttcgcggttgagactttcaccgttaatctcacgaccactgagggaggaagctcagagtacaaggtgggaaatatgatgtttgggtgtggccattggaaccgaggtctcttcagtggtgcttcaggtctgcttgggttaggaagaggacctctttcgttttcttctcagcttcagtctctctatggccattccttttcctactgtcttgtcgatagaaacagcaacaccaatgtaagcagcaagttgatatttggagaagacaaagatttgctgaaccacacaaatctgaacttcacttcttttgtgaacgggaaggagaattcagtggagacattttactatatacagatcaaatccattctagtcggcggcaaagctctagacatacctgaagaaacatggaatatctcatcagatggtgatggtggaaccatcattgattctggtacaaccttaagctatttcgcagaacctgcatatgagatcatcaaaaacaagtttgcagagaaaatgaaagaaaactacccaatatttagagatttcccggtccttgatccttgcttcaatgtatctggcatagaggagaacaacatccacctacctgagctcgggattgcatttgtagacggcacagtttggaatttccctgctgagaactccttcatttggttgagcgaggatttggtttgcttggcaattctaggaactccaaaatctaccttctcgatcatcggaaactaccagcaacagaatttccatatactctatgatacaaagaggtctaggctagggttcacacccacaaagtgtgcggacatataa

SEQ ID NO: 2214 - protein, 527 aa, Arabidopsis thaliana
MSTKLSIFLLGLILFSVSPFSGDCRTLSGKHEHYSSSLNMFNSQDTMRFSSASSSTSNDCGFSSKEHDPSKEHTRESVKPQSRIKQETKRTTHSVVDLQIQDLTRIKTLHARFNKSKKQKNEKVRKKITSDISLVGAPEVSPGKLIATLESGMTLGSGEYFMDVLVGTPPKHFSLILDTGSDLNWLQCLPCYDCFHQNGMFYDPKTSASFKNITCNDPRCSLISSPDPPVQCESDNQSCPYFYWYGDRSNTTGDFAVETFTVNLTTTEGGSSEYKVGNMMFGCGHWNRGLFSGASGLLGLGRGPLSFSSQLQSLYGHSFSYCLVDRNSNTNVSSKLIFGEDKDLLNHTNLNFTSFVNGKENSVETFYYIQIKSILVGGKALDIPEETWNISSDGDGGTIIDSGTTLSYFAEPAYEIIKNKFAEKMKENYPIFRDFPVLDPCFNVSGIEENNIHLPELGIAFVDGTVWNFPAENSFIWLSEDLVCLAILGTPKSTFSIIGNYQQQNFHILYDTKRSRLGFTPTKCADI

SEQ ID NO: 2215 - DNA, 1575 bp, Arabidopsis thaliana
atgcaacctccggcaagcgcaggacttttccggtcgccggaaaatctcccttggccttataattacatggattatttggtcgctggtttcttggttttgacggccggaatacttctccgtccatggctctggttacgtctacgaaactcgaaaacgaaagatggagatgaagaagaagataatgaggagaagaagaagggaatgattccaaacggaagcttaggctggccggtgatcggagaaaccctaaacttcatcgcttgtggttattcttctcggcctgttaccttcatggacaaacgaaagtctttatacgggaaagtgttcaaaacgaacataatagggacaccaatcataatatcaaccgatgcagaggtgaataaagtggtgctccaaaaccatgggaacacatttgtccctgcataccctaaatcaattacggaactacttggagaaaactctattctcagcatcaatggacctcatcaaaaaaggcttcacacgctcattggcgcgttcctcagatctcctcacctcaaagaccggatcactcgagacattgaggcctcggttgttctcactttggcgtcttgggctcaacttccattggttcatgttcaggatgagatcaaaaagatgacgtttgagatattagtaaaagtgttgatgagcacatctcctggtgaagatatgaacattctcaaacttgagttcgaagaattcatcaaaggtttgatttgtatcccaatcaaattccctggcactagactctacaaatccttaaaggcgaaagagaggttaataaagatggtaaaaaaggttgtggaggagagacaagtggcgatgacaacgacgtctccggcaaatgacgtggtggacgtacttctaagagacggtggtgattcagagaagcaatctcaaccgtcagatttcgtcagcggaaagatcgtagagatgatgatacccggagaggaaacaatgccaacggcgatgaccttggctgtcaaattcttaagtgacaaccccgtcgctctagccaaactcgtggaggagaatatggagatgaagaggcgtaaattggaattgggagaagaatacaagtggaccgattatatgtctctctcttttactcaaaatgtgataaacgaaacgcttagaatggctaacattattaacggggtgtggaggaaagctctcaaggatgtagaaattaaaggttacttaataccgaaaggatggtgtgtattggcatcattcatatcggttcacatggatgaagacatttatgataatccctatcaattcgatccgtggagatgggacagaattaatggatcggcaaacagcagtatttgcttcacaccctttggtggtgggcaaaggctatgtcctggtttagagctgtcgaagctcgaaatatccatctttcttcaccaccttgtaacccggtacagttggacggctgaggaagacgagatagtgtcatttccgactgtgaagatgaagcggaggctcccgatccgagtggctactgtagatgatagtgcttctccgatctcacttgaagatcattaa

SEQ ID NO: 2216 - protein, 524 aa, Arabidopsis thaliana
MQPPASAGLFRSPENLPWPYNYMDYLVAGFLVLTAGILLRPWLWLRLRNSKTKDGDEEEDNEEKKKGMIPNGSLGWPVIGETLNFIACGYSSRPVTFMDKRKSLYGKVFKTNIIGTPIIISTDAEVNKVVLQNHGNTFVPAYPKSITELLGENSILSINGPHQKRLHTLIGAFLRSPHLKDRITRDIEASVVLTLASWAQLPLVHVQDEIKKMTFEILVKVLMSTSPGEDMNILKLEFEEFIKGLICIPIKFPGTRLYKSLKAKERLIKMVKKVVEERQVAMTTTSPANDVVDVLLRDGGDSEKQSQPSDFVSGKIVEMMIPGEETMPTAMTLAVKFLSDNPVALAKLVEENMEMKRRKLELGEEYKWTDYMSLSFTQNVINETLRMANIINGVWRKALKDVEIKGYLIPKGWCVLASFISVHMDEDIYDNPYQFDPWRWDRINGSANSSICFTPFGGGQRLCPGLELSKLEISIFLHHLVTRYSWTAEEDEIVSFPTVKMKRRLPIRVATVDDSASPISLEDH

SEQ ID NO: 2217 - DNA, 456 bp, Arabidopsis thaliana
atggcgacgtcaggaacatatgtgacggaggttccattgaaaggatcggctgagaaacactacaagcggtggaggagtgagaaccacctcttccccgacgccatcggccaccacatccaaggtgtcaccatccacgacggtgaatgggactcccatggagccatcaagatttggaactacacatgcgatgggaaaccggaggtgttcaaggagaggagagagatagacgatgagaatatggcggtaacgttcagaggactcgaaggtcacgtgatggagcagcttaaagtgtatgacgtcatctttcagttcattcaaaagtcacctgatgatatcatctgtaagatcactatgatctgggagaagcaaaacgatgacatgcctgagcccagcaactacatgaagttcgtcaagagcctcgctgctgacatggatgatcacgttctcaaagcctaa

SEQ ID NO: 2218 - protein, 151 aa, Arabidopsis thaliana
MATSGTYVTEVPLKGSAEKHYKRWRSENHLFPDAIGHHIQGVTIHDGEWDSHGAIKIWNYTCDGKPEVFKERREIDDENMAVTFRGLEGHVMEQLKVYDVIFQFIQKSPDDIICKITMIWEKQNDDMPEPSNYMKFVKSLAADMDDHVLKA

SEQ ID NO: 2219 - DNA, 483 bp, Arabidopsis thaliana
atggatcgatccctccaaagcacacacgcaaaactcgtggcgcgtgacatccaacgcctgacacagtcacctacagaatccaactctttctctctgcttggcggagcgtgcgtttcacgcgtagagatagtaggcacaatcgtctctcgtgatctgaccccaaagtttctcaagttcggcgtcgacgatggcaccggctgcgtcacgtgcgtcatgtggctcaaccaactcacgtcttcttacttctcccggtgggatccagccacgattctgctgctcgcaagtgccgcgcggaaacaagccgcacaaatcagaatcggagccgtggctcgcgttcgcggccgcgtcggctcgtacagaggagtgatgcagatcacggctaatgtggcggtggccgagagagacccgaacgcggagatcttgcactggttggagtgtttaaagcttggtcaaagttgttatcgtgttcgtattcaaagttaa

SEQ ID NO: 2220 - protein, 160 aa, Arabidopsis thaliana
MDRSLQSTHAKLVARDIQRLTQSPTESNSFSLLGGACVSRVEIVGTIVSRDLTPKFLKFGVDDGTGCVTCVMWLNQLTSSYFSRWDPATILLLASAARKQAAQIRIGAVARVRGRVGSYRGVMQITANVAVAERDPNAEILHWLECLKLGQSCYRVRIQS

SEQ ID NO: 2221 - DNA, 1596 bp, Arabidopsis thaliana
atggacaagttctcgtacaattcgtatccagattcagctgaatcgtcgccaagatctcgcgatgtcgaatttgaaaatccgtcgccatgggaggaccagcagcagcagaactacaaggtgaagctcatgtgcagctatggcggcaagatccagcctcgtccacacgataaccagcttacttatgtaaacggcgataccaaaatcatgtcggtcgatcgtggtatcagatttccggctttagtatcgaagctctccgccgtctgcagcggtggtggtgatggaggagaaatctcgttcaagtatcagcttccaggtgaagatctagatgcgttgatttcggtgactaatgatgaggatctggagcacatgatgcatgagtacgatcggttgcttcgtttgtctactaaaccagctaggatgcgtttgtttctcttcccgtcttctcccatttccggcggatttggctccgaaggttcgactaaatcggatcgggatacgcttaatccaatccctagccgacctgaatcggagaaatctgtaaccgctcctccgaataatgctgatttcttgtttggatcggagaaagtagctccaattccgccgtcgccagtgaaggttcctcaaccggtaccggaaccagtggtgcttgaaccgccgcagatgttcgtagatcaacggatgttacaaccggaacacggcgtaaatccggcggagattcaaagacaaatccaggaatttcagatgattcaaatcagagaccaagagcaacaaatgcttcatcagaatcagctacatcaacaacaacaacaacaagaggctatacatcaaaatcagcttcatcaccaacaagaggttatacatcagaatcagctgcttcaacaagaggctatacatcagaatcagatgcttcaacaacaacaacaacaagaggctatgtacagaagaaaaaccgaagacgaagccggaagatacttccctcccacatacactcaaaatccggcgccggtgacgaatcaacaacctccggttggctactggcaaggaaacaccaacaacagtaatattcaggggaatatctacacaacaacgtcacagaatctaccggagcaacaacaacaacaacaacaagtatacatgattccagctcaatctcaagctccagggacattataccaaagcgtcatgagaccaacggtacaaggaaaccaaggttattacccatcacctgttcagcgacttcatcatcctgatgcatacatggaacagcagaaccagccaggttacaacgtggttcaaccacagccaacgttttcaggtggtccacaagttatgactagtgttggtccgcaagttatgactagtgtcggtcctccaatggggttacaggaaccttattcacagatggggaagcctgtgtactatacggtggctggagaaggcatgatggttcaaccgccaccagcccagcctcagcagcagcagcagcagtaccagggaatgggtcaaccggttagtggcatgaccgatctcagaaccggaccggatgggaaagtggcggttaacatggctgcaccacaagtttcagattcggtgtga

SEQ ID NO: 2222 - protein, 531 aa, Arabidopsis thaliana
MDKFSYNSYPDSAESSPRSRDVEFENPSPWEDQQQQNYKVKLMCSYGGKIQPRPHDNQLTYVNGDTKIMSVDRGIRFPALVSKLSAVCSGGGDGGEISFKYQLPGEDLDALISVTNDEDLEHMMHEYDRLLRLSTKPARMRLFLFPSSPISGGFGSEGSTKSDRDTLNPIPSRPESEKSVTAPPNNADFLFGSEKVAPIPPSPVKVPQPVPEPVVLEPPQMFVDQRMLQPEHGVNPAEIQRQIQEFQMIQIRDQEQQMLHQNQLHQQQQQQEAIHQNQLHHQQEVIHQNQLLQQEAIHQNQMLQQQQQQEAMYRRKTEDEAGRYFPPTYTQNPAPVTNQQPPVGYWQGNTNNSNIQGNIYTTTSQNLPEQQQQQQQVYMIPAQSQAPGTLYQSVMRPTVQGNQGYYPSPVQRLHHPDAYMEQQNQPGYNVVQPQPTFSGGPQVMTSVGPQVMTSVGPPMGLQEPYSQMGKPVYYTVAGEGMMVQPPPAQPQQQQQQYQGMGQPVSGMTDLRTGPDGKVAVNMAAPQVSDSV

SEQ ID NO: 2223 - DNA, 1173 bp, Arabidopsis thaliana
atggccatgagcatactcgcgaagatctttctcgtctttgccatctattgcgctatcgatcccttcagtcacagctccatttccaagttcccggatttcaaaacttacaagattgacatgcctccgttatcgtcacttccaaaggagagagaccgccagaatctgttgcagaattcagagatcaggtttcttaacgaggttcaaggtcccgagagcattgctttcgatccgcaaggtcgtggtccttataccggagtcgccgacggtcgaattctcttttggaatggcactcgttggacagatttcgcatatacttcgaacaatcggtcagagctatgtgatcctaagccatcgcttttggattacttaaaggatgaagatatctgtggtcggcctttaggtcttcgattcgacaagaaaaatggggatttgtacattgcagatgcgtatttggggataatgaaagttggtccggaaggaggtttagcaacttctgttacaaacgaggctgatggtgtgcctttgagatttaccaatgatcttgacattgatgatgaaggcaatgtttactttactgatagcagctctttcttccaacgaaggaaatttatgcttttgattgtctcgggggaagacagtgggagggtgttgaaatacaatccaaaaacaaaggagactaccactctcgtgagaaatctccagtttcctaacggattatccctcggcaaagacggctcctttttcatcttttgtgaaggatctattggaagattacggaaatactggttgaaaggggagaaagctggaacgtcagaagtggtagctctattacatgggttcccagacaacatccgcacaaacaaagatggagatttctgggtggcggtgcactgccacagaaacatattcacacacttgatggcgcattacccgagggtgaggaagttctttctgaagctgccgatatcagtgaagtttcagtacttgctgcaggtaggtggttggcctcatgctgtagctgtgaagtacagtgaagaagggaaagtgctaaaggtgttggaagatagtaaagggaaagtggtgaaggcagtgagtgaagtggaggagaaagatgggaagctttggatgggaagtgtattgatgtccttcattgccgtatatgacttgccttag

SEQ ID NO: 2224 - protein, 390 aa, Arabidopsis thaliana
MAMSILAKIFLVFAIYCAIDPFSHSSISKFPDFKTYKIDMPPLSSLPKERDRQNLLQNSEIRFLNEVQGPESIAFDPQGRGPYTGVADGRILFWNGTRWTDFAYTSNNRSELCDPKPSLLDYLKDEDICGRPLGLRFDKKNGDLYIADAYLGIMKVGPEGGLATSVTNEADGVPLRFTNDLDIDDEGNVYFTDSSSFFQRRKFMLLIVSGEDSGRVLKYNPKTKETTTLVRNLQFPNGLSLGKDGSFFIFCEGSIGRLRKYWLKGEKAGTSEVVALLHGFPDNIRTNKDGDFWVAVHCHRNIFTHLMAHYPRVRKFFLKLPISVKFQYLLQVGGWPHAVAVKYSEEGKVLKVLEDSKGKVVKAVSEVEEKDGKLWMGSVLMSFIAVYDLP

SEQ ID NO: 2225 - DNA, 1200 bp, Arabidopsis thaliana
atgggatcaatggctcagaaatcggttttgatgttatgcggagagttcatggaagcctacgagactatagtacctctctacgtcctccaagcgtttggtgttagcgtccactgcgtttctcctggtcgcaaaactggcgacaagtgcgtcatggccgctcacgatctccttggcctcgagatatacaccgaactggtggttgaccatctaacactaaacgctaacttcgatggcgtcatccccgaccaatacgacgccatcatcattcccggtggacgtttcacggaacttttgagcgccgacgagaaatgcgtgagtcttgttgctagattcgccgaactcaagaagctcatcttcacgagctgccacagccagctgtttcttgcggcggcaggtctgctcaccggtggaatgaagtgcacggcgttcgaaagcatgaaaccgtttatcgagctctccggcggcgcatggtggcaacagcctggagtccagacccttttcgaaatcactgattgtgtcaaggacggcagtttcatgtccactatggggtggccaacgcttggccatagtctcaaagttttgttagaatcacttggctccaagatttctagctctaaagagaatcatcagacttctttgcttttcttgattggggattgtgttgaagattatagtatcaacgtaccatttaaagcgtttcaagctttgggatgtaaagtggatgcagtgacgccaaccaagaagagaggtgagaaatgcgctacaatcgtacacgaccttgaagacggacggcaacttcctactgagaagtttggtcacaacttctatgtgaccgttgcgtgggatgatgtctctgtggatgattacgactgcattgtggttcccggaggaagatctccggagctcttggtgatgaaccccaaggccgtcgaattggtcagaaagtttgttgagaaaggcaagtttgttgctgccattggaatgggaaattggctacttgccgccacaggcgcccttaagaagaagagatgtgcaagtagttatgggacaaaggtggctgtgaaggttgctggtggtgagatcgtggaatctgaacggtgcgtgaccgacgacaagctggtcacagccgcatcaacttccgatcttcctgcctttttgtatgcattgtcgactgcacttggtctctctgttgtattctaa

SEQ ID NO: 2226 - protein, 399 aa, Arabidopsis thaliana
MGSMAQKSVLMLCGEFMEAYETIVPLYVLQAFGVSVHCVSPGRKTGDKCVMAAHDLLGLEIYTELVVDHLTLNANFDGVIPDQYDAIIIPGGRFTELLSADEKCVSLVARFAELKKLIFTSCHSQLFLAAAGLLTGGMKCTAFESMKPFIELSGGAWWQQPGVQTLFEITDCVKDGSFMSTMGWPTLGHSLKVLLESLGSKISSSKENHQTSLLFLIGDCVEDYSINVPFKAFQALGCKVDAVTPTKKRGEKCATIVHDLEDGRQLPTEKFGHNFYVTVAWDDVSVDDYDCIVVPGGRSPELLVMNPKAVELVRKFVEKGKFVAAIGMGNWLLAATGALKKKRCASSYGTKVAVKVAGGEIVESERCVTDDKLVTAASTSDLPAFLYALSTALGLSVVF

SEQ ID NO: 2227 - DNA, 1344 bp, Arabidopsis thaliana
atggctcttatacaatttggaagttcatgtgttgctcaatgggggattcttcgtcctcggtttgctgttaaagctttttatccaagcagattggagtctcaccaagacaattgcatcagccaaataaattgtctgggagcttcaaggtcgagtatgtttgcacagggctctttacccttcttgtcattgacgggagtatctcctaatacacattctcgtagaggagctcgcttcactgttagagctgatactgatttctattctgtccttggagtctcgaaaaatgcaaccaaagctgagattaaaagcgcttatcggaagctcgctaggagttatcatccagatgtgaacaaggatgctggggcagaagataaatttaaagaaataagtaatgcatatgagatcttatcagatgatgagaaaagatctctatacgacagatatggcgaggcaggagttaaaggcgctggaatgggaggcatgggggattatagtaatccgtttgatctatttgagtcattattcgaaggaatgggtgggatgggaggaatgggcggtggaatgggtagtagaggttcaaggagcagagctatcgatggtgaagatgagtattactcactaatcttgaatttcaaagaagcggttttcggtattgagaaagaaattgagatatctcggttagagagctgtgggacttgcaatggttctggagctaaagcgggaaccaaaccaaccaaatgcaaaacatgtggcgggcaaggacaggtggtagcatcaacgaggacaccactcggtgtattccaacaagtgatgacttgctctccgtgtaacggaactggggagatatcaaaaccgtgtggtgcatgctcaggagatggacgtgtgagaaggacaaagcggattagtcttaaagttcctgcgggtgtggattctggaagtaggttaagagtgaggggagaagggaatgcaggaaagagaggtggatcaccgggagatctctttgcggttattgaggttattccagatccggttttgaagcgtgatgatacaaatatactttatacgtgtaagatatcgtatgtagatgccatattggggacgactttgaaggtaccaacagtggatggagaggtggatttgaaagtaccggcagggacacaaccaagcacgacattggtgatggctaaaaaaggagttccggttttgaataagagcaagatgagaggtgatcagttagtgagagtgcaagttgagattcctaagagattgagtaaagaagagaagatgcttgttgaggagctggctgatatgagcaagaacaaggtagctaatagcaggagataa

SEQ ID NO: 2228 - protein, 447 aa, Arabidopsis thaliana
MALIQFGSSCVAQWGILRPRFAVKAFYPSRLESHQDNCISQINCLGASRSSMFAQGSLPFLSLTGVSPNTHSRRGARFTVRADTDFYSVLGVSKNATKAEIKSAYRKLARSYHPDVNKDAGAEDKFKEISNAYEILSDDEKRSLYDRYGEAGVKGAGMGGMGDYSNPFDLFESLFEGMGGMGGMGGGMGSRGSRSRAIDGEDEYYSLILNFKEAVFGIEKEIEISRLESCGTCNGSGAKAGTKPTKCKTCGGQGQVVASTRTPLGVFQQVMTCSPCNGTGEISKPCGACSGDGRVRRTKRISLKVPAGVDSGSRLRVRGEGNAGKRGGSPGDLFAVIEVIPDPVLKRDDTNILYTCKISYVDAILGTTLKVPTVDGEVDLKVPAGTQPSTTLVMAKKGVPVLNKSKMRGDQLVRVQVEIPKRLSKEEKMLVEELADMSKNKVANSRR

SEQ ID NO: 2229 - DNA, 852 bp, Arabidopsis thaliana
atgcccaagatctgctgctctcgttccgctacacaagttgtggtagcacaaaaatcaaactcgggtaaaggaagaaacggtgaaggaggaatcaagtatggatttagtttgataaaagggaaatctaaccattcaatggaggattatcatgttgctaagtttaccaatttcaatggcaatgaattggggctttttgcaatctttgatggtcataaaggtgatcatgttgctgcttatctgcagaaacatctcttctctaatatccttaaagatggagagttcttggttgatcctcgaagagcaattgcgaaagcttatgagaatacagatcaaaagattttagcagataatagaacggatttagagagtggtggttcgactgctgtgactgcgattttgatcaatgggaaagctttgtggatagctaatgttggtgattcacgagctattgtttctagtcgaggtaaagcaaaacagatgagtgttgatcatgatcctgatgatgatactgagaggagtatgattgagagtaaaggtggatttgtgaccaacagaccaggtgatgttcctcgagtgaacggtttgttagcggtctctcgtgtctttggagataaaaaccttaaagcatatttgaactcagagcctgagattaaggacgtaaccattgatagtcacacagattttcttattctggctagtgacggtatttcgaaggtgatgtcaaaccaagaagcagttgatgtagctaagaagttgaaagatccaaaggaagcggcgaggcaagtagttgctgaagcattgaaaagaaacagcaaggatgacatatcttgcattgttgtccggtttagatga

SEQ ID NO: 2230 - protein, 283 aa, Arabidopsis thaliana
MPKICCSRSATQVVVAQKSNSGKGRNGEGGIKYGFSLIKGKSNHSMEDYHVAKFTNFNGNELGLFAIFDGHKGDHVAAYLQKHLFSNILKDGEFLVDPRRAIAKAYENTDQKILADNRTDLESGGSTAVTAILINGKALWIANVGDSRAIVSSRGKAKQMSVDHDPDDDTERSMIESKGGFVTNRPGDVPRVNGLLAVSRVFGDKNLKAYLNSEPEIKDVTIDSHTDFLILASDGISKVMSNQEAVDVAKKLKDPKEAARQVVAEALKRNSKDDISCIVVRFR

SEQ ID NO: 2231 - DNA, 1137 bp, Arabidopsis thaliana
atgatgcttgttcgatctgtatttcgatctcagttgcgaccctctgtctcgggtggtctgcaatctgcttcttgctattcttcattatctgctgcttcagctgaagctgagaggactatcagagaaggtcccagaaacgattggagtagagatgaaatcaagtctgtttatgattctcctcttcttgacctcctcttccatggagctcaggttcatagacatgttcataacttcagggaggtacaacaatgtaccctcctctccataaagactggtggctgtagtgaagactgttcatattgtcctcagtcttcgagatatagcactggagttaaggcacaaagactcatgtctaaggacgctgtcattgatgctgctaagaaggcaaaagaagctgggagcacacgtttttgcatgggtgctgcttggcgagatacaattggacggaaaaccaacttcagccagattcttgaatacatcaaagaaataagaggcatggggatggaagtttgctgcaccttaggcatgattgagaaacaacaagcactagagctaaagaaggctggcctcactgcttataaccacaatcttgatacttcaagagagtactacccaaacgtcatcactactagaagttatgacgatcgccttgaaactcttagccatgttcgtgatgctggaatcaacgtttgttcaggaggaatcatagggcttggtgaggcagaggaagacagaataggtttattacacacgctggcaacacttccttctcaccctgagagtgttcccattaatgctctacttgcagtgaaaggcactcctcttgaagaccagaagccagttgagatatgggagatgatcaggatgattggaaccgcacgtattgtaatgccaaaagcgatggtgagactgtctgctggtagagtccggttctcaatgtccgaacaagctctctgtttccttgctggtgcaaactctatcttcaccggagagaagcttttaaccacaccaaacaatgattttgacgctgaccagctcatgttcaagacattaggcctcattcctaaaccgccaagtttctctgaagatgattctgaatcagaaaactgcgagaaagttgcttccgcttctcactaa

SEQ ID NO: 2232 - protein, 378 aa, Arabidopsis thaliana
MMLVRSVFRSQLRPSVSGGLQSASCYSSLSAASAEAERTIREGPRNDWSRDEIKSVYDSPLLDLLFHGAQVHRHVHNFREVQQCTLLSIKTGGCSEDCSYCPQSSRYSTGVKAQRLMSKDAVIDAAKKAKEAGSTRFCMGAAWRDTIGRKTNFSQILEYIKEIRGMGMEVCCTLGMIEKQQALELKKAGLTAYNHNLDTSREYYPNVITTRSYDDRLETLSHVRDAGINVCSGGIIGLGEAEEDRIGLLHTLATLPSHPESVPINALLAVKGTPLEDQKPVEIWEMIRMIGTARIVMPKAMVRLSAGRVRFSMSEQALCFLAGANSIFTGEKLLTTPNNDFDADQLMFKTLGLIPKPPSFSEDDSESENCEKVASASH

SEQ ID NO: 2233 - DNA, 1335 bp, Arabidopsis thaliana
atggtgagaaggcaagaggaggagaagaaggcggagaagggaatgcgtctggggaaatacgagctagggaggacgctcggcgagggtaatttcggtaaagttaaattcgctaaagataccgtctccggtcattccttcgccgttaaaatcatcgacaagtctcgtatcgccgatctcaacttctccttacagataaaaagagagatccggactctgaaaatgttgaaacatccccacattgttagattacatgaggtcttggctagcaaaacgaaaattaatatggtaatggaacttgttaccggaggagaattgttcgacagaattgtttccaacggaaaattaacagaaactgatggaagaaaaatgtttcagcagcttatcgatggaatcagctactgtcatagcaaaggtgttttccacagggatctcaagctagagaatgttcttcttgatgcaaagggacatataaagatcactgattttggcctcagtgctctgcctcagcattttagggatgacggattgttgcatacaacctgtggaagtcctaattacgttgcgcctgaggttttagctaacagaggctacgatggtgcagcatcagacatatggtcctgtggtgtaatcttgtatgtgattctaaccggatgtcttcctttcgacgacagaaaccttgcagttctttaccagaagatatgtaaaggagacccaccaataccaagatggttatccccgggtgcaagaaccatgattaagagaatgcttgatccaaatccagtcacgaggatcacagttgtgggtattaaagccagcgagtggttcaaacttgagtacattccttcaattcccgatgatgatgacgaagaagaagttgacacagacgatgatgctttctcaatccaagaactcggatcagaagaagggaagggcagtgattcaccgaccatcatcaatgcgtttcagttaatcggaatgtcttcctttcttgacctgtccggtttctttgaacaagagaatgtatcagagaggagaataagattcacttcaaatagctcagcaaaagatttactggagaaaatcgaaacagccgttacagaaatgggattcagtgtacaaaagaaacatgccaagttaagagtaaaacaagaagaaagaaaccagaaaggtcaagttggtttatcagtaacagctgaggttttcgagataaagccgtcactgaacgtggttgagctaagaaaatcttatggcgattcatgtttatatagacagttgtacgagagactattaaaagacgtgggcacatcctcgccggagcaagagatagtaacttag

SEQ ID NO: 2234 - protein, 444 aa, Arabidopsis thaliana
MVRRQEEEKKAEKGMRLGKYELGRTLGEGNFGKVKFAKDTVSGHSFAVKIIDKSRIADLNFSLQIKREIRTLKMLKHPHIVRLHEVLASKTKINMVMELVTGGELFDRIVSNGKLTETDGRKMFQQLIDGISYCHSKGVFHRDLKLENVLLDAKGHIKITDFGLSALPQHFRDDGLLHTTCGSPNYVAPEVLANRGYDGAASDIWSCGVILYVILTGCLPFDDRNLAVLYQKICKGDPPIPRWLSPGARTMIKRMLDPNPVTRITVVGIKASEWFKLEYIPSIPDDDDEEEVDTDDDAFSIQELGSEEGKGSDSPTIINAFQLIGMSSFLDLSGFFEQENVSERRIRFTSNSSAKDLLEKIETAVTEMGFSVQKKHAKLRVKQEERNQKGQVGLSVTAEVFEIKPSLNVVELRKSYGDSCLYRQLYERLLKDVGTSSPEQEIVT

SEQ ID NO: 2235 - DNA, 537 bp, Arabidopsis thaliana; identical to SEQ ID NO: 1773

SEQ ID NO: 2236 - protein, 178 aa, Arabidopsis thaliana; identical to SEQ ID NO: 1774

SEQ ID NO: 2237 - DNA, 966 bp, Arabidopsis thaliana
atgaggatattaccgaaaagcggaggaggtgctctttgcctcctctttgtgtttgctctttgttcggtggctcattcccttagctgtgacgtcaaggttgttggcgatgtcgaagtcattggctactcagaaatcagcaaaatcaagatccccaatgcattctcaggacttcgagttacgatagaatgcaaggcggccgattcaaaaggccattttgtaacgaggggaagcggagaagtggacgaaacaggaaagtttcatcttaatattcctcatgacattgtcggtgatgacggaactctaaaagaagcttgctatgctcatcttcaaagtgccttcggcaacccttgtccggcccacgatggccttgaggcctccaagatcgtgtttctatcgaaatccggccaaaaccacgttttgggtctcaaaaaaagtcttaaattctcaccagaagtttgcatctcaaagttcttttggcatatgcctaagttccctttacctcctccgcttaatctcccaccgttaacgtttcctaagatcaagaagccttgtcccccaatttacaaaccaccggtggtgatccctaagaagccgtgtccaccaaagattgcacataaacccatctacaagccgccggttcccatctacaagcctccagtgcctatctacaagccaccagtggttatccccaagaaaccgtgtccaccaaagatacacaagcccatctacaagccacccgtgcctatctacaagcctccagtggtgatcccaaagaagacatttcctccacttcacaagccgatctacaagcacccggttcctatctacaaaccaatcttcaagccgccagtggtggtgattccaaagaaaccatgtccaccacttcccaagtttccacacttcccacctaaatacattccacaccctaagttcggaaaatggcctcctttcccttctcatccttga

SEQ ID NO: 2238 - protein, 321 aa, Arabidopsis thaliana
MRILPKSGGGALCLLFVFALCSVAHSLSCDVKVVGDVEVIGYSEISKIKIPNAFSGLRVTIECKAADSKGHFVTRGSGEVDETGKFHLNIPHDIVGDDGTLKEACYAHLQSAFGNPCPAHDGLEASKIVFLSKSGQNHVLGLKKSLKFSPEVCISKFFWHMPKFPLPPPLNLPPLTFPKIKKPCPPIYKPPVVIPKKPCPPKIAHKPIYKPPVPIYKPPVPIYKPPVVIPKKPCPPKIHKPIYKPPVPIYKPPVVIPKKTFPPLHKPIYKHPVPIYKPIFKPPVVVIPKKPCPPLPKFPHFPPKYIPHPKFGKWPPFPSHP

SEQ ID NO: 2239 - DNA, 1131 bp, Arabidopsis thaliana
atggcgattcggaaggaggaagaaagtagagaagaacagagcaattcgtttcttcttgatgctctctactgcgaagaagagaaatgggacgatgaaggagaagaagttgaagaaaactcttccttgtcttcttcttcttctccattcgttgttttgcaacaagatttgttctgggaagatgaagatctggttacactcttctccaaagaagaagaacaaggactcagctgtctcgatgatgtttatctttccacggatcgaaaagaagctgttggttggattctgagagtcaacgctcattatggcttctctactttagcagctgttttagccataacttatctcgataagttcatctgtagctacagcttacagagagacaaaccatggatgcttcagctcgtttctgtcgcgtgtctctcattagctgctaaagtcgaagaaacccaagtccctcttcttctagactttcaagtggaggagacaaagtatgtgtttgaagcaaaaaccatacagagaatggagctactgattctgtctactctcgagtggaagatgcatctcattactccaatttcgttcgtagaccacattatcaggagattgggacttaagaacaatgctcactgggatttcctcaacaaatgccaccgtctcctcctctctgtaatctccgattcaagatttgtcgggtacctcccatcagtagttgccgcagctaccatgatgcgaattatagagcaagttgatccctttgaccctctttcataccaaactaatctcctcggtgtccttaacttaaccaaggaaaaggtgaaaacttgctacgatctaatcctccaactaccagtggaccgcatcggtttacagatccaaatccaatcttccaagaaacgcaagagtcacgattcatcatcatcgttgaacagtccaagctgcgtgattgatgcaaaccctttcaatagcgacgaaagctcaaacgattcgtggtcagcgagttcgtgcaacccaccaacgtcgtcgtcgtccccgcagcaacaacctccattgaagaagatgagaggagctgaagagaatgagaagaagaagccgattttgcatctgccatgggcaatcgtagccactccataa

SEQ ID NO: 2240 - protein, 376 aa, Arabidopsis thaliana
MAIRKEEESREEQSNSFLLDALYCEEEKWDDEGEEVEENSSLSSSSSPFVVLQQDLFWEDEDLVTLFSKEEEQGLSCLDDVYLSTDRKEAVGWILRVNAHYGFSTLAAVLAITYLDKFICSYSLQRDKPWMLQLVSVACLSLAAKVEETQVPLLLDFQVEETKYVFEAKTIQRMELLILSTLEWKMHLITPISFVDHIIRRLGLKNNAHWDFLNKCHRLLLSVISDSRFVGYLPSVVAAATMMRIIEQVDPFDPLSYQTNLLGVLNLTKEKVKTCYDLILQLPVDRIGLQIQIQSSKKRKSHDSSSSLNSPSCVIDANPFNSDESSNDSWSASSCNPPTSSSSPQQQPPLKKMRGAEENEKKKPILHLPWAIVATP

SEQ ID NO: 2241 - DNA, 1440 bp, Arabidopsis thaliana
atggccaaaaccagagggtcttgttgtctcgtcaacgctctaatcgctatagcttttttggcgacagcccatttgtgtgaagctggcttgtctcagaaagaacaggacaaggtctcgaaattgcctggtcagaattttaatgttagttttgctcactactctgggtttgttgctactaatgagcaattgggaagagctctcttttactggttatttgaagccgttgaagatgctaagtctaagcctcttgttctctggctcaatggaggaccaggatgttcatctgttgcatatggtgaagcagaagagataggaccatttcacattaaggcagatgggaagactctttaccttaatcaatattcttggaaccaagctgcaaatattttgttccttgatgcacctgttggagttggttattcatactcaaacacctcgtctgatttgaagagcaatggtgataaaagaactgccgaagattcactgaaatttctgctgaaatgggttgagcggtttccggaatacaaaggaagggacttttatatagtaggggagagctatgcaggacattacattcctcagctgagtgaagccattgtaaaacataaccaaggttctgacaaaaacagtataaatctgaagggttacatggtaggaaatgggctgatggacgatttccatgacaggcttggtcttttccaatatatttggtcgttgggttttatatctgaccaaacatacagcttactgcaacttcaatgcggtttcgaatcgtttattcactcctccaaacagtgtaacaagattctggagatagcggacaaagaaataggtaacatagaccaatacagtgtcttcaccccagcttgtgttgccaatgcttcccagtcaaatatgttgctaaagaaaagacctatgactagccgcgtgagcgaacagtatgatccttgtacggagaaacacactacagtttatttcaatcttccagaggttcaaaaagccctccatgtcccaccaggacttgcaccatcaaaatgggatacttgcagtgatgtcgtgagtgaacactggaatgactctccttcctcggttctaaacatttaccacgagcttatagctgctgggcttcgtatctgggttttcagtggggacgcagatgccgttgtaccagtcacatcaacccggtacagtatcgatgcactaaaccttcgtcctttgagtgcctatggtccttggtacttagatggacaggtgggagggtggagtcagcagtatgctggtctgaactttgtgacagtgagaggtgcaggccatgaagttcctttgcacagaccgaagcaagctcttgcgctcttcaaggcttttatatctggaactccattgtccacacatgagaacagcatcagccgcgacatgtctgaactcgttagtgactcataa

SEQ ID NO: 2242 - protein, 479 aa, Arabidopsis thaliana
MAKTRGSCCLVNALIAIAFLATAHLCEAGLSQKEQDKVSKLPGQNFNVSFAHYSGFVATNEQLGRALFYWLFEAVEDAKSKPLVLWLNGGPGCSSVAYGEAEEIGPFHIKADGKTLYLNQYSWNQAANILFLDAPVGVGYSYSNTSSDLKSNGDKRTAEDSLKFLLKWVERFPEYKGRDFYIVGESYAGHYIPQLSEAIVKHNQGSDKNSINLKGYMVGNGLMDDFHDRLGLFQYIWSLGFISDQTYSLLQLQCGFESFIHSSKQCNKILEIADKEIGNIDQYSVFTPACVANASQSNMLLKKRPMTSRVSEQYDPCTEKHTTVYFNLPEVQKALHVPPGLAPSKWDTCSDVVSEHWNDSPSSVLNIYHELIAAGLRIWVFSGDADAVVPVTSTRYSIDALNLRPLSAYGPWYLDGQVGGWSQQYAGLNFVTVRGAGHEVPLHRPKQALALFKAFISGTPLSTHENSISRDMSELVSDS

SEQ ID NO: 2243 - DNA, 876 bp, Arabidopsis thaliana
atgattcaagacaagtctaaaggtgcaaagcaaacgcttctagagcggccatggttcctcgctgtggctctagctggtcttataggtggcgcaatgctcatcacaagcttcatccgagctacggacaacaccttgtcactctgctccacggctaagaacacagctgcgtctatagccaaatacacagccaccccaatccaactccaatccatcgtccactacgccacttcacacaccgtccctcaacaatctttcgaggagatctcgatctctttaaacgtcctcaaggagcgtctcccttgtaactttctagtctttggcctcggccgcgactccctcatgtgggcctccctcaatccaggtggcacaactgtgttcttggaagaggatcctgagtggatagaggccgtcctcaaggacgccccatccctcagggcccaccatgttcagtaccggacccacctttctgaggccggccgccttctctcgacttacaagaacgaacccatgtgtttaccagctaaagctttcccgatccgctacaacgaaaagtgtcccttggcgttgacttctctccctgatgagttctatgataccgagtgggatctgatcatggtggacgcaccaaaagggtacttcccagaggcgccaggaaggatggcggcgatattttcctcggccatcatggcacgtaaccggaaaggtgatggcacgactcacgtcttccttcatgacgttaaccgcaaagtggagaacgcttttgccaatgagttcctttgtgagaagtataaggtcaactccgtaggtaggctctggcacttcgagatacctaacgccgctaacatgaccgaccagcctggtgaccggttttgctag

SEQ ID NO: 2244 - protein, 291 aa, Arabidopsis thaliana
MIQDKSKGAKQTLLERPWFLAVALAGLIGGAMLITSFIRATDNTLSLCSTAKNTAASIAKYTATPIQLQSIVHYATSHTVPQQSFEEISISLNVLKERLPCNFLVFGLGRDSLMWASLNPGGTTVFLEEDPEWIEAVLKDAPSLRAHHVQYRTHLSEAGRLLSTYKNEPMCLPAKAFPIRYNEKCPLALTSLPDEFYDTEWDLIMVDAPKGYFPEAPGRMAAIFSSAIMARNRKGDGTTHVFLHDVNRKVENAFANEFLCEKYKVNSVGRLWHFEIPNAANMTDQPGDRFC

SEQ ID NO: 2245 - DNA, 606 bp, Arabidopsis thaliana
atgtccgtcgttctcaacgccggcttcagttctccgcttcaaaacagatcacatcatgttatacagttaaagccttcgccttttgcgtcatacatatctctaaacagttcaagaaggtcactgttatgcaaaagaagattggttgtatcttgtttggatacaaatgacaattctgtcacaactacatccgtagattcttcttcttcttcagattctaataaaccagtaagtgaatcagttgaatcaagcaatggcactgccaaaaaagcaccattgacagcacgagagagactaagagcggctcgtgttcttagccgatacactgaagcaacaccgaaaccgtcaaaacctaaaatggggagccaacttcttgatgtgctcaaggaaagtgataagaaatcaaagaggaaaccgggtctacccgaagcaccaactaacatgcttgatgatagcaggagagggatgccaaagagcggtcttacgtttgatttaccgggaggctcggatattctcatcattgctttctcctttgtgttcataagcacagtcatgtttgctactacttttcttgtttggaaactcggtgcgatacacttcaacgaatag

SEQ ID NO: 2246 - protein, 201 aa, Arabidopsis thaliana
MSVVLNAGFSSPLQNRSHHVIQLKPSPFASYISLNSSRRSLLCKRRLVVSCLDTNDNSVTTTSVDSSSSSDSNKPVSESVESSNGTAKKAPLTARERLRAARVLSRYTEATPKPSKPKMGSQLLDVLKESDKKSKRKPGLPEAPTNMLDDSRRGMPKSGLTFDLPGGSDILIIAFSFVFISTVMFATTFLVWKLGAIHFNE

SEQ ID NO: 2247 - DNA, 2046 bp, Arabidopsis thaliana
atggccatggcttctgctatggacttatcttctcctccaacgtttttcttatccggaacttctacatcttccccatctctccgtcgtctctcctccatttccgtctctggattccgccgtcactctaatcggaagttacagatactttgccaagccacagctggaactgagcctcagagcggtctctctgtctctggctccaaattagccgcccgttctggtcaagaccgtcttttgaaggttccaatttcgaacatcaggaattttagtattatagctcatattgatcatgggaaatctacgttagcggataagttgcttcaggtgactggtactgttcagaacagagatatgaaggagcagtttcttgataacatggacttagagagagaacgaggcatcactatcaagcttcaggcagctcgaatgcgttatgtttatgaagatacaccgttttgcctcaacttgatagatactccaggtcatgttgatttctcttacgaggtttcccgatctcttgctgcttgcgagggtgctcttcttgttgtggatgcatcccagggtgtggaagcacaaacattggctaatgtgtatttggccttggaaaacaacctcgaaattattcccgttttaaataagattgaccttccaggcgctgagccagagaaagttctcagggagattgaggaggttattgggttagattgtagcaaagcgatattctgttcggcaaaggagggaattggtattaccgagattttggatgcaattgttcaaaggatacctgcacctctcgatactgcaggaaagcccttaagagctttaatttttgacagttattatgatccatatcgtggtgtcattgtatactttcgagttatcgatgggaaagtgaagaaaggcgacagaatttttttcatggcaagcggaaaggattattttgcggatgaagtcggagttctatctccaaatcaaattcaagtggatgaattatatgcgggtgaggtaggatatattgcggcttctgtaagatctgttgcagatgccagggtaggagatacaataacacattatagcagaaaggcagaaagctctttacctggttacgaggaagctacccctatggtgttctgtggtctttttccagttgacgctgaccagtttcccgatcttcgcgatgcattggaaaaactgcaactcaatgatgctgcattgaagtttgagcctgaaacttcgagtgccatgggatttggctttagatgcgggtttttgggtcttctccacatggaaattgtgcaggaaaggctagagagggagtacaacttaaatcttattaccacagctccaagtgttgtttatagggtgaactctgtaaatggtgatactactttgtgctcaaatccatcacgccttccagatcctgggcaaaggaaatcggtcgaggagccatacgttaagattgaactgctcacaccaaaagactatattggtgcgcttatggagctcgctcaagagaggagaggggagttcaaagaaatgaaatatatagctgagaacagagcttcaatcctctatgagttacctcttgcagagatggtgggtgatttctttgaccaattgaagtcgagaaccaagggatatgctagcatggaatactccgttattgggtacagggaaagtgatctgataaaactcgatattctgattaatgctgaaatggtggaacctttgtcaaccatcgtacacagggataaggcatattccgttgggagagctttgactcagaaactcaaagagcttattccacgacaaatgtttaaagtgcccatccaggcttgtataggatccaaggtgattgctagtgaagcactctcagcaatcagaaaagatgttttggcaaaatgttatggtggagatatttctcggaagaagaagcttcttaagaaacaggcggcaggtaagaagagaatgaaagccataggtagagttgatgtccctcaagaagctttcatggccgttctcaaacttgaacgagaagtattgtga

SEQ ID NO: 2248 - protein, 681 aa, Arabidopsis thaliana
MAMASAMDLSSPPTFFLSGTSTSSPSLRRLSSISVSGFRRHSNRKLQILCQATAGTEPQSGLSVSGSKLAARSGQDRLLKVPISNIRNFSIIAHIDHGKSTLADKLLQVTGTVQNRDMKEQFLDNMDLERERGITIKLQAARMRYVYEDTPFCLNLIDTPGHVDFSYEVSRSLAACEGALLVVDASQGVEAQTLANVYLALENNLEIIPVLNKIDLPGAEPEKVLREIEEVIGLDCSKAIFCSAKEGIGITEILDAIVQRIPAPLDTAGKPLRALIFDSYYDPYRGVIVYFRVIDGKVKKGDRIFFMASGKDYFADEVGVLSPNQIQVDELYAGEVGYIAASVRSVADARVGDTITHYSRKAESSLPGYEEATPMVFCGLFPVDADQFPDLRDALEKLQLNDAALKFEPETSSAMGFGFRCGFLGLLHMEIVQERLEREYNLNLITTAPSVVYRVNSVNGDTTLCSNPSRLPDPGQRKSVEEPYVKIELLTPKDYIGALMELAQERRGEFKEMKYIAENRASILYELPLAEMVGDFFDQLKSRTKGYASMEYSVIGYRESDLIKLDILINAEMVEPLSTIVHRDKAYSVGRALTQKLKELIPRQMFKVPIQACIGSKVIASEALSAIRKDVLAKCYGGDISRKKKLLKKQAAGKKRMKAIGRVDVPQEAFMAVLKLEREVL

SEQ ID NO: 2249 - DNA, 1644 bp, Arabidopsis thaliana
atgagggcgttgaattcgcggctagttctgatcgacatcaacagctcctggcaagcttcgcgccggttaatctcagccaccgcaaccgctttttcatctgattcctcttcctcattccgtcggacacgtggtgcgcgtcagagaatcgcttcatcgaaatccccggcgtcgtcaccgtctcctgttcggagaccatctgatggattcagtttcgatgttcggtcaccgtcatctgattcatcgatctcatcacggaagtcaccgacgacggctccgcctacggtggagctcgacgctttcctagagattcttcctccggcgacgaggaaggagcttgttaagcacgaggcgattgaggaattgatcgaagtagtgatggatttagggagaaagccacttgctagattcccttccggcgattgggtgatctcagagcagcctgtgacacaccaggatctggagcttgcggtatcaaaggttggtgatttttcggatgataaccgatccgggattgacagatctttgcatcgtataagcgctatacgtaatcgcaaactgcaagtaattggtctaacatgtcgagtgggtcgagtagtctctggaagtgcagaaattataagagacttgattgaaggaggaggatccatcttggtcattggatctcctggagttggcaaaacaactttaatcagagaaattgcacggatgttagctgatgaacacaggaaacgtgtagtgattgttgacacgtcaaatgagattggaggtgatggtgatgttcctcattctggaattggtcgtgccaggcggatgcaagttccaaatgtgaatttacagcacgatgttatgattgaggcggttgagaatcatatgcctgagacaatcatcattgacgagataggaactgagcttgaagctttagctgctagcactattgctcaacgaggtgttcagcttgttgcaactgctcatgggatgactatagacaacataatcaaaaatccttctttgcagattcttattggtggaattgagagtgtgactcttggtgatgaagaagcaaggaaaagaaaagtgcagaagacaattcttgaaagaaaaggacctccgacattcacttgtgctgtagagatgatatcgagaactgagtgtcgtgttcatcaaagactagatgttaccgttgatgctatactagctgggaaatccgctccatttgagatccgtcaaattcgtggcgaagacgatgttcctcataagttagtgactcccattcctttggagaaccttgaagaggagcctgcaccattgctcaacagagatttcgtaagtgaattgctgtctgacgatgaagatgaagattttcttctcattcggtctaataaggccagaagtaacacatacacgagcccaagaagctcaccggttcatgtgtatacttacaatgtccttgaagctgatctcctccaagtagctgaagttatgggtctagacgacgaaatagaagtgacagatgatgttggagaagcagatgtcattctagcctcaagttctgaattgaaacagaattcatcaatccgtcgtgttgccaaattacacaagctaccgatatttgtcattaaggtatccttctttttgcatggctga

SEQ ID NO: 2250 - protein, 547 aa, Arabidopsis thaliana
MRALNSRLVLIDINSSWQASRRLISATATAFSSDSSSSFRRTRGARQRIASSKSPASSPSPVRRPSDGFSFDVRSPSSDSSISSRKSPTTAPPTVELDAFLEILPPATRKELVKHEAIEELIEVVMDLGRKPLARFPSGDWVISEQPVTHQDLELAVSKVGDFSDDNRSGIDRSLHRISAIRNRKLQVIGLTCRVGRVVSGSAEIIRDLIEGGGSILVIGSPGVGKTTLIREIARMLADEHRKRVVIVDTSNEIGGDGDVPHSGIGRARRMQVPNVNLQHDVMIEAVENHMPETIIIDEIGTELEALAASTIAQRGVQLVATAHGMTIDNIIKNPSLQILIGGIESVTLGDEEARKRKVQKTILERKGPPTFTCAVEMISRTECRVHQRLDVTVDAILAGKSAPFEIRQIRGEDDVPHKLVTPIPLENLEEEPAPLLNRDFVSELLSDDEDEDFLLIRSNKARSNTYTSPRSSPVHVYTYNVLEADLLQVAEVMGLDDEIEVTDDVGEADVILASSSELKQNSSIRRVAKLHKLPIFVIKVSFFLHG

SEQ ID NO: 2251 - DNA, 546 bp, Arabidopsis thaliana
atggccgcgtctctaacatctcttccgaccggtttttgtcttagccatggtgatgaatgttgcaaccgttcacctaccaaatcaccatttccaggccatcatcctctggctgggaggaggaagggtcacttgctccattacgaacgtagtacagtgaggagattggttgtgacggcggcgacggagggatctaaaaaatctaaagaaagtgaaccgtcttgggcgaatcctgactcagatgagccacctccttgggctagaaacgaaggtcgttcttctacgtcccaagagagctttgaggttcctttctttgtttatctgctagcttccgcgattactgccattgctgctattggttctgttttcgagtacacaagcaagaatccagttttcgggatcttggaatctgacagcatcttttatactcctgtgcttggattctttgctcttactggaatccccacttctgtgttcctatggttcaaatccgttgaagctgctaataaggaagctcaagaacaagataaaagagatggctttctttaa

SEQ ID NO: 2252 - protein, 181 aa, Arabidopsis thaliana
MAASLTSLPTGFCLSHGDECCNRSPTKSPFPGHHPLAGRRKGHLLHYERSTVRRLVVTAATEGSKKSKESEPSWANPDSDEPPPWARNEGRSSTSQESFEVPFFVYLLASAITAIAAIGSVFEYTSKNPVFGILESDSIFYTPVLGFFALTGIPTSVFLWFKSVEAANKEAQEQDKRDGFL

SEQ ID NO: 2253 - DNA, 1068 bp, Arabidopsis thaliana
atggagagtacggtggaaagagaggcgtggaaagctcacgtggcgatgatcggtgtgcaattgttcaacggaggatatcatgtcattaccaaagtggctctcaacgttggtgtaaaccaacttgtcttctgtgtctttcgtgatctcattgctctctccattcttgctcctcttgcttatatccgtgataagagaacaagacctcctttgaatcgacagtttctcttagctttcttcttccttggtttaacagggatatttggtaatcagcttttgttcctcattggtctgaattacaccaatccaacttatgctgcagccattcagccgtcgatcccggtttttactttcatcttggctctcattatgggaacagagagactgaatttattcaagctagaaggtcaagctaaggtaggaggcacactgatttgtgtcgctggggcggtgctgatggttttgtttcgtggactggctttgtttggggaaacagaggctgagtccttgggtcatggtgaatcaagacacactgaaacatctggacacttcatgcatgctccggtcttaaagaagtatccggcgaatctttcagtcacagcatactcgtatttctttgggaccatgtttatggtgacatctgcttttttcatgactaatgagtcgacgaactggagtctcacaagatccgagttctttgcagttgtctacgcaggagtaatcgcgtctgctctcaactatggtctcttgacatggtcaaataagatcttgggtccttccttggttgctctctataatcctcttcaacccgcagcctcagctttcttgtccagaatcttccttggaagccctatctacttggggagcattttaggcggatgtgcaatcatagcaggtctttatagtgtcacctgggcatcttacaaagaaaagaaagcggcagcagcaatggctgtgatcccgatcacctcaaaggaagctgaacccttgatctacaaggaccataaaaacaaaccaataggacatctattcacaaaatctcccatctcttcaccaaaatccgatgattga

SEQ ID NO: 2254 - protein, 355 aa, Arabidopsis thaliana
MESTVEREAWKAHVAMIGVQLFNGGYHVITKVALNVGVNQLVFCVFRDLIALSILAPLAYIRDKRTRPPLNRQFLLAFFFLGLTGIFGNQLLFLIGLNYTNPTYAAAIQPSIPVFTFILALIMGTERLNLFKLEGQAKVGGTLICVAGAVLMVLFRGLALFGETEAESLGHGESRHTETSGHFMHAPVLKKYPANLSVTAYSYFFGTMFMVTSAFFMTNESTNWSLTRSEFFAVVYAGVIASALNYGLLTWSNKILGPSLVALYNPLQPAASAFLSRIFLGSPIYLGSILGGCAIIAGLYSVTWASYKEKKAAAAMAVIPITSKEAEPLIYKDHKNKPIGHLFTKSPISSPKSDD

SEQ ID NO: 2255 - DNA, 1434 bp, Arabidopsis thaliana
atggctttgactacaaaacctcaccatcttcagagatctttcctctctccgtcgcgtgtttccggcgaacgatatttggaatctgcgccatcatgtctgagattccgtcgcagcggtgtccaatgctcggtggtggctaaggagtgcagagtgaaaggagtgaaagcgagacagattattgatagtagagggaatccgacggtggaggttgatctgattaccgatgatctgtatcgttcggctgttccaagtggtgcatctaccgggatctacgaagcgcttgagcttagagatggagacaagagcgtctatggtggtaaaggtgtattacaggctattaaaaacatcaatgaacttgtggctccaaaactcattggagttgacgttaggaaccaagctgatgtcgatgctcttatgctggaactggatgggaccccaaacaagtcgaaactcggggctaatgcgatattaggagtgtcattgagcgtttgcagggcaggtgctggagctaaaggagtgcctttgtacaaacacatccaggaaacatcaggaacaaaggagcttgtcatgccagttcctgcattcaatgtgatcaatggaggcagtcatgctgggaatagtttggctatgcaagagtttatgatactacctgtaggagctacctcattctcggaggccttccagatgggaagtgaagtttatcatacattgaaggggataatcaaaactaagtatggtcaagatgcttgtaatgtcggagatgaaggagggtttgcgccgaatgttcaagataacagagagggactagttctgctcatagatgcaattgaaaaggccggttacactggaaagatcaaaataggaatggatgttgctgcatcagaatttttcatgaaagatggtagatacgatttgaacttcaagaaacagccaaacgatggagctcacgtactgtcagccgagagtcttgctgacctctacagagaattcatcaaggatttcccaattgtctctatcgaagatccttttgaccaggatgattggagctcatgggcttcattgcaatcctctgtggatatccaactcgtgggagatgacttgttagtcactaacccgaagaggatagctgaagctattaagaaacagtcttgcaatgctctactcttgaaggttaaccagattgggacagtcactgagtcaattcaagcagcacttgactcaaaagctgcaggctggggtgtgatggttagtcacaggagtggcgagacagaggataacttcatcgcagatctctctgttggtttagcaagcggacagatcaaaactggtgctccatgccgaagtgaacgattgtcaaaatacaaccagcttctccgtatcgaagaggaactcggcaatgtgcgctacgccggtgaagctttccgatcaccatga

SEQ ID NO: 2256 - protein, 477 aa, Arabidopsis thaliana
MALTTKPHHLQRSFLSPSRVSGERYLESAPSCLRFRRSGVQCSVVAKECRVKGVKARQIIDSRGNPTVEVDLITDDLYRSAVPSGASTGIYEALELRDGDKSVYGGKGVLQAIKNINELVAPKLIGVDVRNQADVDALMLELDGTPNKSKLGANAILGVSLSVCRAGAGAKGVPLYKHIQETSGTKELVMPVPAFNVINGGSHAGNSLAMQEFMILPVGATSFSEAFQMGSEVYHTLKGIIKTKYGQDACNVGDEGGFAPNVQDNREGLVLLIDAIEKAGYTGKIKIGMDVAASEFFMKDGRYDLNFKKQPNDGAHVLSAESLADLYREFIKDFPIVSIEDPFDQDDWSSWASLQSSVDIQLVGDDLLVTNPKRIAEAIKKQSCNALLLKVNQIGTVTESIQAALDSKAAGWGVMVSHRSGETEDNFIADLSVGLASGQIKTGAPCRSERLSKYNQLLRIEEELGNVRYAGEAFRSP

SEQ ID NO: 2257 - DNA, 624 bp, Arabidopsis thaliana
atggcgctaaaccctcaattactacccaatgggatgcctgttccctttgttaatgaaatgttcgtcctagtccgagatggtgttgagtttgaagtcgacaagatccctggagggcatggaggtcatgttaaggccaagggggtgatttacttgtctaatatacggatggtctttgtttcaagcaagcctgttgacaactttgttgcttttgacatgcccctgctttacatccatgccgagaaatttaatcagccaatatttcactgcaacaatattgctggacaagtggagcctgtggtgccagaaaatgagcatagagctctatattcaacacacagtttcaagatcctatttaaggaaggtggttgtgggacatttgttcctctcttcttgaatctcatatcatcagtgagacaatacaacagacaaatgcaacaagcagcagaagcagcagcggcagctcctcatgttgatcctcttcaagccgctcagacacctgtggacgaaatgatgagacatgcgtacgtggaccctaatgatccaacgaggatatatctgcaacagccatcaggggaatctcagttgaggcgtagagcttaccattcgggtgcggcggaacattga

SEQ ID NO: 2258 - protein, 207 aa, Arabidopsis thaliana
MALNPQLLPNGMPVPFVNEMFVLVRDGVEFEVDKIPGGHGGHVKAKGVIYLSNIRMVFVSSKPVDNFVAFDMPLLYIHAEKFNQPIFHCNNIAGQVEPVVPENEHRALYSTHSFKILFKEGGCGTFVPLFLNLISSVRQYNRQMQQAAEAAAAAPHVDPLQAAQTPVDEMMRHAYVDPNDPTRIYLQQPSGESQLRRRAYHSGAAEH

SEQ ID NO: 2259 - DNA, 1053 bp, Arabidopsis thaliana
atgaataatcaaaaatggagtataggtttcatatctctcgcttttctcttcatcacttcctcttcagctgagttcatcattcaacaggtcacaaagggcagaggaatagagtacaacagttcttacagtctcgaggagaatcttggagtgacaagagagttgagagaagagcgaccatcgagtaagatagtgacaataacaagcttctcagtgattaaaggcagaggagaaccctatgaatcctctgtttttgaggctgctggttacaaatggagattggttttgtacgtgaatggtaataaaaacgacggtggaaatgatcatatttccctttacgcaaggatcgaagagacaaactctcttccattaggttgggaagtgaatgttgatctcaaactctttgtccataatgggaagctacacaaatatttgactgttacagatggcttagtgaagcgatataacaatgcgaaaaaagaatggggtttcggacaattgattcctcgatcaacattctacaacgcgaacgaaggttaccttgaccaggacactggttcttttggtgctgagatctttattgttaaaccggctcaacaacaagagaaagttacattcatatcaaaccctccaaacaatgttttcacttggaagatacttcgtttctctaccttggaagataaattctattactccgatgattttctcgttgaagaccgatactggagactaggatttaacccgaaaggggatggaggaggaagaccacatgcacttccaatcttcctatttgctcaaggccataaggcaaatgcagttgctacaaacacttggggagcggttaatctgcggttaaagaatcaacgaagtactaaccatagacaaatatattctgcagcttggtacccgattggaagcggttatggtgtgggagtgaacaatatcatactgttagctgatttaaacgatgcatcaaaaggatatttggtgaatgatgccattatctttgaagctgaaatggttaaggtctctataaccaacatcgtctccgcttaa

SEQ ID NO: 2260 - protein, 350 aa, Arabidopsis thaliana
MNNQKWSIGFISLAFLFITSSSAEFIIQQVTKGRGIEYNSSYSLEENLGVTRELREERPSSKIVTITSFSVIKGRGEPYESSVFEAAGYKWRLVLYVNGNKNDGGNDHISLYARIEETNSLPLGWEVNVDLKLFVHNGKLHKYLTVTDGLVKRYNNAKKEWGFGQLIPRSTFYNANEGYLDQDTGSFGAEIFIVKPAQQQEKVTFISNPPNNVFTWKILRFSTLEDKFYYSDDFLVEDRYWRLGFNPKGDGGGRPHALPIFLFAQGHKANAVATNTWGAVNLRLKNQRSTNHRQIYSAAWYPIGSGYGVGVNNIILLADLNDASKGYLVNDAIIFEAEMVKVSITNIVSA

SEQ ID NO: 2261 - DNA, 1122 bp, Arabidopsis thaliana
atgggatacctttttcaagaaaccttaagctctaaccctaaaactccaattgttgttgatgatgataacgagttgggtttgatggccgtgagacttgccaacgccgccgcctttcctatggttctcaaagccgccctcgagcttggtgtctttgacactctctacgccgcagcctctcgcaccgactcattcctctcaccctatgaaatagcaagtaagctaccaactacacctcgtaaccctgaagcgccggttttgttggaccgcatgcttcgtctactcgctagctactccatggtcaagtgtggtaaggccttatccggaaagggcgagagggtctacagagccgagccgatttgcaggttcttcttgaaggataacattcaagatattggatcccttgcttctcaagtcatcgtcaatttcgacagcgtcttccttaatacctgggcacagttgaaagatgtggtgctagaaggaggagatgcgtttggtcgcgcacatggtggtatgaaactctttgactatatgggtacagatgagagattcagcaagctctttaaccagaccggattcacaatcgcggtcgttaagaaggcccttgaagtctatgaaggcttcaaaggtgtgaaagttttagttgatgttggaggaggagttggtaacactcttggtgttgttacttctaaatatcccaatattaagggtatcaactttgatctaacctgtgccttggcacaagcaccttcttatcccggtgtggagcatgttgccggagatatgtttgtggatgtcccaaccggagatgccatgatcttgaaacgtatacttcatgattggaccgacgaagattgtgtcaagattcttaagaattgttggaaatcactacctgaaaacggtaaagtggttgttatagaattagtcactcctgatgaggcagagaatggtgacatcaatgcgaacattgcctttgacatggacatgttaatgttcacccaatgttctggtggaaaagagcgatcaagagctgagtttgaagctttagctgcagcttctggcttcacccattgcaagttcgtttgccaagcttatcactgctggattattgaattctgtaaataa

SEQ ID NO: 2262 - protein, 373 aa, Arabidopsis thaliana
MGYLFQETLSSNPKTPIVVDDDNELGLMAVRLANAAAFPMVLKAALELGVFDTLYAAASRTDSFLSPYEIASKLPTTPRNPEAPVLLDRMLRLLASYSMVKCGKALSGKGERVYRAEPICRFFLKDNIQDIGSLASQVIVNFDSVFLNTWAQLKDVVLEGGDAFGRAHGGMKLFDYMGTDERFSKLFNQTGFTIAVVKKALEVYEGFKGVKVLVDVGGGVGNTLGVVTSKYPNIKGINFDLTCALAQAPSYPGVEHVAGDMFVDVPTGDAMILKRILHDWTDEDCVKILKNCWKSLPENGKVVVIELVTPDEAENGDINANIAFDMDMLMFTQCSGGKERSRAEFEALAAASGFTHCKFVCQAYHCWIIEFCK

SEQ ID NO: 2263 - DNA, 921 bp, Arabidopsis thaliana
atgaccacgttattcctccttattgctctattcatcacaaccatcctcaacccaacaagtggagaatcagtaggtgtatgctatggaatgatggggaacaaccttccttctcaatcagacacaatcgctctctttagacaaaacaacatccgacgtgttagactctacgatccaaaccaagccgctttaaacgctcttagaaacacgggtatcgaagtcatcatcggcgttccaaacaccgatcttcgttcactcactaacccttcttccgctagatcatggctccaaaacaacgtcctcaactattaccccgccgttagcttcaagtacatcgccgtaggtaacgaagtatctccgtcgaacggcggtgatgttgtgctccctgccatgcgtaacgtttacgatgctctaagaggtgcaaatcttcaagatcgtattaaagtttctaccgccattgatatgactttgattggaaactctttccctccttcctccggagagtttcgtggtgacgttagatggtatatcgatcccgtcatcgggtttcttacgagtacgaactcagcgttactagccaacatctatccttacttcagctacgttgacaatccacgtgacatatctctctcttacgctctcttcacttctccttccgtcgtcgtatgggacggctctcgtggctaccaaaacctctttgacgctttacttgacgttgtttactctgccgttgaacgctcaggcggtggatctctcccagtggttgtttccgagagcggatggccttctaacggtggaaacgccgcgagtttcgataacgcgcgaagctttttacacgaatcttgcgtcgcgtgtgagagagaacagaggaacaccgaagagacctggaagaggagtggaaacgtatttgttcgctatgtttga

SEQ ID NO: 2264 - protein, 306 aa, Arabidopsis thaliana
MTTLFLLIALFITTILNPTSGESVGVCYGMMGNNLPSQSDTIALFRQNNIRRVRLYDPNQAALNALRNTGIEVIIGVPNTDLRSLTNPSSARSWLQNNVLNYYPAVSFKYIAVGNEVSPSNGGDVVLPAMRNVYDALRGANLQDRIKVSTAIDMTLIGNSFPPSSGEFRGDVRWYIDPVIGFLTSTNSALLANIYPYFSYVDNPRDISLSYALFTSPSVVVWDGSRGYQNLFDALLDVVYSAVERSGGGSLPVVVSESGWPSNGGNAASFDNARSFLHESCVACEREQRNTEETWKRSGNVFVRYV

SEQ ID NO: 2265 - DNA, 1200 bp, Arabidopsis thaliana
atggctgggatttgttgcggtgttgttggagagactgaaccggcggcaccggttgattcaacttctcgagcttctcttagacggaggttagatctacttccgtcgatcaaaattgttgctgactccgccgttgctcctccgcttgaaaactgccgtaaacggcagaagcgtgagacagtagtgctctcgacgttaccgggaaatctagatctggattcgaatgtgaggagtgagaataagaaggctagatcagcggttacgaattcaaattctgttacggaagcagagagtttcttttccgatgtacctaagatcggtacgacgtcggtttgtggtagaagacgagacatggaagacgctgtctcgattcatccttcgtttcttcaacggaactctgagaatcatcatttctacggtgtctttgacggccatggctgctctcatgttgcggagaagtgcagagaacggttgcatgatatagtgaagaaggaagttgaagttatggcttccgacgagtggacagagacgatggttaagagttttcaaaaaatggataaagaagttagccaacgagagtgtaacttagttgttaatggtgctactcggagtatgaaaaattcttgtagatgtgaattgcagtctcctcagtgtgacgccgtcggatccaccgctgttgtatcggttgtcacgccggagaagatcattgtttctaattgcggtgattcacgggctgtgctttgtcgtaacggtgtagccattcctctctccgtagatcacaagccggatcgacccgatgaattgattcggatccaacaagctggtgggcgagttatatattgggatggagctagggttcttggagttcttgccatgtctagagcaattggtgataattacttgaaaccgtatgtgattccggatccggaggtaacagtgacggatcgaactgatgaggatgagtgtttgatcttggcgagtgatggactatgggatgttgtaccaaacgagacggcgtgtggcgtggctcgcatgtgccttcgaggtgctggtgcgggtgacgactcagatgcggcgcacaatgcgtgctccgatgcggcgttgctcttaacaaagttggctctagcaagacagagctccgataacgtgagcgtcgttgtggttgacttgaggaagaggaggaataatcaagcgtcgtcttaa

SEQ ID NO: 2266 - protein, 399 aa, Arabidopsis thaliana
MAGICCGVVGETEPAAPVDSTSRASLRRRLDLLPSIKIVADSAVAPPLENCRKRQKRETVVLSTLPGNLDLDSNVRSENKKARSAVTNSNSVTEAESFFSDVPKIGTTSVCGRRRDMEDAVSIHPSFLQRNSENHHFYGVFDGHGCSHVAEKCRERLHDIVKKEVEVMASDEWTETMVKSFQKMDKEVSQRECNLVVNGATRSMKNSCRCELQSPQCDAVGSTAVVSVVTPEKIIVSNCGDSRAVLCRNGVAIPLSVDHKPDRPDELIRIQQAGGRVIYWDGARVLGVLAMSRAIGDNYLKPYVIPDPEVTVTDRTDEDECLILASDGLWDVVPNETACGVARMCLRGAGAGDDSDAAHNACSDAALLLTKLALARQSSDNVSVVVVDLRKRRNNQASS

SEQ ID NO: 2267 - DNA, 1014 bp, Arabidopsis thaliana
atggagatctcaaaaacccttttgctagtgatttctctggtggctgcaacttgtttcttgcaagccaaggcagctggagtttattgtagtaacccttacactcgatgttaccgcaagtacattaggtgtccagaggaatgtccaagcaaaaccgctatgaactccaagaacaaagtgtgctacgccgattgcgatagacccacttgcaaatcccaatgccgcatgaggaaaccaaactgcaacagacctggatcagcttgttatgacccgaggttcattggaggagacggcattgtgttctacttccatggaaagagcaatgaagagtttagcctcgtctctgactctgaccttcagatcaatggtaggttcattggtcacagacccgctggtcgtgccagagacttcacatggatccaagctctaggattccttttcaactccaacaaattctccctcgaagccgcgaaaaccgcctcatgggacaacgaaatcgaccatctcaaattcagttacgatggccaagatttatctgttccagaagaaactctctccacctggtactcaccaaacaaggacatcaagatcgagagagtgagtatgagaaacagcgtgatcgtgacaatcaaagacaaagccgagatcatgatcaatgtggttccagtgacaaaagaagacgacagaatccatagctacaaagtaccatcagatgattgttttgcacatcttgaggttcaattcagattctttaacctttcacctaaggttgatggaatcttgggacgaacctacaggcccgatttccaaaatccggctaagcctggagtcgcaatgccagttgttggtggtgaagacagcttcaagacttcttctctactctccaatgactgtaaaacttgcattttctctgagtcacaagcagagattgattctgttaagtcagagattgaatatgcaactttggattgtacccgtggagcgtcttctggttacggtatcgtgtgcaggaagtaa

SEQ ID NO: 2268 - protein, 337 aa, Arabidopsis thaliana
MEISKTLLLVISLVAATCFLQAKAAGVYCSNPYTRCYRKYIRCPEECPSKTAMNSKNKVCYADCDRPTCKSQCRMRKPNCNRPGSACYDPRFIGGDGIVFYFHGKSNEEFSLVSDSDLQINGRFIGHRPAGRARDFTWIQALGFLFNSNKFSLEAAKTASWDNEIDHLKFSYDGQDLSVPEETLSTWYSPNKDIKIERVSMRNSVIVTIKDKAEIMINVVPVTKEDDRIHSYKVPSDDCFAHLEVQFRFFNLSPKVDGILGRTYRPDFQNPAKPGVAMPVVGGEDSFKTSSLLSNDCKTCIFSESQAEIDSVKSEIEYATLDCTRGASSGYGIVCRK

SEQ ID NO: 2269 - DNA, 831 bp, Arabidopsis thaliana
atgatcgccgccggagctaaatcgctattagggctttcgatggcttctccaaaagggattttcgatagcaattcaatgagtaattcaagatctgttgttgttgttcgtgcttgtgtttctatggatggatctcaaactctgagtcataacaaaaatggatctattcctgaggttaaatccattaacggtcacacgggacaaaagcaaggacctttgtctacggtcggaaactcgacaaatataaagtggcatgaatgttctgttgagaaagttgatagacagagattgcttgatcagaaaggatgtgtgatttgggtcaccggtcttagtggttcagggaagagtactttggcttgtgctttgaatcagatgttgtatcaaaaggggaagctttgttatattcttgatggtgataatgttaggcatggcttaaaccgtgatcttagctttaaagctgaggatcgtgcagagaatattcgtagagttggagaggttgctaagctttttgcggatgctggaataatctgcattgcgagtttgatatctccttatagaacagatagggacgcttgtcgaagtttgctccccgagggagattttgttgaggtgttcatggatgtaccgcttagtgtttgcgaggcgagggatccaaagggtctttacaagcttgctcgtgcaggaaagatcaaaggttttaccgggatcgatgacccttacgagccaccattgaactgcgagatttctctaggacgtgaaggaggaacttctcctatcgaaatggcggaaaaggtcgtcggatacttagataacaagggttatcttcaagcataa

SEQ ID NO: 2270 - protein, 276 aa, Arabidopsis thaliana
MIAAGAKSLLGLSMASPKGIFDSNSMSNSRSVVVVRACVSMDGSQTLSHNKNGSIPEVKSINGHTGQKQGPLSTVGNSTNIKWHECSVEKVDRQRLLDQKGCVIWVTGLSGSGKSTLACALNQMLYQKGKLCYILDGDNVRHGLNRDLSFKAEDRAENIRRVGEVAKLFADAGIICIASLISPYRTDRDACRSLLPEGDFVEVFMDVPLSVCEARDPKGLYKLARAGKIKGFTGIDDPYEPPLNCEISLGREGGTSPIEMAEKVVGYLDNKGYLQA

SEQ ID NO: 2271 - DNA, 273 bp, Arabidopsis thaliana
atggcgttgagaagggtttacagtgaaatcagagggaagaaggtgacggagcttccaggctatatcaaatcgactttttcaatggagaccgtgaagacctctgtgaagagaggactcgataactacaacgaaaaatacattcagaccagctccgttgatcctatccttcatatctgcttctacggcatggctttctcttaccttgtcgctctccctaatgagcgtcgccatcttgagcatcagcagcatgctaaggagcacggtggtcattga

SEQ ID NO: 2272 - protein, 90 aa, Arabidopsis thaliana
MALRRVYSEIRGKKVTELPGYIKSTFSMETVKTSVKRGLDNYNEKYIQTSSVDPILHICFYGMAFSYLVALPNERRHLEHQQHAKEHGGH

SEQ ID NO: 2273 - DNA, 1185 bp, Arabidopsis thaliana
atgtcaatccttcaagtctctacttcgtctctttcttcttctactcttctctccatatctcccagaaaatctctctcatctaccaagtcatgccggatagttcgatgttccgtcgagggaactactgtaaccgagagaaaagtctcggcaaccagcgagccacttcttctgagagctgttaaaggtgaagttgttgatagacctccggtttggcttatgaggcaagctgggaggtacatgaagagttatcaaactctctgtgagaagtatccttctttcagagatagatcagagaatgcagatcttgtggtggaaatttctttgcagccatggaaggtgtttaagccagatggggtgattctgttctcagacattctcactccattgtctggaatgaacatacctttcgacattgttaaaggaaaaggtcctatcatctttaacccgcctcaatcagctgccgacgttgctcaagttagagaattcgtaccagaggaatctgttccttatgttggagaagcactcagaagattaagaaatgaggtgaacaatgaagccgctgttctgggatttgttggagctccatttacactttcttcgtatgtaatcgaaggtggctcatctaagaacttcacacagataaaaagattagctttttctcaacccaaggttctacatgccttactccagaagttcacaacctcgatgataacgtacatacgctatcaagcagatagcggagctcaagctgtgcaaatattcgactcttgggcaaccgagcttagcccggtggattttgaggagtttagcttaccttatctcaaacagattgtggaagctgtgaaacaaactcacccaaacctacctctcatactttatgctagtggatcaggaggtttgctagagagactggctcggaccggtgtggatgttgtgagcttggactggactgtggacatggctgaaggaagagaccggctaggaagagacatagcagttcaaggaaacgttgatccgggagttctatttggatcgaaagaatttatcacaagccggattcatgatactgtgaagaaagctgggagagataaacacattctcaacttggggcatggtattaaagttggaacccctgaagagaatgtagcacacttctttgaggttgctcaagaaattagatattaa

SEQ ID NO: 2274 - protein, 394 aa, Arabidopsis thaliana
MSILQVSTSSLSSSTLLSISPRKSLSSTKSCRIVRCSVEGTTVTERKVSATSEPLLLRAVKGEVVDRPPVWLMRQAGRYMKSYQTLCEKYPSFRDRSENADLVVEISLQPWKVFKPDGVILFSDILTPLSGMNIPFDIVKGKGPIIFNPPQSAADVAQVREFVPEESVPYVGEALRRLRNEVNNEAAVLGFVGAPFTLSSYVIEGGSSKNFTQIKRLAFSQPKVLHALLQKFTTSMITYIRYQADSGAQAVQIFDSWATELSPVDFEEFSLPYLKQIVEAVKQTHPNLPLILYASGSGGLLERLARTGVDVVSLDWTVDMAEGRDRLGRDIAVQGNVDPGVLFGSKEFITSRIHDTVKKAGRDKHILNLGHGIKVGTPEENVAHFFEVAQEIRY

SEQ ID NO: 2275 - DNA, 1425 bp, Arabidopsis thaliana
atgggtttgatatcagcgaaagagacgaagaacaacactagaggaatgggtttgctcttagtcttcttccccgaccaccacaacaacaacgacgactctccttcttcttcttcttcttctccggcaacaacaactctcttccgctccagatcttctcgtcttctcctctccaaagctcaatccacaatctcaatctgcatcctcctcctcttcctcactctcttcctcttcactctctccaccttcgaaccttcctctggctttcccgccgtttcttcttctcgtcctcaccgtcgatttctcctcaaccgcgacatctccgcctcttctgaatctcgtcgtcgttataaccgattcgctctccaaggtatgggtactctgtttctcagaggaaccaagagcatgcacgatttgattgttgttcatatctcttccgatactacggaagacgatctccgtctcttcatgcgcttgatccaccgctccggtgtcacttccaaatccgacgtcgttttactcttcaattcgggtacgagattcactgaaatgatcgaagaagagaacgactcgttcttaaaactcgttgatgttcatcggaattcgtcgaatcaaatcgactccgtttggggatttaatctcacgaaattcatgaagaagcaatcgaaatcatcatcgtctgagccaatttgggggaagaagacgcatcgagctaattacaacgatacgtcgtcgttgaataactcgaccgagtcaaccgagttgttgacacatggctcagtagtgggtttcgacgtgactgagttggatcctgaaaactcgctatccgggtttatggatcacgttccgataagtttgagaagatgggcgtgttacccaatgctgctaggtcgagtaagacgcaatttcaaacacgttatgctcgtggacgctaaaacctccttgttcctcggtgacccgctaacccggattcgtaaccggagccttgagtcagtcctcttcttctctaaacacagtagtagtagcaagaaaagctccgaggttaatccggcgattctgatcggtggagctaaaggaatcaggaggttatcgagctcgatgcacactgagatcgtgagagcgacgattcagcagcagcataagaagaagaactcggttacggaatcggtggtgttgagccaactcgttgggaatgttcacatgacgaagaattttgaagtggttacgagtgagtcggtggtaccggaagcgagttcactggctgagttaaggacgagaaactcggcggcttcgtcgataaagaatcatgatataatacaaagaggtggtggtaatagtaatagtaatcatattattgatattatggcgattattatgaaacgtatttgttcttgtgaattagattcttctgtttataattactgttag

SEQ ID NO: 2276 - protein, 474 aa, Arabidopsis thaliana
MGLISAKETKNNTRGMGLLLVFFPDHHNNNDDSPSSSSSSPATTTLFRSRSSRLLLSKAQSTISICILLLFLTLFLFTLSTFEPSSGFPAVSSSRPHRRFLLNRDISASSESRRRYNRFALQGMGTLFLRGTKSMHDLIVVHISSDTTEDDLRLFMRLIHRSGVTSKSDVVLLFNSGTRFTEMIEEENDSFLKLVDVHRNSSNQIDSVWGFNLTKFMKKQSKSSSSEPIWGKKTHRANYNDTSSLNNSTESTELLTHGSVVGFDVTELDPENSLSGFMDHVPISLRRWACYPMLLGRVRRNFKHVMLVDAKTSLFLGDPLTRIRNRSLESVLFFSKHSSSSKKSSEVNPAILIGGAKGIRRLSSSMHTEIVRATIQQQHKKKNSVTESVVLSQLVGNVHMTKNFEVVTSESVVPEASSLAELRTRNSAASSIKNHDIIQRGGGNSNSNHIIDIMAIIMKRICSCELDSSVYNYC

SEQ ID NO: 2277 - DNA, 1065 bp, Arabidopsis thaliana
atggctccttctgcgcaacctcttcctgtgagtgtttcggatgaaaaatatgcgaatgtcaagtgggaagagttggcattcaagtttgttcgtacggattatatgtatgttgcgaagtgcaatcatggagagagttttcaagaggggaagattcttccttttgctgatttgcaacttaacccttgcgctgctgttcttcagtatggccagggtttatatgaaggactgaaagcttacaggacagaagatggtcggattctgctattccgaccagaccaaaacggtctccgccttcaagccggagctgacagactctatatgccttatccttcggtcgatcaattcgtctccgccatcaaacaagttgctcttgccaacaagaaatggattcctcctccggggaaaggaacattgtatattaggcctatcttgtttgggagtggtccgattcttggttcatttcccattcctgagaccaccttcacagcttttgcctgtcctgttggacgttatcataaggataactctggtttgaatctgaaaatcgaagatcagtttcgtcgagcttttcctagtggaactggtggtgtgaagagcatcacaaactattgtcctgtttggataccattggcagaggcgaaaaaacaaggtttctctgatattttgtttttggatgctgcaactggcaaaaacattgaagaacttttcgcagctaatgtttttatgctcaagggcaatgttgtatcgacaccaacaattgcaggaactattttgcccggagtcactcgaaactgcgtaatggaattgtgtcgtgatttcggctaccaggtcgaggaacgtacgattcctctagtggactttctcgatgcggacgaagctttctgtactggcactgcttccattgtgactagtattgcatccgtaacctttaaagacaaaaagaccggattcaaaacaggggaagaaacattggctgcgaagctatacgagacgttaagtgatatccagacgggtcgggtcgaggataccaagggatggacggtggagattgaccgccagggctga

SEQ ID NO: 2278 - protein, 354 aa, Arabidopsis thaliana
MAPSAQPLPVSVSDEKYANVKWEELAFKFVRTDYMYVAKCNHGESFQEGKILPFADLQLNPCAAVLQYGQGLYEGLKAYRTEDGRILLFRPDQNGLRLQAGADRLYMPYPSVDQFVSAIKQVALANKKWIPPPGKGTLYIRPILFGSGPILGSFPIPETTFTAFACPVGRYHKDNSGLNLKIEDQFRRAFPSGTGGVKSITNYCPVWIPLAEAKKQGFSDILFLDAATGKNIEELFAANVFMLKGNVVSTPTIAGTILPGVTRNCVMELCRDFGYQVEERTIPLVDFLDADEAFCTGTASIVTSIASVTFKDKKTGFKTGEETLAAKLYETLSDIQTGRVEDTKGWTVEIDRQG

SEQ ID NO: 2279 - DNA, 642 bp, Arabidopsis thaliana
atgtttatgaatcggctattcgggaaacccaaacaggagactagtactctccaaacgttagacaagctcaatgagactcttgagatgttagagaagaaggagaatgttcttctcaagaaagctactggagaggttgagaaagctaaggaattctcccgggcgaagaacaaacgcgcggctatacaatgtttgaaaaggaaaaggttatatgagcaacaagttgaacagctcgggaatttccagctccgtattcatgatcaaatgattatgttagaaggtgctaaagcaacaacagagactgtagatgctttgaggactggagcttctgcaatgaaagctatgcagaaagcaacaaacattgatgatgttgacaagacaatggatgagatcaatgaacaaactgagaacatgaaacagatccaagaagcattgtcggctccatttggggctaatgattttgatgaggatgaattggaagcagaacttgacgaactagaaggcgctgagctagaagagcaacttcttcagcctgttccaatccatgtgcctcaaggaaacaagcctgctcgtgctccagctcagaagcaacctactgctgaggaagatgaactcgctgccttacaagctgagatggctctctaa

SEQ ID NO: 2280 - protein, 213 aa, Arabidopsis thaliana
MFMNRLFGKPKQETSTLQTLDKLNETLEMLEKKENVLLKKATGEVEKAKEFSRAKNKRAAIQCLKRKRLYEQQVEQLGNFQLRIHDQMIMLEGAKATTETVDALRTGASAMKAMQKATNIDDVDKTMDEINEQTENMKQIQEALSAPFGANDFDEDELEAELDELEGAELEEQLLQPVPIHVPQGNKPARAPAQKQPTAEEDELAALQAEMAL

SEQ ID NO: 2281 - DNA, 1788 bp, Arabidopsis thaliana
atggactctgtttcttcttcttccttcctctcctccacattctctcttcatcactctcttcttcgccgccgatcttcctctcctactctcctccgtatcaactccgccgtcgtcgaagaacgttctccaatcacaaacccaagcgacaacaatgatcgtcgtaacaaacccaaaacactccacaaccgaaccaatcacaccttagtctcatcaccaccgaaactccgaccagaaatgactctcgcaacagctctcttcaccaccgtcgaagatgtaatcaacacgttcatcgatccaccttcacgtccttccgttgatccaaaacatgtcctctctgataacttcgctcctgtcctcgacgagcttcctccaacagactgtgaaatcatccacggcactcttccactgtcacttaacggcgcttacatccgtaacggtccaaatccacagtttctccctcgtggtccttaccatctcttcgacggcgacggtatgcttcacgccataaaaatccacaacggtaaagccactctctgtagcagatacgtcaagacttataaatacaacgtcgagaaacaaaccggagctccggttatgcctaacgtgttttccggattcaacggtgtaacggcgtcagtagctcgtggagctttaacggcagctagggttttaaccggacagtataatccggttaacggcattggtttagctaatacaagtctagctttcttcagtaaccgtctctttgctttaggtgaatctgatttaccctacgccgtccgattaaccgaatcaggagatattgaaacgatcggacggtacgatttcgacgggaaattagcgatgagtatgacagctcatcctaaaaccgatccaataaccggagaaactttcgctttccggtacggtccggttccaccgtttttaacatatttccggtttgattccgccgggaaaaaacaaagagacgttccgatattctcgatgacgtctccgtcgtttctccatgacttcgcgatcacgaaacgtcacgcgattttcgcagagattcagcttggcatgaggatgaacatgttggatttggttctcgaaggtggttctccggttggtactgataacggaaaaactccaaggcttggagtgattcctaagtacgccggagatgagtcggagatgaaatggttcgaagttcctggattcaatatcattcacgctattaatgcttgggatgaagatgatggaaacagcgtcgttttgattgcaccgaatattatgtcgattgaacatactttagagaggatggatctggttcatgctttggtggagaaggtgaagatcgatctcgtcaccgggattgtgagacgtcatccgatctcagcgaggaatctcgatttcgctgtgattaatccggcgtttctcgggagatgtagcaggtacgtttacgcggcgattggagatccgatgccgaagatctccggtgtggtgaagcttgatgtgtctaaaggagatcgggatgattgtacggtggcccgtagaatgtacggttcaggttgttacggcggagaaccgtttttcgtagctagggatcctggtaatccggaggcggaggaggatgatggttatgtggtgacgtatgttcacgatgaagtgactggagaatcgaagtttctggtgatggacgctaaatcgccggagcttgaaatcgtcgccgccgtgaggttgccgcgaagggttccgtacggattccatgggttatttgtcaaggaaagtgaccttaataagctttaa

SEQ ID NO: 2282 - protein, 595 aa, Arabidopsis thaliana
MDSVSSSSFLSSTFSLHHSLLRRRSSSPTLLRINSAVVEERSPITNPSDNNDRRNKPKTLHNRTNHTLVSSPPKLRPEMTLATALFTTVEDVINTFIDPPSRPSVDPKHVLSDNFAPVLDELPPTDCEIIHGTLPLSLNGAYIRNGPNPQFLPRGPYHLFDGDGMLHAIKIHNGKATLCSRYVKTYKYNVEKQTGAPVMPNVFSGFNGVTASVARGALTAARVLTGQYNPVNGIGLANTSLAFFSNRLFALGESDLPYAVRLTESGDIETIGRYDFDGKLAMSMTAHPKTDPITGETFAFRYGPVPPFLTYFRFDSAGKKQRDVPIFSMTSPSFLHDFAITKRHAIFAEIQLGMRMNMLDLVLEGGSPVGTDNGKTPRLGVIPKYAGDESEMKWFEVPGFNIIHAINAWDEDDGNSVVLIAPNIMSIEHTLERMDLVHALVEKVKIDLVTGIVRRHPISARNLDFAVINPAFLGRCSRYVYAAIGDPMPKISGVVKLDVSKGDRDDCTVARRMYGSGCYGGEPFFVARDPGNPEAEEDDGYVVTYVHDEVTGESKFLVMDAKSPELEIVAAVRLPRRVPYGFHGLFVKESDLNKL

SEQ ID NO: 2283 - DNA, 846 bp, Arabidopsis thaliana
atggcggtatcgtacaatgcattagctcagtctttagcgagaagtagctgcttcatccccaaaccttattcctttagagatactaagctgagaagcagatccaatgtcgtattcgcgtgcaatgataataagaacattgctcttcaagctaaggtagataacttgttggaccgcattaaatgggatgacaaaggattagctgtggcaatagcacaaaacgttgatacgggagcagtattgatgcaaggctttgttaatagggaggccctctccacaaccatcagttctcggaaagctacattctttagtcgatcaagatctaccttatggactaagggagagacatccaataacttcatcaatattcttgatgtgtatgttgattgtgatcgtgattcgattatttaccttggaacacctgatggacctacctgtcacacaggggaagagacttgttactacacatcggtttttgatcaattaaacaatgatgaggcttcaggaaacaagctagcattaacaacattgtactcgctagaatcaatcatttccaagcggaaagaagaatcaacagttcctcaagaaggtaaaccatcatggactcgacggttgttgacggatgacgctctgctttgctcaaagatcagggaagaagctgacgagttatgcagaacactggaggataatgaggaagtttcaagaacaccatcagagatggctgatgttttataccacgcaatggtgcttctatctaaaaggggtgtgaagatggaagatgttcttgaagttcttaggaaacgcttctctcaatctggaatcgaggagaagcaaaaccgtacaaagtaa

SEQ ID NO: 2284 - protein, 281 aa, Arabidopsis thaliana
MAVSYNALAQSLARSSCFIPKPYSFRDTKLRSRSNVVFACNDNKNIALQAKVDNLLDRIKWDDKGLAVAIAQNVDTGAVLMQGFVNREALSTTISSRKATFFSRSRSTLWTKGETSNNFINILDVYVDCDRDSIIYLGTPDGPTCHTGEETCYYTSVFDQLNNDEASGNKLALTTLYSLESIISKRKEESTVPQEGKPSWTRRLLTDDALLCSKIREEADELCRTLEDNEEVSRTPSEMADVLYHAMVLLSKRGVKMEDVLEVLRKRFSQSGIEEKQNRTK

SEQ ID NO: 2285 - DNA, 2424 bp, Arabidopsis thaliana
atggaggacttaaaaactgttgaagcatctgataatgttgttagtgataatgttgagaaagtcaatcctgagttgattgattccaccattcgagaatctaacatacaatctgcaacaaaggttgataatattccacaatctcaaactgacactgaagagactcaacaatctcaaactgatactgaagagactcaacaatctcaaactgatgacactaccggcaatgcgaagatttatgtcgatgacacgttttcgccttctgatgctgcaaccgctgcggtgttaaccggaaaagatagtacgagtacaacaattgtagaagaagtgatggagccagatgagattggtttacctagtgtcaagattaccgaggctgcgacgggtacagcaagaaatggtggggggtcacctagaactgtatcatctcctagattttcaggatcaccggtgagcactggaacaccgaaaaatgtggactcacatcgaggtttaatcgataccgcagcgccatttgaatctgttaaagaagctgtatcaaaatttggaggaattactgactggaagtctcaccgaatgcaagcggtagagagacgaaagcttattgaagaagagcttaaaaagattcatgaggagattcctgagtacaaaacacattcagaaactgcagaggctgcaaaactgcaagtgcttaaggagctggaaagcacaaagagacttatagaacagttgaagcttaatttggacaaggcacaaacagaagaacaacaggcgaagcaagactcggagcttgctaagctgagggttgaagagatggaacaaggaatagctgaagatgtcagtgttgcagctaaagcgcaacttgaggtggctaaggcgaggcatacaacagcgattacagagttgtcttctgtcaaggaggaactagaaactctgcataaggaatatgatgctctggtgcaagataaagatgtggctgtaaagaaagtagaagaagcaatgttggcgtcaaaagaagttgagaagacagtggaagaactcaccatagagttgatagctacaaaggagtcattggaatcagcacatgcttctcatttagaggcggaagaacagaggattggagcagctatggctagagaccaggatactcaccgttgggagaaggaactgaagcaagcggaagaggaactccaaagacttaaccaacagatacattcttcgaaagatctaaaatcgaagctcgacactgcctcagcgctgcttcttgatttgaaggcggaattggtagcttatatggaatccaagctaaaacaagaagcgtgtgactcaaccacaaacaccgatccttcgacagaaaacatgagccatccagatttacatgcagctgttgcctctgcaaagaaggaacttgaagaggtcaatgtcaatattgagaaagcagctgctgaagtgagttgcttgaaattggcctcctcttccttgcaactggaactcgagaaagaaaagtctactcttgcctctatcaaacagagagaaggaatggcctctatagcagtagcttctatagaggctgaaattgacagaacgaggtcggaaatagcttcggttcagtcaaaggagaaagacgcgagagagaaaatggtggagctaccgaagcaacttcagcaagcagcagaagaggctgatgaagcaaagtcacttgctgaagttgctcgcgaagagctacgaaaggcgaaagaagaagcagagcaagcaaaagctggagcaagtacaatggagagcaggctatttgctgcgcagaaggaaatcgaagcagctaaagcttcagagaggctggccttagctgccatcaaggctttggaggagagtgaatcaacattgaaagctaatgacaccgattctccacgaagcgttacactttcgctagaagagtactatgagctcagcaaacgtgctcacgaggcagaagaactcgcgaacgcaagagtagcagcagcggtttcaagaatcgaggaagctaaagaaacagaaatgagaagcttggagaagttggaagaagtaaacagagacatggatgcgagaaagaaggcattaaaagaagcaactgaaaaggctgagaaggccaaagaagggaagttgggggtggagcaggagctgaggaaatggagggcagaacatgaacaaaagagaaaggctggtgatggagtcaacactgagaaaaacctaaaagaaagctttgaaggaggaaagatggagcaatcacctgaagctgttgtttatgcctccagcccaagtgagtcatatggaacagaagaaaactctgaaaccaatctatccccacagaccaagtctcgaaagaaaaagaagaagctttctttcccccggttttttatgttcttgtcaaagaagaagtcacataataattga

SEQ ID NO: 2286 - protein, 807 aa, Arabidopsis thaliana
MEDLKTVEASDNVVSDNVEKVNPELIDSTIRESNIQSATKVDNIPQSQTDTEETQQSQTDTEETQQSQTDDTTGNAKIYVDDTFSPSDAATAAVLTGKDSTSTTIVEEVMEPDEIGLPSVKITEAATGTARNGGGSPRTVSSPRFSGSPVSTGTPKNVDSHRGLIDTAAPFESVKEAVSKFGGITDWKSHRMQAVERRKLIEEELKKIHEEIPEYKTHSETAEAAKLQVLKELESTKRLIEQLKLNLDKAQTEEQQAKQDSELAKLRVEEMEQGIAEDVSVAAKAQLEVAKARHTTAITELSSVKEELETLHKEYDALVQDKDVAVKKVEEAMLASKEVEKTVEELTIELIATKESLESAHASHLEAEEQRIGAAMARDQDTHRWEKELKQAEEELQRLNQQIHSSKDLKSKLDTASALLLDLKAELVAYMESKLKQEACDSTTNTDPSTENMSHPDLHAAVASAKKELEEVNVNIEKAAAEVSCLKLASSSLQLELEKEKSTLASIKQREGMASIAVASIEAEIDRTRSEIASVQSKEKDAREKMVELPKQLQQAAEEADEAKSLAEVAREELRKAKEEAEQAKAGASTMESRLFAAQKEIEAAKASERLALAAIKALEESESTLKANDTDSPRSVTLSLEEYYELSKRAHEAEELANARVAAAVSRIEEAKETEMRSLEKLEEVNRDMDARKKALKEATEKAEKAKEGKLGVEQELRKWRAEHEQKRKAGDGVNTEKNLKESFEGGKMEQSPEAVVYASSPSESYGTEENSETNLSPQTKSRKKKKKLSFPRFFMFLSKKKSHNN

SEQ ID NO: 2287 - DNA, 1737 bp, Arabidopsis thaliana
atgtgtgggattctcgctgtgttaggctgcgtcgataactctcaagctaaacgttcccgtatcatcgaactctctcgcagattgaggcatagaggtcctgactggagtggtctacattgttatgaggattgttatttggctcatgagcgtttggctatcgttgaccccacttctggagatcaaccactctataacgaagataagaccattgctgtcacggtcaatggagagatttacaaccacaaggctttgcgtgaaaatttgaagtctcaccaattccgtactgggagtgattgtgaagtgattgcccatctttacgaagaacatggagaggaatttgtcgacatgttggatggcatgtttgcatttgtgcttcttgatacccgagacaaaagctttattgctgcaagggatgccattggtatcactccactctacatcgggtggggtctcgatggttctgtttggtttgcttccgagatgaaagcacttagtgatgattgtgagcagtttatgtgcttccccccaggccacatctattcaagtaaacaaggtgggcttaggaggtggtacaaccccccgtggttctctgaggttgttccttcaaccccatatgatcccctagtggtgcgcaatacttttgagaaggctgttataaaacgactaatgactgatgtgccttttggtgtcctcctatctggtggattagattcatcccttgttgcttcagtagcattacgccatctggaaaaatcagaagctgcttgtcagtggggttcaaagttgcacacattttgtatcggtttgaagggatccccggatcttaaagctggcagagaagtcgctgactatttaggaactcgccaccacgagttacactttacagttcaggacggaatagatgccatagaagaagtcatctaccatgttgagacctatgatgtgactactattagagccagcactccaatgtttcttatgtcgcgaaaaatcaaatcgcttggtgtaaagatggttctttctggggaaggctctgatgaaatttttggaggatatttgtacttccataaagctcccaacaagaaggaatttcatgaggaaacatgtcgaaagatcaaagctcttcatcaatatgactgcttgagggctaacaaatcaacttctgcatggggtgttgaggctcgtgtacctttcctcgataaagaatttataaatgtcgcaatgagcatcgatccagagtggaagatgattaggcctgatttgggaaggatcgagaaatgggtgttacgcaatgcctttgatgatgagaaaaatccttacctaccaaagcacattctatataggcagaaagaacagttcagtgatggagttggatacagctggattgatggtctaaaagatcatgcaaacaaacatgtctctgagacaatgctgatgaacgcaagctttgtcttccctgataacacacctttgacaaaagaagcttactactacagaaccatctttgaaaagttcttccctaagagtgctgctagagcaactgtaccaggaggtccaagtgtggcatgtagcacagcaaaagctgtggaatgggacgcagcttggtcacagaatcttgacccatcaggtcgtgcggctcttggagttcatgtttcagcttatggggaagataaaaccgaagattctcgtcccgagaagctacagaaactagcagagaagactccagccattgtttga

SEQ ID NO: 2288 - protein, 578 aa, Arabidopsis thaliana
MCGILAVLGCVDNSQAKRSRIIELSRRLRHRGPDWSGLHCYEDCYLAHERLAIVDPTSGDQPLYNEDKTIAVTVNGEIYNHKALRENLKSHQFRTGSDCEVIAHLYEEHGEEFVDMLDGMFAFVLLDTRDKSFIAARDAIGITPLYIGWGLDGSVWFASEMKALSDDCEQFMCFPPGHIYSSKQGGLRRWYNPPWFSEVVPSTPYDPLVVRNTFEKAVIKRLMTDVPFGVLLSGGLDSSLVASVALRHLEKSEAACQWGSKLHTFCIGLKGSPDLKAGREVADYLGTRHHELHFTVQDGIDAIEEVIYHVETYDVTTIRASTPMFLMSRKIKSLGVKMVLSGEGSDEIFGGYLYFHKAPNKKEFHEETCRKIKALHQYDCLRANKSTSAWGVEARVPFLDKEFINVAMSIDPEWKMIRPDLGRIEKWVLRNAFDDEKNPYLPKHILYRQKEQFSDGVGYSWIDGLKDHANKHVSETMLMNASFVFPDNTPLTKEAYYYRTIFEKFFPKSAARATVPGGPSVACSTAKAVEWDAAWSQNLDPSGRAALGVHVSAYGEDKTEDSRPEKLQKLAEKTPAIV

SEQ ID NO: 2289 - DNA, 1047 bp, Arabidopsis thaliana
atggcttctcttatctctttttctttgctcccaaaaccaaaagccgtaagaagttcaatttcagctcctcagacacagacaataaatactgaaaagcttgaagataaattcggacgaaaaggcataaaattctcggaatcaaacaacattcctatggtagagcttaaggtcagaaatggaagttcattaaaactgagtctatcagatgctcatgtactttcatataagccaaaggtatactggaaagacgagggattcgaggaagtcctttacacagttgatggtgatgagagcagaggtggggttggtgttgttatcgtaaacggggaagaacctaaaggagggtcttcagtaatctcaggatgtgattggagtgtcaaggatactgattcagacgccattgatgctcttcagatcgaacttagctgtacggccggggttctcgacataacgtatatcgtctctctctacccagtaagcatggctacagctctggtggtgaagaacaatggtcgcaaaccagttacccttaaaccggggattatgagttacttgaggttcaagaaacggagtggggcaggaattcaaggactaaagggatgctcttattgtcccaacccgcctttgtcatcgccttttgagctcttgtctccttctgaggcaatgaaggcggaatcttcggggtggttcgggtcggaagaaggggaaaagccggggatttgggcagtagaagattctgttattacacttcttgagaaaaagatgagtagaatatatggtgctcctccggctgagagattaaaggcagtctataacactccaccttccaaatttgaaactatagatcaggggagaggattgtttttcaggatgataaggattgggttcgaagagatgtatgtgggatccccaggatcgatgtgggacaagtatgggaagcaacattacttcgtgtgcacaggtccaacgtcaatgctcgttcctgtcgatgtagcctccggagagacatggagaggagcaatggtaatcgagcatgataatttgtaa

SEQ ID NO: 2290 - protein, 348 aa, Arabidopsis thaliana
MASLISFSLLPKPKAVRSSISAPQTQTINTEKLEDKFGRKGIKFSESNNIPMVELKVRNGSSLKLSLSDAHVLSYKPKVYWKDEGFEEVLYTVDGDESRGGVGVVIVNGEEPKGGSSVISGCDWSVKDTDSDAIDALQIELSCTAGVLDITYIVSLYPVSMATALVVKNNGRKPVTLKPGIMSYLRFKKRSGAGIQGLKGCSYCPNPPLSSPFELLSPSEAMKAESSGWFGSEEGEKPGIWAVEDSVITLLEKKMSRIYGAPPAERLKAVYNTPPSKFETIDQGRGLFFRMIRIGFEEMYVGSPGSMWDKYGKQHYFVCTGPTSMLVPVDVASGETWRGAMVIEHDNL

SEQ ID NO: 2291 - DNA, 759 bp, Arabidopsis thaliana
atgtcaaagtctctagctggattggcggttttggccgctctttttattgcggttgatgcgtttaggccttctggtttaactaatggtcacgctacattctatggaggaagtgacgcttctggaacaatgggtggagcttgtggttacggagatctttactcggcggggtacgggacaatgacggcggcgttaagcacggctctgttcaacgacggagcttcttgcggagaatgctataggataacgtgtgatcacgcggcggactcacggtggtgcttgaaaggagcttctgtggttattacagccactaacttttgcccaccaaactttgctttgcctaacaacaacggtggttggtgcaatccgccgcttaaacatttcgacatggcacaacccgcttgggaaaagatcggaatttacagaggaggaatcgttcccgtcgttttccaaagagtaagctgttacaagaaaggaggagttagattcagaataaacggaagagactacttcgagctagtgaatattcaaaatgtaggaggagcaggttctattaaatctgtatccatcaaaggatcaaagactggttggttagccatgtctcgtaactggggagctaattggcaatcgaatgcttatctagatggtcaagctctctctttctccattaccactactgatggtgctactagagtctttctcaatgttgttccttcttcttggtcttttggacagatttattcttccaacgttcagttttaa

SEQ ID NO: 2292 - protein, 252 aa, Arabidopsis thaliana
MSKSLAGLAVLAALFIAVDAFRPSGLTNGHATFYGGSDASGTMGGACGYGDLYSAGYGTMTAALSTALFNDGASCGECYRITCDHAADSRWCLKGASVVITATNFCPPNFALPNNNGGWCNPPLKHFDMAQPAWEKIGIYRGGIVPVVFQRVSCYKKGGVRFRINGRDYFELVNIQNVGGAGSIKSVSIKGSKTGWLAMSRNWGANWQSNAYLDGQALSFSITTTDGATRVFLNVVPSSWSFGQIYSSNVQF

SEQ ID NO: 2293 - DNA, 1398 bp, Arabidopsis thaliana
atggcaatgtctgtaaatgtttcttcttcttcgtcttctgggatcataaactctcgtttcggtgtttcattggagccaaaagtttcgcaaattggttcgttgaggttattggatcgtgttcatgttgctcctgtgtctctgaatctatctgggaagcgatcatcatctgttaaacctttaaacgctgaaccaaagacaaaggattcaatgattcctcttgcggcaacaatggtagcagaaattgcagaggaagttgaagtggttgagattgaggattttgaagagcttgctaagaagttagagaatgcttcacctcttgagattatggacaaagctcttgagaaatacgggaacgatatcgccattgcatttagtggtgcagaagatgttgctcttattgagtacgctcatttgactgggaggccatttagagtatttagtttggatacagggaggttgaatcctgagacgtatcggtttttcgatgcggtggagaagcactatgggattaggattgagtatatgtttcctgattctgttgaggttcaaggtttggttaggagcaagggattgttctctttttatgaggatggtcatcaggagtgttgccgtgttcgaaaggtgagacctttgaggcgtgctctcaagggtttaaaggcttggattactggtcagaggaaagatcaatctccggggacaaggtctgagattccggttgttcaggttgatccggtgtttgaaggtttggatggtggagttggtagtttggtgaagtggaatccggttgcgaatgttgaagggaatgatgtttggaacttcttgaggactatggatgttccggttaacacattgcatgcggcagggtatatatcgattggatgtgagccttgcacgaaagcggttttaccgggtcagcacgagagagaagggagatggtggtgggaagatgctaaagccaaggaatgtggacttcacaaagggaatgtcaaagaaaactccgatgatgctaaagtgaacggggaatcgaaatccgctgttgcagatatctttaagagtgagaatcttgtgactttgagcaggcaggggattgagaatttgatgaagttggagaaccgtaaagagccttggatcgtcgtgctttatgctccgtggtgccccttttgtcaagccatggaagcatcgtatgatgaactggcggataaattggctggaagtgggattaaggttgccaaattcagagcagatggtgaccagaaggagtttgctaagcaggaattgcagctcggtagcttccctaccattctggttttccctaagaactcatcgagaccgatcaagtatccgtctgagaagagagatgttgagtctttgacttcgttcttgaatcttgtccgataa

SEQ ID NO: 2294 - protein, 465 aa, Arabidopsis thaliana
MAMSVNVSSSSSSGIINSRFGVSLEPKVSQIGSLRLLDRVHVAPVSLNLSGKRSSSVKPLNAEPKTKDSMIPLAATMVAEIAEEVEVVEIEDFEELAKKLENASPLEIMDKALEKYGNDIAIAFSGAEDVALIEYAHLTGRPFRVFSLDTGRLNPETYRFFDAVEKHYGIRIEYMFPDSVEVQGLVRSKGLFSFYEDGHQECCRVRKVRPLRRALKGLKAWITGQRKDQSPGTRSEIPVVQVDPVFEGLDGGVGSLVKWNPVANVEGNDVWNFLRTMDVPVNTLHAAGYISIGCEPCTKAVLPGQHEREGRWWWEDAKAKECGLHKGNVKENSDDAKVNGESKSAVADIFKSENLVTLSRQGIENLMKLENRKEPWIVVLYAPWCPFCQAMEASYDELADKLAGSGIKVAKFRADGDQKEFAKQELQLGSFPTILVFPKNSSRPIKYPSEKRDVESLTSFLNLVR

SEQ ID NO: 2295 - DNA, 690 bp, Arabidopsis thaliana
atgaaaagaatctccatcttcttctctatctcttggctatctctctctctaaactattcactcacacagtcattcttcgtcttcttctgtttcatgcaagattcaaaggcctcacctgcaagaaaaccttggtaccagagagctatggcggttgccagattcgcaacgaattggagaacaatccctaaatcatcatcacaacaacaaccagagaattttcgtccgtctcgaaaccctagcgtcaacagcaagtcatccaatcataaccaaatttatcaccagctgagaaaatgctcgtctctcaaggtagctgcgaattctttcactagggtttgcctctgcgctccgattggtccatacgacgacgtttttcggattcacgtcccgccgagaagaagttcaagctatcctccgtcgaagcctcttcctatggagacggcagtggcggtggcgacggcgaggatgagtgtggattcagggaggaggatatttagagggaagtcgttgagggaaaacgcgttgatgaggagattcgtggtggcggaagaagaagcgataatggagaatagaaagagagatcaaatggagattgtgaggaagagaaatcagatgaggaggaagaagaagcttggacctagtcctcttagtcgtatggttatcgctgaagatcaagaagtttgtcttctttga

SEQ ID NO: 2296 - protein, 229 aa, Arabidopsis thaliana
MKRISIFFSISWLSLSLNYSLTQSFFVFFCFMQDSKASPARKPWYQRAMAVARFATNWRTIPKSSSQQQPENFRPSRNPSVNSKSSNHNQIYHQLRKCSSLKVAANSFTRVCLCAPIGPYDDVFRIHVPPRRSSSYPPSKPLPMETAVAVATARMSVDSGRRIFRGKSLRENALMRRFVVAEEEAIMENRKRDQMEIVRKRNQMRRKKKLGPSPLSRMVIAEDQEVCLL

SEQ ID NO: 2297 - DNA, 1104 bp, Arabidopsis thaliana
atgaaagagagacaacgttggagtggtgaagaagatgcattgttacgtgcttacgttagacagttcggtccgagagaatggcatcttgtgtctgagcgtatgaacaaacctttgaaccgtgacgccaagtcttgtttagagagatggaagaattatcttaagccagggatcaagaaagggtctttgacagaggaagagcagaggcttgtgatccgtcttcaggagaaacacggcaacaagtggaagaagattgctgctgaggttcccgggaggacggcaaagcggttagggaagtggtgggaagtgtttaaggagaagcaacagagagaagagaaagagagtaacaagagagttgagcctattgacgagagtaagtacgatcggattctcgagagtttcgctgagaagcttgtcaaagagcggtctaacgttgtccctgctgctgccgctgctgcaacggttgtgatggctaattcgaatggagggtttttacattctgaacaacaagttcagcctcctaacccagtgatcccgccttggttagctacttctaacaatgggaacaatgttgttgcaaggcctccctcggtaactttgacattatcgccttccacagtggctgcagctgcgcctcaaccgccaatcccgtggctgcagcagcaacagcctgagagagcagagaacggtccagggggacttgtgttagggagtatgatgccgtcttgtagtgggagtagcgagagtgtgttcttgtcagagcttgtggagtgttgtagagagttggaggaagggcaccgagcttgggcagaccataagaaagaggctgcatggaggctaagaaggctggagctgcagctagagtcagagaagacgtgtagacaaagggagaagatggaggagattgaggcaaagatgaaagctcttagggaagagcagaagaacgcaatggagaagatcgaaggagagtacagagaacagctcgttggtttgaggcgagacgcagaggccaaagaccagaaactggctgatcaatggacctctaggcatatcagactcaccaagtttcttgaacaacaaatgggttgcagattagaccgcccctga

SEQ ID NO: 2298 - protein, 367 aa, Arabidopsis thaliana
MKERQRWSGEEDALLRAYVRQFGPREWHLVSERMNKPLNRDAKSCLERWKNYLKPGIKKGSLTEEEQRLVIRLQEKHGNKWKKIAAEVPGRTAKRLGKWWEVFKEKQQREEKESNKRVEPIDESKYDRILESFAEKLVKERSNVVPAAAAAATVVMANSNGGFLHSEQQVQPPNPVIPPWLATSNNGNNVVARPPSVTLTLSPSTVAAAAPQPPIPWLQQQQPERAENGPGGLVLGSMMPSCSGSSESVFLSELVECCRELEEGHRAWADHKKEAAWRLRRLELQLESEKTCRQREKMEEIEAKMKALREEQKNAMEKIEGEYREQLVGLRRDAEAKDQKLADQWTSRHIRLTKFLEQQMGCRLDRP

SEQ ID NO: 2299 - DNA, 2598 bp, Arabidopsis thaliana
atggagagacattgtgtgttagttgccacttttttgctgatgcttcatatcgttcatgctcaggatcaaattggattcattagtgtggattgtggtttggcacctcgtgagtctccttacaatgaagccaaaactggtttaacatatacatcagatgacggtctagtcaacgttgggaaacccggtagaatcgccaaggaattcgaaccgctcgccgataagccgactttgacactgagatattttccagagggagtacgaaactgctacaatctaaatgtcaccagcgacaccaactatctgatcaaggccacattcgtatatggaaattacgatggtcttaatgttgggccaaacttcgacctttacttcggtccgaatttgtggactacggtatgtcttattaagactggaataagtataccttttataaatgttttggagctacgaccgatgaagaaaaacatgtacgttactcaaggcgaatcactgaattacttattcagggtgtatattagcaattcaagtactcgtataaggttcccggatgatgtctatgatcgtaaatggtacccgtacttcgacaactcatggacacaagtaactacgactctcgatgtaaacacaagtcttacttatgaactaccacaaagtgtaatggcaaaagccgcaacgccaattaaggctaacgacaccttgaacattacatggacagtagagcctcctactacaaagttttactcctacatgcactttgcagagcttcagactttaagagccaacgatgcaagggaattcaatgtgacgatgaatggaatatatacatatggaccttatagtcctaaaccactaaaaaccgaaaccatatacgacaaaatccctgagcaatgcgatggaggtgcatgccttttgcaggttgtgaagacacttaaatctacccttccacctttacttaatgctatcgaggctttcaccgtgattgatttcccgcagatggagactaatggagatgacgttgatgcaatcaagaatgttcaagatacgtatggaattagtagaattagttggcaaggagatccatgtgtccccaaactgtttttgtgggatggtctaaattgcaacaactccgataattcgacatcaccaatcatcacttccttagacttatcttcaagtggactaactgggagcatcacccaagccattcagaatctaactaacctgcaagaactggacttgtcagataacaatttgactggagaaatacctgatttcttaggggacattaaatcactcttggtcataaacttaagtggtaataatctaagtggctcagttcctccctcacttcttcagaagaaaggaatgaagttaaatgtcgaaggaaaccctcatcttctttgcacagctgattcatgtgtgaaaaaaggagaggatggacacaagaaaaagagtgtcatagtgccagttgttgcatcaattgcttcaatagctgttcttataggtgcattggttctgtttttcattcttagaaagaaaaagtcaccaaaagttgaaggaccaccaccatcttatatgcaagcatcagatggtagatcgccaagatcatctgaaccggcaatagtgacaaagaatagaaggtttacttactcacaagttgcgataatgacaaataacttccaaagaatccttggaaaaggagggtttggaatggtttatcatggttttgtgaacggtacagaacaagtagctgttaagatactctcccattcatcgtctcaaggatataaagaatttaaagcggaggtagaacttcttcttagagttcatcacaagaacttggtcggtcttgttgggtactgcgacgaaggagagaacatggctcttatctatgaatacatggccaatggagatctaaaagaacatatgtcaggaacacgtaaccggtttactttgaattggggaactagactgaaaatagtcgtcgagtctgcacaaggacttgagtacttgcataatggatgcaaaccaccaatggttcatagagatgtcaaaaccacaaatatattgctgaacgaacacttccaagccaaactagctgattttgggctttcaaggtcatttccaattgaaggtgaaactcatgtgtcaacagttgttgctggaacgcctggatatcttgatcccgaatactataaaacaaattggttgacagaaaagagtgatgtttatagttttgggattgtattgttggagcttatcacaaatcgacccgtgatcgacaaaagccgtgaaaagccacatatagcagaatgggtaggagtaatgcttacaaaaggagacatcaacagtatcatggatcctaatttaaatgaagattatgattctggttctgtttggaaagctgttgagctagccatgagttgtctcaatccttcttcagcaagaagaccgaccatgtcccaagttgttattgaactaaacgagtgtatagcatcagaaaattcaaggggaggagcgagtcgggatatggactcgaagagttccatagaagtgagcttgacctttgataccgaactgagcccaacggctcggtag

SEQ ID NO: 2300 - protein, 865 aa, Arabidopsis thaliana
MERHCVLVATFLLMLHIVHAQDQIGFISVDCGLAPRESPYNEAKTGLTYTSDDGLVNVGKPGRIAKEFEPLADKPTLTLRYFPEGVRNCYNLNVTSDTNYLIKATFVYGNYDGLNVGPNFDLYFGPNLWTTVCLIKTGISIPFINVLELRPMKKNMYVTQGESLNYLFRVYISNSSTRIRFPDDVYDRKWYPYFDNSWTQVTTTLDVNTSLTYELPQSVMAKAATPIKANDTLNITWTVEPPTTKFYSYMHFAELQTLRANDAREFNVTMNGIYTYGPYSPKPLKTETIYDKIPEQCDGGACLLQVVKTLKSTLPPLLNAIEAFTVIDFPQMETNGDDVDAIKNVQDTYGISRISWQGDPCVPKLFLWDGLNCNNSDNSTSPIITSLDLSSSGLTGSITQAIQNLTNLQELDLSDNNLTGEIPDFLGDIKSLLVINLSGNNLSGSVPPSLLQKKGMKLNVEGNPHLLCTADSCVKKGEDGHKKKSVIVPVVASIASIAVLIGALVLFFILRKKKSPKVEGPPPSYMQASDGRSPRSSEPAIVTKNRRFTYSQVAIMTNNFQRILGKGGFGMVYHGFVNGTEQVAVKILSHSSSQGYKEFKAEVELLLRVHHKNLVGLVGYCDEGENMALIYEYMANGDLKEHMSGTRNRFTLNWGTRLKIVVESAQGLEYLHNGCKPPMVHRDVKTTNILLNEHFQAKLADFGLSRSFPIEGETHVSTVVAGTPGYLDPEYYKTNWLTEKSDVYSFGIVLLELITNRPVIDKSREKPHIAEWVGVMLTKGDINSIMDPNLNEDYDSGSVWKAVELAMSCLNPSSARRPTMSQVVIELNECIASENSRGGASRDMDSKSSIEVSLTFDTELSPTAR

SEQ ID NO: 2301 - DNA, 810 bp, Arabidopsis thaliana
atgttaaggtctctgatttggaaacgatcacaggcatattcttcagtcgtcacgatgtcttcaatcagtcagagaggaaatgaaaggcttttgtctgaagtcgctggttcacattcaagagataataagatattggttttgggaggaaatggttatgtaggttcacacatatgtaaggaggcactgagacaaggtttctctgtatctagtcttagcaggtctggaagatcttctcttcacgattcgtgggtcgatgatgtaacctggcatcaaggtgatttgctttcacccgattctctgaagcctgcactagaaggaattacatctgtgatttcatgtgttggtggttttggttccaactcacaaatggtcagaattaacggtactgcaaacatcaatgctgttaaagctgcagcagaacaaggtgtgaagagatttgtgtatatatcagctgcggattttggtgtcataaataacttgattcgaggatatttcgaagggaagagagcaaccgaagctgagattttggataaatttggaaacagaggttcggttttaaggccaggattcatacatgggactcgtcaggtcggtagcataaagctgccacttagtctcattggagctcctctcgaaatggttttgaagctgttgccaaaagaggtgacgaaaattcctgtgatcgggccacttttaatacctccggtcaatgtcaaatccgttgcagcaacagcggtaaaagctgcagttgatcccgagtttgcttctggagtcatcgatgtgtaccggattcttcaacatggtcactga

SEQ ID NO: 2302 - protein, 269 aa, Arabidopsis thaliana
MLRSLIWKRSQAYSSVVTMSSISQRGNERLLSEVAGSHSRDNKILVLGGNGYVGSHICKEALRQGFSVSSLSRSGRSSLHDSWVDDVTWHQGDLLSPDSLKPALEGITSVISCVGGFGSNSQMVRINGTANINAVKAAAEQGVKRFVYISAADFGVINNLIRGYFEGKRATEAEILDKFGNRGSVLRPGFIHGTRQVGSIKLPLSLIGAPLEMVLKLLPKEVTKIPVIGPLLIPPVNVKSVAATAVKAAVDPEFASGVIDVYRILQHGH

SEQ ID NO: 2303 - DNA, 1077 bp, Arabidopsis thaliana
atgtctgcgaaaacaatcctatcatcagtagttttggtggttctcgtcgccgcatcagcagcggctaatatcggattcgatgagtcaaacccgatccgaatggtctccgatggtctccgggaggtagaagaatctgtttcccagatcttaggtcaatctcgtcacgttctctctttcgctcgcttcactcaccgatatggtaaaaagtatcagaacgtggaggagatgaagcttcgattctcgattttcaaggagaatcttgatttgatcagatccaccaacaagaaaggcttatcttacaaactcggtgttaatcaatttgctgatttgacatggcaagagtttcaaaggaccaagcttggtgctgctcagaactgctctgccactttaaagggcagccacaaggtcacagaagcagctcttcctgaaacaaaagactggagagaagatggtatcgttagtccggtcaaagatcagggaggttgtggatcttgctggacattcagcacaactggagctcttgaggcagcttaccatcaggcatttggaaaaggaatttctctctctgagcaacagcttgtggattgtgctggagctttcaataactatggttgcaatggtggccttccttctcaagcctttgaatacatcaaatccaacggtggcctcgacacagagaaagcttatccttataccggtaaagatgaaacctgcaaattttcagctgaaaacgttggtgtacaagtcctcaactcagtcaacattactctgggtgctgaagatgaactgaagcatgcggttggattggtacggccagtaagcatagcatttgaggttatacactcgttccggctttacaagagtggagtttacactgatagtcactgtggaagtactccaatggatgtgaaccacgcggttttggccgttggttatggagttgaagacggtgtaccatattggcttattaagaactcatggggagcggattggggcgacaaaggttacttcaagatggagatggggaagaacatgtgtggtattgctacatgtgcatcataccccgttgtggcttga

SEQ ID NO: 2304 - protein, 358 aa, Arabidopsis thaliana
MSAKTILSSVVLVVLVAASAAANIGFDESNPIRMVSDGLREVEESVSQILGQSRHVLSFARFTHRYGKKYQNVEEMKLRFSIFKENLDLIRSTNKKGLSYKLGVNQFADLTWQEFQRTKLGAAQNCSATLKGSHKVTEAALPETKDWREDGIVSPVKDQGGCGSCWTFSTTGALEAAYHQAFGKGISLSEQQLVDCAGAFNNYGCNGGLPSQAFEYIKSNGGLDTEKAYPYTGKDETCKFSAENVGVQVLNSVNITLGAEDELKHAVGLVRPVSIAFEVIHSFRLYKSGVYTDSHCGSTPMDVNHAVLAVGYGVEDGVPYWLIKNSWGADWGDKGYFKMEMGKNMCGIATCASYPVVA

SEQ ID NO: 2305 - DNA, 1035 bp, Arabidopsis thaliana
atggctccggggcttactcaaaccgctgatgctatgtccaccgtgacgataacaaaaccgtcactgccatcagtccaagacagcgatcgagcttacgtgacgtttcttgctggaaacggtgattacgtgaaaggagtcgttggtttagccaaagggttaaggaaagtcaaatcggcttatccactcgtagtagcgatgttacccgacgtcccggaggaacaccgtcgtatacttgtggatcaaggatgcatcgtccgtgaaatcgaacccgtttacccacccgagaaccaaactcagttcgccatggcttattacgtcatcaactactctaaactccgtatctggaagtttgtggagtatagtaaaatgatatatttagatggagacattcaagtttacgaaaacatcgatcacttgtttgacctaccagatggctatttgtacgcggtgatggattgtttctgtgagaaaacatggagtcacacgccgcaatacaagatcagatattgccaacaatgccccgacaaagtccagtggccaaaagcggagcttggagagccaccggctctttacttcaacgccggaatgttcttgtacgagcctaacctcgagacttacgaggatctactacgaacacttaaaatcactcctccgactcctttcgctgaacaggattttttgaacatgtactttaagaaaatctacaagccgattcctttagtgtacaatctcgtccttgcgatgttatggcgtcacccagaaaatgtagagcttggaaaagtcaaggtggttcactactgtgcagcgggttcgaagccgtggagatacacagggaaagaagcgaacatggagagggaagatataaaaatgttagtgaaaaaatggtgggacatttacgacgacgaatccttggattacaagaaacctgttaccgttgtggacacagaggtcgatctcgtgaatctgaagccgttcatcaccgctcttactgaagctggccggctcaactacgtgaccgcaccgtccgctgcttga

SEQ ID NO: 2306 - protein, 344 aa, Arabidopsis thaliana
MAPGLTQTADAMSTVTITKPSLPSVQDSDRAYVTFLAGNGDYVKGVVGLAKGLRKVKSAYPLVVAMLPDVPEEHRRILVDQGCIVREIEPVYPPENQTQFAMAYYVINYSKLRIWKFVEYSKMIYLDGDIQVYENIDHLFDLPDGYLYAVMDCFCEKTWSHTPQYKIRYCQQCPDKVQWPKAELGEPPALYFNAGMFLYEPNLETYEDLLRTLKITPPTPFAEQDFLNMYFKKIYKPIPLVYNLVLAMLWRHPENVELGKVKVVHYCAAGSKPWRYTGKEANMEREDIKMLVKKWWDIYDDESLDYKKPVTVVDTEVDLVNLKPFITALTEAGRLNYVTAPSAA

SEQ ID NO: 2307 - DNA, 789 bp, Arabidopsis thaliana
atgggaggagaaggtggtgctgagcccgtaattcactttgtgtttgttcatggagccagtcacggagcttggtgttggtataaactcaccactcttctcgacgccgccgggttcaaatcaacctccgtagatctcaccggcgctggcatcagcctcatagactctaacatcgtcttcgactccgaccaatataaccgtcctctcttctctctcttgtccgatctccctcctcaccacaaagtcatactcgttggacatagcatcggtggaggaagtgtcaccgaagctctttgcaagttcactgacaaaatctccatggccatttacctcgcggcttccatggttcaacccggatccatcccttctccgcatctttcaaacatacatgtgggagaagaagatatatgggagtacacatatggtgaaggtaccgataaaccacccaccggagtcctcatgaaaccggagtttatacgccattattactatagccaaagccctcttgaggacgtaactttgtcatctaagctgttgcgtcctgctcctatgagggcctttcaagatcttgataagctacctccaaatcccgaggccgagaaagttcctcgagtttacatcaagactgctaaggataatctatttgattctgtgcgtcaagaccttttggtggagaattggccaccttctcagctgtatgtcttggaggatagtgaccattctgctttcttctctgtcccaactaccttattcgcgtatctcctccgtgcggtttcttttcttcaacgataa

SEQ ID NO: 2308 - protein, 262 aa, Arabidopsis thaliana
MGGEGGAEPVIHFVFVHGASHGAWCWYKLTTLLDAAGFKSTSVDLTGAGISLIDSNIVFDSDQYNRPLFSLLSDLPPHHKVILVGHSIGGGSVTEALCKFTDKISMAIYLAASMVQPGSIPSPHLSNIHVGEEDIWEYTYGEGTDKPPTGVLMKPEFIRHYYYSQSPLEDVTLSSKLLRPAPMRAFQDLDKLPPNPEAEKVPRVYIKTAKDNLFDSVRQDLLVENWPPSQLYVLEDSDHSAFFSVPTTLFAYLLRAVSFLQR

SEQ ID NO: 2309 - DNA, 1020 bp, Arabidopsis thaliana
atggcggggatactagtgaacaatatcctccctcaacctccgattctccgatcgctttcttcttcttcgcgaagaagttcaattcgaaccctagttatggtcaaagcttcttcctctgaaccttccgagtctgtttcagtctccacgaagaccagtgacgacactggagctgttgttgtgttcactgctcctcctggtttcaagccaccggagccaaaacggttcgccgtcaaatccggaaaactcttcgatgtcttgggtgcagcaattggattgtttttccgattcggcactggtgttttcgtttctgggtactctgcatcttttgtgtctaaggaagagattccagctgatcagtatgcgttgcgtttaggcgggatcacggtaaaggaaactgctaaggtcgggcctcgtcctgagaaacccattgagatatatgagtttgaaggctgtcccttctgccggaaggtcagggaaatggttgcagtgttggatcttgatattctctactatccttgtccaagagggagtccaaatttccgcccgaaggttaaacagatgggcgggaaacaacagtttccgtacatggttgatcccaataccggagtgtccatgtatgaatcagatggaatcatcaaatatctatccgagaaatatggagatggaacagttcctttaagtctgtcacttggtgctttaacggctataacagcaggctttgcaatgattggtcgtatgggaaagggtaacttgtacacaccagcgaaactaccacctaagccactcgaattctgggcatatgagggttctccgttttgtaagcttgtacgcgaagttcttgtagaactggagttaccacacattcagcgcagttgtgctcgtggtagccccaaacggcaggtattgcttgagaaagctggtcactttcaggtgccttacctggaagatccaaacactggagtcgcgatgtttgagagtgcagaaattgttgagtatctcaagcaaacttatgctgcctaa

SEQ ID NO: 2310 - protein, 339 aa, Arabidopsis thaliana
MAGILVNNILPQPPILRSLSSSSRRSSIRTLVMVKASSSEPSESVSVSTKTSDDTGAVVVFTAPPGFKPPEPKRFAVKSGKLFDVLGAAIGLFFRFGTGVFVSGYSASFVSKEEIPADQYALRLGGITVKETAKVGPRPEKPIEIYEFEGCPFCRKVREMVAVLDLDILYYPCPRGSPNFRPKVKQMGGKQQFPYMVDPNTGVSMYESDGIIKYLSEKYGDGTVPLSLSLGALTAITAGFAMIGRMGKGNLYTPAKLPPKPLEFWAYEGSPFCKLVREVLVELELPHIQRSCARGSPKRQVLLEKAGHFQVPYLEDPNTGVAMFESAEIVEYLKQTYAA

SEQ ID NO: 2311 - DNA, 1323 bp, Arabidopsis thaliana
atgccttggccaggaagaggccacatcaacccaatgttaaacctctgcaaaagcctcgtccggcgagacccaaacctcaccgtcacattcgtcgtcaccgaagaatggctcgggttcatcgggtccgacccgaaacctaaccggatccatttcgccactctccccaacatcattccctccgagctcgtccgagccaacgacttcatcgccttcatcgacgccgtcctcaccagattagaagagccgttcgaacagctacttgaccgtctaaactctcctcccaccgcaatcatcgccgatacttacatcatttgggcagtacgtgtaggcacaaaaaggaatattccggtggcttctttctggactacgtcagccacgattctctccctcttcattaactccgatcttctcgcaagtcacggccattttccgatcgaaccatcagaatcaaaactagacgagattgttgattacatccccggtttatctccgacaagactcagtgacttacagatcttacacggctatagtcatcaagtcttcaatatattcaaaaagtctttcggtgagctttataaagctaagtatcttctcttcccttctgcttatgagctcgaaccaaaagccattgactttttcacttccaagtttgatttcccggtttactccactggtccgttaatacccttggaagaactatccgttggaaatgagaatagagaacttgattactttaagtggcttgatgagcaacctgaaagctctgttctttacatatctcaagggagttttctttcagtctccgaagctcagatggaggagattgttgtaggagttagagaggctggagttaagttcttttgggtggctcgtgggggtgagttaaagcttaaggaggctcttgaaggtagcttgggtgttgtggtgagctggtgtgatcagctacgtgttttgtgtcatgcggctataggcgggttttggacgcattgcgggtataactcgacattggaagggatatgttcgggagtaccgttgcttacatttcctgttttttgggatcagtttctgaatgctaagatgattgttgaggagtggagagttggaatggggatcgagaggaagaagcagatggagttgttgatagtgagtgatgagatcaaggaattggtaaaaaggtttatggatggagagagtgaagaagggaaagagatgagaagaaggacttgtgatctcagtgagatatgtcgtggagcggttgcgaaaggtggttcttctgatgctaacatcgatgctttcattaaagatattactaagatcgtgtga

SEQ ID NO: 2312 - protein, 440 aa, Arabidopsis thaliana
MPWPGRGHINPMLNLCKSLVRRDPNLTVTFVVTEEWLGFIGSDPKPNRIHFATLPNIIPSELVRANDFIAFIDAVLTRLEEPFEQLLDRLNSPPTAIIADTYIIWAVRVGTKRNIPVASFWTTSATILSLFINSDLLASHGHFPIEPSESKLDEIVDYIPGLSPTRLSDLQILHGYSHQVFNIFKKSFGELYKAKYLLFPSAYELEPKAIDFFTSKFDFPVYSTGPLIPLEELSVGNENRELDYFKWLDEQPESSVLYISQGSFLSVSEAQMEEIVVGVREAGVKFFWVARGGELKLKEALEGSLGVVVSWCDQLRVLCHAAIGGFWTHCGYNSTLEGICSGVPLLTFPVFWDQFLNAKMIVEEWRVGMGIERKKQMELLIVSDEIKELVKRFMDGESEEGKEMRRRTCDLSEICRGAVAKGGSSDANIDAFIKDITKIV

SEQ ID NO: 2313 - DNA, 1095 bp, Arabidopsis thaliana
atgaaacttttctttattgttctcatctcttttctttccctcctccaagcatcaaaaggattcgatttcgacgaaaaagaattagaaaccgaagagaacgtatggaagctctatgagaggtggagaggccaccactctgtatccagagcctcccacgaggcaataaagcggttcaacgtttttagacacaatgtccttcatgtccacaggactaacaaaaagaacaagccttacaaactcaagatcaatagattcgccgacataacgcaccacgagtttagaagctcctacgctggctctaatgttaagcatcaccgaatgcttcgtggaccgaagcgcggatctggtggtttcatgtatgagaatgtgaccagagttccgagttctgttgattggcgagagaaaggagctgtcactgaggtcaagaatcaacaagattgtggaagttgctgggcgttttcgacggttgcagcagtggaagggataaacaagatcagaacaaacaaactggtttcattgtctgaacaagagcttgtggattgtgacactgaagagaatcaaggttgtgcaggaggtctcatggaacctgcgtttgaatttataaagaacaatggtggcatcaaaaccgaagagacttatccttacgattccagtgacgttcaattctgtagagctaatagtattggtggagaaactgtaaccatcgatggacacgaacacgtccctgagaatgatgaggaagaacttctcaaagctgttgctcaccagcctgtctctgtagctattgatgctgggagctcagatttccagctttactctgagggtgtgtttatcggagaatgcgggactcagttgaaccacggggtggtgattgttgggtatggagagaccaaaaatggaacaaaatattggatagtaaggaactcatggggacctgaatggggagaaggaggctatgttcggatagaaagaggaatatcggagaatgaaggacgttgcggtatagccatggaggcttcttatcccaccaagctctcttcgactccttctactcatgagtcagtagttcgtgatgatgttaaagacgagctctag

SEQ ID NO: 2314 - protein, 364 aa, Arabidopsis thaliana
MKLFFIVLISFLSLLQASKGFDFDEKELETEENVWKLYERWRGHHSVSRASHEAIKRFNVFRHNVLHVHRTNKKNKPYKLKINRFADITHHEFRSSYAGSNVKHHRMLRGPKRGSGGFMYENVTRVPSSVDWREKGAVTEVKNQQDCGSCWAFSTVAAVEGINKIRTNKLVSLSEQELVDCDTEENQGCAGGLMEPAFEFIKNNGGIKTEETYPYDSSDVQFCRANSIGGETVTIDGHEHVPENDEEELLKAVAHQPVSVAIDAGSSDFQLYSEGVFIGECGTQLNHGVVIVGYGETKNGTKYWIVRNSWGPEWGEGGYVRIERGISENEGRCGIAMEASYPTKLSSTPSTHESVVRDDVKDEL

SEQ ID NO: 2315 - DNA, 2088 bp, Arabidopsis thaliana
atggcggctttattagcttctcagagctgctgctatggcggtgagaccgcaagagtcaccaaagctattggtttcagtagctctttggagaatcatttcactggggaagccactcagtgttatggcagcaagtctaagagatttcgtattgagatgagacagtcggaattgccctctaaggttggaatcaatggacgttcagtcaaaatggttcctgcgagtgaggtggtgaagaggaaagatggtgtgaatggatcggctgggaaaggtgttaatggagcgagtttggttagtagtagaaacattaatggtgcggcgtcaactttggttaaggcaccaaagaaaacaacagaatcgtaccttcctccaccggttgaaggagttagggttcttccttctgatgaaggttttagctgggctgatgagaattatagctcacttcaacgcagtattgatgtttggtcatttgttatttccctgaggattcgtatcttgttcgataattcgaaatgggcttatgttggaggattcacagaagaaaaacagaaaagcagaagaagagaaacagcttcatggttgagagagagtgtattgcagcttggtccaacgtttatcaaactgggacagttgtcttcaactaggtcagacttgtttccgcgcgaattcgtggatgagctttccaagttgcaggacagagtccccgctttttctccagagaaagcaaagcgcttcattgaggctgaacttggggctcctattagtgtaatgtataaagaatttgaagagcaacccatagctgcagctagccttggtcaggtacacagagctgttttgcacaatggcgagaaagtggtagtaaaagtacaaagacccggactaaagaaacttttcgatattgatctacgaaatctgaagctgattgccgagtatttccagaaaagtgaatcatttggtacaaacgattgggttggtatctatgaagaatgtgccttaattttgtatcaagagattgactacataaacgaagctaagaacgctgacagattccggagagacttccggaatataaactgggtccgcgtacctttggtttattgggattactctgccatgaaggtcttgactttggagtatgtaccaggtgttaagatcaacaacttggacgccttagctgcacggggttttaaccgttctagaatcgcatcacgggccattgaagcttatcttatacagatactcaaaaccggcttctttcatgcggatccgcacccaggaaaccttgcaattgatgtagatgaatcaatcatctactatgacttcggcatgatgggagagatcaaaacatttactcggaagagattacttgatctcttctattctgtttatgaaaaagatgcaaaaaaggtcatgcaaaaccttatagaccttgaagcacttcaacccactggagatctttcatcggtaaggagatctgttcagtttttcttggacaacctattaagccaatcaccagatcagcaacagactttggcagctattggagaggatctgtttgcaatttcccaggatcagccattccgtttcccatcaactttcacctttgtcatccgagcattttccacacttgagggtattggttacatccttgatccagaattttcctttgtgaaggttgcggctccttatgcgcaggaactcctggatctaaaacaaaggcaacgctcgggaactcagcttgtccaagaaataagaaagcaggctgatgatgccaggtcttctactctgtctatgccatatcgagtgcagcgaatagaagagtttgtgaaagaactcgattcaggcgatctgaaactccgtgttcgggttcttgagtcggaaagagcagcccggaaagcgacaatactgcagatggcgacgatgtatacagttcttggaggaactctacttaatattggggttacatttagcaaccaaggaagtcagcttgttgccaatggatccttcattggagcagggatattcatgttattggtactgaggtctatgcaaagggtaaataagcttgataaatttgagaagatgatatga

SEQ ID NO: 2316 - protein, 695 aa, Arabidopsis thaliana
MAALLASQSCCYGGETARVTKAIGFSSSLENHFTGEATQCYGSKSKRFRIEMRQSELPSKVGINGRSVKMVPASEVVKRKDGVNGSAGKGVNGASLVSSRNINGAASTLVKAPKKTTESYLPPPVEGVRVLPSDEGFSWADENYSSLQRSIDVWSFVISLRIRILFDNSKWAYVGGFTEEKQKSRRRETASWLRESVLQLGPTFIKLGQLSSTRSDLFPREFVDELSKLQDRVPAFSPEKAKRFIEAELGAPISVMYKEFEEQPIAAASLGQVHRAVLHNGEKVVVKVQRPGLKKLFDIDLRNLKLIAEYFQKSESFGTNDWVGIYEECALILYQEIDYINEAKNADRFRRDFRNINWVRVPLVYWDYSAMKVLTLEYVPGVKINNLDALAARGFNRSRIASRAIEAYLIQILKTGFFHADPHPGNLAIDVDESIIYYDFGMMGEIKTFTRKRLLDLFYSVYEKDAKKVMQNLIDLEALQPTGDLSSVRRSVQFFLDNLLSQSPDQQQTLAAIGEDLFAISQDQPFRFPSTFTFVIRAFSTLEGIGYILDPEFSFVKVAAPYAQELLDLKQRQRSGTQLVQEIRKQADDARSSTLSMPYRVQRIEEFVKELDSGDLKLRVRVLESERAARKATILQMATMYTVLGGTLLNIGVTFSNQGSQLVANGSFIGAGIFMLLVLRSMQRVNKLDKFEKMI

SEQ ID NO: 2317 - DNA, 651 bp, Arabidopsis thaliana
atggctgcttcatcttcctctttcactctctgtaatcacaccacacttcgtactctccctctgagaaagacccttgtcaccaaaacccaattttcagttcccacaaaatcatcagaatctaacttctttggctccacactcactcactcatcgtatatctccccagtctcttcctcttctctcaaaggcttaatctttgccaaggttaacaagggtcaggctgcaccagacttcacactaaaggatcaaaacggaaagccggtgagcctcaaaaagtataaagggaagcctgttgttctctacttctaccctgcagatgaaacccctggctgcaccaagcaggcttgtgctttcagagactcttatgagaaattcaagaaagctggtgcagaggtcattggcattagtggagatgactctgcttctcacaaggcgtttgcaagcaaatacaaactaccgtatacattgttaagcgacgaagggaataaggtgagaaaagattggggagtgcctggagacctgtttggagcattgccagggagacagacttacgttcttgacaaaaacggtgttgttcagctcatctacaacaaccagttccagcctgagaaacacatcgacgagaccttgaagtttctcaaagctgcttga

SEQ ID NO: 2318 - protein, 216 aa, Arabidopsis thaliana
MAASSSSFTLCNHTTLRTLPLRKTLVTKTQFSVPTKSSESNFFGSTLTHSSYISPVSSSSLKGLIFAKVNKGQAAPDFTLKDQNGKPVSLKKYKGKPVVLYFYPADETPGCTKQACAFRDSYEKFKKAGAEVIGISGDDSASHKAFASKYKLPYTLLSDEGNKVRKDWGVPGDLFGALPGRQTYVLDKNGVVQLIYNNQFQPEKHIDETLKFLKAA

SEQ ID NO: 2319 - DNA, 933 bp, Arabidopsis thaliana
atggctttagtacgtgaacgtcgtcagctaaatctccgtcttcctcttcctccaatctccgaccgccgcttctccacctcttcctcctcagccaccaccaccaccgtcgctggctgtaacggaatctccgcttgtgatctcgagaaactcaacgttctcggatgcggaaacggcgggattgtttacaaagtccgtcataaaaccacatcggagatctacgctttgaaaacagttaacggcgacatggatccgattttcacaagacagttgatgcgagagatggagattctccgccgtacagattcaccgtacgtcgttaagtgtcacggaatcttcgagaaacctgtcgtcggtgaagtatcgattctaatggagtatatggacggcggaaccctagaatcactacgcggcggtgtaacggagcaaaaactcgccggattcgctaaacagatcttaaaaggattaagctatttacacgctcttaagatcgttcatcgtgatatcaaaccggcgaatcttcttctcaattcgaaaaacgaagttaaaatcgctgatttcggagttagtaagatcttagtccgatcattagattcgtgtaattcgtatgttggtacttgtgcttatatgagtccggagaggtttgattcggaatcttccggtggaagctctgatatctacgccggagatatctggagtttcggattgatgatgcttgagcttctcgttggtcattttcctttgcttccgccgggacagagacctgattgggcgacgttgatgtgcgcggtgtgttttggagaaccgccgcgagcgccggagggatgttctgaagagtttaggagcttcgttgagtgttgtctccgtaaagattcgagtaagcgatggacggcgccgcagcttcttgctcatccttttctccgggaagatctttga

SEQ ID NO: 2320 - protein, 310 aa, Arabidopsis thaliana
MALVRERRQLNLRLPLPPISDRRFSTSSSSATTTTVAGCNGISACDLEKLNVLGCGNGGIVYKVRHKTTSEIYALKTVNGDMDPIFTRQLMREMEILRRTDSPYVVKCHGIFEKPVVGEVSILMEYMDGGTLESLRGGVTEQKLAGFAKQILKGLSYLHALKIVHRDIKPANLLLNSKNEVKIADFGVSKILVRSLDSCNSYVGTCAYMSPERFDSESSGGSSDIYAGDIWSFGLMMLELLVGHFPLLPPGQRPDWATLMCAVCFGEPPRAPEGCSEEFRSFVECCLRKDSSKRWTAPQLLAHPFLREDL

SEQ ID NO: 2321 - DNA, 1545 bp, Arabidopsis thaliana
atggacaccgcaaccaccacatgctctgccgtagatctatctgccctcctatcctcttcttctaactcaacatcttccctcgccgcggcaacctttttatgttcccaaatttcaaacatctccaacaaactctccgacacaacttatgccgtcgacaacacgtatctcctcttctccgcctaccttgtctttgccatgcagctcggtttcgctatgctttgtgctggatcagtccgagccaagaacactatgaacatcatgcttaccaatgtccttgatgctgccgctggagccatctcttactacctcttcggattcgcattcgcctttggtacaccttccaacggattcatcggtcgccaccatagcttcttcgctttaagctcttaccctgaacgccccggctccgacttcagctttttcctctaccaatgggcttttgccatagccgcggccggaatcactagcggttccatcgccgagcgaacgcaattcgttgcttaccttatctactctactttcttgaccggttttgtttacccgacagtctcgcactggttctggtcaagtgatggatgggctagcgcgtcccggtctgacaacaatctcttgtttggctcaggtgctattgatttcgcaggttcaggagttgttcacatggtaggtggaattgccggtttatgtggagcgttagttgaaggaccaagaataggtagatttgaccggtcaggccggtccgtggctttacgtggtcacagtgcatcccttgtcgtgcttggtaccttcttgttgtggtttggatggtatgggtttaaccctggttcctttttaaccattcttaaaggctacgacaagtctcggccatattatggtcaatggagcgctgtaggtcgcaccgcggtcaccacaacgctttctggctgcaccgctgcgttgactactctattcagtaaacggcttttagcaggtcattggaacgttattgacgtatgcaacggacttctaggcggctttgcagctataacctccggatgtgccgtggtggagccgtgggctgctatagtatgtggctttgtggcatcatgggttttaatcggatttaacttgcttgccaagaaacttaaatatgatgacccactcgaggctgctcagctccacggtggatgtggagcatggggattaatctttaccgggctgttcgcaaggaaagaatacgttaacgagatttactccggtgataggccttacggactgttcatgggcgggggaggaaaactgctcgccgcgcagatcgttcagattattgtgatcgttgggtgggtgacggtaactatgggaccgttgttttatgggttacataagatgaatcttttgaggatatcagcagaagatgagatggcaggaatggacatgacacgtcatggaggatttgcttacgcatacaatgacgaagacgacgtgtcgactaaaccatggggtcatttcgctggaagagtggagcctacaagccggagctcgactcctacaccgaccttgactgtttga

SEQ ID NO: 2322 - protein, 514 aa, Arabidopsis thaliana
MDTATTTCSAVDLSALLSSSSNSTSSLAAATFLCSQISNISNKLSDTTYAVDNTYLLFSAYLVFAMQLGFAMLCAGSVRAKNTMNIMLTNVLDAAAGAISYYLFGFAFAFGTPSNGFIGRHHSFFALSSYPERPGSDFSFFLYQWAFAIAAAGITSGSIAERTQFVAYLIYSTFLTGFVYPTVSHWFWSSDGWASASRSDNNLLFGSGAIDFAGSGVVHMVGGIAGLCGALVEGPRIGRFDRSGRSVALRGHSASLVVLGTFLLWFGWYGFNPGSFLTILKGYDKSRPYYGQWSAVGRTAVTTTLSGCTAALTTLFSKRLLAGHWNVIDVCNGLLGGFAAITSGCAVVEPWAAIVCGFVASWVLIGFNLLAKKLKYDDPLEAAQLHGGCGAWGLIFTGLFARKEYVNEIYSGDRPYGLFMGGGGKLLAAQIVQIIVIVGWVTVTMGPLFYGLHKMNLLRISAEDEMAGMDMTRHGGFAYAYNDEDDVSTKPWGHFAGRVEPTSRSSTPTPTLTV

SEQ ID NO: 2323 - DNA, 1362 bp, Arabidopsis thaliana
atgaccaaattctccgagccaatcagagactcccacgtggcagttctcgcgtttttccccgttggcgctcatgccggtcctctcttagccgtcactcgccgtctcgccgccgcttctccctccaccatcttttctttcttcaacaccgcaagatcaaacgcgtcgttgttctcctctgatcatcccgagaacatcaaggtccacgacgtctctgacggtgttccggagggaaccatgctcgggaatccactggagatggtcgagctgtttctcgaagcggctccacgtattttccggagcgaaatcgcggcggcagagatagaagttggaaagaaagtgacatgcatgctaacagatgccttcttctggttcgcagcggacatagcggctgagctgaacgcgacttgggttgccttctgggccggcggagcaaactcactctgtgctcatctctacactgatctcatcagagaaaccatcggtctcaaagatgtgagtatggaagagacattagggtttataccaggaatggagaattacagagttaaagatataccagaggaagttgtatttgaagatttggactctgttttcccaaaggctttataccaaatgagtcttgctttacctcgtgcctctgctgttttcatcagttcctttgaagagttagaacctacattgaactataacctaagatccaaacttaaacgtttcttgaacatcgcccctctcacgttattatcttctacatcggagaaagagatgcgtgatcctcatggctgctttgcttggatggggaagagatcagctgcttctgtagcgtacattagcttcggcaccgtcatggaacctcctcctgaagagcttgtggcgatagcacaagggttggaatcaagcaaagtgccgtttgtttggtcgctgaaggagaagaacatggttcatctaccaaaagggtttttggatcggacaagagagcaagggatagtggttccttgggctccacaagtggaactgctgaaacacgaggcaatgggtgtgaatgtgacacattgtggatggaactcagtgttggagagtgtgtcggcaggtgtaccgatgatcggcagaccgattttggcggataataggctcaacggaagagcagtggaggttgtgtggaaggttggagtgatgatggataatggagtcttcacgaaagaaggatttgagaagtgtttgaatgatgtttttgttcatgatgatggtaagacgatgaaggctaatgccaagaagcttaaagaaaaactccaagaagatttctccatgaaaggaagctctttagagaatttcaaaatattgttggacgaaattgtgaaagtttag

SEQ ID NO: 2324 - protein, 453 aa, Arabidopsis thaliana
MTKFSEPIRDSHVAVLAFFPVGAHAGPLLAVTRRLAAASPSTIFSFFNTARSNASLFSSDHPENIKVHDVSDGVPEGTMLGNPLEMVELFLEAAPRIFRSEIAAAEIEVGKKVTCMLTDAFFWFAADIAAELNATWVAFWAGGANSLCAHLYTDLIRETIGLKDVSMEETLGFIPGMENYRVKDIPEEVVFEDLDSVFPKALYQMSLALPRASAVFISSFEELEPTLNYNLRSKLKRFLNIAPLTLLSSTSEKEMRDPHGCFAWMGKRSAASVAYISFGTVMEPPPEELVAIAQGLESSKVPFVWSLKEKNMVHLPKGFLDRTREQGIVVPWAPQVELLKHEAMGVNVTHCGWNSVLESVSAGVPMIGRPILADNRLNGRAVEVVWKVGVMMDNGVFTKEGFEKCLNDVFVHDDGKTMKANAKKLKEKLQEDFSMKGSSLENFKILLDEIVKV

SEQ ID NO: 2325 - DNA, 1002 bp, Arabidopsis thaliana
atggctgcttctgtcgaaactccttcacctaatcatacgaacaacgaaggaacacgcttgaacatggtttctgcaacttcttttgattcttcttctccatcggttagtccatcttcagacaaacgtctctggagcaatgtacgtaacagggttgatgttcttctcgaagaaaatagcaaaaatcacaaacccgttaccaatacgattgctatagaatcagagagatcaaagagatttaagaatgattcgatgcttttgcttaaagggtttgattctgtttctcatactctgtctctcctttctagtaatctcgacaatgcccttcagggagttagagaattagctaaaccaccttcatattctgagatactccattcgaatctcaaagctgatcagattcaacgacaacagaaagaagaagatgaagaggaagaagagagtaaagggaagaagaggaaacacgaatctgatgttgaacaaacagaagattcgtctaatgaagaagagaagagaccaaaagagaggaaaatcatgaagaaggctaagaacattgctatatccatggcagctaaggcgaattcgcttgcaagagagcttaaaactataaaatcagacctgagttttatccaagaacgttgtgggttgcttgaagaagagaacaagagactcagagatgggtttgtgaaaggtgttagacctgaagaagatgatttggtgaggctacaactggaggtgttgcttgcagagaaagctagactagcgaatgagaacgcgaatttagttagggaaaatcagtgtcttcatcagatggttgagtaccatcagattacatctcaagatctatctccttcatatgaacaagttgttcaaggtttttgcttagatttctcatcccctctgcctcaatacgatgatgaagaagaagagcatgaaacaagagctcgagatgtctcgaaagccctcaacgaaagctttgaaaaagctgaagaagaacaatactaa

SEQ ID NO: 2326 - protein, 333 aa, Arabidopsis thaliana
MAASVETPSPNHTNNEGTRLNMVSATSFDSSSPSVSPSSDKRLWSNVRNRVDVLLEENSKNHKPVTNTIAIESERSKRFKNDSMLLLKGFDSVSHTLSLLSSNLDNALQGVRELAKPPSYSEILHSNLKADQIQRQQKEEDEEEEESKGKKRKHESDVEQTEDSSNEEEKRPKERKIMKKAKNIAISMAAKANSLARELKTIKSDLSFIQERCGLLEEENKRLRDGFVKGVRPEEDDLVRLQLEVLLAEKARLANENANLVRENQCLHQMVEYHQITSQDLSPSYEQVVQGFCLDFSSPLPQYDDEEEEHETRARDVSKALNESFEKAEEEQY

SEQ ID NO: 2327 - DNA, 843 bp, Arabidopsis thaliana
atgagcaatcatcaaactcaggtgttgaagctattggagccatggtgtgaacttaaagacaaagtggttcttgtgacaggagcttcctctggtattggaagagagatctgtcttgatcttgccaaagctggttgccaggttattgcagcagctcgtcgtgttgatcgactcaactctctctgctctgaaatcaacagcttcagttcaactggaatccaagccgcagctcttgagttagacgtttcatcagacgcagccaccattcaaaaagcggtcagggaagcttgggacatctttggaaagatcgatgcattgatcaacaatgctggaatcagaggcaatgtcaagtcgagtttggatttgtcagaggacgaatgggacaacgtcttcaagaccaacttaaagggtccttggttagtatccaaacatgtttgtatgttaatgcgtgacgctaaacgaggtggctcggtgataaacatctcatcgatcgccgggatccggggtatgttgcccggtggacttgcttatgcttgttccaaaggcggtgttgacaccatgtcaaggatgatggcacttgagttaggtgttcataagatcagagtgaactcgatcgcaccggggcttttcaagtcagagatcacacaaggtcttatgcaaaaggagtggctcaagaatgttaccgagaggactgtgccgttaaaggtgcaacagaccgttgatccagggcttacttctctggttcgctatctcattcatgactcttctcaatatatatccgggaatacatacattgttgattccggtgctacattgcccggtgtgcctatcttttcatctctctga

SEQ ID NO: 2328 - protein, 280 aa, Arabidopsis thaliana
MSNHQTQVLKLLEPWCELKDKVVLVTGASSGIGREICLDLAKAGCQVIAAARRVDRLNSLCSEINSFSSTGIQAAALELDVSSDAATIQKAVREAWDIFGKIDALINNAGIRGNVKSSLDLSEDEWDNVFKTNLKGPWLVSKHVCMLMRDAKRGGSVINISSIAGIRGMLPGGLAYACSKGGVDTMSRMMALELGVHKIRVNSIAPGLFKSEITQGLMQKEWLKNVTERTVPLKVQQTVDPGLTSLVRYLIHDSSQYISGNTYIVDSGATLPGVPIFSSL

SEQ ID NO: 2329 - DNA, 627 bp, Arabidopsis thaliana
atggaaggaatcattgtgagaagagttataccatctgataacagttgtctcttcaatgcaatcggttatgtcatggacaaggacaaaaacaaagctcctgagctcagacaggtgatagcagcagcagttgcaagcaacaaggagaaatataatgaagcatttctagggaagctcaatgaagaatattgtgcttggattctcaatccagacaagtggggaggtgcgattgagctttcgatattagcagattattatggtcgagaaattgcagcttacgacattcaaactagtcgatgtgacttgtatggacagacgagaaactacgacgaaagagttatgctgatctatgacggtcttcattacgatgctcttgctctgtctccatttgaaggggccgaggaagattttgatatgactatatatccagttggtaaagatagatccataggatcaattgaagggcttgctttgaatctagtgaaggaccaacaaaggaaaaggagttacacagatactgcaaacttcactctacgttgcggtgtttgccaaattggagttattggacaaaaggaagctgtggaacatgctcaagcaactggtcatgttaattttcaagaatacaaataa

SEQ ID NO: 2330 - protein, 208 aa, Arabidopsis thaliana
MEGIIVRRVIPSDNSCLFNAIGYVMDKDKNKAPELRQVIAAAVASNKEKYNEAFLGKLNEEYCAWILNPDKWGGAIELSILADYYGREIAAYDIQTSRCDLYGQTRNYDERVMLIYDGLHYDALALSPFEGAEEDFDMTIYPVGKDRSIGSIEGLALNLVKDQQRKRSYTDTANFTLRCGVCQIGVIGQKEAVEHAQATGHVNFQEYK

SEQ ID NO: 2331 - DNA, 903 bp, Arabidopsis thaliana
atggcggatgcgtggaaggatttagcttcagggactgttggaggagctgctcaactagttgttggtcatccatttgacactatcaaggtcaaacttcagagccaaccgactccagcaccaggccaacttccaaggtacaccggtgcaatcgatgcggttaaacagaccgttgcttctgaaggaaccaaaggtttgtataaaggtatgggagctccacttgcaaccgttgctgccttcaatgcggttttgttcactgtgagaggtcaaatggaagggctgcttaggtctgaagctggagttcctttgaccattagtcaacagtttgtggccggtgcaggcgctggtttcgctgtttcgttccttgcttgtcctaccgagttgatcaagtgcaggttgcaagcacaaggtgcattagctggtgcctctactacaagctcagtggttgcagccgtgaaatacggtggaccaatggatgtagcccgtcatgtcctacgatcagaaggaggagcacgaggtctattcaaaggtttattccctacattcgcccgtgaagtcccgggaaatgcaacaatgtttgcagcctacgaagctttcaagcggtttttagccggtggttcagacacttcaagcttaggacaagggtcattgatcatggcgggtggagtcgctggtgcttctttttggggaatagtatatccgacagatgttgtgaagagtgttcttcaagtcgacgattacaaaaacccgagatacacggggtcgatggatgcttttcggaagattctgaaatctgaaggagttaaaggtttgtataaaggatttggtccagctatggctaggagtgttcctgctaatgctgcttgcttcttggcttatgagatgacaaggtcaagcttgggataa

SEQ ID NO: 2332 - protein, 300 aa, Arabidopsis thaliana
MADAWKDLASGTVGGAAQLVVGHPFDTIKVKLQSQPTPAPGQLPRYTGAIDAVKQTVASEGTKGLYKGMGAPLATVAAFNAVLFTVRGQMEGLLRSEAGVPLTISQQFVAGAGAGFAVSFLACPTELIKCRLQAQGALAGASTTSSVVAAVKYGGPMDVARHVLRSEGGARGLFKGLFPTFAREVPGNATMFAAYEAFKRFLAGGSDTSSLGQGSLIMAGGVAGASFWGIVYPTDVVKSVLQVDDYKNPRYTGSMDAFRKILKSEGVKGLYKGFGPAMARSVPANAACFLAYEMTRSSLG

SEQ ID NO: 2333 - DNA, 900 bp, Arabidopsis thaliana
atgtcgcgaccaatccccattgaagaaatggtgaggctgttcaaaatacgtcacacaacatctcacttgttcaagatagacaacttctctttactcaaaaagcatggaatcgaaaaggtcgaatcctctgttttcgatctcgctggtcacaaatggaaactctctgtgtacccaaatgggcataagaatgctaaggggactcatgtctccatgttcttagtgaatcaagttccggtaaatgatatgcctacatatgagctcctagtcgtcagtcaactagagcgaaaatggcacacccatggacgagatgagtttgatataaatccagaaccagctagtgaggggtttttaaggttcatatctcttgctgatcttgagagaaaaggtttccttattggagattgttgtatgtttggtgtcaagtttcatgggattgaacctgctaatcccggaacagcagagtgttttagcttaatagagaagcctcttaaccacaaagtcacttggatgatgagcaagttctcgtccttcaaccctggaaaggctcatcagtctaatgaatttgtcgttggaaccaggaaatggagacttgaagttcatccaagagggtatatggatgaaaaagacaaatcattttctgtgtatctatcagcagaagggtttgtcaacaatgcaccaatgacaaaaacttacgccaagttcaagctgcgggtattggatcaagttagctggaatcatgttgaggaatcaggtttgagctggtttgatgcagaaccttcggaccaaagtggctttgcggatttcatgcctctggggaaactaaatgaaccttatttggtaaaggataagctttatgtgggagttgagtttgaagtcgtttctaccacttattactgttag

SEQ ID NO: 2334 - protein, 299 aa, Arabidopsis thaliana
MSRPIPIEEMVRLFKIRHTTSHLFKIDNFSLLKKHGIEKVESSVFDLAGHKWKLSVYPNGHKNAKGTHVSMFLVNQVPVNDMPTYELLVVSQLERKWHTHGRDEFDINPEPASEGFLRFISLADLERKGFLIGDCCMFGVKFHGIEPANPGTAECFSLIEKPLNHKVTWMMSKFSSFNPGKAHQSNEFVVGTRKWRLEVHPRGYMDEKDKSFSVYLSAEGFVNNAPMTKTYAKFKLRVLDQVSWNHVEESGLSWFDAEPSDQSGFADFMPLGKLNEPYLVKDKLYVGVEFEVVSTTYYC

SEQ ID NO: 2335 - DNA, 333 bp, Arabidopsis thaliana
atgttgaaatttccactttgttgcagtgagttatctttagaaccgaagattctagcttttgaaagtcagcttgtttcggggcgacgcgatacaatcaaagtttctgcgggaaaaatcggaaatttctctcttggttcgatattcaaaagttgtgagacttgtggagccaaaggagcaattgaatgtcccggttgcaagggaacaggtaaaaataagaagaacggaaatatgtttgagaggtggaaatgttttgattgtcaaggatttggtatgaagagttgtcctaaatgtggcaagggaggcttgacgcctgaacagagaggggaacgatag

SEQ ID NO: 2336 - protein, 110 aa, Arabidopsis thaliana
MLKFPLCCSELSLEPKILAFESQLVSGRRDTIKVSAGKIGNFSLGSIFKSCETCGAKGAIECPGCKGTGKNKKNGNMFERWKCFDCQGFGMKSCPKCGKGGLTPEQRGER

SEQ ID NO: 2337 - DNA, 1479 bp, Arabidopsis thaliana
atggatttgaaccaaatcttgatcctctcatttctctctctttttaccttagccatattcttgctcacaagatccaaacggaaactaaaccttcctccgtcgccggcgatctccttgccggtgatcggacacctccatctcctcaagccaccgcttcaccgtaccttcctttccctttccaaatccatcggaaatgctccggtcttccatctccgactcggaaatcgcctcgtttatgtcatctcttcacgttccatcgctgaagaatgtttcacaaagaacgatgtcgttctcgcgaaccgccccaagttcaccataagtaagcacctcggctacaacgccacctacttactctcggcatcttacggcgatcattggaggaacctccgccgcatagccgccgtcgagatattctccactcatagactcaattcgtttctgtatattcgtaaggacgagatccgacggctcatttcacatctctctcgtgattccttacacggatttgtggaggtagagatgaaaacattgttaaccaatttggcatccaacaccaccatcagaatgttggccgggaagagatatttcggtgaggacaacgatgacgctaaactcgtgaagaaccttgtgtcggaggcggtgaccagcgccggtgcaggaaaccccattgattatctttccattttacgttgggtctcgagttatgaaaaacgaatcaagaatttgggaaataggtttgatacgtttttgcagaaattagtcgacgaaaaacgtgcggagaaggaaaaaggtgaaactatgatcgatcacttgcttgctctccaagacattcaacctgattactatacggatgtcatcatcaaaggaatcatacttaccctgataattgcagggacagatacgtcatcagtaacactagaatgggcaatgtcaaatctgttgaaccatccagaaatacttaagaaagcgagaatggaaatcgatgaaaaagtcggtttagaccgattagtagacgaatcggacattgtaaatctctcttatctccaaagcattgtattggaaacactacgtatgtacccggcagtcccactactactacctcatttgtcatcagaagattgtaaagttggaggctacgatataccaagtggaacaatggtattgaccaacgcatgggccatgcatagagatccagaggtatgggaagatcctgagatattcaaaccagaaagatttgaaaaagaaggagaggctgagaagctaatctcatttgggatgggacgaagagcttgtcctggagccgggctagctcatcggctaataaaccaggctcttggaagtttggttcaatgttttgagtgggaaagagttggtgaggattttgtggacatgaccgaagacaaaggagccacattgcccaaagctataccattaagagccatgtgcaaagcacgttctattgttgataaactgatataa

SEQ ID NO: 2338 - protein, 492 aa, Arabidopsis thaliana
MDLNQILILSFLSLFTLAIFLLTRSKRKLNLPPSPAISLPVIGHLHLLKPPLHRTFLSLSKSIGNAPVFHLRLGNRLVYVISSRSIAEECFTKNDVVLANRPKFTISKHLGYNATYLLSASYGDHWRNLRRIAAVEIFSTHRLNSFLYIRKDEIRRLISHLSRDSLHGFVEVEMKTLLTNLASNTTIRMLAGKRYFGEDNDDAKLVKNLVSEAVTSAGAGNPIDYLSILRWVSSYEKRIKNLGNRFDTFLQKLVDEKRAEKEKGETMIDHLLALQDIQPDYYTDVIIKGIILTLIIAGTDTSSVTLEWAMSNLLNHPEILKKARMEIDEKVGLDRLVDESDIVNLSYLQSIVLETLRMYPAVPLLLPHLSSEDCKVGGYDIPSGTMVLTNAWAMHRDPEVWEDPEIFKPERFEKEGEAEKLISFGMGRRACPGAGLAHRLINQALGSLVQCFEWERVGEDFVDMTEDKGATLPKAIPLRAMCKARSIVDKLI

SEQ ID NO: 2339 - DNA, 1551 bp, Arabidopsis thaliana
atggctcttcttctagtttcttcttcctcctcctatgccctcagagtcaccattttcttgtctttcttcttctttctctgcaatggcttctcttaccctactacttcttctcttttcaacacccatcaccatcgtcaccacttggccaagcacaactacaaagatgctctcactaaatcaatcctcttctttgaaggccaaaggtcagggaaacttccttctaaccagagaatgagttggagaagagactctggtctctctgatggctctgctcttcatgtggatttggttggagggtactatgatgcaggagacaatatcaaatttggtttcccaatggcattcacaaccacaatgctttcatggagtgtaattgaattcggtggactcatgaaatctgaattacaaaacgctaaaatagcgattcgttgggctactgattatctcctcaaagccacttcacaacctgacacaatctatgttcaagttggtgatgctaataaagaccattcttgttgggaaagacctgaagacatggatactgtaagaagtgtgtttaaagttgacaagaacattcctggttctgatgtcgccgctgaaaccgccgctgctctagccgccgccgccattgtattcagaaaatctgatccttcttactccaaagtcctcctcaaacgagccatcagtgtttttgcatttgcggacaaatacagaggaacttatagtgcaggattaaaacctgatgtttgtccattttattgctcttactctggttatcaggatgaattgttgtggggagctgcttggttacaaaaagcgacaaagaatataaaatatttgaattacataaaaatcaatggacaaatccttggagctgctgaatatgataacacttttggttgggataacaagcacgctggtgccagaatccttcttactaaggcatttttggttcagaatgtgaagacacttcatgaatacaaaggtcatgctgataatttcatctgctctgttattcctggagctcctttctcttctactcagtatacaccaggtggattattgtttaaaatggcagacgccaacatgcaatacgtgacgtcaacatcgttcttgctcttaacctatgccaaatacttaacctccgccaaaaccgtcgtccattgcggtggctccgtctacactcccggtcgtcttcgctccatcgccaaaagacaggtggattatcttcttggagacaacccattaagaatgtcttacatggttggttacggtccaaaattcccacggagaatccaccaccgtggctcctcattaccttgtgttgcaagccacccggccaagatccaatgccaccaaggatttgcaatcatgaactctcaatctccaaaccctaacttccttgttggtgcagtcgttggtggtccggaccagcatgatcgcttcccagacgaacggtctgattacgagcagtccgagccggctacttacatcaattcaccactcgttggagctcttgcctacttcgcccacgcctatggtcaactctag

SEQ ID NO: 2340 - protein, 516 aa, Arabidopsis thaliana
MALLLVSSSSSYALRVTIFLSFFFFLCNGFSYPTTSSLFNTHHHRHHLAKHNYKDALTKSILFFEGQRSGKLPSNQRMSWRRDSGLSDGSALHVDLVGGYYDAGDNIKFGFPMAFTTTMLSWSVIEFGGLMKSELQNAKIAIRWATDYLLKATSQPDTIYVQVGDANKDHSCWERPEDMDTVRSVFKVDKNIPGSDVAAETAAALAAAAIVFRKSDPSYSKVLLKRAISVFAFADKYRGTYSAGLKPDVCPFYCSYSGYQDELLWGAAWLQKATKNIKYLNYIKINGQILGAAEYDNTFGWDNKHAGARILLTKAFLVQNVKTLHEYKGHADNFICSVIPGAPFSSTQYTPGGLLFKMADANMQYVTSTSFLLLTYAKYLTSAKTVVHCGGSVYTPGRLRSIAKRQVDYLLGDNPLRMSYMVGYGPKFPRRIHHRGSSLPCVASHPAKIQCHQGFAIMNSQSPNPNFLVGAVVGGPDQHDRFPDERSDYEQSEPATYINSPLVGALAYFAHAYGQL

SEQ ID NO: 2341 - DNA, 639 bp, Arabidopsis thaliana
atgaagatcagacttagcataaccatcatacttttatcatacacagtggctacggtggccggacaacaatgcggtcgtcaaggcggtggtcgaacttgtcccggtaacatctgctgcagtcagtacggttactgtggtaccaccgcggactactgttctccgaccaacaactgtcagagcaattgttggggaagtgggcctagcggaccaggggagagcgcgtcgaacgtacgcgccacctaccatttctataatccggcgcagaataattgggatttgagagccgtgagtgcttattgctccacgtgggatgctgataagccgtacgcatggcggagcaagtatggctggaccgccttctgcgggccggcaggacctcgtggtcaagcttcttgcggcaagtgtttaagggtgaagaacacaagaacaaatgctgcagtaactgtgagaatagtggaccaatgcagcaacggaggcttggatttggatgtagcaatgttcaatcaaatagacaccgatggttttggctatcaacaaggccatctcattgttgactaccaatttgtcgactgtggcaatgagctcattgggcagcctgattccagaaacatgcttgtttcggccattgatcgcgtttga

SEQ ID NO: 2342 - protein, 212 aa, Arabidopsis thaliana
MKIRLSITIILLSYTVATVAGQQCGRQGGGRTCPGNICCSQYGYCGTTADYCSPTNNCQSNCWGSGPSGPGESASNVRATYHFYNPAQNNWDLRAVSAYCSTWDADKPYAWRSKYGWTAFCGPAGPRGQASCGKCLRVKNTRTNAAVTVRIVDQCSNGGLDLDVAMFNQIDTDGFGYQQGHLIVDYQFVDCGNELIGQPDSRNMLVSAIDRV

SEQ ID NO: 2343 - DNA, 1230 bp, Arabidopsis thaliana
atggcggctgaaatggcgttagtgaaacccatctccaagttctcttccccaaagctctcaaacccgagcaaattcctctccggccgacgtttctccaccgtgatcagaatgtcagcctcttcctcaccgcctcctccaaccaccgccacctcgaagtccaagaagggaacgaagaaagagattcaagagtcgcttcttactccgaggttctacacgacggacttcgaggaaatggaacagcttttcaacacggagatcaacaagaaccttaacgaagcagagttcgaggctctgcttcaagagttcaagaccgattacaaccagacacatttcgtgaggaacaaggagtttaaagaagctgcagacaaattgcaaggacctctccgacagatcttcgttgagttccttgagcggtcttgtactgctgagttctctggtttccttctctacaaggagcttggtcgaagactcaagaaaacaaaccctgttgtggctgagatcttctctcttatgtctagagatgaagcaagacatgccgggttcttgaacaagggattgtctgatttcaacttggctcttgatttgggtttcctgacaaaggcaaggaaatacactttcttcaagccaaaattcatcttctacgcgacttacttatccgagaaaatcgggtactggagatacatcacaatctacagacacctcaaggaaaaccctgagttccaatgttacccaatcttcaagtactttgagaactggtgtcaagacgagaaccgtcatggtgatttcttctctgctttgatgaaagctcagcctcagttcctcaatgactggcaagccaagctctggtctcgcttcttctgcctctcggtttatgtgacaatgtacctcaatgactgccaaagaactaatttctacgagggtatcgggttaaacacaaaggagttcgatatgcatgtcatcatcgagacaaaccgaaccacggcaagaatattccctgcggtgctggatgttgagaaccctgagttcaagaggaaactggatagaatggttgtgagctatgagaagctgctggctataggagaaacagatgatgcttccttcatcaagaccctcaagaggattcctttggttacttctttagcctctgagatcttggctgcttatctcatgcctcctgttgagtctggctctgttgatttcgccgagtttgagcctaatcttgtctattag

SEQ ID NO: 2344 - protein, 409 aa, Arabidopsis thaliana
MAAEMALVKPISKFSSPKLSNPSKFLSGRRFSTVIRMSASSSPPPPTTATSKSKKGTKKEIQESLLTPRFYTTDFEEMEQLFNTEINKNLNEAEFEALLQEFKTDYNQTHFVRNKEFKEAADKLQGPLRQIFVEFLERSCTAEFSGFLLYKELGRRLKKTNPVVAEIFSLMSRDEARHAGFLNKGLSDFNLALDLGFLTKARKYTFFKPKFIFYATYLSEKIGYWRYITIYRHLKENPEFQCYPIFKYFENWCQDENRHGDFFSALMKAQPQFLNDWQAKLWSRFFCLSVYVTMYLNDCQRTNFYEGIGLNTKEFDMHVIIETNRTTARIFPAVLDVENPEFKRKLDRMVVSYEKLLAIGETDDASFIKTLKRIPLVTSLASEILAAYLMPPVESGSVDFAEFEPNLVY

SEQ ID NO: 2345 - DNA, 2181 bp, Arabidopsis thaliana
atgacggagatcgatcgttcacgcgcgttcgccaaagacgttaagcgtatcgtcgtcaaggttgggactgcagttgttactgggaaaggtggaagattggctcttggacgtttaggagctatctgtgaacagcttgcggagttaaactcagatggatttgaggtcattttggtgtcatctggtgccgttggtcttggtcgacaaaggcttcgatacagacaattagtcaacagcagttttgcagatttacagaagccacaaatggaacttgatgggaaggcttgtgctggtgttgggcagagcagtctcatggcttactatgagactatgtttgaccagttggatgtgacggttgctcaaatgcttgtgaccgatagcagttttagagataaggatttcaggaagcaacttagtgaaactgtcaaagcgatgctgaggatgagggttattccagttttcaatgagaatgatgctataagcactcgcagagccccctacaaggattctactggtatattttgggataatgacagcttagccgctcttctgtcgctagagctgaaagctgatcttttgattcttctaagtgatgttgagggcctttacactggccctccaagtgattctacctcaaaattaatacacacattcattaaagaaaaacaccaggacgagattacttttggcgaaaagtccaaattaggacgagggggtatgactgcaaaagttaaagctgctgttaatgcagcttatggtggcgttcctgttatcataaccagtggatatgcagctgagaatataagtaaagtccttagaggactgcgtgttggtaccctgttccatcaagatgctcatttatgggctccggtcgtagatactacttctcgtgacatggcagttgctgcaagggaaagctcaagaaagcttcaggccttatcttcagaagataggaaacaaattctacacgacattgccaatgcccttgaagtaaatgagaaaacaattaaagctgagaatgatttagatgttgctgcagcacaagaagctggatatgaagagtctttggtagctcgcttagttatgaagcctgggaagatctcaagccttgcagcttccgttcgccagctagccgaaatggaagatccaataggccgtgtattaaagaaaactcaggttgcagatgatcttattttagagaagacctcatcaccaataggtgttcttctgattgtttttgaatcccggcctgatgcacttgttcagatagcttcgcttgcaatccggagtggaaatggtcttctgctgaagggtggaaaggaggctcgtcgatcaaatgctatcttacacaaggtgatcactgatgcaattccggagactgttggaggtaaactcataggacttgtgacctcaagagaggagattcctgatttgctcaagcttgatgacgttattgatcttgtgatcccaagaggcagcaacaagcttgtttctcaaataaaaaactcgacgaaaatcccagtgctaggccatgctgatggaatctgtcatgtatatgttgataagtctggtaaactggacatggcaaagcgcattgtttccgatgcaaagttggactatccagcagcctgtaatgcgatggaaacccttcttgtacataaagatttggagcagaatggttttctcgatgatcttatttatgttctgcaaaccaaaggcgtcactttgtatggtgggccaagagcaagtgcaaaactgaatattccggaaacaaaatcatttcaccacgagtacagttccaaggcctgcaccgttgaaattgtagaagacgtatatggtgctatagatcatattcaccaacatggaagtgcacacactgattgcatagtgacggaagatagtgaagtagcagaaatattcctccgccaagtggacagtgctgctgttttccacaatgcaagcacaagattctctgatggttttaggttcggacttggtgctgaggtgggaataagcacaagcaggattcatgcccgtggtccagttggagttgaaggattattgacaacaagatggataatgagaggaaagggacaagttgtggatggagacaatggaatcgtttacacccataaggatcttcctgtcttacaaaggacagaggctgttgagaatggaatttag

SEQ ID NO: 2346 - protein, 726 aa, Arabidopsis thaliana
MTEIDRSRAFAKDVKRIVVKVGTAVVTGKGGRLALGRLGAICEQLAELNSDGFEVILVSSGAVGLGRQRLRYRQLVNSSFADLQKPQMELDGKACAGVGQSSLMAYYETMFDQLDVTVAQMLVTDSSFRDKDFRKQLSETVKAMLRMRVIPVFNENDAISTRRAPYKDSTGIFWDNDSLAALLSLELKADLLILLSDVEGLYTGPPSDSTSKLIHTFIKEKHQDEITFGEKSKLGRGGMTAKVKAAVNAAYGGVPVIITSGYAAENISKVLRGLRVGTLFHQDAHLWAPVVDTTSRDMAVAARESSRKLQALSSEDRKQILHDIANALEVNEKTIKAENDLDVAAAQEAGYEESLVARLVMKPGKISSLAASVRQLAEMEDPIGRVLKKTQVADDLILEKTSSPIGVLLIVFESRPDALVQIASLAIRSGNGLLLKGGKEARRSNAILHKVITDAIPETVGGKLIGLVTSREEIPDLLKLDDVIDLVIPRGSNKLVSQIKNSTKIPVLGHADGICHVYVDKSGKLDMAKRIVSDAKLDYPAACNAMETLLVHKDLEQNGFLDDLIYVLQTKGVTLYGGPRASAKLNIPETKSFHHEYSSKACTVEIVEDVYGAIDHIHQHGSAHTDCIVTEDSEVAEIFLRQVDSAAVFHNASTRFSDGFRFGLGAEVGISTSRIHARGPVGVEGLLTTRWIMRGKGQVVDGDNGIVYTHKDLPVLQRTEAVENGI

SEQ ID NO: 2347 - DNA, 573 bp, Arabidopsis thaliana
atggcggaggagcaaaagacgagtaaggttgacgtagaatctccggctgttttagctccggcgaaggaaccgactcctgctccggtggaagtcgcggatgagaaaattcataatccacctcccgtcgagtccaaagctcttgccgttgtagaaaaacccatcgaggagcatacacctaagaaagcttcatctggttcggccgatagagatgtgatacttgccgacttggaaaaagagaagaaaacgtcattcatcaaagcatgggaagagagtgagaagtcaaaggctgagaacagggcacaaaagaagatctctgatgtgcatgcttgggaaaatagcaagaaagcagccgtagaagctcaacttaggaagatcgaggaaaaattagagaagaaaaaagcgcagtacggtgagaaaatgaagaacaaagtagctgcaatccacaagttagcagaagagaagagagcaatggttgaagctaaaaaaggagaagagcttctcaaagctgaagaaatgggtgctaagtatagagccactggtgtagtaccaaaggcaacgtgtggatgtttctaa

SEQ ID NO: 2348 - protein, 190 aa, Arabidopsis thaliana
MAEEQKTSKVDVESPAVLAPAKEPTPAPVEVADEKIHNPPPVESKALAVVEKPIEEHTPKKASSGSADRDVILADLEKEKKTSFIKAWEESEKSKAENRAQKKISDVHAWENSKKAAVEAQLRKIEEKLEKKKAQYGEKMKNKVAAIHKLAEEKRAMVEAKKGEELLKAEEMGAKYRATGVVPKATCGCF

SEQ ID NO: 2349 - DNA, 1023 bp, Arabidopsis thaliana
atgatgttttcggtgacggttgcgatccttgtttgtcttattggctacatttaccgatcatttaagcctccaccaccgcgaatctgcggccatcctaacggtcctccggttacttctccgagaatcaagctcagtgatggaagatatcttgcttatagagaatctggggttgatagagacaatgctaactacaagatcattgtcgttcatggcttcaacagctccaaagacactgaatttcccatccctaaggatgtaattgaggagcttgggatatactttgtgttctacgatagagcaggatatggagaaagtgatccacacccatcacgcactgttaagagtgaagcatacgacattcaagaactcgccgataaactcaagatcggaccaaagttctatgttcttggtatatcactaggtgcttactcggtttatagttgcctcaaatacattccccacagactagctggagcagtcttaatggttccatttgtgaactattggtggactaaagtgcctcaagaaaaattgagtaaagcgttggagctaatgccaaagaaagaccaatggacgtttaaagtggctcattatgttccgtggttgttatattggtggttgacccaaaaactatttccgtcttcgagtatggtcacggggaacaatgcgttatgcagcgacaaagatttggtcgtcataaagaagaaaatggagaatccacgccctggcttggaaaaagttagacaacaaggagaccatgaatgtcttcaccgggacatgatagccggattcgcgacatgggaattcgacccgactgaattagaaaatccgtttgcggaaggcgaaggatcggtccacgtttggcaagggatggaagacagaatcattccatacgaaattaatcgatatatatcagagaagcttccatggattaagtaccatgaggtcttaggttatggacatcttctaaacgccgaggaggagaaatgcaaagacattatcaaggcacttcttgtcaactga

SEQ ID NO: 2350 - protein, 340 aa, Arabidopsis thaliana
MMFSVTVAILVCLIGYIYRSFKPPPPRICGHPNGPPVTSPRIKLSDGRYLAYRESGVDRDNANYKIIVVHGFNSSKDTEFPIPKDVIEELGIYFVFYDRAGYGESDPHPSRTVKSEAYDIQELADKLKIGPKFYVLGISLGAYSVYSCLKYIPHRLAGAVLMVPFVNYWWTKVPQEKLSKALELMPKKDQWTFKVAHYVPWLLYWWLTQKLFPSSSMVTGNNALCSDKDLVVIKKKMENPRPGLEKVRQQGDHECLHRDMIAGFATWEFDPTELENPFAEGEGSVHVWQGMEDRIIPYEINRYISEKLPWIKYHEVLGYGHLLNAEEEKCKDIIKALLVN

SEQ ID NO: 2351 - DNA, 831 bp, Arabidopsis thaliana
atgcagattcacaaactctgttttcttgttctgttcttagctaacgcagcttttgccgtcaaattcaacttcgattccttcgatggcagcaacttgttattcctaggagacgcagagcttggtccttcctctgatggtgtaagccgatccggagctttatccatgacccgagacgagaacccattctctcatggtcaaggtctttacatcaatcaaatcccattcaaaccttcaaacacttcttctcctttttcatttgaaacttctttcactttctccatcactcctcgcaccaaacctaactccggtcaaggtttcgccttcatcataaccccggaagctgataactccggtgcttcagatggcggatatctcggaatcctcaacaaaaccaacgatggaaagccagagaaccacatcttggctatcgaattcgatacttttcagaacaaagagtttctagacattagtggtaaccatgttggagttaacatcaactcaatgacttctcttgtcgctgagaaagctggttactgggttcagacaagagtcgggaaaaggaaagtttggtcgtttaaagatgtgaatcttagcagtggagagaggttcaaggcttgggttgagttcagaaacaaagactctacgattacggttacactcgcgcctgaaaacgttaagaaacctaagcgggctttgatcgaagctcccagagtgctcaatgaagttcttcttcaaaacatgtacgccggttttgctggttccatgggacgtgccgttgagcgtcacgatatttggagctggtcgtttgaaaacgccgccaaaaacaactaa

SEQ ID NO: 2352 - protein, 276 aa, Arabidopsis thaliana
MQIHKLCFLVLFLANAAFAVKFNFDSFDGSNLLFLGDAELGPSSDGVSRSGALSMTRDENPFSHGQGLYINQIPFKPSNTSSPFSFETSFTFSITPRTKPNSGQGFAFIITPEADNSGASDGGYLGILNKTNDGKPENHILAIEFDTFQNKEFLDISGNHVGVNINSMTSLVAEKAGYWVQTRVGKRKVWSFKDVNLSSGERFKAWVEFRNKDSTITVTLAPENVKKPKRALIEAPRVLNEVLLQNMYAGFAGSMGRAVERHDIWSWSFENAAKNN

SEQ ID NO: 2353 - DNA, 1056 bp, Arabidopsis thaliana; identical to SEQ ID NO: 1621

SEQ ID NO: 2354 - protein, 351 aa, Arabidopsis thaliana; identical to SEQ ID NO: 1622

SEQ ID NO: 2355 - DNA, 783 bp, Arabidopsis thaliana
atggcttcttcgtcttctatgcagatggttcacacttcccgctccattgcccagattgggttcggtgttaagtcgcaattagtttctgcaaatcgaacaactcaatcagtttgctttggagctcgttcctctggaattgcattatcttcgagattgcactatgcatcacccattaagcaattttctggggtttatgcgaccaccaagcatcagagaaccgcttgtgttaaatccatggctgctgaggaagaagaagtaatcgaacctcaagctaaagtgacaaacaaggtttactttgatgtggaaattggaggtgaagttgctggcagaattgtgatgggtctctttggagaagttgtgcctaaaaccgttgaaaacttccgtgccttgtgtactggtgagaagaaatacgggtacaagggttcctctttccatcgtattattaaggatttcatgatccaaggaggtgatttcaccgagggaaatggtactggaggtattagtatttacggtgccaagttcgaagatgaaaacttcaccctgaagcatactggacctggaatcttgagcatggcaaacgctggtcctaatactaatggaagccagtttttcatttgtaccgtcaagacttcatggttagataacaagcatgtcgtgtttggacaagtaattgaaggtatgaagcttgttaggactcttgagtctcaagagactcgcgctttcgatgttcccaagaaaggttgtagaatctatgcctgcggagagctcccgttagatgcttga

SEQ ID NO: 2356 - protein, 260 aa, Arabidopsis thaliana
MASSSSMQMVHTSRSIAQIGFGVKSQLVSANRTTQSVCFGARSSGIALSSRLHYASPIKQFSGVYATTKHQRTACVKSMAAEEEEVIEPQAKVTNKVYFDVEIGGEVAGRIVMGLFGEVVPKTVENFRALCTGEKKYGYKGSSFHRIIKDFMIQGGDFTEGNGTGGISIYGAKFEDENFTLKHTGPGILSMANAGPNTNGSQFFICTVKTSWLDNKHVVFGQVIEGMKLVRTLESQETRAFDVPKKGCRIYACGELPLDA

SEQ ID NO: 2357 - DNA, 1122 bp, Arabidopsis thaliana
atgggataccttctagaagaaaccttaagctctaactctaaaaccccaattgttatcgatgatgataacgagttgggtttgatggccgtgagactagccaatgctgctgcctttccgatggttctcaaagccgccctcgagctcggtgtctttgacactctctatgctgaagcctctcgcagcgactcgttcctttcaccatctgaaatagcgagtaagctaccaactacacctcgtaaccctgaggctccggttttgttggaccgtatgcttcgtctactcgctagctattctgtggtcaagtgtggtaaggtctcagaaggaaagggtgagagggtctacagagcagagccaatttgcaggtttttcttgaaggataacattcaagatattggatcccttgcttctcaagtcattgtcaatttcgatagcgtcttcctcaatacttgggcacaattgaaagacgtggttctagaaggaggagatgcatttggccgcgcacatggtggtatgaagctctttgactatatgggtacagatgagagattcagcaaactatttaaccagaccggttttaccattgcggttgtgaagaaggctcttgaagtttaccaaggcttcaaaggtgtgaatgttttagttgatgtgggaggaggagttggtaacactcttggtgttgttgcttctaagtatccaaatattaagggtatcaactttgatctaacctgtgccttggcacaagcaccttcttatcccggtgtggagcatgttgccggagatatgtttgtggatgtcccaaccggagatgccatgatcttgaaacgtatacttcatgattggaccgatgaagattgtgtcaagattcttaagaattgttggaaatcactaccagaaagcggtaaagtagttgttatagaattagtcactcctgatgaggcagagaatggagacatcaacgcaaacattgcctttgacatggacatgttaatgttcacacaatgttccggaggaaaagagagatcaagagctgagtttgaagctttggctgcagcttctggctttacccattgcaagttcgtttgccaagcttatcactgctggattattgagttctgtaaataa

SEQ ID NO: 2358 - protein, 373 aa, Arabidopsis thaliana
MGYLLEETLSSNSKTPIVIDDDNELGLMAVRLANAAAFPMVLKAALELGVFDTLYAEASRSDSFLSPSEIASKLPTTPRNPEAPVLLDRMLRLLASYSVVKCGKVSEGKGERVYRAEPICRFFLKDNIQDIGSLASQVIVNFDSVFLNTWAQLKDVVLEGGDAFGRAHGGMKLFDYMGTDERFSKLFNQTGFTIAVVKKALEVYQGFKGVNVLVDVGGGVGNTLGVVASKYPNIKGINFDLTCALAQAPSYPGVEHVAGDMFVDVPTGDAMILKRILHDWTDEDCVKILKNCWKSLPESGKVVVIELVTPDEAENGDINANIAFDMDMLMFTQCSGGKERSRAEFEALAAASGFTHCKFVCQAYHCWIIEFCK

SEQ ID NO: 2359 - DNA, 552 bp, Arabidopsis thaliana
atgcggattttgtgcgatgcttgcgagaacgcagccgcaatcatcttttgcgccgccgatgaagctgccctttgtcgcccctgcgatgaaaaagttcatatgtgcaacaagctagctagtcggcatgtacgtgttggtttagctgaaccaagcaatgccccatgctgtgatatatgcgaaaatgcacctgccttcttttactgtgagatagacggtagttctctttgtctgcaatgtgacatggtagtacatgttggtggcaagagaacacacggtcggtttcttttgctgagacagagaatcgagtttccaggggataagcctaaagaaaacaatacgagggacaatttgcagaaccaaagagtctctacaaatggaaatggtgaagccaatgggaagattgatgacgaaatgattgatctaaatgctaatccacaaagagtacatgagccatcatcaaataacaacgggattgatgtaaataacgagaacaatcacgagcctgcaggccttgtaccagttggaccctttaaacgagagtctgagaagtga

SEQ ID NO: 2360 - protein, 183 aa, Arabidopsis thaliana
MRILCDACENAAAIIFCAADEAALCRPCDEKVHMCNKLASRHVRVGLAEPSNAPCCDICENAPAFFYCEIDGSSLCLQCDMVVHVGGKRTHGRFLLLRQRIEFPGDKPKENNTRDNLQNQRVSTNGNGEANGKIDDEMIDLNANPQRVHEPSSNNNGIDVNNENNHEPAGLVPVGPFKRESEK

SEQ ID NO: 2361 - DNA, 468 bp, Arabidopsis thaliana
atgaatttcatctccgatcaggtaaagaaactctcaagctcaacaccagaggagccagaccacaacaagccagtcgaaggaaccgaaacagctacaagaccagctaccaacgccgagctcatggcaagtgccaaggttgtagctgaagctgctcaagccgcagctcgtaacgaatcagacaaactcgacaagggtaaagtcgccggagcctctgctgatatcttagacgctgccgagaaatacggtaagttcgatgaaaagagtagcactggtcagtacctcgacaaggctgagaagtatctcaacgactacgagtcgtcacactccaccggtgctggtggtcctcctcctccgacgagtcaggctgagccagcaagtcagcctgagccggcggctaagaaagacgatgaagagtctggtggtgggcttggaggttatgccaagatggctcaaggtttcttgaagtga

SEQ ID NO: 2362 - protein, 155 aa, Arabidopsis thaliana
MNFISDQVKKLSSSTPEEPDHNKPVEGTETATRPATNAELMASAKVVAEAAQAAARNESDKLDKGKVAGASADILDAAEKYGKFDEKSSTGQYLDKAEKYLNDYESSHSTGAGGPPPPTSQAEPASQPEPAAKKDDEESGGGLGGYAKMAQGFLK

SEQ ID NO: 2363 - DNA, 996 bp, Arabidopsis thaliana
atggcaacttctctccaagccgccgcaacttttcttcaaccggcgaagattgccgcttctccttctcgtaatgtccatctccgatcaaaccaaaccgtgggcaagtcctttgggttagactcttcacaagctaggctcacgtgctctctccactctgacctcaaagacttcgctggaaaatgctccgacgccgccaagatcgccggttttgctctagccacctctgctctcgttgtctcgggggccggtgcggagggagcaccaaagaggctaacgtacgacgagatacagagcaagacttacatggaggtaaagggtaccggtacggcaaaccagtgtccaactatcgatggtggctctgagacattctcgttcaaagctggtaagtacacaggcaagaagttctgcttcgagcccacttccttcaccgtcaaggcagatagcgtcagcaagaatgcaccgccggatttccaaaacaccaagctcatgacccgtctcacttacacactcgatgagatcgaaggacccttcgaggttggttcagacggaagcgtgaagttcaaggaagaagatggtatcgattacgcagcagtcacagtccagcttccgggaggagaacgcgtgccgttcctcttcacggttaagcagctcgaggcttcagggaaacccgaaagcttcagtggcaagttcttagttccatcgtaccgtggctcgtcctttttggacccaaagggtcgtggtggatccactgggtacgataatgcagtggctttgcctgccggaggcagaggagacgaggaagagctatccaaggaaaacgtcaagaacacggcggcttccgtcggagagatcactttgaagatcacaaagagcaaaccggagacaggtgaagtgatcggagtgttcgagagtcttcagccatcggatactgacttgggtgctaaggtaccaaaagatgtgaagatccaaggggtttggtacggtcagattgagtga

SEQ ID NO: 2364 - protein, 331 aa, Arabidopsis thaliana
MATSLQAAATFLQPAKIAASPSRNVHLRSNQTVGKSFGLDSSQARLTCSLHSDLKDFAGKCSDAAKIAGFALATSALVVSGAGAEGAPKRLTYDEIQSKTYMEVKGTGTANQCPTIDGGSETFSFKAGKYTGKKFCFEPTSFTVKADSVSKNAPPDFQNTKLMTRLTYTLDEIEGPFEVGSDGSVKFKEEDGIDYAAVTVQLPGGERVPFLFTVKQLEASGKPESFSGKFLVPSYRGSSFLDPKGRGGSTGYDNAVALPAGGRGDEEELSKENVKNTAASVGEITLKITKSKPETGEVIGVFESLQPSDTDLGAKVPKDVKIQGVWYGQIE

SEQ ID NO: 2365 - DNA, 1062 bp, Arabidopsis thaliana
atgactactactccagattggatcatgattggaggagacggtcctgagagttataaccaacaatcctcgtatcagagagcattgttggaagcgacaaaggacaagatgaccaaggcgatctcagccaatctcgacctagacttgatttcgaatcgcttcattgtagcggatttcggttgtgcaagtggacctaacacttttgtggcagttcaaaacataatagatgcggtagaagaaaagtaccgtagagaaaccggacaaaacccggcagataacatcgagttccaagtcctcttcaatgatttcagcctcaatgatttcaacactctcttccagacacttccacccggaagaagatacttcagcgctggagttcctggttccttcttcgaacgtgttcttcctaaggagagtttccacatcggagtcatgagttacgcgttccatttcacctccaaaatccccaaagggattatggaccgcgactctcccttgtggaacaaagacatgcagtgcacggggttcaaccccgctgtcaagaaagcgtatcttgaccagtactctatcgacaccaaaattcttttagatgctagagctgaagagctcgtgcccggggggttgatgttgcttttaggatcgtgtctaagagacggagttaagatgtccgagacccctaaaggaactgtaatggattttattggagaatctcttagcgatcttgctaaacagggtgtcaccgagcaagagaaggtggacactttcagaacctcaatttactttgcagaacaaggtgagataaggcaaatcattgaggagaatgggaagttcacaatcgaggcttttgaagatatcattcacgctaaaaacgagtttccttttgaccccaagacattggccatctctttcaaggccttctatggtgctttcatttccgcacattttggagtcgaagtcatgaggaaagcctttgagcttgttgaggtcaaggcacgcgaacagatttctcgcctccataactccaaacccggaatgcagtacctcatcgtgcttcgcaagaactaa

SEQ ID NO: 2366 - protein, 353 aa, Arabidopsis thaliana
MTTTPDWIMIGGDGPESYNQQSSYQRALLEATKDKMTKAISANLDLDLISNRFIVADFGCASGPNTFVAVQNIIDAVEEKYRRETGQNPADNIEFQVLFNDFSLNDFNTLFQTLPPGRRYFSAGVPGSFFERVLPKESFHIGVMSYAFHFTSKIPKGIMDRDSPLWNKDMQCTGFNPAVKKAYLDQYSIDTKILLDARAEELVPGGLMLLLGSCLRDGVKMSETPKGTVMDFIGESLSDLAKQGVTEQEKVDTFRTSIYFAEQGEIRQIIEENGKFTIEAFEDIIHAKNEFPFDPKTLAISFKAFYGAFISAHFGVEVMRKAFELVEVKAREQISRLHNSKPGMQYLIVLRKN

SEQ ID NO: 2367 - DNA, 921 bp, Arabidopsis thaliana
atggctgctgcttcactccacacttcaatctcaccacgtagcttccttcctctctccaaaccatctctaaaacctcaccgttcccaaattctactgagaaacaaacagaggaattgcgtttcgtgcgcattgatccgtgacgaaatcgacctgattccggttcagagccgagatcggaccgaccatgaggaaggttcggtggtagtgatgagcactgagacggcggttgatggtaatgaatcggttgttgtaggttttagtgctgcgacgagtgaaggtcagctttcgttagaagggtttccttcttcttcttcttcgggagctgatttaggagatgaaaagagaagagagaacgaagaaatggagaagatgatcgatcgaaccattaacgctacgattgttttagctgctggttcttacgctattaccaaattgcttaccatcgatcatgattattggcatggatggactctgtttgagatactaagatatgctcctcaacataactggattgcttacgaagaagcgctaaagcaaaacccggttctagcaaaaatggtcattagtggagttgtctactctgtaggagattggatagctcagtgttacgaaggcaaaccgttgtttgaaattgatagagcaagaacattgagatcaggactagtaggtttcactctccatggctcgttatcgcatttctattaccagttctgtgaagagcttttcccgtttcaagattggtgggtggttcctgtgaaagttgcctttgatcaaacagtctggtcagctatatggaacagtatttacttcacggttcttggtttcctgcgtttcgaatcgcctatcagcatcttcaaagaactaaaagctacgttcttgcctatgctaacagttggaagctttggccatttgctcatttga

SEQ ID NO: 2368 - protein, 306 aa, Arabidopsis thaliana
MAAASLHTSISPRSFLPLSKPSLKPHRSQILLRNKQRNCVSCALIRDEIDLIPVQSRDRTDHEEGSVVVMSTETAVDGNESVVVGFSAATSEGQLSLEGFPSSSSSGADLGDEKRRENEEMEKMIDRTINATIVLAAGSYAITKLLTIDHDYWHGWTLFEILRYAPQHNWIAYEEALKQNPVLAKMVISGVVYSVGDWIAQCYEGKPLFEIDRARTLRSGLVGFTLHGSLSHFYYQFCEELFPFQDWWVVPVKVAFDQTVWSAIWNSIYFTVLGFLRFESPISIFKELKATFLPMLTVGSFGHLLI

SEQ ID NO: 2369 - DNA, 2100 bp, Arabidopsis thaliana
atggcggacgcagaaacctttgctttccaagctgagatcaaccagttgctctccctcatcatcaataccttttactctaacaaggagatcttccttcgtgaactcatcagtaactcttctgatgctttggacaagattaggtttgagtccttgacagacaagagcaagctcgatggtcagccagagctcttcattcacatcattcccgacaagactaacaacaccttgacgattatcgatagtggtattgggatgaccaaggctgatctggtgaacaaccttggaacaattgcaagatctggaaccaaagaattcatggaggcgttggctgctggagctgatgttagcatgattggacagtttggtgttggtttctactctgcttacttggttgctgacaaggttgttgttactaccaagcacaatgacgatgagcagtacgtgtgggagtctcaggccggtggatctttcaccgtcaccagagacacctctggtgaggctcttggtagaggaactaagatggtcctttacctcaaggaagaccagatggagtacattgaggagcgaaggcttaaggatttggtgaagaagcactctgagttcatcagctacccaatctctctctggattgagaagaccattgagaaggagatctctgatgatgaagaggaggaagagaagaaggatgaggaaggcaaggttgaggaagttgatgaggagaaagaaaaggaggagaagaaaaagaagaagattaaggaggtttctcatgagtgggatttggtgaacaagcagaaaccgatttggatgaggaagccagaggagatcaacaaggaggagtacgctgctttctacaagagtttgagcaatgactgggaagagcatttggctgtgaagcatttctcagttgaaggacagcttgagttcaaagctatcctctttgttcccaagagagctccttttgatctctttgacactaagaagaagcccaacaacatcaagctctatgtccgtcgtgtcttcatcatggacaactgtgaagacatcattcctgagtaccttgggtttgtcaagggtattgttgactctgaagatcttcctctcaacatctcaagagaaacattgcagcagaacaagatcctcaaggtcatccgcaagaaccttgtgaagaagtgtcttgagctcttctttgagattgctgagaacaaggaggactacaacaagttctatgaggctttctctaagaacctgaagctcggtatccatgaggactcccaaaacagaaccaagattgctgagttgctccgttaccactcaaccaagagcggtgatgaattgaccagtctcaaggactacgtgacaaggatgaaggaaggtcagaacgatatcttctatatcactggtgagagcaagaaggctgttgagaactctccattccttgagaagctcaagaagaagggtattgaagttctctacatggttgacgctatcgatgagtatgctattggtcagctcaaggaattcgaaggaaagaagcttgtctctgcaaccaaggaaggtctgaaactggatgagactgaagacgagaagaagaagaaagaagagctcaaggagaagtttgagggactctgcaaagtgatcaaggacgttttgggagacaaggttgagaaggttatcgtctctgaccgtgttgtggactcaccctgctgtcttgtaacaggcgagtatggctggactgcaaacatggagaggatcatgaaagctcaagccttgagagacagcagcatgggtggctacatgtcgagcaagaagacaatggagattaacccagagaactccatcatggatgagctgagaaagagagctgatgcagacaagaacgacaagtctgtgaaggaccttgtacttcttctctttgagaccgctcttctcacttctggtttcagcctcgatgagcccaacactttcgggagcaggattcacaggatgttgaagcttggattgagcattgatgacgatgatgttgttgaagccgatgctgacatgcctccacttgaagatgatgccgatgctgaaggtagcaagatggaggaagttgactaa

SEQ ID NO: 2370 - protein, 699 aa, Arabidopsis thaliana
MADAETFAFQAEINQLLSLIINTFYSNKEIFLRELISNSSDALDKIRFESLTDKSKLDGQPELFIHIIPDKTNNTLTIIDSGIGMTKADLVNNLGTIARSGTKEFMEALAAGADVSMIGQFGVGFYSAYLVADKVVVTTKHNDDEQYVWESQAGGSFTVTRDTSGEALGRGTKMVLYLKEDQMEYIEERRLKDLVKKHSEFISYPISLWIEKTIEKEISDDEEEEEKKDEEGKVEEVDEEKEKEEKKKKKIKEVSHEWDLVNKQKPIWMRKPEEINKEEYAAFYKSLSNDWEEHLAVKHFSVEGQLEFKAILFVPKRAPFDLFDTKKKPNNIKLYVRRVFIMDNCEDIIPEYLGFVKGIVDSEDLPLNISRETLQQNKILKVIRKNLVKKCLELFFEIAENKEDYNKFYEAFSKNLKLGIHEDSQNRTKIAELLRYHSTKSGDELTSLKDYVTRMKEGQNDIFYITGESKKAVENSPFLEKLKKKGIEVLYMVDAIDEYAIGQLKEFEGKKLVSATKEGLKLDETEDEKKKKEELKEKFEGLCKVIKDVLGDKVEKVIVSDRVVDSPCCLVTGEYGWTANMERIMKAQALRDSSMGGYMSSKKTMEINPENSIMDELRKRADADKNDKSVKDLVLLLFETALLTSGFSLDEPNTFGSRIHRMLKLGLSIDDDDVVEADADMPPLEDDADAEGSKMEEVD

SEQ ID NO: 2371 - DNA, 2010 bp, Arabidopsis thaliana; identical to SEQ ID NO: 1553

SEQ ID NO: 2372 - protein, 669 aa, Arabidopsis thaliana; identical to SEQ ID NO: 1554

SEQ ID NO: 2373 - DNA, 1446 bp, Arabidopsis thaliana; identical to SEQ ID NO: 379

SEQ ID NO: 2374 - protein, 481 aa, Arabidopsis thaliana; identical to SEQ ID NO: 380

SEQ ID NO: 2375 - DNA, 1413 bp, Arabidopsis thaliana
atggcccaaaagctagaagcaaagggtggtgagatgggagatgtatgggatgatggtgtttacgaaaatgttagaaaggtatatgtagggcaagcacaatacggtatagccttcgtcaagtttgagtatgtcaatggttctcaagtggttgttggagatgaacatggaaagaagacagagctaggagttgaagagtttgagattgatgcggatgactacatcgtatacgtggaaggttaccgtgagaaagttaacgatatgacgtcagaaatgatcacgtttctttctattaagacttttaaaggcaaaacctctcatcctatcgaaaaaagacctggggttaagtttgtgctacatggtggaaaaatcgttgggtttcacggacgttcaacagatgttttacactcccttggggcctatgtttctttgtcatccactatcaaattgcttgggaagtggattaaggtggagcaaaaaggagaaggtccagggctaagatgctcacatggcatagcacaagtaggcaacaagatttactcctttggtggcgagttcacaccaaatcagcccatcgacaaacacctttacgtctttgacctcgagacccggacttggtccatttctccagccaccggagacgttccacacctctcttgtttaggtgtccggatggtgtcagtaggatcgaccctctatgtctttggaggccgagacgcttcacgccaatacaacggtttctactcgtttgacacgaccactaacgagtggaaactgctaactccggtcgaagaaggacccactcctcgtagtttccactcaatggcagccgatgaggaaaacgtttacgttttcggtggagtgagtgctacggcacgactcaatacactagactcttacaacatcgttgataagaagtggtttcattgttcgactccaggagattcccttaccgcaagaggaggagcagggctcgaagtggtgcaagggaaggtatgggttgtgtatgggtttaacggatgtgaagtagatgatgttcattactacgatcctgttcaagacaagtggacacaagtggaaacattcggtgtgaggccttccgaaagaagtgtattcgctagtgcggctattgggaaacacattgtgatttttggaggtgaaattgcgatggacccgctagctcacgtgggtccaggtcaattgaccgatggaacttttgcattggacacagagacgttgcaatgggagaggctggataagtttggtggagaggaagagactccgagtagcagaggatggaccgcgtccacgactgctaccattgatggtaagaaaggacttgtgatgcatggtggtaaagctccaaccaatgaccggtttgatgatctcttcttttacgggattgactctgcctaa

SEQ ID NO: 2376 - protein, 470 aa, Arabidopsis thaliana
MAQKLEAKGGEMGDVWDDGVYENVRKVYVGQAQYGIAFVKFEYVNGSQVVVGDEHGKKTELGVEEFEIDADDYIVYVEGYREKVNDMTSEMITFLSIKTFKGKTSHPIEKRPGVKFVLHGGKIVGFHGRSTDVLHSLGAYVSLSSTIKLLGKWIKVEQKGEGPGLRCSHGIAQVGNKIYSFGGEFTPNQPIDKHLYVFDLETRTWSISPATGDVPHLSCLGVRMVSVGSTLYVFGGRDASRQYNGFYSFDTTTNEWKLLTPVEEGPTPRSFHSMAADEENVYVFGGVSATARLNTLDSYNIVDKKWFHCSTPGDSLTARGGAGLEVVQGKVWVVYGFNGCEVDDVHYYDPVQDKWTQVETFGVRPSERSVFASAAIGKHIVIFGGEIAMDPLAHVGPGQLTDGTFALDTETLQWERLDKFGGEEETPSSRGWTASTTATIDGKKGLVMHGGKAPTNDRFDDLFFYGIDSA

SEQ ID NO: 2377 - DNA, 396 bp, Arabidopsis thaliana
atgtcgtggcaatcatacgtcgatgaccatctcatgtgcgaggtcgaaggcaaccacctcacacacgccgccatcttcggccaagacggcagtgtctgggctcagagctcagctttccctcagttgaagcctgcagagatagcaggaatcaacaaagactttgaagaagccggacatcttgccccaaccgggctattccttggcggtgagaagtacatggttgtccaaggtgaggctggagccgtcatccgagggaaaaagggacctggtggagtcactatcaagaagactactcaagctctagtctttggtatctatgatgaaccgatgaccggagggcaatgcaacttggtcgtggagaggctcggcgattaccttatcgagtctggtctctaa

SEQ ID NO: 2378 - protein, 131 aa, Arabidopsis thaliana
MSWQSYVDDHLMCEVEGNHLTHAAIFGQDGSVWAQSSAFPQLKPAEIAGINKDFEEAGHLAPTGLFLGGEKYMVVQGEAGAVIRGKKGPGGVTIKKTTQALVFGIYDEPMTGGQCNLVVERLGDYLIESGL

SEQ ID NO: 2379 - DNA, 1326 bp, Arabidopsis thaliana
atggattcaacgaagcttagtgagctaaaggtcttcatcgatcaatgcaagtctgacccttcccttctcactactccttcactctccttcttccgtgactatctcgagagtcttggtgctaagatacctactggtgtccatgaagaagacaaagacactaagccgaggagtttcgtagtggaagagagtgatgatgatatggatgaaactgaagaagtaaaaccgaaagtggaggaagaagaagaagaggatgagattgttgaatctgatgtagagcttgaaggagacactgttgagcctgataatgatcctcctcagaagatgggggattcatcagtggaggtgactgatgagaatcgtgaagctgctcaagaagctaagggcaaagccatggaggccctttctgaaggaaactttgatgaagcaattgagcatttaactcgggcaataacgttgaacccgacttcagctattatgtatggaaacagagctagtgtctacattaagttgaagaagccaaacgctgctattcgagatgcaaacgcagcattggagattaaccctgattctgccaagggatacaagtcacgaggtatggctcgtgccatgcttggagaatgggcagaggctgcaaaagaccttcaccttgcatctacgatagactatgatgaggaaattagtgctgttctcaaaaaggttgaacctaatgcacataagcttgaggagcaccgtagaaagtatgacagattacgtaaggaaagagaggacaaaaaggctgaacgggatagattacgtcgccgtgctgaagcacaggctgcctatgataaagctaagaaagaagaacagtcatcatctagcagaccatcaggaggcggtttcccaggaggtatgcccggtggtttcccaggaggtatgcccggtggattcccaggaggaatgggaggcatgcccggcggattcccgggaggaatgggtggtatgggcggtatgcccggtggattcccaggaggaatgggcggtggtatgcctgcaggaatgggcggtggtatgcccggaatgggcggtggtatgcctgctggaatgggtggtggcggtatgccaggtgcaggcggtggtatgcctggtggtggcggtatgcctggtggtatggacttcagcaaaatattgaatgatcctgagctaatgacggcatttagcgaccctgaagtcatggctgctcttcaagatgtgatgaagaaccctgcgaatctagcgaagcatcaggcgaatccgaaggtggctcccgtgattgcaaagatgatgggcaaatttgcaggacctcagtaa

SEQ ID NO: 2380 - protein, 441 aa, Arabidopsis thaliana
MDSTKLSELKVFIDQCKSDPSLLTTPSLSFFRDYLESLGAKIPTGVHEEDKDTKPRSFVVEESDDDMDETEEVKPKVEEEEEEDEIVESDVELEGDTVEPDNDPPQKMGDSSVEVTDENREAAQEAKGKAMEALSEGNFDEAIEHLTRAITLNPTSAIMYGNRASVYIKLKKPNAAIRDANAALEINPDSAKGYKSRGMARAMLGEWAEAAKDLHLASTIDYDEEISAVLKKVEPNAHKLEEHRRKYDRLRKEREDKKAERDRLRRRAEAQAAYDKAKKEEQSSSSRPSGGGFPGGMPGGFPGGMPGGFPGGMGGMPGGFPGGMGGMGGMPGGFPGGMGGGMPAGMGGGMPGMGGGMPAGMGGGGMPGAGGGMPGGGGMPGGMDFSKILNDPELMTAFSDPEVMAALQDVMKNPANLAKHQANPKVAPVIAKMMGKFAGPQ

SEQ ID NO: 2381 - DNA, 948 bp, Arabidopsis thaliana
atggacaacaatggagttaaacccgctgtttccgccatggaagcctttgaaaagcttgagaaagtaggtgaagggacttatgggaaagtttacagagcaagagagaaagctactgggatgatcgttgctttgaagaagacgcgtctccatgaggatgaagaaggtgttcctcccactactcttcgcgagatctctatcttgcgtatgctcgctcgtgatcctcacatcgttaggttgatggatgttaagcaaggaataaacaaagaaggaaaaactgtactttaccttgttttcgagtatgttgatactgatctcaagaaattcatcagaagctttcgtcaagctggacagaacattccacaaaatactgtcaagtgcttgatgtaccagttatgcaaaggcatggctttttgccatggtcatggagtgttgcacagggatcttaagcctcacaatctcttgatggaccggaagacaatgacgctcaaaatagcagatcttggattagccagagccttcactctcccaatgaaaaagtatacacatgagattctaactctatggtatagagctccggaagttcttcttggagcaacccattactctactggagtggatatgtggtctgttggctgtatttttgctgaactagtgaccaagcaagcaatctttgcgggagactctgagctccaacagctcctccgtatattcaggttgttgggaacaccaaacgaagaagtttggcctggagtaagcaaactcaaggactggcatgaatacccgcaatggaaaccgttgagtctctccacagctgtgccaaacctcgacgaggctggacttgatctcttatctaaaatgctggagtacgagccagcaaaacgaatctcagcaaagaaagctatggagcatccttacttcgatgatttgcctgacaagtcctctctctga

SEQ ID NO: 2382 - protein, 315 aa, Arabidopsis thaliana
MDNNGVKPAVSAMEAFEKLEKVGEGTYGKVYRAREKATGMIVALKKTRLHEDEEGVPPTTLREISILRMLARDPHIVRLMDVKQGINKEGKTVLYLVFEYVDTDLKKFIRSFRQAGQNIPQNTVKCLMYQLCKGMAFCHGHGVLHRDLKPHNLLMDRKTMTLKIADLGLARAFTLPMKKYTHEILTLWYRAPEVLLGATHYSTGVDMWSVGCIFAELVTKQAIFAGDSELQQLLRIFRLLGTPNEEVWPGVSKLKDWHEYPQWKPLSLSTAVPNLDEAGLDLLSKMLEYEPAKRISAKKAMEHPYFDDLPDKSSL

SEQ ID NO: 2383 - DNA, 477 bp, Arabidopsis thaliana
atggcggctaaactaatctgttcgtctttaacagtgcattcaatggcaaataagaagccatcaccttctgctgcaacaagaacaataacctcaaagaagagcacagcgactccacaggtgaaactgctgacaagagtcgagcagctcaagcttctgaccaaagccgagaaagcaggacttttgtctttagcagagaaatcaggtttctctctatcgaccatcgagcgtcttggattgctgaccaaagcagaggagttcggcgttttgtctgccgccacaaacccggaaacgcctggaacgttattcactttgagcctcggtttactccttcttggaccggtttttgcatatgtggttcctgaagattacacttgggaagtagtgattcaggttcttgtggctctactctctgttcttggtggctctgctgcttttgctgcttctggttttgtctccaatttgcagaaatctgattag

SEQ ID NO: 2384 - protein, 158 aa, Arabidopsis thaliana
MAAKLICSSLTVHSMANKKPSPSAATRTITSKKSTATPQVKLLTRVEQLKLLTKAEKAGLLSLAEKSGFSLSTIERLGLLTKAEEFGVLSAATNPETPGTLFTLSLGLLLLGPVFAYVVPEDYTWEVVIQVLVALLSVLGGSAAFAASGFVSNLQKSD

SEQ ID NO: 2385 - DNA, 255 bp, Arabidopsis thaliana
atggtgctccaaaacgacatcgatctccttcatccgccacctgagcttgagaagagaaagcataagctcaagcgtctcgtgcaatctcccaactccttcttcatggatgttaagtgtcagggatgcttcaacataaccactgtgttcagccattctcaaactgttgtggtatgtggaaactgtcagacagttctgtgccagcccaccggtggtaaagcgaggctacaagagggatgctctttcaggaagaagtga

SEQ ID NO: 2386 - protein, 84 aa, Arabidopsis thaliana
MVLQNDIDLLHPPPELEKRKHKLKRLVQSPNSFFMDVKCQGCFNITTVFSHSQTVVVCGNCQTVLCQPTGGKARLQEGCSFRKK

SEQ ID NO: 2387 - DNA, 495 bp, Arabidopsis thaliana
atgtctacgttcagcggcgatgaaacagctcccttcttcggcttcctcggcgctgcagccgcactcgttttctcctgtatgggagctgcttatggaaccgcaaagagtggtgttggtgtggcttctatgggagttatgagacctgagttggtgatgaaatctattgtccctgttgttatggctggagtgttgggtatctatggattgatcattgctgttatcatcagtaccgggattaaccccaaggctaagtcttactacctctttgatggatacgcacatctctcgtctggtcttgcttgtggtcttgctggtctctcagctggaatggccattgggattgttggtgatgccggtgtcagggcaaatgctcagcagcctaagctctttgttgggatgattcttatccttattttcgcagaagcgcttgctctttacgggcttattgtaggaatcattctttcctcacgagctggccagtctagagctgaatga

SEQ ID NO: 2388 - protein, 164 aa, Arabidopsis thaliana
MSTFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAE

SEQ ID NO: 2389 - DNA, 768 bp, Arabidopsis thaliana
atgggagttttagtaatctcgcttctcgtggttcatctcctagctttttccgtctgcgttcagggcggctaccgtcgtggcggacaccatcccggcggtcacatgggaccttggatcaacgctcatgccactttttacggcggcggtgatgcttccggcactatgggtggagcatgcgggtacggcaatctgtatagccaaggttatggactggagacggcagcgctgagcacagcgttattcgaccaaggacttagttgtggcgcatgttttgagctgatgtgtgtcaacgatcctcaatggtgcataaaaggccgatccattgtggtcactgccactaacttttgtcctcctggtggtgcatgcgaccctcccaaccaccatttcgatctttctcagccgatctacgagaaaattgctctctacaaatccggtatcattcccgttatgtatagaagggttcggtgcaagagaagtggtgggataaggttcacgatcaacggccactcatactttaacttggtgttggtcacaaacgtgggtggagccggggacgtacactcggtctcaatgaaagggtcgaggacaaaatggcaattaatgtcgagaaattgggggcaaaattggcaaagcaactcttatctcaatggtcaaagtctgtcgtttgttgttaccacaagtgatcgtcgaagtgtcgtctcttttaatgttgcaccacccacttggtcctttggccagacctacaccggagggcagtttcggtattaa

SEQ ID NO: 2390 - protein, 255 aa, Arabidopsis thaliana
MGVLVISLLVVHLLAFSVCVQGGYRRGGHHPGGHMGPWINAHATFYGGGDASGTMGGACGYGNLYSQGYGLETAALSTALFDQGLSCGACFELMCVNDPQWCIKGRSIVVTATNFCPPGGACDPPNHHFDLSQPIYEKIALYKSGIIPVMYRRVRCKRSGGIRFTINGHSYFNLVLVTNVGGAGDVHSVSMKGSRTKWQLMSRNWGQNWQSNSYLNGQSLSFVVTTSDRRSVVSFNVAPPTWSFGQTYTGGQFRY

SEQ ID NO: 2391 - DNA, 594 bp, Arabidopsis thaliana
atgcctatgaagtcgttgaggaatgaccatggaacccttaaggccatgatcggatccgatttcaacgagctcactatcgctgctaagaacctagctacacacgccttcacactcactggtttaggctttggtacctctgtcctcgaatgggttgcttcaatcgccgccatatacttgttggtgttggatcgaaccaattggaagacgaatatgctcacatcacttctcattccttacatcttcttcagtcttccttccttgatctttggtattttcagaggagaaattggtaaatggattgctttcgtagctgttgttgtacaactcttctttcctaaacacgccagagaatacctggaattaccggtggctttggttcttctcgccgtggtggcaccaaatttgattgctggcacattcagagacagttggattggtttagctatatgtttaggtattggatgttacttgcttcaagaacacattagagcttcaggtggattcagaaatgcatttactaaagccaatggtatctccaacaccgtcgggatcatctgtctcgtcgtcttccccgtctgggctcttatcttttaa

SEQ ID NO: 2392 - protein, 197 aa, Arabidopsis thaliana
MPMKSLRNDHGTLKAMIGSDFNELTIAAKNLATHAFTLTGLGFGTSVLEWVASIAAIYLLVLDRTNWKTNMLTSLLIPYIFFSLPSLIFGIFRGEIGKWIAFVAVVVQLFFPKHAREYLELPVALVLLAVVAPNLIAGTFRDSWIGLAICLGIGCYLLQEHIRASGGFRNAFTKANGISNTVGIICLVVFPVWALIF

SEQ ID NO: 2393 - DNA, 1389 bp, Arabidopsis thaliana
atggcgagagttctagtctcgtctccatcttcattcttcggttcaccgttgattaaaccgtcgtcatctctccgtcacagtggagtaggaggaggaggaaccgctcaatttcttccataccggagtaataataacaaactcttcactacttcaaccaccgtacgattcagcttaaacgagattcctcctttccatggcttggattcatctgtagacatcggagcgattttcaccagagctgaatctcttctctatacaatagctgacgccgccgttgttggtgctgattccgtcgtaactactgattcatccgccgtgcagaagagtggtggttggtttggttttatctccgatgctatggaattggttcttaagattttgaaggatggattatcagcggttcatgtaccttatgcttatggatttgcgattatcttgcttacgattatcgtcaaagcagcgacgtatcctttgactaagcaacaggttgaatcaacactagcgatgcaaaatcttcaaccgaaaatcaaagcgattcaacaacgttacgcaggaaatcaggagaggatacaactagagacatcgcgattgtataaacaagctggtgttaatccgttggcaggttgcttaccaactttagcaaccataccagtttggattggtttataccaagctctctctaacgtggccaacgagggattgtttacagaaggtttcttttggattccatctctgggtggaccaacatctatagctgctcggcagagtggatccggcatttcgtggctttttccgtttgtggacgggcatccaccattgggatggtatgacactgtagcttatcttgttctacctgttctacttattgcctcccagtatgtgtcaatggaaattatgaagcctcctcaaactgatgatcctgcacagaagaatacgcttcttgttttcaagtttcttccactcatgatcggttactttgcattgtctgtcccatcaggactatctatttactggctcacaaataatgtacttagtaccgcccaacaagtatatctgcgtaaactaggtggtgcaaagccaaatatggatgaaaacgcaagcaaaataataagtgcgggacgagcaaagagatctattgctcagcctgacgatgctggcgaaagatttagacaattaaaagagcaagagaagcgcagcaagaagaacaaggcggttgcgaaagatacagttgaattggtagaagaatctcagtctgaatcagaagaagggtctgatgatgaggaagaagaggctcgtgaaggagcgttagcttcgagcacaacaagcaagccgcttcctgaggttggccaacgaagaagcaaaagatcgaagcggaaacgcactgtatag

SEQ ID NO: 2394 - protein, 462 aa, Arabidopsis thaliana
MARVLVSSPSSFFGSPLIKPSSSLRHSGVGGGGTAQFLPYRSNNNKLFTTSTTVRFSLNEIPPFHGLDSSVDIGAIFTRAESLLYTIADAAVVGADSVVTTDSSAVQKSGGWFGFISDAMELVLKILKDGLSAVHVPYAYGFAIILLTIIVKAATYPLTKQQVESTLAMQNLQPKIKAIQQRYAGNQERIQLETSRLYKQAGVNPLAGCLPTLATIPVWIGLYQALSNVANEGLFTEGFFWIPSLGGPTSIAARQSGSGISWLFPFVDGHPPLGWYDTVAYLVLPVLLIASQYVSMEIMKPPQTDDPAQKNTLLVFKFLPLMIGYFALSVPSGLSIYWLTNNVLSTAQQVYLRKLGGAKPNMDENASKIISAGRAKRSIAQPDDAGERFRQLKEQEKRSKKNKAVAKDTVELVEESQSESEEGSDDEEEEAREGALASSTTSKPLPEVGQRRSKRSKRKRTV

SEQ ID NO: 2395 - DNA, 828 bp, Arabidopsis thaliana
atgacggaagtgattagcaaaacgagtttgttcttaggagcttgtggtaatcatcaccgtgttgatgatttctctttctctccggtgagttttggtgggtttggtttgaaaaagagtttctcttgtctgaagcttaagagtcagaagcctcttagaagtgtattttacggaaaacagatcgttttcggagattctcaagacgagagcttcagaagatcatcagctatcacagctcagacaactttgaggattgggacagctcagaagtggtgggagaaaggtctgaaagataacatgagagagatctcttcagctcaagagctcgttgattctcttactaacgctggtgataagcttgttgttgttgatttcttctcacctggctgtggtggctgcaaggctctccatcctaagatatgtcagtttgcagagatgaacccggatgtgcagtttcttcaggtgaattacgaggagcataagtccatgtgttatagtcttggtgtccatgttctcccttttttccgattctaccgtggctctcagggtcgtgtttgcagctttagctgtaccaatgccacgatcaagaaattcagagatgccttggcaaagcatggtccagataggtgcagcctcggaccgaccaaaggccttgaagagaaagagcttgtggcacttgcagccaacaaagaactcaactttacttacacaccaaagcctgtaccagttgagaaagaagcagccactcctgattcaaacccaagtctccctgttcctcttccttcgatgagctccaatgacgaaaaaacattggtctccgcagggagatga

SEQ ID NO: 2396 - protein, 275 aa, Arabidopsis thaliana
MTEVISKTSLFLGACGNHHRVDDFSFSPVSFGGFGLKKSFSCLKLKSQKPLRSVFYGKQIVFGDSQDESFRRSSAITAQTTLRIGTAQKWWEKGLKDNMREISSAQELVDSLTNAGDKLVVVDFFSPGCGGCKALHPKICQFAEMNPDVQFLQVNYEEHKSMCYSLGVHVLPFFRFYRGSQGRVCSFSCTNATIKKFRDALAKHGPDRCSLGPTKGLEEKELVALAANKELNFTYTPKPVPVEKEAATPDSNPSLPVPLPSMSSNDEKTLVSAGR

SEQ ID NO: 2397 - DNA, 423 bp, Arabidopsis thaliana
atggcagcaacatttgcaacaccatcgacggtgataggcctcggaggatcatccatcaccaccaaacccttctcttcatcctttttaaaaccaacattaagcgccaagaaccctttgagactcgccggtgcatcgggaggaagagtcacttgctttgagaggaactggttgaggagagatttgaacgtggtaggatttgggctgatcggatggctagctccgtcgagcattccagcgataaatgggaagagcctgacgggtctcttcttcgatagcatcggaactgagctcgctcacttcccgactcctccagctctcacttcacagttctggttgtggttggttacgtggcacttaggcctcttcctctgcctcactttcggacaaatcggattcaagggcaggactgaagattacttctaa

SEQ ID NO: 2398 - protein, 140 aa, Arabidopsis thaliana
MAATFATPSTVIGLGGSSITTKPFSSSFLKPTLSAKNPLRLAGASGGRVTCFERNWLRRDLNVVGFGLIGWLAPSSIPAINGKSLTGLFFDSIGTELAHFPTPPALTSQFWLWLVTWHLGLFLCLTFGQIGFKGRTEDYF

SEQ ID NO: 2399 - DNA, 1533 bp, Arabidopsis thaliana
atgttgtggatcaaaaacctagcaagaatctcgcagaccacttcttcgtctgtcggaaacgtgttcagaaaccccgaatcctacactctctcgtcccgtttctgcaccgctctgcaaaagcaacaagtaaccgacacggttcaagcaaaggaggatgtagttaatgcgttggagccacaacgttacgacggtttggctccgacgaaagagggagagaagccgagagttttggttctcgggtcgggttgggcgggttgtcgggtattaaaagggatcgatactagtatttacgacgtcgtttgtgtctctcctaggaaccacatggtcttcactcctctcttggcttctacttgcgttggtacgcttgagtttaggtctgttgctgaaccaatctctcgtatccaaccggcgatttcacgagaacccggttcttattacttccttgctaattgctccaaacttgatgctgataatcatgaggtgcattgtgagactgtaactgaggggtctagcacattgaagccatggaagttcaagatagcttatgacaaactggtactagcttgtggtgcagaagcatccacatttggaattaatggcgtcttagaaaacgccattttcctccgtgaggttcaccacgctcaggagatccgtaggaagcttcttcttaacctcatgctctctgaagttccaggcataggtgaagatgagaagaagaggctgttgcattgcgttgtggttggaggtgggccaactggtgttgagtttagtggtgaattgagtgatttcatcatgaaagatgttcgtcagagatattctcatgtgaaagacgacattcgtgttactctgattgaggcaagggatatactttcttcttttgacgatcggctaaggcactatgcaatcaagcagttaaacaagtctggagtgaagcttgtgcgtgggattgtgaaagaagtgaagcctcagaagctaatccttgatgatggcactgaagttccttacggtcccttagtctggtcaactggtgttggtccatcttcatttgtgaggtctcttgattttcctaaagatccaggtggaaggattggtattgatgagtggatgcgtgtaccttctgtacaagacgtgtttgcaattggtgactgtagcggttatctcgagagcacagggaaatcaacacttcctgcacttgcacaggtggctgagagagaaggcaaatacttggcgaatctgtttaacgtgatgggaaaagctggaggaggacgggccaatagcgcaaaggaaatggagcttggggaaccatttgtgtataaacatctcggaagtatggctactattgggagatacaaagctctcgttgatctccgtgagagcaaggaagggaaaggaatatcaatggcaggttttctgagctggttcatatggaggtctgcttatctgactcgagtcgtcagctggagaaaccgtttctacgttgctatcaattggctcactacctttgtctttggtcgggacattagccgaatctga

SEQ ID NO: 2400 - protein, 510 aa, Arabidopsis thaliana
MLWIKNLARISQTTSSSVGNVFRNPESYTLSSRFCTALQKQQVTDTVQAKEDVVNALEPQRYDGLAPTKEGEKPRVLVLGSGWAGCRVLKGIDTSIYDVVCVSPRNHMVFTPLLASTCVGTLEFRSVAEPISRIQPAISREPGSYYFLANCSKLDADNHEVHCETVTEGSSTLKPWKFKIAYDKLVLACGAEASTFGINGVLENAIFLREVHHAQEIRRKLLLNLMLSEVPGIGEDEKKRLLHCVVVGGGPTGVEFSGELSDFIMKDVRQRYSHVKDDIRVTLIEARDILSSFDDRLRHYAIKQLNKSGVKLVRGIVKEVKPQKLILDDGTEVPYGPLVWSTGVGPSSFVRSLDFPKDPGGRIGIDEWMRVPSVQDVFAIGDCSGYLESTGKSTLPALAQVAEREGKYLANLFNVMGKAGGGRANSAKEMELGEPFVYKHLGSMATIGRYKALVDLRESKEGKGISMAGFLSWFIWRSAYLTRVVSWRNRFYVAINWLTTFVFGRDISRI

SEQ ID NO: 2401 - DNA, 1053 bp, Arabidopsis thaliana
atggaatcagaaaccctaaccgccaaggctacgatcacgaccacgaccctaccgagtcacgacgagaccaagacagaatcaacagagttcgagaaaaatcaaaaacggtatcaagacctcatctccacgtttcctcacgagaaaggctggagaccgaaagagcccctgatcgagtatggtggttactggtggctaccgtctctcctcgaaggttgtattcacgcgcaagagttctttcaagcacgacccagtgacttcctcgtctgtagctacccaaagacaggcaccacttggctcaaagccctgactttcgccatcgcaaatcgttcccgcttcgatgattcctccaaccctctcctgaaacgtaaccctcacgagtttgttccttacattgagatagatttccctttcttccctgaagttgatgttctcaaagacaaagggaacactctgttttcgactcatatcccatacgagttattacctgattcggttgtgaaatccggttgtaagatggtttacatatggagagaaccaaaggacactttcatctccatgtggactttccttcacaaggaaaggacagagcttggacctgtcagcaatcttgaggagtcttttgatatgttctgtcgtggtctgtctgggtatggtccttatcttaatcatatcctggcgtattggaaagcataccaagagaatccagataggatcttgttcctcaagtacgagacgatgagagctgatcctttaccgtacgtgaagagtctggctgagtttatgggtcatggattcacagccgaggaagaggagaaaggtgttgttgagaaagtggtgaatctttgcagcttcgagacgttgaagaatcttgaagctaacaaaggggagaaagacagagaggatcgtcctggtgtttacgcgaatagcgcgtatttcaggaaaggaaaggtgggagattggtcgaactatctgactccggagatggctgctcgtatagatgggttaatggaagagaaatttaagggcaccggcttgcttgaacatggtaaatga

SEQ ID NO: 2402 - protein, 350 aa, Arabidopsis thaliana
MESETLTAKATITTTTLPSHDETKTESTEFEKNQKRYQDLISTFPHEKGWRPKEPLIEYGGYWWLPSLLEGCIHAQEFFQARPSDFLVCSYPKTGTTWLKALTFAIANRSRFDDSSNPLLKRNPHEFVPYIEIDFPFFPEVDVLKDKGNTLFSTHIPYELLPDSVVKSGCKMVYIWREPKDTFISMWTFLHKERTELGPVSNLEESFDMFCRGLSGYGPYLNHILAYWKAYQENPDRILFLKYETMRADPLPYVKSLAEFMGHGFTAEEEEKGVVEKVVNLCSFETLKNLEANKGEKDREDRPGVYANSAYFRKGKVGDWSNYLTPEMAARIDGLMEEKFKGTGLLEHGK

SEQ ID NO: 2403 - DNA, 957 bp, Arabidopsis thaliana
atgatggggaataagcgaaatctcggatttgtgatcttcttctgggctctggtggttgcagtagtagccacggccatcgagcatcgtcgcaatgagaggactaaaggcgtcaatggtcttgacaagatcatcatccgcgaccgtcgtggccgatctgctgaggtttacttgtatggaggtcaagtcagttcttggaaaaatgagaatggagaggagttacttgttatgagtagcaaggctatattccagcctccaacaccgattcgtggaggaattccagtattgtttccgcaatacagtaacaccggtccacttccctcacatggatttgtaagacagaggttctgggaggttgagactaaaccacctcctttgccatcactttctactgctcatgttgacctgatcgtaagatcatccaatgaggatttgaagatctggccgcataagtttgagtatagactgagagtagcattgggacatgatggagatttgacgttaacatctcgtgttaagaatactgatacaaaaccatttaacttcacatttgctcttcacccctacttcgctgtttccaatatcagtgaaatccatgtcgaaggattacacaacttggattaccttgaccaacaaaagaacagaacacgtttcactgatcatgagaaggttataactttcaatgctcaacttgacaggttgtacctaagcactccagatcaactaagaatcgtggaccataagaaaaagaagactattgttgtacacaaggagggacaagttgatgccgtggtgtggaatccatgggataagaaagtatccgatttgggagttgaagactataagcgttttgtaacggtggaaagcgcggctgtcgcgaaaccgatcacagtgaaccccggcaaagaatggaaaggaatactccatgtttctgtggttccatcaaatcggaaagcttga

SEQ ID NO: 2404 - protein, 318 aa, Arabidopsis thaliana
MMGNKRNLGFVIFFWALVVAVVATAIEHRRNERTKGVNGLDKIIIRDRRGRSAEVYLYGGQVSSWKNENGEELLVMSSKAIFQPPTPIRGGIPVLFPQYSNTGPLPSHGFVRQRFWEVETKPPPLPSLSTAHVDLIVRSSNEDLKIWPHKFEYRLRVALGHDGDLTLTSRVKNTDTKPFNFTFALHPYFAVSNISEIHVEGLHNLDYLDQQKNRTRFTDHEKVITFNAQLDRLYLSTPDQLRIVDHKKKKTIVVHKEGQVDAVVWNPWDKKVSDLGVEDYKRFVTVESAAVAKPITVNPGKEWKGILHVSVVPSNRKA

SEQ ID NO: 2405 - DNA, 1104 bp, Arabidopsis thaliana
atggagatcactaacgttaccgagtatgatgcaatcgcaaagcagaagctgcctaagatggtgtacgactactatgcatctggtgcagaagaccaatggactcttcaagagaacagaaacgcttttgcaaggatcctctttcggcctcggattctgattgatgtgagcaagattgacatgacaaccaccgtcttggggttcaagatctcgatgcccatcatggttgctccaactgccatgcaaaagatggctcaccctgatggggaatatgctactgctagagctgcatctgcagctggaactatcatgacactatcttcatgggctacttccagcgttgaagaagttgcgtctacagggccagggatccgattcttccagctctatgtatacaagaacaggaatgtggttgagcagctcgtgagaagagctgagagggctgggttcaaagccattgctctcactgtagacaccccaaggctaggccgcagagagtctgatatcaagaacagattcactttgcctccaaacctgacattgaagaactttgaaggacttgacctcggaaagatggacgaggccaatgactctggcttggcttcatatgttgctggtcaaattgaccgtaccttaagctggaaggatgtccagtggctccagacaatcaccaagttgcccattcttgtcaaaggtgttcttacaggagaggatgcaaggatagcgattcaagctggtgcagccggaatcattgtatcaaaccatggagctcgccagcttgactatgtcccagcaaccatctcggcccttgaagaggttgtcaaagcgacacaaggacgaattcctgtcttcttggatggtggtgttcgacgtggcactgatgtcttcaaagcacttgcacttggagcctccgggatatttattggaagaccagtggtattctcattggcagctgaaggagaggctggagttagaaaggtgcttcaaatgctacgtgatgagttcgagctgaccatggcactgagtgggtgtcggtccctaaaggaaatctcccgtaaccacattaccaccgaatgggacactccacgtccttcagccaggttatag

SEQ ID NO: 2406 - protein, 367 aa, Arabidopsis thaliana
MEITNVTEYDAIAKQKLPKMVYDYYASGAEDQWTLQENRNAFARILFRPRILIDVSKIDMTTTVLGFKISMPIMVAPTAMQKMAHPDGEYATARAASAAGTIMTLSSWATSSVEEVASTGPGIRFFQLYVYKNRNVVEQLVRRAERAGFKAIALTVDTPRLGRRESDIKNRFTLPPNLTLKNFEGLDLGKMDEANDSGLASYVAGQIDRTLSWKDVQWLQTITKLPILVKGVLTGEDARIAIQAGAAGIIVSNHGARQLDYVPATISALEEVVKATQGRIPVFLDGGVRRGTDVFKALALGASGIFIGRPVVFSLAAEGEAGVRKVLQMLRDEFELTMALSGCRSLKEISRNHITTEWDTPRPSARL

SEQ ID NO: 2407 - DNA, 984 bp, Arabidopsis thaliana
atggccaatgcgaagcccttttgtctcctcggcttcttttgtctgttattacagttattctccatcttccatatcggaaatggggaattggagatgaactattacaaagagagttgtccaaaagcggaagagataataagacaacaagtggagacgctttactacaaacacggtaacacagccgtatcttggctccgtaatctcttccatgactgtgtcgtcaagtcgtgtgatgcgtcgctgctgctagagacagcgagaggtgtggaatctgagcagaaatcgaagaggagtttcggtatgagaaactttaagtacgttaagattatcaaagacgcactcgagaaagagtgtccttccacagtctcttgtgctgatattgtcgctctttctgcgagagacggtattgtcatgttgaaagggccaaagatagagatgataaagacaggaaggagagatagtagagggagctacttgggagatgttgagactctaatccctaaccacaatgactctctctcatctgttatctccacctttaactccattggcatcgatgtcgaagccaccgtcgctctcttaggtgctcactcagtgggtagggtccactgcgttaacctagtgcaccggctatacccaacgattgaccctactctcgacccaagttacgccctttacttaaaaaaacgttgcccaagtccaacaccggacccgaacgccgtcttgtactcccgtaacgatcgtgagactccgatggttgtggacaacatgtattataagaacatcatggcccataaggggcttcttgtcattgatgatgagctagccaccgatcccaggaccgcaccgtttgtggccaagatggctgcggacaataattacttccatgagcagttctcacgtggcgtcaggctcttgtccgagaccaacccgctcacgggagaccaaggggagatcaggaaggattgtcgttatgtgaactaa

SEQ ID NO: 2408 - protein, 327 aa, Arabidopsis thaliana
MANAKPFCLLGFFCLLLQLFSIFHIGNGELEMNYYKESCPKAEEIIRQQVETLYYKHGNTAVSWLRNLFHDCVVKSCDASLLLETARGVESEQKSKRSFGMRNFKYVKIIKDALEKECPSTVSCADIVALSARDGIVMLKGPKIEMIKTGRRDSRGSYLGDVETLIPNHNDSLSSVISTFNSIGIDVEATVALLGAHSVGRVHCVNLVHRLYPTIDPTLDPSYALYLKKRCPSPTPDPNAVLYSRNDRETPMVVDNMYYKNIMAHKGLLVIDDELATDPRTAPFVAKMAADNNYFHEQFSRGVRLLSETNPLTGDQGEIRKDCRYVN

SEQ ID NO: 2409 - DNA, 609 bp, Arabidopsis thaliana
atggcgttcaatatcataacacctggtcgtgtttattcagccacgtctctcactttcgtttccaccattaaagctgctttcgttaaacctcctttggcctctccgtctcgtcgtaacctccttcgtttctcatcatctcctttgtcatttccgtcgctccgtcgaggtttccacggtggtcgtattgtggcaatgggttcttctgctcctgaatcggtcaataagccggaagaagagtggcgtgcgattctttctcctgaacaatttaggattctcagacagaaaggcactgaatatccaggaactggagaatacaacaaagtattcgacgatggcatctattgttgtgcaggatgtggaactcctctctacaaatccaccaccaaattcgactctggttgtggctggccagctttctttgatggactccccggagctataacccgaacccctgatccagatgggagacgaatcgagatcacatgtgctgcttgtggaggacatcttggtcacgtttttaaaggagaaggtttccctactcctaccgatgagcgacactgtgtaaacagtatctctctcaagttcacaccagagaatccgaccctgtaa

SEQ ID NO: 2410 - protein, 202 aa, Arabidopsis thaliana
MAFNIITPGRVYSATSLTFVSTIKAAFVKPPLASPSRRNLLRFSSSPLSFPSLRRGFHGGRIVAMGSSAPESVNKPEEEWRAILSPEQFRILRQKGTEYPGTGEYNKVFDDGIYCCAGCGTPLYKSTTKFDSGCGWPAFFDGLPGAITRTPDPDGRRIEITCAACGGHLGHVFKGEGFPTPTDERHCVNSISLKFTPENPTL

SEQ ID NO: 2411 - DNA, 1161 bp, Arabidopsis thaliana
atggcgaaaccggtgtccattgaagtgtataatcctaatgggaaatacagagttgttagcacaaaaccgatgcctggaactcgctggatcaatctcttggtagaccaaggttgtcgcgttgagatatgtcatttgaagaagacaatcttgtctgtagaagatatcattgatctgatcggagacaagtgtgatggagtcatcggtcagttgacggaagattggggagagactctgttctcagctttgagcaaagctggagggaaagctttcagtaacatggccgttggttataacaacgttgatgttgaagctgccaataagtatggaattgctgtcggtaacactccgggagtgttgactgagacgacggctgaactagctgcttctctttccttggctgctgcaagaagaattgttgaagccgacgaattcatgagaggtggcttgtacgagggatggcttcctcatctgtttgtggggaacttacttaaaggacagactgttggagttattggagctggacgtattggatctgcttatgctagaatgatggtggaagggttcaagatgaatttgatctactttgatctttaccaatccactcgtcttgagaaatttgtgacagcttatggacagttcttgaaagcaaatggagaacaacctgtgacatggaaacgagcttcgtccatggaggaggtgctgcgtgaggctgatctgataagtcttcacccggtgctggacaaaaccacttaccatcttgtcaacaaggagaggcttgccatgatgaaaaaggaagcaatccttgtgaactgcagcagaggtcctgtgatcgatgaggcagctttggtcgaacatctcaaagagaacccgatgttccgagttggtctcgatgtgttcgaggaagagccattcatgaaaccagggcttgctgatacgaaaaacgctattgttgttcctcacattgcttctgcttccaagtggactcgtgaaggaatggctacgcttgcagctctcaacgtcctcggaagagtcaaagggtacccgatttggcatgacccgaaccgagtcgatccattcttgaacgaaaacgcttcaccgcccaatgccagtccaagcatcgtcaactcaaaggccttaggattgcctgtttcgaagctatga

SEQ ID NO: 2412 - protein, 386 aa, Arabidopsis thaliana
MAKPVSIEVYNPNGKYRVVSTKPMPGTRWINLLVDQGCRVEICHLKKTILSVEDIIDLIGDKCDGVIGQLTEDWGETLFSALSKAGGKAFSNMAVGYNNVDVEAANKYGIAVGNTPGVLTETTAELAASLSLAAARRIVEADEFMRGGLYEGWLPHLFVGNLLKGQTVGVIGAGRIGSAYARMMVEGFKMNLIYFDLYQSTRLEKFVTAYGQFLKANGEQPVTWKRASSMEEVLREADLISLHPVLDKTTYHLVNKERLAMMKKEAILVNCSRGPVIDEAALVEHLKENPMFRVGLDVFEEEPFMKPGLADTKNAIVVPHIASASKWTREGMATLAALNVLGRVKGYPIWHDPNRVDPFLNENASPPNASPSIVNSKALGLPVSKL

SEQ ID NO: 2413 - DNA, 516 bp, Arabidopsis thaliana
atggcggccatgaactcgagtgttctcacttgcagctacgcaattgctggctctggctcggtagagcttaaccagaaagttggtttggtgaattcatcagttgggtttggtcagaagaaacagatgattatgcctgtgatcaaagctcaacgcgttgttggtgatgatgttgatggatctaatggaagacgatcagccatggttttcttagcagctacactcttctccactgctgctgtttctgcttctgctaatgctggcgtcattgacgaatacctcgagaggagcaaaaccaacaaagaacttaatgataagaagagattggcaacaagtggagcaaactttgcgagagcattcactgttcaattcggaagctgcaagttccctgagaatttcactggctgccaagatcttgccaagcaaaagaaagttccatttatctcagaagatattgctttggaatgcgaaggcaaggacaagtacaagtgtggttccaatgttttctggaaatggtga

SEQ ID NO: 2414 - protein, 171 aa, Arabidopsis thaliana
MAAMNSSVLTCSYAIAGSGSVELNQKVGLVNSSVGFGQKKQMIMPVIKAQRVVGDDVDGSNGRRSAMVFLAATLFSTAAVSASANAGVIDEYLERSKTNKELNDKKRLATSGANFARAFTVQFGSCKFPENFTGCQDLAKQKKVPFISEDIALECEGKDKYKCGSNVFWKW

SEQ ID NO: 2415 - DNA, 624 bp, Arabidopsis thaliana
atggcgtcttcgctgtgtgtatcaaattccacaatttgccctctgcctaatgtatcttcgcagccgctgctatcattctcccactctctcaggccattcatttccaagtcgaaacctatgtgtgcctcgatacagaagagagatggctctcaatttgtggtgaaatctcaggctcttgacttctctggaactttctttgaaggtggattcgggtcggatgatgacccgacttctccttccgggtcgggagtctcaactgcccttgaagacaaaccggaacctcagtgcccacctgggctcaggcagtacgaaacaatggcggttttgagaccagacatgtctgaagatgaacggcttggtcttacccagaaatacgaagagttgcttgtggcaggaggtggaatgtatgtggaagtgtttaacagaggagtgattccgttggcttacagcataagaaagaagaacaaagctggagaaaccaacacttacttggatggaatctaccttctcttcacttacttcaccaaacccgaatcaatagttccactcgagaccgttctcactgccgacgatgacattatccgatcatcttccttcaagataaagaagaggaagtacaactga

SEQ ID NO: 2416 - protein, 207 aa, Arabidopsis thaliana
MASSLCVSNSTICPLPNVSSQPLLSFSHSLRPFISKSKPMCASIQKRDGSQFVVKSQALDFSGTFFEGGFGSDDDPTSPSGSGVSTALEDKPEPQCPPGLRQYETMAVLRPDMSEDERLGLTQKYEELLVAGGGMYVEVFNRGVIPLAYSIRKKNKAGETNTYLDGIYLLFTYFTKPESIVPLETVLTADDDIIRSSSFKIKKRKYN

SEQ ID NO: 2417 - DNA, 1266 bp, Arabidopsis thaliana
atgaaggtggttgataagatcaaatccgtgacggagcaaggccaaacagctttctccttcgagtttttcccaccgaagacagaagatggcgtcgagaatctctttgaacgaatggatcgattggtctcttatggacctaccttctgcgatatcacttggggtgctggtggatccacagctgatctcactctcgagattgcttctaggatgcagaatgttatctgcgtcgagactatgatgcatctcacttgtaccaacatgccgattgagaagattgatcacgcgcttgagacgattagatctaatggaattcagaatgtgcttgctcttagaggagatcctcctcatggacaagataagtttgttcaggttgaaggaggatttgcttgtgctttggatctggtgaatcacattcgtagcaagtatggtgattactttggaatcactgttgctggttatcctgaggctcatccggatgttattgaagctgatggacttgctactcctgaatcttatcagagtgatcttgcttacttgaagaaaaaggttgatgctggagcagatttgattgtgactcagcttttctatgatactgatatattcctcaagtttgtgaatgattgtcggcaaatcgggattaattgtcccattgttcctggaattatgcctatttccaactacaaggggttcttgcgtatggctggtttctgtaagaccaagatacccgctgagctcactgctgccttagagcctattaaggataatgacgaggctgttaaagcctatggaattcactttgcaacagaaatgtgcaaaaagattttggcccatggaatcacttcccttcatctctacacattgaacgtggacaaatcagctattgggatattaatgaaccttggtctgattgatgagtcaaaaatttctcgttctctaccttggagacgccctgcaaatgttttccgtactaaggaagatgttcgcccaattttctgggcaaaccgtccaaagagctacatatctagaacaaagggctggaatgacttcccacatggacgttggggtgattcacacagtgcagcatacagtacactttcggattatcagtttgcgcgcccaaaaggacgtgacaagaagcttcagcaagaatgggtcgtcccactgaaaagcattgaagatgttcaagaggtaggctttactttacggacactcgtacaaattgtttcgatctctttccctcatactcacttgcacattttcatgtaa

SEQ ID NO: 2418 - protein, 421 aa, Arabidopsis thaliana
MKVVDKIKSVTEQGQTAFSFEFFPPKTEDGVENLFERMDRLVSYGPTFCDITWGAGGSTADLTLEIASRMQNVICVETMMHLTCTNMPIEKIDHALETIRSNGIQNVLALRGDPPHGQDKFVQVEGGFACALDLVNHIRSKYGDYFGITVAGYPEAHPDVIEADGLATPESYQSDLAYLKKKVDAGADLIVTQLFYDTDIFLKFVNDCRQIGINCPIVPGIMPISNYKGFLRMAGFCKTKIPAELTAALEPIKDNDEAVKAYGIHFATEMCKKILAHGITSLHLYTLNVDKSAIGILMNLGLIDESKISRSLPWRRPANVFRTKEDVRPIFWANRPKSYISRTKGWNDFPHGRWGDSHSAAYSTLSDYQFARPKGRDKKLQQEWVVPLKSIEDVQEVGFTLRTLVQIVSISFPHTHLHIFM

SEQ ID NO: 2419 - DNA, 615 bp, Arabidopsis thaliana
atggcaactcaagccgccggaatcttcagccccgccataacaaccactacttccgccgtcaagaaactccacctcttctcatcaagccaccgtcccaagtctctctccttcaccaaaaccgccatccgcgccgagaaaacagagtcctcctctgctgccccagccgtgaaagaagctccagttggattcactcccccgcagctagacccaaacacaccatcaccaatcttcgccggaagcacaggaggtctcctccgtaaagcacaagtagaggaattttacgtgatcacatggaactcaccgaaagaacaaatctttgagatgccaacaggaggagctgcgataatgagagaaggaccgaatctattgaaactggcgaggaaagaacagtgtttggctttaggtacgaggttgaggtcaaagtacaagatcacttaccagttttacagagtgttccctaacggagaggttcaatatcttcacccgaaagatggagtttatccagagaaagcgaatccaggaagagaaggtgttggactaaacatgagatccatcggtaaaaatgttagtcccattgaggttaaattcactgggaaacaatcttatgatttgtaa

SEQ ID NO: 2420 - protein, 204 aa, Arabidopsis thaliana
MATQAAGIFSPAITTTTSAVKKLHLFSSSHRPKSLSFTKTAIRAEKTESSSAAPAVKEAPVGFTPPQLDPNTPSPIFAGSTGGLLRKAQVEEFYVITWNSPKEQIFEMPTGGAAIMREGPNLLKLARKEQCLALGTRLRSKYKITYQFYRVFPNGEVQYLHPKDGVYPEKANPGREGVGLNMRSIGKNVSPIEVKFTGKQSYDL

SEQ ID NO: 2421 - DNA, 849 bp, Arabidopsis thaliana
atgagtgtgattggaagcaagagctgtattttctctgtggctagatacacccgagaaaatgagaaatcttcttgcttcacttctatcaacaagaaatcttcgcttgatctgagatttcccagaaatctggcgggagtttcctgcaaattctctggagaaaatccaggaacaaatggggtttctcttagctccaagaacaaaatggaggattacaatacagctatgaagagattgatgagaagcccttatgaatatcatcatgatctaggtatgaactatacattgataagagatgaacttatagttgggtcacagccacagaaacctgaggacatagatcacttgaagcaggaacagaatgttgcttacatacttaacttgcagcaggataaggacattgagtattggggaatcgatttggattccattgttagaagatgtaaggagcttggaatccgtcacatgagaaggcctgctaaagattttgatccactttcgttgagaagccaacttccaaaagctgtttcttctttggaatgggcggtttcagaaggtaaaggaagagtctatgtgcattgctcagccggattgggaagagctccaggggtttccattgcttatatgtattggttctgtgacatgaatcttaacacggcttatgacactttggtatcaaagcgtccatgtgggcctaacaaaggagccatccgtggtgcaacatatgatctggctaagaatgatccctggaaagagccctttgagagtctccctgagaacgcattcgaggacattgcagattgggaaaggaagttgattcaagaacgtgttcgggccctccgtggaacctga

SEQ ID NO: 2422 - protein, 282 aa, Arabidopsis thaliana
MSVIGSKSCIFSVARYTRENEKSSCFTSINKKSSLDLRFPRNLAGVSCKFSGENPGTNGVSLSSKNKMEDYNTAMKRLMRSPYEYHHDLGMNYTLIRDELIVGSQPQKPEDIDHLKQEQNVAYILNLQQDKDIEYWGIDLDSIVRRCKELGIRHMRRPAKDFDPLSLRSQLPKAVSSLEWAVSEGKGRVYVHCSAGLGRAPGVSIAYMYWFCDMNLNTAYDTLVSKRPCGPNKGAIRGATYDLAKNDPWKEPFESLPENAFEDIADWERKLIQERVRALRGT

SEQ ID NO: 2423 - DNA, 1533 bp, Arabidopsis thaliana
atggccgctttgacaatgcagtttgaaggagagaagaaaaacgtatccgaagttgcagacgtaaccctcaagcaagaagatgaacaacaagaacgtagatcttattcgacgccgtttagggaagagagagacacctttggcccgatccaagttccttccgataaattatggggagcacagacgcagagatcgcttcagaacttcgagattggtggtgaccgcgagcgaatgcccgaaccaatcgtccgagcttttggtgtcttgaagaaatgtgctgccaaggttaacatggagtatggtcttgatccaatgattggggaagccataatggaagctgcacaagaagtagcagaaggaaagctcaatgatcatttccctcttgttgtatggcaaactggtagtgggacgcagagtaatatgaatgctaatgaggtcattgccaatagagcagctgagattcttggtcacaaacgtggtgaaaaaattgtgcacccaaatgaccatgtgaacagatcacaatcttctaatgacacttttccaactgtcatgcacattgcagctgcaaccgagattacttcgaggctaatccctagtttgaaaaatttgcatagctctttggaatctaagtccttcgagtttaaagatatagtgaaaatcggaagaactcatactcaagatgctacacctttgacattaggacaagaatttggtggctatgctactcaagttgagtatggacttaatagagtcgcatgtactctaccccgcatctatcagcttgcacaaggtggaactgctgttgggaccggattaaacactaagaaagggtttgatgtaaagatcgctgctgcagtagctgaagaaacaaacttgccattcgtcaccgcagaaaacaagtttgaagctctggctgcacacgatgcttgtgttgaaacaagtggatctcttaacacaatcgccacatcattgatgaagattgccaatgatatacgttttcttggaagtggtccaagatgtggtcttggtgaactttctctgcctgagaatgaaccaggaagcagtattatgcctggaaaggtaaatcctacacagtgtgaggccttgactatggtttgtgctcaagttatgggaaaccatgtagccgtgacaattggtgggtcgaatggtcattttgaattgaatgtattcaagccggttatcgcaagcgctctcttacattccattagactaatagcagatgcttcagcttcatttgagaaaaactgtgttagaggcattgaggccaacagagaaaggatctcaaagctattgcacgagtctcttatgcttgtgacatcattgaatcctaaaattggctatgacaatgctgcagcagtagccaaaagagctcacaaagaaggatgcacattaaaggtaaacaataaactattaacgttttcatcactaaataaatcggaatttaaacccatttttagcaagagaaaacatgttcatgtttgttacaatatatttgttgttctattttggatttaa

SEQ ID NO: 2424 - protein, 510 aa, Arabidopsis thaliana
MAALTMQFEGEKKNVSEVADVTLKQEDEQQERRSYSTPFREERDTFGPIQVPSDKLWGAQTQRSLQNFEIGGDRERMPEPIVRAFGVLKKCAAKVNMEYGLDPMIGEAIMEAAQEVAEGKLNDHFPLVVWQTGSGTQSNMNANEVIANRAAEILGHKRGEKIVHPNDHVNRSQSSNDTFPTVMHIAAATEITSRLIPSLKNLHSSLESKSFEFKDIVKIGRTHTQDATPLTLGQEFGGYATQVEYGLNRVACTLPRIYQLAQGGTAVGTGLNTKKGFDVKIAAAVAEETNLPFVTAENKFEALAAHDACVETSGSLNTIATSLMKIANDIRFLGSGPRCGLGELSLPENEPGSSIMPGKVNPTQCEALTMVCAQVMGNHVAVTIGGSNGHFELNVFKPVIASALLHSIRLIADASASFEKNCVRGIEANRERISKLLHESLMLVTSLNPKIGYDNAAAVAKRAHKEGCTLKVNNKLLTFSSLNKSEFKPIFSKRKHVHVCYNIFVVLFWI

SEQ ID NO: 2425 - DNA, 777 bp, Arabidopsis thaliana
atgtctatatccatggcgttattctctccgccgatctcttcctcacttcagaaccctaatctcatccccaagatctcaacctctcttctctccaccaagcgtttctctctaatctccgtccctagagcttcctccgacaatggtacgacttcccccgtcgtggagattccgaagcctgcttctgtggctgtagaggaagttccagttaaatctccagccgaaagctcctccgcttctgaaaacggcgccgttggaggtgaagcgactgattcgagtactgagacggtaatcaaatatcagaatgcgaagtgggttaatggaacttgggatctgaaacagttcgagaaagatggcaaaactgattgggattctgttatcgtttctgaggcaaagaggagaaaatggcttgaagataacccggaaacaacgagtaacgacgagcttgttgtcttcgatacttcgattattccatggtgggcatggatgaagagataccatctacctgaagctgaacttctcaatggtcgtgctgcgatgatagggttcttcatggcttactttgttgatagtcttaccggagtaggacttgttgatcaaatgggaaatttcttctgcaaaacactcttgtttgtggctgtagctggagttctcttcatccgtaagaatgaagatttagacaaacttaaggatctgttcgatgagactacgttatatgacaaacaatggcaagctgcatggaaagagccagattcatcaacagtttcttcaaagaagtga

SEQ ID NO: 2426 - protein, 258 aa, Arabidopsis thaliana
MSISMALFSPPISSSLQNPNLIPKISTSLLSTKRFSLISVPRASSDNGTTSPVVEIPKPASVAVEEVPVKSPAESSSASENGAVGGEATDSSTETVIKYQNAKWVNGTWDLKQFEKDGKTDWDSVIVSEAKRRKWLEDNPETTSNDELVVFDTSIIPWWAWMKRYHLPEAELLNGRAAMIGFFMAYFVDSLTGVGLVDQMGNFFCKTLLFVAVAGVLFIRKNEDLDKLKDLFDETTLYDKQWQAAWKEPDSSTVSSKK

SEQ ID NO: 2427 - DNA, 1422 bp, Arabidopsis thaliana
atggacaacaacaacaacaacaacacttttagttctctggataatgtcatgactaaccaaaatcctcttctcatggattttataccttcaagagaagattcaacttcattctcaacaatgcttccatggaataccatcagatcagatcctctacaaatgggtggctttgatattttcaattctatgctgactaacaaatacttatcatcttctccacggtctatcgatgttcaagataaccgcaatgttgagttcatggctcctcctcctcatcctcctccacttcatcctttggatcatttaagacactatgatgattcctcaaacaacatgtggggttttgaagcaaatagtgagtttcaggcattttcaggtgtagttggtccaagtgaaccaatgatgtctacattcggtgaagaagatttcccgtttctaatttcgaataaaagaaacaatgagctttcattgagtcttgcatcagatgtttctgatgaatgctcggagataagtctttgtgcagctacaagattagcctcagagcaagcttcttgcagcagcaaagacatttctaataacgttgttactcaaggtttctctcaacttatatttggctcaaaataccttcactctgttcaagaaatactatctcatttcgccgcatactcgctcgattattcatctcgaggaaccgagtcaggagctgctagttcagcctttacttcacgttttgagaatataactgagtttcttgatggtgattctaataactcggaggcgggtttcggatctacatttcaaaggagagcattagaagcaaagaaaacccatctcttggatcttcttcaaatggtggatgatcgatatagtcattgcgtagatgagattcatacggttatatcagcgttccatgctgcaaccgagttagatccacagttacacacccggtttgccctccaaaccgtttccttcttatacaagaacctgagagagagaatctgcaagaagataatctctatgggatctgtattggagagaggcaaagacaagactcaagaaacctctatgttccaccagcattgccttcttcagcagctgaaacgaaagaaccatcagatttggagacctcaacgaggtttgcctgagaaatctgtttcggttctacggaattggatgttccaaaacttccttcacccttacccgaaagattcggagaaacatcttctagctatacgaagtggcttgacaagaagtcaggtatcaaactggtttataaatgcgcgggttaggctatggaagccgatgatagaagagatgtatgcggaaatgaacaagaggaagctcaataacagtcacattcaacccaacggaccaactcttcgaatgccaaaatctgttatgatgagccaagcaatgcataaataa

SEQ ID NO: 2428 - protein, 473 aa, Arabidopsis thaliana
MDNNNNNNTFSSLDNVMTNQNPLLMDFIPSREDSTSFSTMLPWNTIRSDPLQMGGFDIFNSMLTNKYLSSSPRSIDVQDNRNVEFMAPPPHPPPLHPLDHLRHYDDSSNNMWGFEANSEFQAFSGVVGPSEPMMSTFGEEDFPFLISNKRNNELSLSLASDVSDECSEISLCAATRLASEQASCSSKDISNNVVTQGFSQLIFGSKYLHSVQEILSHFAAYSLDYSSRGTESGAASSAFTSRFENITEFLDGDSNNSEAGFGSTFQRRALEAKKTHLLDLLQMVDDRYSHCVDEIHTVISAFHAATELDPQLHTRFALQTVSFLYKNLRERICKKIISMGSVLERGKDKTQETSMFHQHCLLQQLKRKNHQIWRPQRGLPEKSVSVLRNWMFQNFLHPYPKDSEKHLLAIRSGLTRSQVSNWFINARVRLWKPMIEEMYAEMNKRKLNNSHIQPNGPTLRMPKSVMMSQAMHK

SEQ ID NO: 2429 - DNA, 1404 bp, Arabidopsis thaliana
atggcccaaaagctagttgcacagggtggtgagacgggagatgtatgggatgatggtgtttacgacaatgttacaaaggtatatgtagggcaaggccagtatggtatagccttcgtcaagtttgagtatgccaatggttctgaagtggttgttggagatgaacatggagagaagactgagctaggagttgaagagtttgagattgattcggatgactacatcgtctacgtggaaggttaccgtgagaaagttagcgatatgacctcagaaatgatcacgtttctttcattcaagacttctaaaggcaaaacctctcagcctatcgttaaaaaacctggggttaagtttgtgctacatggtggaaaaatcgttgggtttcatggacgttcgaccgacgttctacattccctaggggcctatgtttctttgccgtccactcccaaattgcttggaaactggattaaggtggagcaaaatggagaaggcccagggctaagatgctcacatggcatagctcaagtaggcaacaagatttactcttttggtggtgagctcataccaaatcagcccatcgataaacacctttacgtctttgacctcgagacccggacttggtccattgctccagccaccggagacgttccacacctctcttgcttaggtgtccgtatggtgtcagtaggatcgaccctctatacctttggaggccgagacttttcacgccaatacaacggtttctactcgtttgacacgacaacaaacgagtggaaactgctaactccggtggaagaaggacccactcctcgtagtttccattcgatggcagcggatgaggaaaacgtttacgttttcggtggagtgggtgctatggatcgaatcaagacactagactcttacaatatcgttgacaagacgtggtttcattgttcgaatccaggagattcctttagcataagaggaggagcagggctcgaagtggtgcaagggaaagtatggattgtgtatggatttaacggatgtgaagtagatgatgttcatttctacgatcctgctgaagacaaatggacacaagtggaaacattcggtgtgaagcctaacgaaaggagtgttttcgctagtgcggctattgggaaacacattgtgatatttggaggtgagattgcgatggatccacgagctcacgtaggtccgggtcaattaatcgatgggactttcgcgttggatacagagacgttgcaatgggagaggttagataagtttgaggggactccgagtagcagaggatggaccgcgtccacgactggaaccattgatggtaagaaaggacttgtgatgcatggtggtaaagctccaaccaatgaccggtttgatgacctcttcttttacggaattgactctgtctga

SEQ ID NO: 2430 - protein, 467 aa, Arabidopsis thaliana
MAQKLVAQGGETGDVWDDGVYDNVTKVYVGQGQYGIAFVKFEYANGSEVVVGDEHGEKTELGVEEFEIDSDDYIVYVEGYREKVSDMTSEMITFLSFKTSKGKTSQPIVKKPGVKFVLHGGKIVGFHGRSTDVLHSLGAYVSLPSTPKLLGNWIKVEQNGEGPGLRCSHGIAQVGNKIYSFGGELIPNQPIDKHLYVFDLETRTWSIAPATGDVPHLSCLGVRMVSVGSTLYTFGGRDFSRQYNGFYSFDTTTNEWKLLTPVEEGPTPRSFHSMAADEENVYVFGGVGAMDRIKTLDSYNIVDKTWFHCSNPGDSFSIRGGAGLEVVQGKVWIVYGFNGCEVDDVHFYDPAEDKWTQVETFGVKPNERSVFASAAIGKHIVIFGGEIAMDPRAHVGPGQLIDGTFALDTETLQWERLDKFEGTPSSRGWTASTTGTIDGKKGLVMHGGKAPTNDRFDDLFFYGIDSV

SEQ ID NO: 2431 - DNA, 3177 bp, Arabidopsis thaliana
atggatccaagaacaagacttgactatgctctgtttcagctcacaccaactagaacaagatgtgatcttgtgatattctctggtggtgagaatgagaaacttgcttctgggatttttcaacctttcgttacgcatctcaagagcgttagtgatcagatttctaaaggtggatactccgttactctccgtccttcctccgttggtgttccttggtttactaaagtgacccttcagagatttgtgcgatttgtgactactccggaggttcttgagaggtctgtaacattagagaaggagattgagcagatcgaggattcgattcaagctaatgcagccgccattgccggtgaagctgaaggaaacgagttgggtggtacatggacttctcaaaagtctacggctttatcaaagacgaaaggggaaactgatggagacactgtggaagaaaattcgaaggttggtcttcagcgtgttctggagaaccgtaaagcggctttgtgcaaagagcaagcgatggcttatgctcgagctttggttgttgggtttgaacttgactacatggatgacctcttttcgtttgctgatgctttcggagcttcgcggttaagggaagcgtgtgttaactttgtggacttgtgcaagagaaagaacgaggatagaatgtgggtggaccaaatcactgctatgcaagcatttcctaggcctgaattaacgttcatgggtgactctgggatcgtactcgctggtgaagagaatgatttgttgaatgctacaaacgtaaagcatggaaactctatggatgcctcgagccagggtagctttgagactggccaagaagggagagctcaaatggcaatgccgtggccaaaccagtttcctcagtacatgcagaactttcaaggacatgggtatccgcctccttatatgtttccggggatgcaaggtcaatcaccatatttccatgggaatatgcaatggcctgtaaacatgggagatgtggagtcaaatgagaagtcttccaagaagaaaaagaagaagaagaagaataagaagaagtcgaagcaagatgaatctgccgagccaagcgataattccagtactgagaccgaatcagaagacggaaatgaaggaaagaaacaatccaggaaagtggttatccgcaacataaattatataacttcaaagaggaatggagcgaaggagagtgattcagatgagtctggagaagaagaagggtttgtggatggagattctattaagcagcaagtagaagaagccattggctcagtggagagacgtcataaatcgacttcacaccgtcagaggaaacacaaaagtcacaacggtgatgatgattcaagtaacaaggaaactaaggggaatgataattgggatgccttccagaatcttcttttgaaagacaatgattcagagccagaagaattactacgtatatcatcaactgcgttaaatatggcgtctgaagttgtgagaaagagagaaccgccttctgatgattcattcttggttgcaattggaaatgaggattggggaagagaaaccagcattgagaaattcaatgcaggtgagaatgttcggataataaggaaagggaacaactatgacgaggagatgttgaatccgggtagaagcgatgaatcaagaagctattcgcaggcagagatgtcggttcatgatgggaagctcagaaccagaaatgaggcggaagaagactggttcatacgtaaccaagctggtccagaaacagatccaagtcttgtcaaaacatttgtaggagaccatttccacttaaataagagcagtgagagagatgtcctgaccgatgactctttcatgatccattctcgtgttgagaaccaagtagaagattctcggttaaggacagaaatcatggacttagacgtttacggaaccacccaacaagaaaacagtgccccggagaacactccgcatgaaccagatgacctatacatggttcttggacgggaacaagatgttaaacctacattgttaccatggacccctgaaattgactttgagactaacactttggctcaaagaacaagcagaatcgatttgataactgccacaaaggcctctgcaggtgaacaaaccttagatggtaaagaaaagaagagtcgtggtatctccaaggggaaggatgcaaagtcaagagcatcaagtagacctgacccggcgtcaaaagccaagagacctgcttggggaagtagagctgctgtctccaagtccaaatccgagatggaggaagagagaaagaagagaatggaggaacttttaattcagaggcaaaagagaattgcggagaagagttccggtggtagtgtatcaagttctttagcgtccaagaaaactcctactgtgaccaagtcagtgaagagctcgataaagaatgagaagactcctgaagccgcgcagtcaaaggctaagccagtactgagaagttccaccattgagcgccttgctgttgctcggaccgctccaaaggagccacagcaaaaaccagtaatcaaaagaacatcaaaaccttcaggatacaagacagagaaagctcaggaaaagaaatcgagtaaaataggtcaatcagatgcgaaaagtgtggaactttctcgtgacccgagtctcgaaatcaaggaaacggtggtggaagattcacattcttacttgtcagagaagcaagttgatgcacttcctgctgttgcttctgttgatgatttcaaagacattaaagaattgcatagcttgccatcagaagaaacggccagagtaaagaacagaccgaatgaaatcatagcagagaaagtacaagatcagacgaagatcgatgatcaggaaacagtgaagaatacatctgtttctgaagataagcaaatcaccacgaagcattactcagaggatgttggagaagtccaggcttcacaggaaaaaccggtgtctccaaagaagtcggtgactttttcagagacaaacatggaggagaagtattatttctcaccagcggtctcagagattgacatctcaacgccacctgctactgaagcagatcattcgaggaagaaatggaacagtgaagagacgtctcccaaggcaacggctaaagtcttcaggaagcttcttatgttcggaaggaaaaagtaa

SEQ ID NO: 2432 - protein, 1058 aa, Arabidopsis thaliana
MDPRTRLDYALFQLTPTRTRCDLVIFSGGENEKLASGIFQPFVTHLKSVSDQISKGGYSVTLRPSSVGVPWFTKVTLQRFVRFVTTPEVLERSVTLEKEIEQIEDSIQANAAAIAGEAEGNELGGTWTSQKSTALSKTKGETDGDTVEENSKVGLQRVLENRKAALCKEQAMAYARALVVGFELDYMDDLFSFADAFGASRLREACVNFVDLCKRKNEDRMWVDQITAMQAFPRPELTFMGDSGIVLAGEENDLLNATNVKHGNSMDASSQGSFETGQEGRAQMAMPWPNQFPQYMQNFQGHGYPPPYMFPGMQGQSPYFHGNMQWPVNMGDVESNEKSSKKKKKKKKNKKKSKQDESAEPSDNSSTETESEDGNEGKKQSRKVVIRNINYITSKRNGAKESDSDESGEEEGFVDGDSIKQQVEEAIGSVERRHKSTSHRQRKHKSHNGDDDSSNKETKGNDNWDAFQNLLLKDNDSEPEELLRISSTALNMASEVVRKREPPSDDSFLVAIGNEDWGRETSIEKFNAGENVRIIRKGNNYDEEMLNPGRSDESRSYSQAEMSVHDGKLRTRNEAEEDWFIRNQAGPETDPSLVKTFVGDHFHLNKSSERDVLTDDSFMIHSRVENQVEDSRLRTEIMDLDVYGTTQQENSAPENTPHEPDDLYMVLGREQDVKPTLLPWTPEIDFETNTLAQRTSRIDLITATKASAGEQTLDGKEKKSRGISKGKDAKSRASSRPDPASKAKRPAWGSRAAVSKSKSEMEEERKKRMEELLIQRQKRIAEKSSGGSVSSSLASKKTPTVTKSVKSSIKNEKTPEAAQSKAKPVLRSSTIERLAVARTAPKEPQQKPVIKRTSKPSGYKTEKAQEKKSSKIGQSDAKSVELSRDPSLEIKETVVEDSHSYLSEKQVDALPAVASVDDFKDIKELHSLPSEETARVKNRPNEIIAEKVQDQTKIDDQETVKNTSVSEDKQITTKHYSEDVGEVQASQEKPVSPKKSVTFSETNMEEKYYFSPAVSEIDISTPPATEADHSRKKWNSEETSPKATAKVFRKLLMFGRKK

SEQ ID NO: 2433 - DNA, 1983 bp, Arabidopsis thaliana
atgaagtcttttgcggctaaggtagaagagggagttaaaggaatagacggaaagccgtcggtaggtccggtgtaccggaatcttctgtcggaaaaaggttttcctccgattgattctgagatcaccactgcttgggacattttcagtaaatcagtggagaaattccctgacaataatatgcttggatggcgtcgaattgttgatgagaaggttggaccatatatgtggaaaacgtacaaggaagtatacgaagaagttttgcagattggctctgcactacgagccgccggagctgaacctgggagtcgagtggggatctacggtgttaattgtcctcagtggatcatagcaatggaggcttgtgcagctcacactctaatctgtgtacctctatatgatacattgggttcaggagcagtcgattacattgtagagcatgcggaaatcgactttgtgtttgtccaagacaccaaaattaaaggacttcttgagccagattgcaaatgtgctaaacggctaaaagctatagtttccttcactaacgtgagcgacgagcttagccacaaggcttcagaaattggagtcaaaacatactcctggatcgattttctccatatgggacgtgagaaaccggaagacacgaacccgcctaaggcgtttaacatatgcaccataatgtacaccagcggcacaagcggtgatcctaaaggtgtggttttgactcaccaagcggtcgcgacttttgttgttgggatggatctctatatggaccagtttgaagataagatgacacatgatgatgtgtatctctccttcttgcccttggctcatattcttgaccgtatgaacgaggaatacttctttcgcaaaggcgcttccgtcggctattaccatggaaatttgaacgtgttacgtgacgatattcaagaactgaaaccgacttatctagctggagtaccaagagtgtttgagagaatccatgaggggattcaaaaggctcttcaagaacttaacccaagaaggagattcatcttcaatgctctctacaaacacaagcttgcgtggttgaatcgtgggtactctcatagtaaagcttcacccatggctgatttcattgctttcagaaagattagagacaaattgggaggtcgcatccggttgctagtatctggaggagcacctttgagccctgagattgaagagtttttgagagttacttgttgttgctttgtcgttcaaggctacggtctaacggagacacttggaggaacggctttgggtttcccggacgagatgtgtatgctagggacagtcggtattccagcggtttacaacgagatacggcttgaagaggtgtctgaaatgggctatgacccgctcggagaaaatccggcaggagagatctgtataagaggacaatgtatgttttcagggtattacaagaaccctgaactcactgaagaagtcatgaaagatggatggttccacacaggagatataggtgagattcttccaaacggagtactcaagatcatcgatcgtaaaaagaatctgatcaaactttctcaaggagaatatgttgctctcgagcatttggaaaacatcttcgggcaaaactctgttgtccaagatatatgggtttatggagacagcttcaaatctatgcttgtcgcggtggttgttcccaacccagaaaccgtcaacaggtgggctaaagatctcggttttactaaaccattcgaagaactctgttctttcccggaactaaaagaacacatcatttcagaactgaagtccacggcagaaaagaacaagctaagaaagtttgagtacatcaaagcggtgacagtggagacaaaacctttcgacgtagagagagacttagtgactgcgacgctcaagaatcggaggaacaatcttctcaaatattatcaggtgcaaatcgacgaaatgtaccgcaaattggcctcaaagaaaatctga

SEQ ID NO: 2434 - protein, 660 aa, Arabidopsis thaliana
MKSFAAKVEEGVKGIDGKPSVGPVYRNLLSEKGFPPIDSEITTAWDIFSKSVEKFPDNNMLGWRRIVDEKVGPYMWKTYKEVYEEVLQIGSALRAAGAEPGSRVGIYGVNCPQWIIAMEACAAHTLICVPLYDTLGSGAVDYIVEHAEIDFVFVQDTKIKGLLEPDCKCAKRLKAIVSFTNVSDELSHKASEIGVKTYSWIDFLHMGREKPEDTNPPKAFNICTIMYTSGTSGDPKGVVLTHQAVATFVVGMDLYMDQFEDKMTHDDVYLSFLPLAHILDRMNEEYFFRKGASVGYYHGNLNVLRDDIQELKPTYLAGVPRVFERIHEGIQKALQELNPRRRFIFNALYKHKLAWLNRGYSHSKASPMADFIAFRKIRDKLGGRIRLLVSGGAPLSPEIEEFLRVTCCCFVVQGYGLTETLGGTALGFPDEMCMLGTVGIPAVYNEIRLEEVSEMGYDPLGENPAGEICIRGQCMFSGYYKNPELTEEVMKDGWFHTGDIGEILPNGVLKIIDRKKNLIKLSQGEYVALEHLENIFGQNSVVQDIWVYGDSFKSMLVAVVVPNPETVNRWAKDLGFTKPFEELCSFPELKEHIISELKSTAEKNKLRKFEYIKAVTVETKPFDVERDLVTATLKNRRNNLLKYYQVQIDEMYRKLASKKI

SEQ ID NO: 2435 - DNA, 525 bp, Arabidopsis thaliana
atggcggtgttatccaccatctactccatcaccagagcttcaacgcctactatggcgtctctaactaatgactcaccgtctccacttccttcttcttcaccgtcgaagcttccctctcctacttctccgtcaaagaaaccgttaaaactaagacaagtgagcaaacaaatgggaagtcaaaaccagcaacgacgaggcaacaagccttcgatagcacagattgagagagcttttggctctggatcatatcgtgattccgaaggggaaatggatatgaatacggtattcgatgagcttctattaggccatgctaataaattcgaaagtaagatcgagaagaagctacgggagattggcgaaatctttgtagctcgaacagagcctaagcttcgttcctcggggaaaccagttttgatgtttacaattcaatggattcttccaatatggattatgtcactgctcgtagcttgtggagttatcaaactcccttttagcatccctttccttgatgacttgatcatgtga

SEQ ID NO: 2436 - protein, 174 aa, Arabidopsis thaliana
MAVLSTIYSITRASTPTMASLTNDSPSPLPSSSPSKLPSPTSPSKKPLKLRQVSKQMGSQNQQRRGNKPSIAQIERAFGSGSYRDSEGEMDMNTVFDELLLGHANKFESKIEKKLREIGEIFVARTEPKLRSSGKPVLMFTIQWILPIWIMSLLVACGVIKLPFSIPFLDDLIM

SEQ ID NO: 2437 - DNA, 1416 bp, Arabidopsis thaliana
atggaaccagtctcttcatggggtaacacctctctcgtctccgtagatccagagatccacgacctaatcgagaaggagaaacgtcggcaatgtcgaggaatcgaacttatcgcttccgagaatttcacttccttcgccgtcatcgaagctctcggaagtgccttaaccaacaaatactccgaaggtattcctggtaatcgttattacggaggtaacgaattcatcgatgagatcgagaatctttgccgttcaagagctctcgaagctttccattgtgatccagcagcgtggggcgttaatgttcagccgtattctggatctccggcaaatttcgctgcttacacggctttgcttcagcctcacgatcgtatcatggggcttgatttgccttcaggtggtcatttgactcatggttactatacatctggtggtaagaagatctctgcgacttcgatctactttgagagtcttccgtataaggtgaatttcaccactggttacattgattacgataagcttgaagagaaggcgttggatttcaggcctaagttgcttatctgtggtggtagtgcgtatcctagggattgggattacgctagatttagagctattgctgataaggttggagctcttttgctttgtgacatggctcacatcagtggtctcgttgctgctcaggaagctgcaaacccatttgagtactgtgacgttgtgacaaccacaacccacaagagtttgaggggtccaagggctggtatgattttctacaggaagggtccaaaaccaccaaagaagggtcaacccgagggtgcagtctatgattttgaggacaaaatcaactttgctgtattccctgcgcttcaaggtggtcctcacaatcaccagattggtgctctagctgttgcgttgaagcaggctaatactcctgggttcaaggtctacgcaaaacaagtgaaagccaatgctgttgcccttggaaactacctaatgagcaagggttaccagattgtgaccaatggaactgagaaccaccttgttctctgggatcttcgccctcttggattgaccggaaacaaggttgagaagctctgcgatctgtgcagcattacattgaacaagaacgcagtatttggagacagtagtgctcttgctcctggaggtgtaagaatcggtgcacccgcgatgacatcgagaggattggtggagaaggactttgagcagataggagaattcctgagccgtgcagtgacactgacgttggacatccaaaagacatacggtaagttgttgaaggacttcaacaagggtttggtgaacaacaaagatctcgatcagctcaaggctgatgtcgagaagttctcggcgtcttatgagatgcctggattcctcatgtctgagatgaagtacaaggattag

SEQ ID NO: 2438 - protein, 471 aa, Arabidopsis thaliana
MEPVSSWGNTSLVSVDPEIHDLIEKEKRRQCRGIELIASENFTSFAVIEALGSALTNKYSEGIPGNRYYGGNEFIDEIENLCRSRALEAFHCDPAAWGVNVQPYSGSPANFAAYTALLQPHDRIMGLDLPSGGHLTHGYYTSGGKKISATSIYFESLPYKVNFTTGYIDYDKLEEKALDFRPKLLICGGSAYPRDWDYARFRAIADKVGALLLCDMAHISGLVAAQEAANPFEYCDVVTTTTHKSLRGPRAGMIFYRKGPKPPKKGQPEGAVYDFEDKINFAVFPALQGGPHNHQIGALAVALKQANTPGFKVYAKQVKANAVALGNYLMSKGYQIVTNGTENHLVLWDLRPLGLTGNKVEKLCDLCSITLNKNAVFGDSSALAPGGVRIGAPAMTSRGLVEKDFEQIGEFLSRAVTLTLDIQKTYGKLLKDFNKGLVNNKDLDQLKADVEKFSASYEMPGFLMSEMKYKD

SEQ ID NO: 2439 - DNA, 807 bp, Arabidopsis thaliana
atggaagtaacttcccaatctaccctccctccagggttcagatttcatcctaccgacgaagaactcatcgtttactatcttcgaaaccagaccatgtctaaaccatgccctgtctccatcatcccagaagttgatatctacaaattcgacccatggcaattacccgagaaaacagagtttggagaaaatgagtggtatttcttcagccctagagaaagaaaatatccaaacggagtcagaccaaaccgggcagctgtttccggttattggaaagcaaccggtacagacaaagccattcacagcggttcaagtaacgtaggtgtcaagaaagctctagtcttctacaaaggtagacctcctaaaggaatcaaaactgactggatcatgcatgagtatcgtctccatgattcacgtaaagcatcaacgaaacgtaacggttccatgaggttagatgaatgggtactgtgtaggatatacaagaagagaggagcaagtaagcttctgaatgagcaagagggtttcatggacgaagtactaatggaggatgagacaaaagttgtagttaacgaagcagagagaagaactgaagaagagataatgatgatgacgtcgatgaaacttccaaggacgtgttcgctggctcatttgttggaaatggattacatgggacccgtctctcacattgataattttagtcagttcgatcatcttcatcaacctgattcggagtctagttggttcggggaccttcagtttaaccaagacgagatcttaaaccatcatcgtcaagcgatgtttaagttttag

SEQ ID NO: 2440 - protein, 268 aa, Arabidopsis thaliana
MEVTSQSTLPPGFRFHPTDEELIVYYLRNQTMSKPCPVSIIPEVDIYKFDPWQLPEKTEFGENEWYFFSPRERKYPNGVRPNRAAVSGYWKATGTDKAIHSGSSNVGVKKALVFYKGRPPKGIKTDWIMHEYRLHDSRKASTKRNGSMRLDEWVLCRIYKKRGASKLLNEQEGFMDEVLMEDETKVVVNEAERRTEEEIMMMTSMKLPRTCSLAHLLEMDYMGPVSHIDNFSQFDHLHQPDSESSWFGDLQFNQDEILNHHRQAMFKF

SEQ ID NO: 2441 - DNA, 1290 bp, Arabidopsis thaliana
atggaatcacttccccagccgcaaaaccaatcatctccggcaacaactccggcgaagatcctccttgggaaatacgaactcggtcgtcgtctcggtagcggaagcttcgcgaaagtccatttagctcgatcaatcgaatccgacgagctcgtcgccgttaaaatcatcgagaagaagaaaacaatcgaatccggtatggaaccaagaataatcagagagatcgatgcgatgcgtcgtcttcgtcatcatccaaacatactcaagatccatgaagttatggcaaccaaatctaagatctatctcgtaatggaactcgcttccggtggtgaacttttctcaaaagtcctccgtcgtggacgtcttcctgaatcaacggcgcgtcgttactttcaacaactcgcctccgctcttcgtttctctcaccaagacggtgtcgctcaccgtgatgtgaaacctcagaatctactcttagatgagcaaggtaacctcaaggtctctgactttggtttatcagctttaccggagcatctacaaaacggattgcttcacacggcgtgtggtactccggcttatacagctccggaggttatttcacggaggggatacgacggagcaaaagctgatgcgtggtcttgtggtgtgattttgtttgttttattggttggcgatgttccatttgatgattcgaatatcgctgcgatgtatcggaagattcatcggagagattatcggtttccgagctggatttcgaaacaagctaaatcgataatctatcagatgttagatccgaatccagtaacgaggatgagtattgaaacagtgatgaaaacgaattggttcaagaagtctctagagacttctgagtttcatcgtaacgtctttgattcggaagtagagatgaaatcgagtgttaattcgattactgcttttgatttgatctcgttatcgtcgggattagatctttctggattgtttgaggctaagaagaagaaggagaggagattcacggcgaaggtttcgggtgttgaagtggaggagaaggcgaagatgattggggagaagttaggttatgtagtgaagaagaagatgatgaagaaggaaggagaagtgaaggttgttggattagggagaggaagaactgtgattgtggtggaagcagtggagttaacggtggatgttgtggtggttgaagtgaaagttgttgaaggtgaagaagatgattcacggtggtctgatttgattactgagcttgaagatatagttctttcatggcacaatgacatcatgtaa

SEQ ID NO: 2442 - protein, 429 aa, Arabidopsis thaliana
MESLPQPQNQSSPATTPAKILLGKYELGRRLGSGSFAKVHLARSIESDELVAVKIIEKKKTIESGMEPRIIREIDAMRRLRHHPNILKIHEVMATKSKIYLVMELASGGELFSKVLRRGRLPESTARRYFQQLASALRFSHQDGVAHRDVKPQNLLLDEQGNLKVSDFGLSALPEHLQNGLLHTACGTPAYTAPEVISRRGYDGAKADAWSCGVILFVLLVGDVPFDDSNIAAMYRKIHRRDYRFPSWISKQAKSIIYQMLDPNPVTRMSIETVMKTNWFKKSLETSEFHRNVFDSEVEMKSSVNSITAFDLISLSSGLDLSGLFEAKKKKERRFTAKVSGVEVEEKAKMIGEKLGYVVKKKMMKKEGEVKVVGLGRGRTVIVVEAVELTVDVVVVEVKVVEGEEDDSRWSDLITELEDIVLSWHNDIM

SEQ ID NO: 2443 - DNA, 1239 bp, Arabidopsis thaliana
atggcggaggagaaatgggtggtgatggtgacggcgcagactccaacgaatatcgccgtgattaagtattggggaaagagagatgaggttcggattcttcccattaatgatagcattagcgtcacgcttgatcctgatcacctctgtactctcaccaccgtcgctgttagtccttcctttgatcgagatcgaatgtggctcaatggcaaggaaatctcgctttctggaagtaggtaccagaattgcttgagggaaattcgaagtcgtgctgatgatgtagaagataaagaaaagggtatcaagattgcgaagaaagattgggagaagctgcatctgcacattgcttctcataacaacttccctactgctgctggcttagcatcttctgctgctggttttgcttgcttagtttttgctcttgccaagttgatgaatgtaaatgaagatccaagccaactttctgctatagcaaggcaaggttcaggaagtgcttgccgtagtttatttgggggatttgtcaagtggaatatgggaaacaaagaagatggaagtgacagtgttgcagttcaactggtagatgataagcactgggatgatcttgttatcattattgctgtggttagttcacgacagaaggaaacaagcagcacctcgggaatgcgtgagagtgttgagacaagtttgcttttacagcatagagcaaaggaagttgtcccagtacggattttgcaaatggaagaagctataaagaatcgagatttcacatcttttacaaaattgacgtgttcagacagtaatcagtttcatgctgtttgtatggatacatctccacccatattctacatgaatgacacctcccacaggataatcagcttagttgaaaagtggaaccgttctgccggtacaccagagattgcttatacatttgatgctggcccaaatgcagtcatgattgcaagaaacaggaaagtagcagttgaattgctgcaggggctgctctactgcttccctcctaagcctgacacagacatgaagagttacgtactgggggatacatcgatagtaaaagaggcaggcttggaaggagagcttccacaaggaattaaagacaaaattggaagtcaggatcaaaaaggtgaagtgagttattttatatgcagcagacctggaagaggtcctgtggtgcttcaagaccaaactcaagctcttctccatcctcaaactggcctccccaaataa

SEQ ID NO: 2444 - protein, 412 aa, Arabidopsis thaliana
MAEEKWVVMVTAQTPTNIAVIKYWGKRDEVRILPINDSISVTLDPDHLCTLTTVAVSPSFDRDRMWLNGKEISLSGSRYQNCLREIRSRADDVEDKEKGIKIAKKDWEKLHLHIASHNNFPTAAGLASSAAGFACLVFALAKLMNVNEDPSQLSAIARQGSGSACRSLFGGFVKWNMGNKEDGSDSVAVQLVDDKHWDDLVIIIAVVSSRQKETSSTSGMRESVETSLLLQHRAKEVVPVRILQMEEAIKNRDFTSFTKLTCSDSNQFHAVCMDTSPPIFYMNDTSHRIISLVEKWNRSAGTPEIAYTFDAGPNAVMIARNRKVAVELLQGLLYCFPPKPDTDMKSYVLGDTSIVKEAGLEGELPQGIKDKIGSQDQKGEVSYFICSRPGRGPVVLQDQTQALLHPQTGLPK

SEQ ID NO: 2445 - DNA, 1053 bp, Arabidopsis thaliana; identical to SEQ ID NO: 2401

SEQ ID NO: 2446 - protein, 350 aa, Arabidopsis thaliana; identical to SEQ ID NO: 2402

SEQ ID NO: 2447 - DNA, 1536 bp, Arabidopsis thaliana
atggaggagatgactcccgcagttgcaatgactcttagcttagcagccaacaccatgtgtgaatcatcacctgtcgagatcactcagctaaagaacgttactgatgcagctgacttgttatctgattctgaaaatcaaagcttttgcaacggagggactgaatgcactatggaagatgtttctgaactggaagaggtaggtgaacaggatttgttgaaaactttatccgatacgagaagcgggtcttccaatgtttttgatgaagacgatgtattgtctgttgtggaggataatagtgctgtcataagtgagggcttgttagttgttgatgcaggctctgaattaagcttgtctaatacagctatggaaatagataacgggcgagttcttgcaaccgcgattatcgtaggcgaatcaagcattgagcaggttcccaccgcggaagttcttatcgcgggtgtaaatcaggataccaatacttcggaggttgtcattagattgccagatgaaaatagtaatcatctggtgaaagggagaagtgtttatgaactagattgtataccgctttggggcacggtttccattcaagggaatagatctgagatggaggatgcttttgccgtgtcacctcattttctgaaactacccatcaaaatgcttatgggggaccatgagggtatgagtccaagcctcacacacctcaccggtcattttttcggtgtttatgatggtcatggaggccataaggttgctgactattgccgagatagactccattttgctttggctgaagaaatagaacgtataaaagacgaattatgcaagaggaatacaggagagggtaggcaggtgcagtgggataaagtcttcacgagttgttttctaactgtcgatggtgagattgaaggaaaaattggtagagccgttgttggttcttctgataaggttcttgaggctgttgcgtctgagaccgtaggatcaactgctgttgttgccttggtttgctcatcacatatagtagtttctaactgcggtgattcgagggcggttttattccgtggcaaagaagccatgcccttgtcagttgatcacaaaccagatagagaggatgaatatgcaagaatagaaaatgctggaggcaaagttatacaatggcaaggcgcacgtgtttttggtgttctcgccatgtctaggtccatcggtgacagatatctgaagccatatgtgatcccagaaccggaagtgacattcatgcctcggtcaagagaagacgagtgtctcatactagccagtgacggtctttgggatgtaatgaacaaccaagaagtctgcgaaatagcaaggagacggatattgatgtggcacaagaagaacggtgcaccgcctctagcagagagaggcaaaggaatagatccagcttgccaagccgcagctgactacctctcaatgcttgctctacaaaaaggaagtaaagacaacatctccatcattgtgattgacttgaaagctcaaagaaagttcaagaccagaacctga

SEQ ID NO: 2448 - protein, 511 aa, Arabidopsis thaliana
MEEMTPAVAMTLSLAANTMCESSPVEITQLKNVTDAADLLSDSENQSFCNGGTECTMEDVSELEEVGEQDLLKTLSDTRSGSSNVFDEDDVLSVVEDNSAVISEGLLVVDAGSELSLSNTAMEIDNGRVLATAIIVGESSIEQVPTAEVLIAGVNQDTNTSEVVIRLPDENSNHLVKGRSVYELDCIPLWGTVSIQGNRSEMEDAFAVSPHFLKLPIKMLMGDHEGMSPSLTHLTGHFFGVYDGHGGHKVADYCRDRLHFALAEEIERIKDELCKRNTGEGRQVQWDKVFTSCFLTVDGEIEGKIGRAVVGSSDKVLEAVASETVGSTAVVALVCSSHIVVSNCGDSRAVLFRGKEAMPLSVDHKPDREDEYARIENAGGKVIQWQGARVFGVLAMSRSIGDRYLKPYVIPEPEVTFMPRSREDECLILASDGLWDVMNNQEVCEIARRRILMWHKKNGAPPLAERGKGIDPACQAAADYLSMLALQKGSKDNISIIVIDLKAQRKFKTRT

SEQ ID NO: 2449 - DNA, 912 bp, Arabidopsis thaliana
atggatcacgacaagtctacttcttgttgctgcgttcttgatgcttccacttatgttggtttctggattctcaagaaattgcttagcagaggatactctgttcacgcagcgattcgtagaaacggggagagtgaaattgaggagatgatcagagagatggaaacaacagaagagagattagtggtgtacgatgtagatgtgttggattatcaaagcatacttgtctctctcaagacatgtaacgttgtcttctgttgcttagacagccctgaagggtacgatgagaaggaggtggatttggaagtgagaggagcgatcaatgtggtggaagcgtgtggaagaacagagagtatagagaagattgtgttttcttcttcattaacagcttcaatttggagagacaacattggaactcaaaaggatgttgatgagaagtgttggagtgaccaagacttctgtcgcagcaagaagttgtggcatgcactggcaaagatgttgtcggagaaagcagcttgggcattagccatggaccgtaggctcaacatggtctctatcaaccctggtcttgtcgtcggaccatctgtcgcacaacacaacgctaggcccaccatgtcataccttaaaggagctgcacaaatgtatgagaatggtgtgttagcttatgtagacgttaagtttctagcggacgttcatattagagcattcgaggatgtttcagcttgcggtcgatacttctgcttcaaccaaatcgtcaacacagaagaagaagctctcaagctagtggagagtttgtctcctttgattcctatgccaccgaggtatgagaatgagatgcacggaagtgaagtttacgaagaaagattaaggaacaacaaattaagcaagctggtagaagctggctctgcttgttaa

SEQ ID NO: 2450 - protein, 303 aa, Arabidopsis thaliana
MDHDKSTSCCCVLDASTYVGFWILKKLLSRGYSVHAAIRRNGESEIEEMIREMETTEERLVVYDVDVLDYQSILVSLKTCNVVFCCLDSPEGYDEKEVDLEVRGAINVVEACGRTESIEKIVFSSSLTASIWRDNIGTQKDVDEKCWSDQDFCRSKKLWHALAKMLSEKAAWALAMDRRLNMVSINPGLVVGPSVAQHNARPTMSYLKGAAQMYENGVLAYVDVKFLADVHIRAFEDVSACGRYFCFNQIVNTEEEALKLVESLSPLIPMPPRYENEMHGSEVYEERLRNNKLSKLVEAGSAC

SEQ ID NO: 2451 - DNA, 1149 bp, Arabidopsis thaliana
atgtcttcagatcaactaagcaaattccttgatagaaacaaaatggaagacaataaaagaaaagtattagatgaagaagcgaaagcttctctagacatatggaagtatgtctttgggtttgcagatatagcagctgcaaagtgtgccattgatcttaaaataccagaagccattgaaaaccatccttcttcacagcccgtaacactagccgaactctcctccgccgtctccgcctctccctcgcatctccgccgtataatgaggtttcttgtacaccaaggaatctttaaagaaatccccacaaaagatggtttagctacaggctacgttaatacgccactctctcgccgtttgatgatcacaagacgtgatggaaaatcgctggctccttttgttctcttcgaaacaactcccgagatgctcgctccatggttgagacttagctcagtcgtttcttcgccggtcaacggttcaactccaccaccgtttgatgcagtgcacggtaaggacgtgtggtcgttcgcgcaggataatcccttcctcagcgatatgatcaatgaggccatggcttgtgatgcaaggcgcgtggtgccacgtgtagccggagcttgtcacggcttgtttgatggcgtgactacgatggttgacgtaggaggtggtacgggagagacgatggggatgcttgtgaaggagtttccttggatcaaaggatttaactttgatcttcctcatgtcattgaagttgctgaagtcttggacggtgttgagaatgttgagggcgatatgtttgattctattccggcttgcgacgccattttcatcaagtgggtgttacacgattggggagacaaagattgcataaagatattgaagaattgcaaagaagcggtccctccaaatatcggaaaagtgttgatagtggaatcggtgatcggagagaataaaaagacgatgatagtggacgaacgagatgaaaagttagagcacgtgagattgatgcttgatatggtgatgatggctcacacaagcacaggcaaagaacggactttgaaagaatgggactttgttcttaaagaagctggctttgctcgatatgaggttagggacattgatgatgttcagagtcttataatcgcgtatcggtcttaa

SEQ ID NO: 2452 - protein, 382 aa, Arabidopsis thaliana
MSSDQLSKFLDRNKMEDNKRKVLDEEAKASLDIWKYVFGFADIAAAKCAIDLKIPEAIENHPSSQPVTLAELSSAVSASPSHLRRIMRFLVHQGIFKEIPTKDGLATGYVNTPLSRRLMITRRDGKSLAPFVLFETTPEMLAPWLRLSSVVSSPVNGSTPPPFDAVHGKDVWSFAQDNPFLSDMINEAMACDARRVVPRVAGACHGLFDGVTTMVDVGGGTGETMGMLVKEFPWIKGFNFDLPHVIEVAEVLDGVENVEGDMFDSIPACDAIFIKWVLHDWGDKDCIKILKNCKEAVPPNIGKVLIVESVIGENKKTMIVDERDEKLEHVRLMLDMVMMAHTSTGKERTLKEWDFVLKEAGFARYEVRDIDDVQSLIIAYRS

SEQ ID NO: 2453 - DNA, 1287 bp, Arabidopsis thaliana
atggcgacggctttcgctcccactaagctcactgccacggttcctctgcatggatcccatgagaatcgtctcttgctcccgatccgattggctcctccttcttctttcctcggatccacccgttccctctcccttcgcagactcaatcactccaacgccacccgtcgatctcccgtcgtctctgtccaggaagttgtcaaggagaagcaatccaccaataataccagcctgttgataaccaaagaggaaggattggagttgtatgaagatatgatactaggtagatctttcgaagacatgtgtgctcaaatgtattaccgaggcaagatgtttggttttgttcacttgtacaatggccaagaggctgtttctactggctttatcaagctccttaccaagtctgactctgtcgttagtacctaccgtgaccatgtccatgccctcagcaaaggtgtctctgctcgtgctgttatgagcgagctcttcggcaaggttactggatgctgcagaggccaaggtggatccatgcacatgttctccaaagaacacaacatgcttggtggctttgcttttattggtgaaggcattcctgtcgccactggtgctgcctttagctccaagtacaggagggaagtcttgaaacaggattgtgatgatgtcactgtcgcctttttcggagatggaacttgtaacaacggacagttcttcgagtgtctcaacatggctgctctctataaactgcctattatctttgttgtcgagaataacttgtgggccattgggatgtctcacttgagagccacttctgaccccgagatttggaagaaaggtcctgcatttgggatgcctggtgttcatgttgacggtatggatgtcttgaaggtcagggaagtcgctaaagaagctgtcactagagctagaagaggagaaggtccaaccttggttgaatgtgagacttatagattcagaggacactccttggctgatcccgatgagctccgtgatgctgctgagaaagccaaatacgcggctagagacccaatcgcagcattgaagaagtatttgatagagaacaagcttgcaaaggaagcagagctaaagtcaatagagaaaaagatagacgagttggtggaggaagcggttgagtttgcagacgctagtccacagcccggtcgcagtcagttgctagagaatgtgtttgctgatccaaaaggatttggaattggacctgatggacggtacagatgtgaggaccccaagtttaccgaaggcacagctcaagtctga

SEQ ID NO: 2454 - protein, 428 aa, Arabidopsis thaliana
MATAFAPTKLTATVPLHGSHENRLLLPIRLAPPSSFLGSTRSLSLRRLNHSNATRRSPVVSVQEVVKEKQSTNNTSLLITKEEGLELYEDMILGRSFEDMCAQMYYRGKMFGFVHLYNGQEAVSTGFIKLLTKSDSVVSTYRDHVHALSKGVSARAVMSELFGKVTGCCRGQGGSMHMFSKEHNMLGGFAFIGEGIPVATGAAFSSKYRREVLKQDCDDVTVAFFGDGTCNNGQFFECLNMAALYKLPIIFVVENNLWAIGMSHLRATSDPEIWKKGPAFGMPGVHVDGMDVLKVREVAKEAVTRARRGEGPTLVECETYRFRGHSLADPDELRDAAEKAKYAARDPIAALKKYLIENKLAKEAELKSIEKKIDELVEEAVEFADASPQPGRSQLLENVFADPKGFGIGPDGRYRCEDPKFTEGTAQV

SEQ ID NO: 2455 - DNA, 801 bp, Arabidopsis thaliana
atggccacttcagcaatccaacactcttctttcgctggccaaacgaccctaaagccatccaacgatctcctccgcaaaatcggagcctccaatggcggtggccgcatcatcatgcgtcgtaccgtcaagtctactcctcagagcatctggtacggaccagaccgtcccaaatacctaggaccattttccgaaaacacaccatcatacctaaccggagaataccctggagactacggttgggacaccgctggtctctcagccgatccagaaacattcgcaaagaatcgtgagctcgaagtgatccacagtagatgggcaatgttgggagctttaggctgcaccttccctgaaattctctcaaaaaacggagtcaaattcggtgaagccgtgtggttcaaggcaggatctcaaatcttctcagaaggagggcttgactacctcggaaaccctaacttgatccacgcgcaaagcatattagctatatgggcgtgtcaagttgtgctaatgggattcattgaagggtacagaatcggaggtggtcctcttggggaagggcttgacccgctttacccgggcggggccttcgacccgttgaacttagcggaggatccagaagcgttttcagagttgaaagtgaaggagcttaaaaacggtcgtcttgctatgttctcaatgtttggattctttgtccaagccatagttaccggtaaaggtccgatcgaaaatctgttcgatcacattgcagaccctgtggctaacaatgcttgggcttacgccaccaacttcgtccccggaaaatag

SEQ ID NO: 2456 - protein, 266 aa, Arabidopsis thaliana
MATSAIQHSSFAGQTTLKPSNDLLRKIGASNGGGRIIMRRTVKSTPQSIWYGPDRPKYLGPFSENTPSYLTGEYPGDYGWDTAGLSADPETFAKNRELEVIHSRWAMLGALGCTFPEILSKNGVKFGEAVWFKAGSQIFSEGGLDYLGNPNLIHAQSILAIWACQVVLMGFIEGYRIGGGPLGEGLDPLYPGGAFDPLNLAEDPEAFSELKVKELKNGRLAMFSMFGFFVQAIVTGKGPIENLFDHIADPVANNAWAYATNFVPGK

SEQ ID NO: 2457 - DNA, 1509 bp, Arabidopsis thaliana
atgaaggagccaacgacggagatagagattgaaacttcagctgtcgcaacgatcctgcctcctcctcttcctccgacggcgtcacctcatcaagcgttagtcgagaggctcaaggattatggacaggaagatgttttctctctctgggatgaactctcaccggaagagcgagatctcctcctcagagatatcgagaatttggatcttccaaggatagatcggatcatcagatgctcacttcattcacaagggttgccagtggcggcaatagaaccggtgccggagaattgtgtgtcaacggtggaggaaagaactaaggaagacagagaaaaatggtggaaaatgggattaaaagctatctacgaaggcaaattgggtgtggtgcttttatctggtggacagggaacaagacttggaagttcagatccaaaagggtgttataatatcggactgccatctgggaaatcactttttcagattcaagctgagaggatcttatgtgtccaaaggcttgcttctcaggcaatgagtgaggcaagtccaactcgcccagttacaatacagtggtatataatgaccagtccatttactcatgaaccaacacaaaaattcttcaagagtcacaagtattttggccttgaaccagatcaagtcaccttttttcaacaaggaactctgccttgcatttcaaaggatggcaagtttatcatggagacacctttcagcctatccaaggcgccggatgggaacgggggagtttatacagctttaaaatcttcaaggttattagaagatatggcttcgagggggattaaatatgtggattgctatggtgttgacaatgttctggttcgagtagctgaccctacttttctgggatacttcatcgacaaaagtgcagcttcagctgcaaaagtagtgcgcaaggcatatccacaggaaaaagttggagtatttgtaaggaggggaaaaggtgggcctttgactgtagttgagtacacagagcttgaccagtctatggcttctgcaactaatcaacaaacaggacgtcttcaatattgctggagtaacgtgtgcttacacatgttcactctggatttccttaaccaagttgcgaatgggctggaaaaagacagcgtttaccatttggcggagaagaagataccgtctataaatggcgacatagtgggactaaaactagaacagttcatattcgattgctttccttatgctccttcgactgcactttttgaggtgttgagggaggaagagtttgcaccggtgaagaacgcaaacgggtcgaattacgacacaccggaaagcgcaagactgttggttctacgactgcatacacgttgggtcatagcagctggtggatttctaacacattccgttcctttatatgcgactggtgtggaagtgtcaccattgtgctcgtacgctggagaaaatctagaagcgatttgtcggggaagaacctttcacgcaccatgtgaaatctccctctaa

SEQ ID NO: 2458 - protein, 502 aa, Arabidopsis thaliana
MKEPTTEIEIETSAVATILPPPLPPTASPHQALVERLKDYGQEDVFSLWDELSPEERDLLLRDIENLDLPRIDRIIRCSLHSQGLPVAAIEPVPENCVSTVEERTKEDREKWWKMGLKAIYEGKLGVVLLSGGQGTRLGSSDPKGCYNIGLPSGKSLFQIQAERILCVQRLASQAMSEASPTRPVTIQWYIMTSPFTHEPTQKFFKSHKYFGLEPDQVTFFQQGTLPCISKDGKFIMETPFSLSKAPDGNGGVYTALKSSRLLEDMASRGIKYVDCYGVDNVLVRVADPTFLGYFIDKSAASAAKVVRKAYPQEKVGVFVRRGKGGPLTVVEYTELDQSMASATNQQTGRLQYCWSNVCLHMFTLDFLNQVANGLEKDSVYHLAEKKIPSINGDIVGLKLEQFIFDCFPYAPSTALFEVLREEEFAPVKNANGSNYDTPESARLLVLRLHTRWVIAAGGFLTHSVPLYATGVEVSPLCSYAGENLEAICRGRTFHAPCEISL

SEQ ID NO: 2459 - DNA, 327 bp, Arabidopsis thaliana
atggcaacttcgaagcttcaagctctttggaatcatccagctggacctaagacaattcatttttgggcgccgacgttcaagtggggtataagcattgccaatattgcagactttcaaaaacctccagagacactttcataccctcaacaaattgtgatcacaggtactggacttgtttggtcacgttacagcactgtaattactccgaaaaactggaatctctttagcgtgagtcttggtatggctgtgacagggatataccaacttactcgtaaaataaagcacgattatgtatatgaagcaaattctattgttgcaaaagaatga

SEQ ID NO: 2460 - protein, 108 aa, Arabidopsis thaliana
MATSKLQALWNHPAGPKTIHFWAPTFKWGISIANIADFQKPPETLSYPQQIVITGTGLVWSRYSTVITPKNWNLFSVSLGMAVTGIYQLTRKIKHDYVYEANSIVAKE

SEQ ID NO: 2461 - DNA, 954 bp, Arabidopsis thaliana
atggcgactcttaaggtttctgattctgttcctgctccttctgatgatgctgagcaattgagaaccgcttttgaaggatggggtacgaacgaggacttgatcatatcaatcttggctcacagaagtgctgaacagaggaaagtcatcaggcaagcataccacgaaacctacggcgaagaccttctcaagactcttgacaaggagctctctaacgatttcgagagagctatcttgttgtggactcttgaacccggtgagcgtgatgctttattggctaatgaagctacaaaaagatggacttcaagcaaccaagttcttatggaagttgcttgcacaaggacatcaacgcagctgcttcacgctaggcaagcttaccatgctcgctacaagaagtctcttgaagaggacgttgctcaccacactaccggtgacttcagaaagcttttggtttctcttgttacctcatacaggtacgaaggagatgaagtgaacatgacattggctaagcaagaagctaagctggtccatgagaaaatcaaggacaagcactacaatgatgaggatgttattagaatcttgtccacaagaagcaaagctcagatcaatgctacttttaaccgttaccaagatgatcatggcgaggaaattctcaagagtcttgaggaaggagatgatgatgacaagttccttgcacttttgaggtcaaccattcagtgcttgacaagaccagagctttactttgtcgatgttcttcgttcagcaatcaacaaaactggaactgatgaaggagcactcactagaattgtgaccacaagagctgagattgacttgaaggtcattggagaggagtaccagcgcaggaacagcattcctttggagaaagctattaccaaagacactcgtggagattacgagaagatgctcgtcgcacttctcggtgaagatgatgcttaa

SEQ ID NO: 2462 - protein, 317 aa, Arabidopsis thaliana
MATLKVSDSVPAPSDDAEQLRTAFEGWGTNEDLIISILAHRSAEQRKVIRQAYHETYGEDLLKTLDKELSNDFERAILLWTLEPGERDALLANEATKRWTSSNQVLMEVACTRTSTQLLHARQAYHARYKKSLEEDVAHHTTGDFRKLLVSLVTSYRYEGDEVNMTLAKQEAKLVHEKIKDKHYNDEDVIRILSTRSKAQINATFNRYQDDHGEEILKSLEEGDDDDKFLALLRSTIQCLTRPELYFVDVLRSAINKTGTDEGALTRIVTTRAEIDLKVIGEEYQRRNSIPLEKAITKDTRGDYEKMLVALLGEDDA

SEQ ID NO: 2463 - DNA, 606 bp, Arabidopsis thaliana
atgagttatttgggagtcggagttagtcccggaaacgtctccggaagtactaccaaaatgaagctgattgatcggaaagtgagagtcacggagttgattctgaggtgtttggtttgtgtccttgctctcgtcgctgcgattctcattgctacagatgttcaagtgagagagattttcatgattcagaagaaagccaaattcaccgacatgaaggcgcttgtgcttttggtggtcgtcaatggcatagccgcgggttattctttggttcaggcggttcgttgcgtggtgggtttgatgaaaggaagagttttgtttagtaagcctctggcttgggccattttcttcggcgatcaggcagtagcatacttgtgtgtggcgggggttgcagccgcggcgcagtctgcggcctttgcaaagttgggtgagccagagcttcaatggatgaaaatttgtaatatgtatgggaagttttgtaaccaagtgggtgaaggaattgcgagcgctttgtttgcttgcattggaatggttttgatctcttgcatttcggctttcggtgtctttcgtttgtacggcggaagcaaatctaggccaagctcacggtggtga

SEQ ID NO: 2464 - protein, 201 aa, Arabidopsis thaliana
MSYLGVGVSPGNVSGSTTKMKLIDRKVRVTELILRCLVCVLALVAAILIATDVQVREIFMIQKKAKFTDMKALVLLVVVNGIAAGYSLVQAVRCVVGLMKGRVLFSKPLAWAIFFGDQAVAYLCVAGVAAAAQSAAFAKLGEPELQWMKICNMYGKFCNQVGEGIASALFACIGMVLISCISAFGVFRLYGGSKSRPSSRW

SEQ ID NO: 2465 - DNA, 1719 bp, Arabidopsis thaliana
atgggaaagcctgcaaggtggttaaaaagtgtactacttggaaagaaaccatctaaatctagtggttctaaagataaggagagaattgtgaatggaaaagaagtagtggttatatcaaagattgaagaatccgatgttgtttcggatctttcatcaattggaaatgcagcagtctataccagtggtattgtagagacgcagaatctaaaacatgaagatgtttcggacgacgagatacaagtttctgaggtccaaccaacagattctcaagatgttgcttctgttcctgatgattcgctatccgaatcagagaaaattcaacaagagatcgcagcagttaccgtgcaggctgcgtatagaggatacttggcacgacgtgctttcaagatattaaaaggtataataaggctacaagcacttatccgtggtcacatggttagaaggcaagctgtttcgactctgtgctgtgttatgggaattgtcagattgcaagcacttgctcgtgggagagagatcagacattcagacattggagttgaagttcagaggaaatgtcatttgcatcatcagcctttagagaataaagccaactcggttgttgatacacattcttacttgggaatcaataagctaacaggaaatgcttttgctcagaagcttctagcttcatcgccaaacgtgctgcctttgtccctcgacaatgattcttccaattcaatctggttagagaactggtcagcatcttgcttctggaaaccagttcctcagccaaagaaagcatcactcagaaaatctcagaagaagtttgccagtaatcctcagatagtcgaggctgagtttgcgagaccaaagaagagtgttcgcaaagtcccttcttcaaatctcgacaattcctcggtggcacaaacatcatctgagcttgagaaacccaaacgcagcttccgcaaggtttcaacaagccaatctgtagaaccactaccgtctatggacaatcctcaagttgatctagagaaagtgaaacgtggcttgagaaaagtacataatcccgtagttgagaactctatccaacctcaactggttccacagattgcagttgaaaagccaaatggtagtttagaagaatctgtgaatgcctttgatgaagagaaagaagatgaagtggctgagacagtggtgcaacaacctgaagagttgatacaaactcatacaccattggggaccaatgaatctcttgattccacattggtcaaccaaatcgaagagagtgaagaaaatgtaatggccgaggaaaaggaggatgtaaaagaagagaggactcccaaacaaaaccataaggagaattcagctgggaaggagaatcagaaatccgggaaaaaggcttcttcggttactgctactcaaaccgccgagtttcaagagagtggtaatggtaatcagactagtagcccgggaataccgagctatatgcaggcgactaaatccgctaaagcaaagctgaggctacaaggctcttcttcacctaggcaattagggacaactgagaaagccagtagacgttactctctaccatcttcaggtaatagtgcaaaaatcacttctcattctcctaaaacaagagtctcaaactcgagtggcaaaagcgggaacaagacagagaaaactcttctttcgtcccgagaaggaaacggtaaggcaactccggtagagtggaagagatga

SEQ ID NO: 2466 - protein, 572 aa, Arabidopsis thaliana
MGKPARWLKSVLLGKKPSKSSGSKDKERIVNGKEVVVISKIEESDVVSDLSSIGNAAVYTSGIVETQNLKHEDVSDDEIQVSEVQPTDSQDVASVPDDSLSESEKIQQEIAAVTVQAAYRGYLARRAFKILKGIIRLQALIRGHMVRRQAVSTLCCVMGIVRLQALARGREIRHSDIGVEVQRKCHLHHQPLENKANSVVDTHSYLGINKLTGNAFAQKLLASSPNVLPLSLDNDSSNSIWLENWSASCFWKPVPQPKKASLRKSQKKFASNPQIVEAEFARPKKSVRKVPSSNLDNSSVAQTSSELEKPKRSFRKVSTSQSVEPLPSMDNPQVDLEKVKRGLRKVHNPVVENSIQPQLVPQIAVEKPNGSLEESVNAFDEEKEDEVAETVVQQPEELIQTHTPLGTNESLDSTLVNQIEESEENVMAEEKEDVKEERTPKQNHKENSAGKENQKSGKKASSVTATQTAEFQESGNGNQTSSPGIPSYMQATKSAKAKLRLQGSSSPRQLGTTEKASRRYSLPSSGNSAKITSHSPKTRVSNSSGKSGNKTEKTLLSSREGNGKATPVEWKR

SEQ ID NO: 2467 - DNA, 1140 bp, Arabidopsis thaliana
atggaatcagaattccagcaacatcacttccttctccacgatcatcaacaccagagaccaagaaactcaggattgattcgttaccaatcagcaccaagttcgtacttttcgagtttcggtgaatcaatcgaagagtttttagatcgacccacaagtcctgaaactgagcgaatcttatctggctttttacaaaccaccgacacaagcgacaacgttgatagtttccttcaccatacttttaacagtgatggaactgagaagaaacctccggaagttaaaacagaggacgaagatgctgaaattccggtgactgcgacggcgacggcgatggaggttgttgtttccggtgatggtgaaatctcagtgaatcctgaagtatcgattgggtatgtggcttcggtttcgaggaataagagaccaagagagaaagatgatcggactccggtgaataatctagctcgtcataatagttcaccggccggattattttcatccattgatgttgaaacagcttatgcagctgtaatgaaaagtatgggaggttttggaggaagtaatgtgatgagtacaagcaatactgaagcttcgtctcttactcctagaagcaagttacttcctcctacttctagagcgatgagtccgatctctgaggttgatgttaaacccggtttctcgtctagattgcctcctcggacgctttccggtgggtttaatcgttcttttgggaatgaagggtctgcttcttccaagcttacagctcttgctaggacccaatctggaggtctagatcaatacaaaaccaaggatgaggattcagcaagtagacgtcctcctttggcacatcacatgagtttgcccaagtctttatcagatattgaacagttactgtcagattctatcccatgtaagatcagagccaagcggggttgtgcaactcatcctcgaagcatagccgagagggtgagaagaaccaagatcagtgaaagaatgaggaagctgcaagaccttgttccaaacatggacacgcaaacaaacacagcagacatgttggatcttgcggttcaatacatcaaggacctgcaagaacaagtgaaggcgctcgaagagagtcgggcaagatgtagatgctctagtgcgtga

SEQ ID NO: 2468 - protein, 379 aa, Arabidopsis thaliana
MESEFQQHHFLLHDHQHQRPRNSGLIRYQSAPSSYFSSFGESIEEFLDRPTSPETERILSGFLQTTDTSDNVDSFLHHTFNSDGTEKKPPEVKTEDEDAEIPVTATATAMEVVVSGDGEISVNPEVSIGYVASVSRNKRPREKDDRTPVNNLARHNSSPAGLFSSIDVETAYAAVMKSMGGFGGSNVMSTSNTEASSLTPRSKLLPPTSRAMSPISEVDVKPGFSSRLPPRTLSGGFNRSFGNEGSASSKLTALARTQSGGLDQYKTKDEDSASRRPPLAHHMSLPKSLSDIEQLLSDSIPCKIRAKRGCATHPRSIAERVRRTKISERMRKLQDLVPNMDTQTNTADMLDLAVQYIKDLQEQVKALEESRARCRCSSA

SEQ ID NO: 2469 - DNA, 1638 bp, Arabidopsis thaliana
atgtttaaaccccaacatatgtatgacagggaatttggtaccggcaacggctacagcaacgggaacggctacaccaatggaaacggccacaccaacggaaacggcaattacaacggcaatggccacgttaatggtaacggaaaagctaacggagccaaggtggtaaagatgaaaccaatggacagtgagttgctgagagagcaaggtcacataatggttgattttattgctgattattacaaaaaccttcaagactcgcctcaagatttccctgttctgtcccaagttcagcctggttatctccgtgacatgttgcctgattcagcacctgaacgacctgaatcgttaaaagaacttctcgacgatgtttcgaagaagataatgccggggataactcattggcaaagcccgagttactttgcatactatgcatcaagcacgagtgtggctggattcttaggagagatgcttaacgccggcctgagcgtcgtcggttttacctggctcacttctcctgccgctactgagctcgaaatcatcgttcttgattggcttgctaaattgctacaactccccgaccattttctctccacaggaaatggaggaggagtaatccaagggacaggatgtgaagcagtgcttgtggtagtattagctgctagagacagaattctgaagaaagttggcaaaacattacttcctcaacttgttgtctatggctctgaccaaacccattctagtttccgaaaagcttgtctgattggtgggatacatgaagaaaacattaggctgctcaaaactgattcttccacaaactatggaatgcctccagaatcacttgaggaagctatttctcatgatctcgctaagggttttatccctttcttcatttgtgccactgttggcacaacgtcttcagcagcggttgatcctttggtcccattggggaacatcgcaaagaaatatgggatatggttgcatgtggatgcagcttatgcagggaatgcatgtatatgtccagaatatcgaaaatttattgacgggattgaaaacgcagactcctttaacatgaatgctcataaatggttatttgctaatcaaacttgttcacctctttgggttaaggatcgatactctctcattgatgctctcaaaacaaatcccgagtatctagaattcaaggtttccaaaaaagatacggtcgtaaattataaagattggcaaatttctctctctcggagattcagatcactgaagttatggatggttttacggctctatggttccgagaacttaagaaactttataagagaccatgtcaatctcgctaagcattttgaagattatgtagctcaagatccaagttttgaggttgtcactactcggtacttttcactcgtttgctttcgccttgcgccagttgacggcgatgaagaccaatgtaacgaacgtaaccgtgaactgcttgcggctgttaactccactggcaagatattcatctctcacacggctctatctggaaaattcgttttacgatttgctgttggtgcaccgttaacggaagagaagcatgtcactgaagcatggcagattatacagaaacatgcctccaaatttacacgcaacgaccattattaa

SEQ ID NO: 2470 - protein, 545 aa, Arabidopsis thaliana
MFKPQHMYDREFGTGNGYSNGNGYTNGNGHTNGNGNYNGNGHVNGNGKANGAKVVKMKPMDSELLREQGHIMVDFIADYYKNLQDSPQDFPVLSQVQPGYLRDMLPDSAPERPESLKELLDDVSKKIMPGITHWQSPSYFAYYASSTSVAGFLGEMLNAGLSVVGFTWLTSPAATELEIIVLDWLAKLLQLPDHFLSTGNGGGVIQGTGCEAVLVVVLAARDRILKKVGKTLLPQLVVYGSDQTHSSFRKACLIGGIHEENIRLLKTDSSTNYGMPPESLEEAISHDLAKGFIPFFICATVGTTSSAAVDPLVPLGNIAKKYGIWLHVDAAYAGNACICPEYRKFIDGIENADSFNMNAHKWLFANQTCSPLWVKDRYSLIDALKTNPEYLEFKVSKKDTVVNYKDWQISLSRRFRSLKLWMVLRLYGSENLRNFIRDHVNLAKHFEDYVAQDPSFEVVTTRYFSLVCFRLAPVDGDEDQCNERNRELLAAVNSTGKIFISHTALSGKFVLRFAVGAPLTEEKHVTEAWQIIQKHASKFTRNDHY

SEQ ID NO: 2471 - DNA, 555 bp, Arabidopsis thaliana
atggcgaaatctccggtggaagtgaatttgattcctatcgaagctactccggagaacttcgcagagtatggtcaagtcattgaagcctctcgtgatggtgctggtttcggtccccacgacgctcaactagatctctctagaggaaccccacggctgaaagaaacacccttagggtttttcaagatcacacatcacgcaaaggtgacacagtgtctaggatcaataggaggtgatgtttggtatatgggagtggctaagccgtctcttattgaagatgatgacgatgatggaaggagcgtagatacagtaaaatcaaagtctggtcacttatacattccacctgaggtggaagagattcgcgtcttcaggttctcgggaccaaagtttgtgaaactgcaccgtggtacatggcatgctggacccttgtttagtggcagctccttcatggatttctacaacttagagctcagcaacacaaatgtggtggatcacacgtcacatgatttcaccaagaataatggagtcagcttcggatttgacacattgtcttcctag

SEQ ID NO: 2472 - protein, 184 aa, Arabidopsis thaliana
MAKSPVEVNLIPIEATPENFAEYGQVIEASRDGAGFGPHDAQLDLSRGTPRLKETPLGFFKITHHAKVTQCLGSIGGDVWYMGVAKPSLIEDDDDDGRSVDTVKSKSGHLYIPPEVEEIRVFRFSGPKFVKLHRGTWHAGPLFSGSSFMDFYNLELSNTNVVDHTSHDFTKNNGVSFGFDTLSS

SEQ ID NO: 2473 - DNA, 855 bp, Arabidopsis thaliana
atggggaagataatggaatgggcagcaagatctgatcatttgggaggaattccaaggaatactgtgataatggctgttagtgcatttgcaaaagcagtagcaaatctttgcaataaaagctcagttcacaatgcagatactcttatgaatcttgtccagtcaagaccacctggtgttcctctcatcactgttagtaatcacatgtcgactttggatgatccagtaatgtggggggcatttaagggtctcctttccttagatccagaattggctcggtgggttcttgctgcagaggatatatgtttcaggaaccctatattctcctacattttccgcactggaaaatgtatacctataactagaggtggtggaatctaccaagaaaacatgaatgaagctctccagcgattaaaagatggatcttggctgcataccttcccagagggaaaggtgtttcaagatgatgttcctataagacgacttaaatggggaactgcaagcctcatcgcccgttccccagttaccccaatcgttttgccaataattcaccgtggttttgaggagatgatgccggagaactacaataatggacgaagaccactggtaccgttgccgaacaaacaccttaaagttgtggttggtgaaccaattgagtttgatgttccaatgatggttgagactgctgtcttggactcccgccatgtaacccctcctcttcaagaagtgaaatggcctgtcctcacttctgctggccaagtgctagacgaaactgctcagagacacctctacatagctctgtccgagaagattcaatcctccttggaaacattgagactcttagccaagcggttgtga

SEQ ID NO: 2474 - protein, 284 aa, Arabidopsis thaliana
MGKIMEWAARSDHLGGIPRNTVIMAVSAFAKAVANLCNKSSVHNADTLMNLVQSRPPGVPLITVSNHMSTLDDPVMWGAFKGLLSLDPELARWVLAAEDICFRNPIFSYIFRTGKCIPITRGGGIYQENMNEALQRLKDGSWLHTFPEGKVFQDDVPIRRLKWGTASLIARSPVTPIVLPIIHRGFEEMMPENYNNGRRPLVPLPNKHLKVVVGEPIEFDVPMMVETAVLDSRHVTPPLQEVKWPVLTSAGQVLDETAQRHLYIALSEKIQSSLETLRLLAKRL

SEQ ID NO: 2475 - DNA, 711 bp, Arabidopsis thaliana
atggcgggaagagcgattttctctgtatcttgttcatctactccttccttgtgtatcccttattcaactgcttcgttttcatcgatgaatcgactggcgctccccgccgtccggatttctccccgaaccaacagatttcccaggattcactgctctatgtctgctaacgacatcaaagcgggaaccaatatcgaagtcgatggtgctccttggcgtgttcttgagtttcttcatgttaaaccaggaaaaggtgcggcatttgtgagaactaagatcaggaactatgtgaatggtagcacagtcgagagaacatttcgtgctggaatttctgttgaggaagctaatatatataaagaaaccaaacaattcacatacaaagatgggtctcagtttgttttcatggatttgaccacatacgaagaaacacgtcttaacgaatctgatatgggtgagaagacgaaatggttgaaagaaggaatggattgcattttgctctattggaaagacaaggttatcgatttcgatctaccgattacagttaagctaaaagtggttgacgttgatcctggccttcgcggtgatactgtgcaaggtggatcaaaaccggcgacaatggaaacgggtgcaatagttgctgtaccactctttattaacgtcggtgaagagatatttgtggacacaagaactggtgcatacatgaaccgagcgtga

SEQ ID NO: 2476 - protein, 236 aa, Arabidopsis thaliana
MAGRAIFSVSCSSTPSLCIPYSTASFSSMNRLALPAVRISPRTNRFPRIHCSMSANDIKAGTNIEVDGAPWRVLEFLHVKPGKGAAFVRTKIRNYVNGSTVERTFRAGISVEEANIYKETKQFTYKDGSQFVFMDLTTYEETRLNESDMGEKTKWLKEGMDCILLYWKDKVIDFDLPITVKLKVVDVDPGLRGDTVQGGSKPATMETGAIVAVPLFINVGEEIFVDTRTGAYMNRA

SEQ ID NO: 2477 - DNA, 735 bp, Arabidopsis thaliana
atggcgacgactagtttagtgaccggactaaaagtggtattaccggttatgttctgtctgatgctagcgactcttgtctacaccatcatcaccgatggccttcctttacctgatcgtcaagatgtcttcacaccatggttcgttacgacaattttggatttctacattaatcttgtacctatagcggtttggattgtgtataaggagtctacatggtctggttcaatactttggaccattttgctcatcatttttggcagcctcacgacatgtgtgtatctgtttctgcaacttctcaagctgacaaatcaagaagcttcagaagatcctatgtactatttgttacttcgagattcaatcaaggatggagttggtctgagagacaagaattcacttgttgtcactgcaagatttgtgtttggtgccttaggatgtgtgatgctaggagctttggtttacacttgcttcacttatggttctcctttccacatggagcttctatacccgtggatggtggttttattggttaacttctacattgatgttgctgtcttatcagtttgggttgtctataaagaatctagtttgatcattggaattctatgggttgctctattgataggtcttggcagcgttggcacgagcgcagtcattgtcgtgcagctattccgtctgtctcctctcgacccgctctacctcgttctagtgaacaacagcaatcggaagcaaagttaa

SEQ ID NO: 2478 - protein, 244 aa, Arabidopsis thaliana
MATTSLVTGLKVVLPVMFCLMLATLVYTIITDGLPLPDRQDVFTPWFVTTILDFYINLVPIAVWIVYKESTWSGSILWTILLIIFGSLTTCVYLFLQLLKLTNQEASEDPMYYLLLRDSIKDGVGLRDKNSLVVTARFVFGALGCVMLGALVYTCFTYGSPFHMELLYPWMVVLLVNFYIDVAVLSVWVVYKESSLIIGILWVALLIGLGSVGTSAVIVVQLFRLSPLDPLYLVLVNNSNRKQS

SEQ ID NO: 2479 - DNA, 210 bp, Arabidopsis thaliana
atggtggagaagtcaggaggagaagtcaatttcccaaaattggagaaaccaacaggcaagaaacagacagcgacggttgttgtgggagtgttggcggtgggatggctggcgatagagctcgtgtttaagccattgttcaagaagctgagctcctccaaggacaaatccgattccgacgatgccaccgtccctcccccgtcgggcgcctga

SEQ ID NO: 2480 - protein, 69 aa, Arabidopsis thaliana
MVEKSGGEVNFPKLEKPTGKKQTATVVVGVLAVGWLAIELVFKPLFKKLSSSKDKSDSDDATVPPPSGA

SEQ ID NO: 2481 - DNA, 657 bp, Arabidopsis thaliana
atggcggcaaaatcctacctcgttatcccgacggtaaactccgttacaacggtggtcacactcgcgtcctcgccgttcctcgctccgtctcattttccggttagtttcacgctctcgatctcattgtcaattttgaatttcacaaaaaaaaaaacgaaatcggttttgtggaaagagaaattaaggccacacgtgtggtgcgttttaacagagttagcgtcgaagatggcggagatgtgcggcggcgtcggcggatctataaccgtaacgatccgatgtcagcttccgacggaagatctcgacgcgctcgtttcaattacttccgatgaagatctagtgaatctaatcgaagagtacgatctcgtttcctcttcatctccgatgaaaatcagagtcttcttaaatccaccaaaatccgccgccggatctaaaaaatctcctcctccgttagcgttaccgtcatcaaccaccacgtcatcatcttccacaacttcctctacttcatcaagtcctagatctccgtctctatcaaaaccaccgctacctccgtctccaccgagaataacgacggttacgaagaatccgtgttatggttgttatgttcaccgtaattccagaaatatctaccttgttcacaacggcaatcactggcaataa

SEQ ID NO: 2482 - protein, 218 aa, Arabidopsis thaliana
MAAKSYLVIPTVNSVTTVVTLASSPFLAPSHFPVSFTLSISLSILNFTKKKTKSVLWKEKLRPHVWCVLTELASKMAEMCGGVGGSITVTIRCQLPTEDLDALVSITSDEDLVNLIEEYDLVSSSSPMKIRVFLNPPKSAAGSKKSPPPLALPSSTTTSSSSTTSSTSSSPRSPSLSKPPLPPSPPRITTVTKNPCYGCYVHRNSRNIYLVHNGNHWQ

SEQ ID NO: 2483 - DNA, 1098 bp, Arabidopsis thaliana
atggctttaacattgtcaaccacaaagaccttcactaacataaactgctcaaacaatacttccaacataaccacctttaagcctctcaagcttcctcttttctggccatggcaaaaggtcaaaatgggtcctttaagtgtttctcctatgggttttgggacatgggcttggggtaatcagcttctttggggttatcagacttccatggatgatcagcttcaacaagcttttgaattggctttggaaaatggaatcaatttgtttgatactgctgattcttatggcactggtaggcttaatggccaaagtgagagacttttggggaaattcattaaagaatctcaaggacttaaagggaaacaaaatgaagtagtggtagctacaaagtttgcagcttatccatggaggttaacttcaggacagtttgtgaatgcctgcagagcttctttagaccggcttcagatagaccagctcgggattggacagcttcactggtcaactgcaagctacgcgcctctacaagagcttgttctttgggatggtctagtgcaaatgtacgaaaagggtttagttagagccgttggagttagtaactatggacctcaacagcttgtgaagattcatgattaccttaaaactcgaggggttcctttatgttctgcccaagtgcaattctcattgctaagcatgggaaaagagcaactagagatcaagagtatatgcgacgagctcgggattcgtttaatctcttatagtcctcttgggctaggaatgctaactgggaaatactcctcttcaaaacttcccactggtccacgatcattgctgttccgacaaattcttcctggattagaacctcttcttttagcactgagcgagattgcaaagaaacgaggaaagactatgcctcaggttgcaataaactggtgcatatgcaaagggacagtaccgataccgggaatcaagtcggtaagacatgttgaagataatttgggtgctctgggatggaaacttacaaatgatgaacagcttcagttagaatatgcagctaaagaatcaccaaagtcaatgattcagaatatttttcagacaagatga

SEQ ID NO: 2484 - protein, 365 aa, Arabidopsis thaliana
MALTLSTTKTFTNINCSNNTSNITTFKPLKLPLFWPWQKVKMGPLSVSPMGFGTWAWGNQLLWGYQTSMDDQLQQAFELALENGINLFDTADSYGTGRLNGQSERLLGKFIKESQGLKGKQNEVVVATKFAAYPWRLTSGQFVNACRASLDRLQIDQLGIGQLHWSTASYAPLQELVLWDGLVQMYEKGLVRAVGVSNYGPQQLVKIHDYLKTRGVPLCSAQVQFSLLSMGKEQLEIKSICDELGIRLISYSPLGLGMLTGKYSSSKLPTGPRSLLFRQILPGLEPLLLALSEIAKKRGKTMPQVAINWCICKGTVPIPGIKSVRHVEDNLGALGWKLTNDEQLQLEYAAKESPKSMIQNIFQTR

SEQ ID NO: 2485 - DNA, 498 bp, Arabidopsis thaliana
atggcactaagaatgtgggcttcttctacagcaaacgctctcaagctttcttcttctgtttccaagtctcatctctctcctttctccttctctagatgcttctccacagttttggagggtttgaagtatgcaaattcacatgagtgggttaaacatgaaggctctgttgccaccattggcatcactgcccatgctcaggaccatttaggtgaagtggtgtttgttgaactgccagaggacaatacttcagtgagcaaagagaaaagctttggagcagtggagagtgtgaaggcaacaagtgagatcttatcaccaatctcaggtgaaatcattgaggttaacaagaagctcacagaatcacctggcttgatcaactcaagcccctatgaagatggttggatgatcaaagtgaaaccaagtagccccgcggagttggaatctttgatgggtccaaaggaatacaccaagttctgcgaggaggaagatgctgctcactag

SEQ ID NO: 2486 - protein, 165 aa, Arabidopsis thaliana
MALRMWASSTANALKLSSSVSKSHLSPFSFSRCFSTVLEGLKYANSHEWVKHEGSVATIGITAHAQDHLGEVVFVELPEDNTSVSKEKSFGAVESVKATSEILSPISGEIIEVNKKLTESPGLINSSPYEDGWMIKVKPSSPAELESLMGPKEYTKFCEEEDAAH

SEQ ID NO: 2487 - DNA, 357 bp, Arabidopsis thaliana
atggccgcagaaggagaagttatcgcttgccacaccgttgaagattggaccgagaagctcaaagccgccaacgaatccaagaaactgattgtgatagacttcactgcaacatggtgcccaccttgccgtttcattgcacccgtctttgctgacttagccaagaagcacctcgacgtagtcttcttcaaggtcgatgttgacgaattgaacactgttgctgaggagtttaaagttcaggcaatgccaacgtttatcttcatgaaagaaggagagatcaaggagactgtggttggtgctgctaaagaagaaatcattgccaatctcgagaagcacaagacagttgttgctgctgcttga

SEQ ID NO: 2488 - protein, 118 aa, Arabidopsis thaliana
MAAEGEVIACHTVEDWTEKLKAANESKKLIVIDFTATWCPPCRFIAPVFADLAKKHLDVVFFKVDVDELNTVAEEFKVQAMPTFIFMKEGEIKETVVGAAKEEIIANLEKHKTVVAAA

SEQ ID NO: 2489 - DNA, 1056 bp, Arabidopsis thaliana
atggctacatcaggacgctcccacggctctaccacggcggctttagcctttacactcgccgtagtatctgtatccgctgccttctcgctgtatagatggcgaagacgagaagaagatttggagaataggatcaaggaatttgagaagtctttgggatctaccttggaaaaaagtgcttctgagagaaaaggtcgagtcaaagctcagcaggctttacgggaggcgttagcacagactgagtcacatgatttacacagcacaatatacccgatgcgacctattggcactatccagtcttgcttctctactaggaacgggacaccgaggcagccattgcttgtttctcttgcgagggcatgtttgatctttgatccggctttggttcctcctgcgtctcttgagggtcttgaagagtattctcattgctggatactctatgtgtttcatctcaatactgatatcgagaagctatggagaaaaccatctcagtcgaagctcaaggcaaaggtgagagtgccacggctaaatggggaacggaagggagtctttgctacgcggtcccctcatcgaccttgtcccattggcctcaccgttgctaaggtggaggaaatccaaaaggataaggttctcctctctggtgtcgatctggtggatgggactccggtgctcgacatcaaaccatatttaccatactcggacagtattcaaggagcctcagtgccaaactgggtaaaggaggactgctcattggctgtggcttctgtgactttctcagataccttctcttcatccatcaccagctgctggaaactgatagaaaagaagtctctatatagttcagcagatgagtttaggagcttgatcacgcaggtcctgtcatgggacatacgatcaatgtcgcaacggaacaagccacaagatacattggatgaggaaattgtttatcacttggttctggagggactagacgtgtcttacatgatagataatgaaagtaatattctcgttcaggatgtttctcttcccaaaaacctgcaagatgttgcaggaagctga

SEQ ID NO: 2490 - protein, 351 aa, Arabidopsis thaliana
MATSGRSHGSTTAALAFTLAVVSVSAAFSLYRWRRREEDLENRIKEFEKSLGSTLEKSASERKGRVKAQQALREALAQTESHDLHSTIYPMRPIGTIQSCFSTRNGTPRQPLLVSLARACLIFDPALVPPASLEGLEEYSHCWILYVFHLNTDIEKLWRKPSQSKLKAKVRVPRLNGERKGVFATRSPHRPCPIGLTVAKVEEIQKDKVLLSGVDLVDGTPVLDIKPYLPYSDSIQGASVPNWVKEDCSLAVASVTFSDTFSSSITSCWKLIEKKSLYSSADEFRSLITQVLSWDIRSMSQRNKPQDTLDEEIVYHLVLEGLDVSYMIDNESNILVQDVSLPKNLQDVAGS

SEQ ID NO: 2491 - DNA, 1539 bp, Arabidopsis thaliana
atgaacggatgtgaggctgaccacaaagcaccacttggcacggtagaaacaaggactctatcaacggtgccatctccggcagccgcgacggagaggctgataaccgccgtctctgacctcaaatctcaaccgcctccattctcctccggcattgtccgattacaggtaccaattgagcagaaaattggagcaatcgattggcttcatgcacagaacgaaattcttcctcgcagtttcttttcccgtcgtagcgattctggccgtccagatcttcttcaagacttctcaagtgacaatggatcatctgatcataatccagttagtgtcgctggaatcgggtctgctgtctttttccgcgatctcgacccgttttctcatgatgactggagatcaatccgaaggttcttgtcttcaaagtctcctctgattcgtgcctatggaggtcttcgatttgatcctacagggaagatcgctgtggaatgggaacattttggctcgttttactttacagtgccccaggtcgagtttgatgagtttggaggaagctcaatgctggctgcaactgttgcttgggacaatgagctctcatggacgcttgaaaatgctattgaagcacttcaggaaactatgcttcaggtttcttctgttataatgagattacggcgagaatctttaggagttattgttgttagcaagaaccatgttccaagtgaaggagcctattaccctgctgtgaataatgctctagagattatcaaggacaaacattcacccctaagcaaggttgtgcttgcacgcagtagcagaatcattacggataccgacattgatcctatcgcttggttagcacggttgcagtgtgaaggacaagacgcgtaccaattctgtcttcaaccacccggtgcaccagcattcatagggaacacgcctgagagactcttccacagaaaacatctaggtgtctgcagtgaggctttggctgcaacaaggcctagaggtgattcaaaggttcgtgaaatggagatagagcgcgacttactaaccagtcccaaagacgatcttgagttttctattgtccgagagaatataagagaaaaacttaaaaccatatgtgacagggtagtagttaaaccccataaatcagtgagaaagcttgcaagagtacagcatctatattctcaattggcaggacagctaaaaagagaagatgatgagtttaacatcttaactgctttgcatccgacgccagctgtttgcggatgtccagtagaagaagctaggcttttgattaaacaaattgagtcatttgatagaggaatgtatgctggacctattgggttctttggtggtggggagagtgaattttctgtaggcatacgatctgctttagtcgaaaagggtcttggagcattgatctatgcaggaacaggaatcgtttcaggaagcaatccttcctcggagtggaacgagcttgagcttaagatctctcagttcactaagtcacttgaacatgagtcagctttgcaaccaatcaactaa

SEQ ID NO: 2492 - protein, 512 aa, Arabidopsis thaliana
MNGCEADHKAPLGTVETRTLSTVPSPAAATERLITAVSDLKSQPPPFSSGIVRLQVPIEQKIGAIDWLHAQNEILPRSFFSRRSDSGRPDLLQDFSSDNGSSDHNPVSVAGIGSAVFFRDLDPFSHDDWRSIRRFLSSKSPLIRAYGGLRFDPTGKIAVEWEHFGSFYFTVPQVEFDEFGGSSMLAATVAWDNELSWTLENAIEALQETMLQVSSVIMRLRRESLGVIVVSKNHVPSEGAYYPAVNNALEIIKDKHSPLSKVVLARSSRIITDTDIDPIAWLARLQCEGQDAYQFCLQPPGAPAFIGNTPERLFHRKHLGVCSEALAATRPRGDSKVREMEIERDLLTSPKDDLEFSIVRENIREKLKTICDRVVVKPHKSVRKLARVQHLYSQLAGQLKREDDEFNILTALHPTPAVCGCPVEEARLLIKQIESFDRGMYAGPIGFFGGGESEFSVGIRSALVEKGLGALIYAGTGIVSGSNPSSEWNELELKISQFTKSLEHESALQPIN

SEQ ID NO: 2493 - DNA, 798 bp, Arabidopsis thaliana
atgaaaatcctctcactttcacttctcttgctcttggccgctacggtctcggcatccgttccagggctcatcgaactcgtcgattcgaaaaccatctttgggaacgtagccgaactcttagagaaagagaaactttccatcaactacgccaactgcagaagctggcaccttggtgttgagacctctaacatcatagacttcgacacggtgcccgcaaattgcaaagactatgttgaagactacttgatcacttccaaacagtaccaatacgactccaaaaccgtgtgcaaagaggcttatttctatgccaaaggacttgccctaaagaacgacaccgtcaatgtttggatctttgacctagatgataccctcctctctagtattccctactacgcaaaatatggatacggaacagagaagaccgacccgggggcgtactggttgtggttagggaccggagcatcaacccctggactcccggaggccttgcatctttaccaaaacatcatagagctcgggattgaacccatcatactcagtgaccgttggaagttgtggaagaatgtcactctcgacaatctcgaagctgctggcgtgacctactggaagcatctcatattgaagcctaatggttcgaacttgaggcaagtggtgtacaagtcaaaggtgaggaagagtctcgtgaagaaaggatacaacatcgttggcaatatcggagatcaatgggctgatttggttgaggatacccctgggagggtttttaagctcccaaatccactctactacgtaccttcttaa

SEQ ID NO: 2494 - protein, 265 aa, Arabidopsis thaliana
MKILSLSLLLLLAATVSASVPGLIELVDSKTIFGNVAELLEKEKLSINYANCRSWHLGVETSNIIDFDTVPANCKDYVEDYLITSKQYQYDSKTVCKEAYFYAKGLALKNDTVNVWIFDLDDTLLSSIPYYAKYGYGTEKTDPGAYWLWLGTGASTPGLPEALHLYQNIIELGIEPIILSDRWKLWKNVTLDNLEAAGVTYWKHLILKPNGSNLRQVVYKSKVRKSLVKKGYNIVGNIGDQWADLVEDTPGRVFKLPNPLYYVPS

SEQ ID NO: 2495 - DNA, 678 bp, Arabidopsis thaliana
atggcgatgagctttcatcgtcttcctcaggcattgcatatgatacccagaaaccctacgcaatcatcgaagaatttagggttttcttcgtttctatcgtgtgcaccatcgatggattctcgtatatcagtttctaggctttctctgaatcatcccggctcgaaatttgggttctcactcgatactagggtgagaaatgagtttatcgttagagcagaagaaggtaacacagaagctgaatctgaagaatttgttgctgaaatcgctgatacggaaggaaatgtagaggaagtggtcgaagctaaacctacaagaaaacctaggatcaagctcggagatgtcatggggatactgaaccagaaagcaattgaggtagcagagaaagtgagacctgttccagaaatcaggacaggagatattgtagaaatcaaattggaagttcctgagaacaaacgtaggctatctatctacaaaggcatagtgatgtcgagacaaaatgcaggcatacacactaccattcgtattcggagaattattgcgggtatcggtgttgaaattgtgtttcccatatactctcccaacatcaaagagataaaagtggtgagtcacaggaaagtaagaagagcaaggctttactatctgagggacaagcttcctcgtctgtccactttcaagtga

SEQ ID NO: 2496 - protein, 225 aa, Arabidopsis thaliana
MAMSFHRLPQALHMIPRNPTQSSKNLGFSSFLSCAPSMDSRISVSRLSLNHPGSKFGFSLDTRVRNEFIVRAEEGNTEAESEEFVAEIADTEGNVEEVVEAKPTRKPRIKLGDVMGILNQKAIEVAEKVRPVPEIRTGDIVEIKLEVPENKRRLSIYKGIVMSRQNAGIHTTIRIRRIIAGIGVEIVFPIYSPNIKEIKVVSHRKVRRARLYYLRDKLPRLSTFK

SEQ ID NO: 2497 - DNA, 849 bp, Arabidopsis thaliana
atggcggagaaaaatgcgagcgcggtggacggtgcaattagggttagtggaatgcagttttcttacgatgttcaagatcctattttcttcgattttaatctcgatcttcccgctggatctcgttgcctcttggttggtgccaatggatctgggaaaactacgttattgaagattcttgctggaaaacatatggttggaggaaagaatgttgtacaagtgcttgatcgctcagcatttcatgatacagagcttgtttgtagtggtgatttgtcttacctaggaggatcatggagtaaaactgctggttctgctggtgatattccactccaaggagacttctcagcagaacatatgatatttggagttgaagggattgatcctttcagaagagagaagttgattgatcttcttgatatcaatcttcaatggcgtatgcataaggtttctgatgggcagagacgtcgagtgcaaatatgtatgggtctattacatccgttcaaggtattactactggatgaagttactgttgacctcgacgttgttgctaggatggatttgttggagttctttaaagaagaatgtgaacagagaggagctacaattgtatatgcaactcatattttcgacgggctcgagacatgggctagtcatttggcttacattaatggaggagagctgaaactctcggccaagttagatgagatcaaggatctcaaaacctcaccaaatctgctatctgttgttgaagcttggctccggtctgaaaccaaagttgagaaaaagacgaagaagaaacctgttgttacctctccatttatgtcgtctagacaaatggcatattaccgatga

SEQ ID NO: 2498 - protein, 282 aa, Arabidopsis thaliana
MAEKNASAVDGAIRVSGMQFSYDVQDPIFFDFNLDLPAGSRCLLVGANGSGKTTLLKILAGKHMVGGKNVVQVLDRSAFHDTELVCSGDLSYLGGSWSKTAGSAGDIPLQGDFSAEHMIFGVEGIDPFRREKLIDLLDINLQWRMHKVSDGQRRRVQICMGLLHPFKVLLLDEVTVDLDVVARMDLLEFFKEECEQRGATIVYATHIFDGLETWASHLAYINGGELKLSAKLDEIKDLKTSPNLLSVVEAWLRSETKVEKKTKKKPVVTSPFMSSRQMAYYR

SEQ ID NO: 2499 - DNA, 483 bp, Arabidopsis thaliana
atggccacaagcgcatcagctttgctctcaccaaccacattctccactgcaatctcccacaaaaaccctaactccatctcattccatggccttcgtcccctccgtctaggtggctcctcctccgccctacccaaactatcaaccaccgggagaaaatcctcctccgctgtcgtgagagctgagctaagcccttccatcgtcataagtctcagcacaggtctctccctcttcctcggccgtttcgtcttcttcaacttccagagagagaacgtagcaaaacagggcttaccggagcagaacggaaaaacccatttcgaagctggagatgatcgtgctaaggagtacgtcagtctcttgaaatcgaacgatccaattggattcaacattgttgatgttcttgcttggggttctattggacacatcgttgcttactacatcttggctacttccagcaatggatacgacccaagcttctttggatga

SEQ ID NO: 2500 - protein, 160 aa, Arabidopsis thaliana
MATSASALLSPTTFSTAISHKNPNSISFHGLRPLRLGGSSSALPKLSTTGRKSSSAVVRAELSPSIVISLSTGLSLFLGRFVFFNFQRENVAKQGLPEQNGKTHFEAGDDRAKEYVSLLKSNDPIGFNIVDVLAWGSIGHIVAYYILATSSNGYDPSFFG

SEQ ID NO: 2501 - DNA, 750 bp, Arabidopsis thaliana
atggctaaaacctctcttcctctcgccgcctccttcctcctcctcatctccttctcctccgccgtagacacttcccgtctcttcctcaccgtcgtcaacaactgtcccttcactgtctggccagccattcaacccaacgccggccaccccgtcctagagaaaggtggcttcgctctcccaactttcactcaccgctccttcaacgttccaaccacacactggtccggtcgcatctgggccagaacctggtgtgcccactacaacggaaaattctcctgcctcaccggagactgcggaaaccgcctggaatgcaacggtctcggcggggcaccaccagcttctctagctcagttcgacctccaccacggtggtcaccacgacttctcctcttacggtgtctctctcgttgacggttacaatgttccgatgaccgtgactcctcacgaaggccatggtgtctgtcctgtcgttggttgtcgtgaagatctaataaaaacgtgtccggctcatcttcaggtccggtcacacagtggacacgtggtggcttgtaagagtgggtgtgaggctttccatacagacgagctgtgttgtcgtggtcattacaatagccctaacacgtgtaaagcttcgagccattcgctgttctttaagcatgcgtgtccttcgagtttcacttttgctcatgatagtccttcgcttatgcatgactgtgcttctcctagagagctcaaagtcatcttctgccactaa

SEQ ID NO: 2502 - protein, 249 aa, Arabidopsis thaliana
MAKTSLPLAASFLLLISFSSAVDTSRLFLTVVNNCPFTVWPAIQPNAGHPVLEKGGFALPTFTHRSFNVPTTHWSGRIWARTWCAHYNGKFSCLTGDCGNRLECNGLGGAPPASLAQFDLHHGGHHDFSSYGVSLVDGYNVPMTVTPHEGHGVCPVVGCREDLIKTCPAHLQVRSHSGHVVACKSGCEAFHTDELCCRGHYNSPNTCKASSHSLFFKHACPSSFTFAHDSPSLMHDCASPRELKVIFCH

SEQ ID NO: 2503 - DNA, 990 bp, Arabidopsis thaliana
atggagaatcacacgaccatgaaagtttcatctcttaattgtatcgatctagccaacgacgatcttaatcattctgttgtttccctcaaacaggcatgtttggattgtggatttttctatgtgatcaatcatgggataagcgaagagttcatggacgatgttttcgagcagagcaagaagctttttgctcttcctttagaagaaaagatgaaagtgttgagaaacgaaaagcatcgaggctatacacctgttcttgatgaacttttagatcccaagaatcaaatcaatggggatcacaaagagggttattacattggaattgaagttcctaaagatgatcctcattgggataagccattctatggtcctaacccttggcctgatgctgatgttttacctggttggcgagaaacaatggagaaatatcatcaagaagcattgagggtttctatggctattgcaagacttttggcgttagcacttgacttggatgtgggatactttgataggacggagatgcttggaaaacctattgcaactatgcgactgttgcggtatcaagggatttctgatccttcgaaaggaatatatgcatgtggagcacattctgacttcggaatgatgactctgttagccactgatggtgtaatgggactccagatatgcaaagataagaacgcgatgccgcagaagtgggaatatgtaccgccgattaaaggagcatttatagtgaatcttggcgatatgctggaacgttggagcaatggcttttttaaatccacgttgcatcgggttcttggaaacggtcaggaacgatattctattccattctttgtggaaccaaatcatgactgtctcgtggagtgtctcccaacctgcaagtcggaaagcgagcttcctaaatatccaccgatcaaatgttcgacatacctcacccagcgttacgaggaaacacatgcgaatttaagcatctaccaccaacaaacatga

SEQ ID NO: 2504 - protein, 329 aa, Arabidopsis thaliana
MENHTTMKVSSLNCIDLANDDLNHSVVSLKQACLDCGFFYVINHGISEEFMDDVFEQSKKLFALPLEEKMKVLRNEKHRGYTPVLDELLDPKNQINGDHKEGYYIGIEVPKDDPHWDKPFYGPNPWPDADVLPGWRETMEKYHQEALRVSMAIARLLALALDLDVGYFDRTEMLGKPIATMRLLRYQGISDPSKGIYACGAHSDFGMMTLLATDGVMGLQICKDKNAMPQKWEYVPPIKGAFIVNLGDMLERWSNGFFKSTLHRVLGNGQERYSIPFFVEPNHDCLVECLPTCKSESELPKYPPIKCSTYLTQRYEETHANLSIYHQQT

SEQ ID NO: 2505 - DNA, 714 bp, Arabidopsis thaliana
atggagactaagttctgttactacaacaactacaacgtaaaccaacctcgccatttttgtaaagcttgtcagagatattggacctcaggtgggaccatgagaagtgttccaatcggagcaggacggcgcaagaacaagaacaactcaccaacttcacattaccaccatgtgactatctccgaaacaaatggtccggtccttagtttcagcctcggagatgatcaaaaggtctcgagtaataggtttggtaatcaaaagctagttgctaggatagagaacaatgacgagcgctctaataacaacacttcgaacggtttgaattgttttccgggagtttcgtggccgtacacgtggaatcctgcgttttacccggtttacccttattggagcatgccagtgttgtcttctccggtaagttcaagtcctacttctactcttggtaagcattcgagagacgaagacgagacggtgaagcaaaaacagaggaatggatctgtattggttccaaagactttgagaattgatgatcctaatgaagctgcaaagagttcgatatggacaacacttgggatcaagaacgaagttatgttcaatgggtttggttcgaagaaagaggttaagctcagtaacaaagaagaaacagagacctcacttgttctttgtgcaaaccctgctgcgttatcaagatcaatcaatttccatgagcagatgtga

SEQ ID NO: 2506 - protein, 237 aa, Arabidopsis thaliana
METKFCYYNNYNVNQPRHFCKACQRYWTSGGTMRSVPIGAGRRKNKNNSPTSHYHHVTISETNGPVLSFSLGDDQKVSSNRFGNQKLVARIENNDERSNNNTSNGLNCFPGVSWPYTWNPAFYPVYPYWSMPVLSSPVSSSPTSTLGKHSRDEDETVKQKQRNGSVLVPKTLRIDDPNEAAKSSIWTTLGIKNEVMFNGFGSKKEVKLSNKEETETSLVLCANPAALSRSINFHEQM

SEQ ID NO: 2507 - DNA, 462 bp, Arabidopsis thaliana
atgaacacttccccaaaaatggaaatggaaatgaaaatggaaacgaaggcggctcctgaagctggtatgatcaaaaagtccaacgaggagtggcgtacggttctatctcctgaacagtttaagattcttagagagaaatctattgaaaagagagggtcaggagaatatgtgaagttgttcgaggaaggaatctactgttgtgttggttgtggaaatccggtttataaatcaaccactaaattcgattccggttgcggttggccggctttttttgatgctattcctggcgccattaaccgaaccgaggagagagctggattaagatatgagataacttgcacaaaatgtgatggacatctaggtcatgtcttaaaaaatgaaggttttccaacaccaactgacgaacgccattgcgtcaacagcgttgctctcaagttctcttccgctatcacatctcagtga

SEQ ID NO: 2508 - protein, 153 aa, Arabidopsis thaliana
MNTSPKMEMEMKMETKAAPEAGMIKKSNEEWRTVLSPEQFKILREKSIEKRGSGEYVKLFEEGIYCCVGCGNPVYKSTTKFDSGCGWPAFFDAIPGAINRTEERAGLRYEITCTKCDGHLGHVLKNEGFPTPTDERHCVNSVALKFSSAITSQ

SEQ ID NO: 2509 - DNA, 882 bp, Arabidopsis thaliana
atggtggtgtcactcttctcttccagaaatgttttctatacgttaagcttatgcttatttgcagcattataccagccggttatgagtagaccggctaagtttgaagatgactttaggatcgcatggtccgatactcatatcactcaaattgacggaggcagagccattcagctcaaattggaccctagctcaggatgtggatttgcttcgaagaagcaatacttgttcggccgtgtgagcatgaaaatcaaactgatccccggtgattctgccgggactgtcactgccttctacatgaattcagataccgattcggtacgagacgagcttgattttgagttcttaggaaatcgaagtggacaaccttacacagtgcaaaccaatgtgtttgctcatggtaaaggcgatagagagcaaagagttaacctttggttcgacccttctcgtgatttccacgaatatgccatctcatggaaccatctccgtattgtcttctacgtagacaatgtgcccatcagggtttacaagaacaatgaggcaaggaaagtaccatacccaagattccaaccaatgggtgtatattccacgttatgggaagccgatgattgggcgacacgtggaggaatagagaaaatcaattggtcgagagcgccattttatgcttattacaaagattttgatatagaaggatgtccggttccaggacccgcagattgtcccgctaattcgaagaattggtgggaaggcagtgcgtaccaccagttgagtccggtggaagctcgaagttatagatgggtccgagtgaaccatatggtctacgattattgcactgacaaatctcgttttcctgttccacctccagaatgctcggctggaatctga

SEQ ID NO: 2510 - protein, 293 aa, Arabidopsis thaliana
MVVSLFSSRNVFYTLSLCLFAALYQPVMSRPAKFEDDFRIAWSDTHITQIDGGRAIQLKLDPSSGCGFASKKQYLFGRVSMKIKLIPGDSAGTVTAFYMNSDTDSVRDELDFEFLGNRSGQPYTVQTNVFAHGKGDREQRVNLWFDPSRDFHEYAISWNHLRIVFYVDNVPIRVYKNNEARKVPYPRFQPMGVYSTLWEADDWATRGGIEKINWSRAPFYAYYKDFDIEGCPVPGPADCPANSKNWWEGSAYHQLSPVEARSYRWVRVNHMVYDYCTDKSRFPVPPPECSAGI

SEQ ID NO: 2511 - DNA, 1329 bp, Arabidopsis thaliana
atgttgaaaatcaaaagagttccgaccgttgtttcgaactaccagaaggacgatggagcggaggatcccgtcggctgtggacggaattgcctcggcgcttgttgccttaacggggctaggcttccattgtatgcatgtaagaatctggtaaaatccggagagaagcttgtaatcagtcatgaggctatagagcctcctgtagcttttctcgagtcccttgttctcggagagtgggaggataggttccaaagaggactttttcgctatgatgtcactgcctgcgaaaccaaagttatcccggggaagtatggtttcgttgctcagcttaacgagggtcgtcacttgaagaagaggccaactgagttccgtgtagataaggtgttgcagtcttttgatggcagcaaattcaacttcactaaagttggccaagaagagttgctcttccagtttgaagctggtgaagatgcccaagttcagttcttcccttgcatgcctattgaccctgagaattctcccagtgttgttgccatcaatgttagtccgatagagtatggccatgtgctgctgattcctcgtgttcttgactgcttgcctcaaaggatcgatcacaaaagccttttgcttgcagttcacatggctgctgaggctgctaatccatacttcagactcggttacaacagcttgggtgcttttgccactatcaatcatctccactttcaggcttattacttggccatgcctttcccactggagaaagctcctaccaagaagataactaccactgttagtggtgtcaaaatctcagagcttctaagttaccctgtgagaagtcttctctttgaaggtggaagctctatgcaagaactatctgatactgtttcagactgctgtgtttgccttcaaaacaacaacattcctttcaacattctcatctctgattgtggaaggcagatcttcttaatgccacagtgttacgcagagaaacaggctctaggtgaagtgagcccggaggtattggaaacacaagtgaacccagccgtgtgggagataagtggtcacatggtactgaagaggaaagaggattacgaaggtgcttcagaggataacgcgtggaggctccttgcggaagcttctctgtcggaggaaaggtttaaggaggttactgctctcgcctttgaagccataggttgtagtaaccaagaggaggatcttgaaggaaccatagttcatcagcaaaactctagtggcaatgttaaccagaaaagcaacagaacccatggaggtccgatcacaaatgggacggccgccgagtgccttgtccttcagtga

SEQ ID NO: 2512 - protein, 442 aa, Arabidopsis thaliana
MLKIKRVPTVVSNYQKDDGAEDPVGCGRNCLGACCLNGARLPLYACKNLVKSGEKLVISHEAIEPPVAFLESLVLGEWEDRFQRGLFRYDVTACETKVIPGKYGFVAQLNEGRHLKKRPTEFRVDKVLQSFDGSKFNFTKVGQEELLFQFEAGEDAQVQFFPCMPIDPENSPSVVAINVSPIEYGHVLLIPRVLDCLPQRIDHKSLLLAVHMAAEAANPYFRLGYNSLGAFATINHLHFQAYYLAMPFPLEKAPTKKITTTVSGVKISELLSYPVRSLLFEGGSSMQELSDTVSDCCVCLQNNNIPFNILISDCGRQIFLMPQCYAEKQALGEVSPEVLETQVNPAVWEISGHMVLKRKEDYEGASEDNAWRLLAEASLSEERFKEVTALAFEAIGCSNQEEDLEGTIVHQQNSSGNVNQKSNRTHGGPITNGTAAECLVLQ

SEQ ID NO: 2513 - DNA, 1137 bp, Arabidopsis thaliana
atggagaaaggtagcagtgatgattatgactacagtgatagtttcattaacgacgacgatccagctgtccgtggttcacacgtgtctagtactgatgatgatgaaatatctattaaggagatgacagctaaaacaaaagagaagaaaaaaaatggaaaaggtagaagactaaggaagaagtttcaagtttctgattcagattctgatgaaacttcggctagagctgatgaatctagcaatgaggattctgtagaagtacttaacaatggtaatgagcccaagatcgcgaaggtccattcttcagagagtcctctgccttcaagggttacgaggtcgaaggcaagaaaatcgactttggaaagtggtgagcctgccaagtgtgagaagacatttgaagcaaaaattaatactcacaagactctggataatagggaggataaaccattggatgatgctaaactgtctcccgtccagaaagactgtgaaattctttcgaagaaaaaaagaaacaaggaaaggtctaagagttcagctataattattgactcagatgacggagaggggaaaaatatgcctgaaagtcttcagaatgagaatccagtttctgacaaggggatcaaatcatcaagtgatgtattactttctcagaatggtgatgcaactctatcaaagaaaaagaagaaaagggataggagagaggaaactacagatgtcccggaatgtccagagaagaagaaacaagctatcgacaagaacatcgagaaagaagctggtactaagaaaccactagaaacgaggactttatcaaatggagtgatcattgaagatattgaaaaaggaaagttagatggaaaatcagctgttaaagggaaaaaggtcagtatactctatactgggaagttgaaagacaccgggaacttgtttgattcaaacttgggagaagatccactaagattccgcttaggtggagaaaatgtcatagaaggtctcagcattggtgttgaaggaatgcgagttggtgataagagaagactcataataccgccagccctcgggtactcaaaaaggggattgaaggaaaaggtgcctaagagtgcgtggcttgtctatgaagtggaggctgtaaaaatcagataa

SEQ ID NO: 2514 - protein, 378 aa, Arabidopsis thaliana
MEKGSSDDYDYSDSFINDDDPAVRGSHVSSTDDDEISIKEMTAKTKEKKKNGKGRRLRKKFQVSDSDSDETSARADESSNEDSVEVLNNGNEPKIAKVHSSESPLPSRVTRSKARKSTLESGEPAKCEKTFEAKINTHKTLDNREDKPLDDAKLSPVQKDCEILSKKKRNKERSKSSAIIIDSDDGEGKNMPESLQNENPVSDKGIKSSSDVLLSQNGDATLSKKKKKRDRREETTDVPECPEKKKQAIDKNIEKEAGTKKPLETRTLSNGVIIEDIEKGKLDGKSAVKGKKVSILYTGKLKDTGNLFDSNLGEDPLRFRLGGENVIEGLSIGVEGMRVGDKRRLIIPPALGYSKRGLKEKVPKSAWLVYEVEAVKIR

SEQ ID NO: 2515 - DNA, 792 bp, Arabidopsis thaliana
atgagtgaggaggagaggaagcaacacgtcgttctagtacatggtgcttgccatggcgcctggtgctggtacaaggttaagccgcagctcgaggcttctggccaccgcgtaaccgccgtagatctagctgcctccggtatagacatgaccaggtcaatcacagatatatccacatgcgaacaatactcagagccattgatgcagctaatgacctcactaccagatgatgagaaggttgtgcttgttggtcatagcttaggaggtttgagtttagctatggccatggatatgtttccgaccaaaatctctgtttctgtctttgtgactgctatgatgccagacaccaaacactcaccatccttcgtatgggataagctaagaaaagaaacttcacgagaggaatggttagacaccgtgtttacgagcgagaaacctgattttcctagcgagttttggatttttggaccagaattcatggccaagaacttgtatcagttgtctccagtccaagatcttgaattggcgaaaatgttggtgagggcaaacccattgattaagaaagatatggcagagagaagaagcttcagtgaggaaggatacggatccgttacacgtatatttattgtatgcggaaaggatcttgtgtcacccgaagattaccagcgatcgatgatcagcaactttcccccaaaagaagtaatggagatcaaagacgcagatcatatgccaatgttctccaagcctcaacaactatgtgctcttctcttggagattgcaaataaatatgcctaa

SEQ ID NO: 2516 - protein, 263 aa, Arabidopsis thaliana
MSEEERKQHVVLVHGACHGAWCWYKVKPQLEASGHRVTAVDLAASGIDMTRSITDISTCEQYSEPLMQLMTSLPDDEKVVLVGHSLGGLSLAMAMDMFPTKISVSVFVTAMMPDTKHSPSFVWDKLRKETSREEWLDTVFTSEKPDFPSEFWIFGPEFMAKNLYQLSPVQDLELAKMLVRANPLIKKDMAERRSFSEEGYGSVTRIFIVCGKDLVSPEDYQRSMISNFPPKEVMEIKDADHMPMFSKPQQLCALLLEIANKYA

SEQ ID NO: 2517 - DNA, 588 bp, Arabidopsis thaliana
atgaacaaaacccgccttcgtgctctctccccaccttccggtatgcaacaccgtaagagatgtcgattgagaggtcgaaactacgtaaggccagaagttaaacaacgcaacttctcaaaagatgaagacgatctcatcctcaagcttcatgcacttcttggcaatagatggtcattgatagcgggaagattgccaggacgaaccgacaacgaagttaggatccattgggaaacttacctaaaaaggaagctcgtaaaaatgggaatcgacccaaccaatcatcgtctccaccatcacaccaactacatttctagacgtcacctccattcttcacataaggaacatgaaaccaagattattagtgatcaatcttcttcggtatccgaatcatgtggtgtaacaattttgcccattccaagtaccaattgctcggaggatagtactagtaccggacgaagtcatttgcctgacctaaacattggtctcatcccggccgtgacttctttgccagctctttgccttcaggactctagcgaatcctctaccaatggttcaacaggtcaagaaacgcttcttctattccgatga

SEQ ID NO: 2518 - protein, 195 aa, Arabidopsis thaliana
MNKTRLRALSPPSGMQHRKRCRLRGRNYVRPEVKQRNFSKDEDDLILKLHALLGNRWSLIAGRLPGRTDNEVRIHWETYLKRKLVKMGIDPTNHRLHHHTNYISRRHLHSSHKEHETKIISDQSSSVSESCGVTILPIPSTNCSEDSTSTGRSHLPDLNIGLIPAVTSLPALCLQDSSESSTNGSTGQETLLLFR

SEQ ID NO: 2519 - DNA, 858 bp, Arabidopsis thaliana; identical to SEQ ID NO: 1913

SEQ ID NO: 2520 - protein, 285 aa, Arabidopsis thaliana; identical to SEQ ID NO: 1914

SEQ ID NO: 2521 - DNA, 900 bp, Arabidopsis thaliana
atgggtaactctttgatctctcttctctcaatcttccacttgctggtgttatggggatcctcagtgaatgcctattggccaccatcacctggttattggccaagctccaaggttggttccctcaacttctacaaaggttttaggaatctttggggtcctcagcatcagagaatggaccaaaatgccctcaccatctggcttgatagaacctcaggaagtggattcaagtcagtgaagccattcagatcaggctactttggagcaaacatcaaactccaacctggctacactgctggagtcatcacatctctctatctatcaaataatgaggcacatccagggttccatgatgaggtagacatagaatttttggggacaacatttgggaagccttacacacttcagacaaatgtgtatattagaggaagtggtgatgggaaaatcattggccgtgagatgaagtttcgcttgtggtttgatccaactaaagattttcaccattatgctattctttggagccctagagaaatcatatttttggtggatgatattcccataagaagatacccaaagaagagtgcgtctacatttcctttaagaccaatgtggctttatggttccatatgggatgcttcttcttgggcaacggaagacggtaaatacaaagccgactataaatatcaacctttcactgctaaatacaccaattttaaagcgctcggctgcaccgcctactcgtcagctcggtgctatccgttgtcggcttcgccataccgttctggcggattaacccgacaacaacaccaagccatgagatgggttcaaacacatagtatggtatacaattattgcaaagattataagcgagaccattctttaacgccggaatgttggcgttag

SEQ ID NO: 2522 - protein, 299 aa, Arabidopsis thaliana
MGNSLISLLSIFHLLVLWGSSVNAYWPPSPGYWPSSKVGSLNFYKGFRNLWGPQHQRMDQNALTIWLDRTSGSGFKSVKPFRSGYFGANIKLQPGYTAGVITSLYLSNNEAHPGFHDEVDIEFLGTTFGKPYTLQTNVYIRGSGDGKIIGREMKFRLWFDPTKDFHHYAILWSPREIIFLVDDIPIRRYPKKSASTFPLRPMWLYGSIWDASSWATEDGKYKADYKYQPFTAKYTNFKALGCTAYSSARCYPLSASPYRSGGLTRQQHQAMRWVQTHSMVYNYCKDYKRDHSLTPECWR

SEQ ID NO: 2523 - DNA, 1236 bp, Arabidopsis thaliana; identical to SEQ ID NO: 1753

SEQ ID NO: 2524 - protein, 411 aa, Arabidopsis thaliana; identical to SEQ ID NO: 1754

SEQ ID NO: 2525 - DNA, 552 bp, Arabidopsis thaliana
atgggaatgtcgaaatcgaaaggcaacacacacaacatcttccttctctgcaactacatcctcttaggctcagcctcaagttgcatcttcctcacaatctccctccgtctcttcccatctctctccggtctctcccttatcttcctctacactctcacaatcgcaaccgcggtatccggctgctcgatcttcgcctcctccacatccgccaccgcgagcgatagattatacggttcacacatggtagccacagtcctcacggccattttccaaggcgctgtctctgttctgatattcacgagaacaggggatttccttaggttcttgaaatcttatgttcgggaagaagacggtgaagtgatacttaaactctctggtggtttgtgtgtattgatgttttgcttagagtggattgttcttgtgttagcgtttttgttgaagtatagtgattatttggatgagagtgttgtagatgatgatgattttaaggtgaggaggcaagaagaagatctcaaggattggccttcttacccatttcaactcaagatttaa

SEQ ID NO: 2526 - protein, 183 aa, Arabidopsis thaliana
MGMSKSKGNTHNIFLLCNYILLGSASSCIFLTISLRLFPSLSGLSLIFLYTLTIATAVSGCSIFASSTSATASDRLYGSHMVATVLTAIFQGAVSVLIFTRTGDFLRFLKSYVREEDGEVILKLSGGLCVLMFCLEWIVLVLAFLLKYSDYLDESVVDDDDFKVRRQEEDLKDWPSYPFQLKI

SEQ ID NO: 2527 - DNA, 753 bp, Arabidopsis thaliana
atggtggagcaaaagagatacgctctgtttctagcgactttggactcagagttcgtgaagaaaacttacggaggataccacaacgtgttcgtgacgacgttcggagacgaaggagagcattgggactcctttagagtcgtcagcggagagtttcctgacgagaaagatctggagaaatacgatggcttcgttatcagcggaagctctcacgatgcctttgagaatgatgattggatccttaagctctgtgatattgtcaagaaaattgatgagatgaagaagaaaattcttggcatctgctttggtcatcagatcatagccagggtaaggggaggaacagtcggaagagcaaagaagggaccagaacttaaacttggagacataaccatcgtcaaggatgcgattacgcctggaagttacttcggaaacgagattcctgatagcatagcgatcatcaaatgtcaccaggacgaagtgttggtgctgcccgaaactgctaaagtgcttgcgtattccaagaactacgaggtggagatgtattcgattgaggatcatttgttctgtatccaaggacatcctgagtataacaaagagattctcttcgagattgttgatcgtgttcttgctctaggctacgtcaagcaagaatttgctgatgcggctaaggcaacgatggagaataggggagcagacaggaagctttgggagacgatttgcaagaacttcctcaaaggcagagttccaactaactag

SEQ ID NO: 2528 - protein, 250 aa, Arabidopsis thaliana
MVEQKRYALFLATLDSEFVKKTYGGYHNVFVTTFGDEGEHWDSFRVVSGEFPDEKDLEKYDGFVISGSSHDAFENDDWILKLCDIVKKIDEMKKKILGICFGHQIIARVRGGTVGRAKKGPELKLGDITIVKDAITPGSYFGNEIPDSIAIIKCHQDEVLVLPETAKVLAYSKNYEVEMYSIEDHLFCIQGHPEYNKEILFEIVDRVLALGYVKQEFADAAKATMENRGADRKLWETICKNFLKGRVPTN

SEQ ID NO: 2529 - DNA, 1074 bp, Arabidopsis thaliana
atgggaaaggttcttgagaaggaggcgtttggattggctgcgaaagacgaatcgggaattctttcgcctttcagtttctctagaagggcgacgggtgaaaaggatgtgaggttcaaagtcttgttctgtggaatttgccacactgatctgagtatggccaaaaacgaatgggggttaactacttatcctcttgtccctgggcatgagattgtgggcgtggtgactgaagttggagccaaagtgaaaaaattcaacgctggagacaaagtcggagttggctatatggccggctcgtgcaggtcatgtgacagctgcaatgatggcgacgagaactactgtccaaagatgatcttaacgtccggagccaaaaactttgacgataccatgacccatggtggatactccgaccacatggtgtgtgctgaggatttcatcatccgtattcctgacaatctcccattagacggtgccgcaccactactctgcgccggggtcacggtctactcccccatgaagtatcacgggctcgacaagcccggtatgcacatcggtgtggtgggactaggcggtttgggccatgtagcagtgaaatttgctaaggctatgggtactaaagttacggttattagtacttcggagcgtaagagagacgaggccgttactcggcttggtgcggatgccttcttggtgagccgtgacccgaaacaaatgaaggatgcaatggggactatggatggtatcattgataccgtatctgcgacccatccacttcttccgctgcttggtttgcttaaaaataagggaaaacttgttatggttggtgcaccagcagaaccgctcgagcttcctgtttttcctctcatctttgggcggaagatggtggtgggtagtatggtaggaggtataaaggagacgcaagagatggtggatttggctggaaaacacaacatcacggcggatattgagctcatctctgcggattatgtcaacaccgccatggaacggcttgcaaaggctgacgttaagtaccgatttgtgattgatgttgccaacacgatgaagccaactccttaa

SEQ ID NO: 2530 - protein, 357 aa, Arabidopsis thaliana
MGKVLEKEAFGLAAKDESGILSPFSFSRRATGEKDVRFKVLFCGICHTDLSMAKNEWGLTTYPLVPGHEIVGVVTEVGAKVKKFNAGDKVGVGYMAGSCRSCDSCNDGDENYCPKMILTSGAKNFDDTMTHGGYSDHMVCAEDFIIRIPDNLPLDGAAPLLCAGVTVYSPMKYHGLDKPGMHIGVVGLGGLGHVAVKFAKAMGTKVTVISTSERKRDEAVTRLGADAFLVSRDPKQMKDAMGTMDGIIDTVSATHPLLPLLGLLKNKGKLVMVGAPAEPLELPVFPLIFGRKMVVGSMVGGIKETQEMVDLAGKHNITADIELISADYVNTAMERLAKADVKYRFVIDVANTMKPTP

SEQ ID NO: 2531 - DNA, 999 bp, Arabidopsis thaliana
atggaagcagaagaaggtcatcagcgtgaccgcctctgcgactattgcgactcctccgtggctcttgtctactgcaaagctgactccgccaagctctgcctcgcctgcgacaagcaagtccacgtcgccaaccaactcttcgccaaacacttcaggtcacttctctgcgactcctgcaacgaatctccctcttcccttttctgcgagactgaaaggtctgttctttgccagaactgcgactggcaacaccacaccgcctcttcctcccttcatagccgcagaccctttgaaggatttaccggctgtccctccgtgcctgagttgctggccatcgttggcctcgatgacctcactctcgattccggattgctttgggagtcacctgagatcgttagcctcaacgaccttattgtttcgggcgggtcgggtactcataacttccgggccacggatgttcctcctctgcctaagaatcgtcacgccacctgcgggaaatacaaagatgagatgatccgacagctccgtggactatccagatctgagcctggttgtctgaaatttgaaaccccagatgctgagatcgatgccgggttccaattcctagcgccggatttgttttctacatgcgagctggagagtggactgaaatggttcgatcagcaagatcatgaggactttccatattgctctctgctaaagaacttgtcggagtcagatgagaaacctgagaatgtagaccgagagtcatcggtgatggttcccgtttccggctgcttaaaccgatgtgaggaagagactgtgatggttccggttatcactagtacaaggtcgatgacacatgagatcaacagtcttgagaggaactctgctctctctcgctacaaagaaaagaagaagtctcgaaggtacgagaaacacatcaggtatgaatcacgcaaggttcgtgcagaaagcaggacaagaatcaggggacgtttcgccaaggcagcagatccatga

SEQ ID NO: 2532 - protein, 332 aa, Arabidopsis thaliana
MEAEEGHQRDRLCDYCDSSVALVYCKADSAKLCLACDKQVHVANQLFAKHFRSLLCDSCNESPSSLFCETERSVLCQNCDWQHHTASSSLHSRRPFEGFTGCPSVPELLAIVGLDDLTLDSGLLWESPEIVSLNDLIVSGGSGTHNFRATDVPPLPKNRHATCGKYKDEMIRQLRGLSRSEPGCLKFETPDAEIDAGFQFLAPDLFSTCELESGLKWFDQQDHEDFPYCSLLKNLSESDEKPENVDRESSVMVPVSGCLNRCEEETVMVPVITSTRSMTHEINSLERNSALSRYKEKKKSRRYEKHIRYESRKVRAESRTRIRGRFAKAADP

SEQ ID NO: 2533 - DNA, 582 bp, Arabidopsis thaliana
atgaactcaactcaacagttagattccgacttacgattcttcagaatactggagacaaatcggtttatcaatctccctgattcgagattgacacaaaccttagaaattccggcggcggctcctccttctttgtggcttaatcaaagagttttaagtcgacggcgagcggagatagttctctcagatggaggttcgttggtagatctacaatggggaactatgactctcgacgacggcagcagatctggtggatttcttcgtcagtctcttcgcggaggtacctctcctccgatgaacctccttggtagtggtggctcagtgttaagaaggtacagaggtaggcggatcgtggttttcgagcttggttgtgaagatcctatcgatcccgggcagatttacatgattcaaggcgtattagctatgctgccgtcaacgactcctgatggagaattaatgagaaatgggggagaaaagaaaaccatttggattgtagaagaagaaggaaagctctccaataaagcctcgacttcaagaaatttttgtctcagcccggttgatccggttgagtatcagtcggattag

SEQ ID NO: 2534 - protein, 193 aa, Arabidopsis thaliana
MNSTQQLDSDLRFFRILETNRFINLPDSRLTQTLEIPAAAPPSLWLNQRVLSRRRAEIVLSDGGSLVDLQWGTMTLDDGSRSGGFLRQSLRGGTSPPMNLLGSGGSVLRRYRGRRIVVFELGCEDPIDPGQIYMIQGVLAMLPSTTPDGELMRNGGEKKTIWIVEEEGKLSNKASTSRNFCLSPVDPVEYQSD

SEQ ID NO: 2535 - DNA, 852 bp, Arabidopsis thaliana
atggcaggcagtaatattctccataagattaagttgaaggctgggttctgtggatctgctcctgacatgggaagaggcaaaagcaagatgtggaagaacatcacccacggttttcactgtgtgaagggcaagtccagccatccgatggaggactatgtagtgtctgaattcaagaaacttgaaggtcatgaattgggtttgtttgctatctttgatggtcacttggggcatgatgtggctaaatacttgcagactaatctctttgacaacattcttaaagagaaggatttttggactgacacagagaatgctataaggaatgcctacagatcaacagatgccgtgatattgcagcagtcccttaagcttggtaaaggcggatcaacagctgtaacgggaattctaattgatggtaaaaagctagttgttgctaatgttggagactccagagcagtgatgtctaagaatggtgttgcgcatcagctatctgtcgatcatgaaccaagcaaggagaaaaaagaaatagagagccgaggtggctttgtgtcaaatattccaggggatgttccacgagtggatggacagttagcggttgcaagagcatttggagataagagcttaaagttacatctgagctcagaaccggacataacacaccagacaattgatgatcacactgaattcatccttttcgcaagcgatggtatttggaaagtattatcaaaccaagaagcggttgatgctatcaagagtatcaaagatcctcatgcagctgcaaagcacttgatagaggaagctatatctaggaagagcaaagatgacatctcatgtatcgttgtaaagttccactaa

SEQ ID NO: 2536 - protein, 283 aa, Arabidopsis thaliana
MAGSNILHKIKLKAGFCGSAPDMGRGKSKMWKNITHGFHCVKGKSSHPMEDYVVSEFKKLEGHELGLFAIFDGHLGHDVAKYLQTNLFDNILKEKDFWTDTENAIRNAYRSTDAVILQQSLKLGKGGSTAVTGILIDGKKLVVANVGDSRAVMSKNGVAHQLSVDHEPSKEKKEIESRGGFVSNIPGDVPRVDGQLAVARAFGDKSLKLHLSSEPDITHQTIDDHTEFILFASDGIWKVLSNQEAVDAIKSIKDPHAAAKHLIEEAISRKSKDDISCIVVKFH

SEQ ID NO: 2537 - DNA, 492 bp, Arabidopsis thaliana
atggcgacgggaaagagttactacgctaggcctagctatcgatttctcggcaccgatcagccgtcttacttcaccgcttccgattcaggtctcgaattcgacgaatccgatctcttcaatccaatccactccgattcaccagatttttgccgtaaaatctcttcatcagtcagatccggtaaaaaatcgtcgaatcgtccctccgccgcttcctccgccgcagcagcgtcgtcgcttcctgttaacgtgccggactggtccaagattctccgcggagaataccgcgataaccgacggagaagcatcgaggataacgacgacgatgacgatgataacgaagacggtggcgattggttaccgccgcatgagtttctggcgaagacgagaatggcttcgttctcggttcatgaaggagtagggaggacattgaaaggaagagatctgagtagggttcgaaatgcaatttttgaaaaatttgggttccaagattaa

SEQ ID NO: 2538 - protein, 163 aa, Arabidopsis thaliana
MATGKSYYARPSYRFLGTDQPSYFTASDSGLEFDESDLFNPIHSDSPDFCRKISSSVRSGKKSSNRPSAASSAAAASSLPVNVPDWSKILRGEYRDNRRRSIEDNDDDDDDNEDGGDWLPPHEFLAKTRMASFSVHEGVGRTLKGRDLSRVRNAIFEKFGFQD

SEQ ID NO: 2539 - DNA, 1029 bp, Arabidopsis thaliana
atggcggatctgaaatcaaccttcctcgacgtttactctgttctcaagtctgatctgcttcaagatccttcctttgaattcacccacgaatctcgtcaatggcttgaacggatgcttgactacaatgtacgcggagggaagctaaatcgtggtctctctgtggttgatagctacaagctgttgaagcaaggtcaagacttgacggagaaagagactttcctctcatgtgctcttggttggtgcattgaatggcttcaagcttatttccttgtgcttgatgacatcatggacaactctgtcacacgccgtggccagccttgttggtttagaaagccaaaggttggtatgattgccattaacgatgggattctacttcgcaatcatatccacaggattctcaaaaagcacttcagggaaatgccttactatgttgacctcgttgatttgtttaacgaggtagagtttcaaacagcttgcggccagatgattgatttgatcaccacctttgatggagaaaaagatttgtctaagtactccttgcaaatccatcggcgtattgttgagtacaaaacagcttattactcattttatcttcctgttgcttgcgcattgctcatggcgggagaaaatttggaaaaccatactgatgtgaagactgttcttgttgacatgggaatttactttcaagtacaggatgattatctggactgttttgctgatcctgagacacttggcaagatagggacagacatagaagatttcaaatgctcctggttggtagttaaggcattggaacgctgcagtgaagaacaaactaagatactatacgagaactatggtaaagccgaaccatcaaacgttgctaaggtgaaagctctctacaaagagcttgatctcgagggagcgttcatggaatatgagaaggaaagctatgagaagctgacaaagttgatcgaagctcaccagagtaaagcaattcaagcagtgctaaaatctttcttggctaagatctacaagaggcagaagtag

SEQ ID NO: 2540 - protein, 342 aa, Arabidopsis thaliana
MADLKSTFLDVYSVLKSDLLQDPSFEFTHESRQWLERMLDYNVRGGKLNRGLSVVDSYKLLKQGQDLTEKETFLSCALGWCIEWLQAYFLVLDDIMDNSVTRRGQPCWFRKPKVGMIAINDGILLRNHIHRILKKHFREMPYYVDLVDLFNEVEFQTACGQMIDLITTFDGEKDLSKYSLQIHRRIVEYKTAYYSFYLPVACALLMAGENLENHTDVKTVLVDMGIYFQVQDDYLDCFADPETLGKIGTDIEDFKCSWLVVKALERCSEEQTKILYENYGKAEPSNVAKVKALYKELDLEGAFMEYEKESYEKLTKLIEAHQSKAIQAVLKSFLAKIYKRQK

SEQ ID NO: 2541 - DNA, 639 bp, Arabidopsis thaliana
atgagtgaagaaactaaagataaccagaggctgcagcgaccagctcctcgtcttaacgagaggattctctcatccttgtcaagaagatccgtagctgctcatccatggcatgatcttgagattggacctggagctccacagattttcaatgtggttgttgagatcactaaaggaagcaaggtcaaatacgagcttgacaaaaagacaggactcatcaaggttgatcgtattctctactcatcagttgtgtaccctcacaactatggttttgttcctcgcacattgtgtgaagacaatgaccccattgatgtcttagtcatcatgcaggaacctgtgcttccgggttgttttctgcgtgccagagccattggattaatgcctatgattgaccagggtgaaaaagatgacaagatcattgcagtgtgtgttgatgatcctgaatataagcactacactgacatcaaagaacttcctcctcaccgtctctctgaaatccgtcgtttcttcgaagactacaagaaaaacgagaacaaggaagttgcagtgaatgattttctgccatctgagtctgcggttgaagctatccagtactcaatggacctctatgctgaatacattctccacaccctgaggcgttga

SEQ ID NO: 2542 - protein, 212 aa, Arabidopsis thaliana
MSEETKDNQRLQRPAPRLNERILSSLSRRSVAAHPWHDLEIGPGAPQIFNVVVEITKGSKVKYELDKKTGLIKVDRILYSSVVYPHNYGFVPRTLCEDNDPIDVLVIMQEPVLPGCFLRARAIGLMPMIDQGEKDDKIIAVCVDDPEYKHYTDIKELPPHRLSEIRRFFEDYKKNENKEVAVNDFLPSESAVEAIQYSMDLYAEYILHTLRR

SEQ ID NO: 2543 - DNA, 1308 bp, Arabidopsis thaliana
atggttgatatggattggaagaggaagatggtatcatcagatttaccaaactcacctaagctttcttcaaagcttcacgtaactattccatcaccgttcaaaatcgtccctgtttcatctccgatctcatgttcagcacctgctctttgctctgcttacgagctttaccttcgtctccctgagctaagaaagctctggtcatctcgtgattttcctcaatggacatcagagccgattctcaaaccagctcttcaagctttggagatcagtttcagattagttttcgccgtttgttctgatactagaccgtacatcaaccaccgtgaatggaaccggaggctagattctctcatcacgaagcagatccagcttgtagcagcgatctgcgaagatgaagaagaagaaggtatatcagcggaggctccggtcggcggtggacggagttcgttgagtttgttaccgcagctagctacgtggaggagatcagaggctttggggaagaagatcttatatacgatcgataacgagatgagtcggtgtaagtacacgctcggactcggtgaacaaaacatcgccggaaaaccaaatctccggtacgatgcgatttgccgaccaaacgagatctatagcctcaaggataatccatacgcagatcatatcgataatcacgagaatcaaactctctatatcattcaccagatcctcgaatcgtggatctacgcatctggaaatcttctgaatcgaatcgtctcaagtatcgaagaagagaaattcggaaaagcttcaaacgatgtttacttgctggagaagatctggaaaattttagcggagattgaagatcttcatatgttgatggatccggaagattttttgaaattgaagaaacagttacagatcaaatcgacgggtaaaaacgatgcgttttgtttcagatctaaaggattagtggagatgatgaagatgtcgaaagatctgagacagaaagtaccggcggtcttggcggttgaggtagatccaaccggaggaccaagattacaagaggcggcgatgaagctttacgcgaggaagacagagtgcgataagattcatttgcttcaggggatgcaagcggtggaagcggcggcgaagagtttcttctttgggtataggcagttagtggcggctatgatgggaagtgcggagatgaacgcgacggcgagtcaagagtcgtgtgactcactgagtcagatatttatggagccgacgtatttcccgagccttgacgcggcaaagacgtttctgggagagttttggagtcatttgggatga

SEQ ID NO: 2544 - protein, 435 aa, Arabidopsis thaliana
MVDMDWKRKMVSSDLPNSPKLSSKLHVTIPSPFKIVPVSSPISCSAPALCSAYELYLRLPELRKLWSSRDFPQWTSEPILKPALQALEISFRLVFAVCSDTRPYINHREWNRRLDSLITKQIQLVAAICEDEEEEGISAEAPVGGGRSSLSLLPQLATWRRSEALGKKILYTIDNEMSRCKYTLGLGEQNIAGKPNLRYDAICRPNEIYSLKDNPYADHIDNHENQTLYIIHQILESWIYASGNLLNRIVSSIEEEKFGKASNDVYLLEKIWKILAEIEDLHMLMDPEDFLKLKKQLQIKSTGKNDAFCFRSKGLVEMMKMSKDLRQKVPAVLAVEVDPTGGPRLQEAAMKLYARKTECDKIHLLQGMQAVEAAAKSFFFGYRQLVAAMMGSAEMNATASQESCDSLSQIFMEPTYFPSLDAAKTFLGEFWSHLG

SEQ ID NO: 2545 - DNA, 531 bp, Arabidopsis thaliana
atggagacggaagcggcggtgacagcgacggttacggcggcgacgatggggattgggacgaggaagagagatctgaaaccgtataaaggaatacgaatgaggaaatgggggaaatgggtggcggagatacgggaaccgaataagagatcaaggatctggttaggttcttatgcgacgcctgaagcggcggcgagagcttacgacactgctgttttttacctccgtggtccttcagcgaggcttaattttccggagcttttggctggacttactgtttctaacggcggaggaagaggtggtgatttatcggcggcgtatattaggagaaaagcggcggaggttggtgctcaggttgatgcgcttggagcgacggtggttgtgaataccggcggcgagaatcgcggtgattacgagaagattgagaattgtcgtaagagcggtaacgggtcattggaacgggtcgatttgaataaattacccgacccggaaaattcggatggtgatgatgacgaatgtgtgaaaagaagatag

SEQ ID NO: 2546 - protein, 176 aa, Arabidopsis thaliana
METEAAVTATVTAATMGIGTRKRDLKPYKGIRMRKWGKWVAEIREPNKRSRIWLGSYATPEAAARAYDTAVFYLRGPSARLNFPELLAGLTVSNGGGRGGDLSAAYIRRKAAEVGAQVDALGATVVVNTGGENRGDYEKIENCRKSGNGSLERVDLNKLPDPENSDGDDDECVKRR

SEQ ID NO: 2547 - DNA, 816 bp, Arabidopsis thaliana
atggcggacaatgattctctagatcagtttttggctgccgccattgatgccgctaaaaaagctggacagatcattcgtaaagggttttacgagactaaacatgttgaacacaaaggccaggtggatttggtgacagagactgataaaggatgtgaagaacttgtgtttaatcatctcaagcagctctttcccaatcacaagttcataggagaagaaactacagctgcatttggtgtgacagaactaactgacgaaccaacttggattgttgatcctcttgatggaacaaccaatttcgttcacgggttccctttcgtgtgtgtttccattggacttacgattggaaaagtccctgttgttggagttgtttataatcctattatggaagagctattcaccggtgtccaagggaaaggagcattcttgaatggaaagcgaatcaaagtgtcagctcaaagcgaacttttaaccgctttgctcgtgacagaggcgggtactaaacgagataaagctacattagacgatacaaccaacagaatcaacagtttgctaaccaaggtcaggtcccttaggatgagtggttcgtgtgcactggacctctgtggcgttgcgtgtggaagggttgatatcttctacgagctcggtttcggtggtccatgggacattgcagcaggaattgttatcgtgaaagaagctggtggactcatctttgatccatccggtaaagatttggacataacatcgcagaggatcgcggcttcaaacgcttctctcaaggagttattcgctgaggcgttgcggcttacaggggcatga

SEQ ID NO: 2548 - protein, 271 aa, Arabidopsis thaliana
MADNDSLDQFLAAAIDAAKKAGQIIRKGFYETKHVEHKGQVDLVTETDKGCEELVFNHLKQLFPNHKFIGEETTAAFGVTELTDEPTWIVDPLDGTTNFVHGFPFVCVSIGLTIGKVPVVGVVYNPIMEELFTGVQGKGAFLNGKRIKVSAQSELLTALLVTEAGTKRDKATLDDTTNRINSLLTKVRSLRMSGSCALDLCGVACGRVDIFYELGFGGPWDIAAGIVIVKEAGGLIFDPSGKDLDITSQRIAASNASLKELFAEALRLTGA

SEQ ID NO: 2549 - DNA, 2649 bp, Arabidopsis thaliana
atggctgcgtggtcaccatcagttgggataggatcttgttgtctcaataatggcatcactagaacatggaagtttccttctgcaaggctttttactggtaggaagaacaagattaaacttggatccgagacactaatgtttacacgaaaacgtttcatgggtgatttggttacaagcgcgttgcaaagttatcagtttagtaagatatgtgcttcaaagacttccatcgagctgagagaggcattgtctagtagaagagctgaggctgatgacctgaagaaggtaacatcatattcattcaggacaaaagcaggtgctctggttaaagtcaaagttgaaaagaagagagaaaagtacagcattttggtttatgtctcatctttggaacttagtggtgatgacaagagtaggctggtgatggtttggggtgtctacaggtctgattcttcgtgttttttgcctctggatttcgaaaactcttcccaagactcacaaacccacacaacagaaactacatttgtgaaaagctccttgtctgagttaatgctagggctagaatttgatgggaaagaatctcctttctacttatcatttcacctgaagttagtgtcaggtagagatccggacggtcaagaaatgctgactcacagggacactgacttctgtatcccggttggttttactgctggtcatccattgccgctaggcctttcttccgggccagatgatgattcttggaatttttcgttcttttcaagaagctcaacgaacgtggttttatgcttgtatgatgatagcacaacagataaacctgctttagaacttgatcttgatccttatgtcaaccgaacaggtgatgtttggcatgcttcagttgacaatacatgggattttgtgagatatggctaccgttgcaaggagacagctcactctaaagaagatgtcgatgttgaaggtgagccaattgtcttggatccatatgccacagtcgttggtaaatctgtctctcagaaatatcttggaagtttatctaagagtccttcttttgattggggagaagatgtgtctccgaacatacctctggagaaacttcttgtttaccggttgaatgtgaagggttttacacaacacagatccagcaagttgcctagtaacgtagcagggacattttctggtgtagctgagaaagttagccatttgaaaacccttggaaccaacgctgttcttttggagccaatattctcattctccgagcaaaaaggtccttattttccatttcatttcttttcaccaatggacatatatggaccttccaatagccttgaatccgcagttaactcaatgaaagtgatggtgaagaaattgcacagtgagggaatagaggtacttttggaagtagtttttacacatactgctgattctggagctcttcgtggaattgatgacagttcctattactacaagggaagagccaatgatctagattctaaaagttacttgaactgtaactatcctgttgttcagcagttggtattggagagcttgcgttattgggtaaccgagtttcatgtagatggattttgttttataaatgcttcatctctcttgagaggcgttcacggtgaacagctctctcgtcctcctttggttgaagcaatagcttttgatccacttcttgcggagaccaaactaatagctgattgctgggatccacttgaaatgatgccaaaagaagtacggttcccacattggaagcgatgggcagaactcaacacaagatattgtcgaaatgtaagaaattttttaaggggaagaggcgttcttagtgatctggctacaagaatttgtggaagtggtgacgtatttaccgatggaagaggtccggccttctccttcaactacatttcaagaaactcaggactctcgcttgttgacatagtcagtttcagtggccctgagctagcttcagagctaagttggaattgtggggaagaaggagcaacgaataaatcagctgttcttcaaagaaggctaaaacaaatccgcaatttcttgtttatacagtacatatcacttggagttccagtgcttaatatgggagatgaatgtggaatctcgacaaggggctcgcctttgttggaatcacggaaaccttttgattggaacttgctagcttcggctttcggtacacagatcacgcaatttatctccttcatgacttcagtaagagcaagaagaagtgatgtgtttcaaaggagagactttttgaaacctgaaaatattgtttggtatgcaaatgaccaaacaactccaaagtgggaagatcctgcttctaagtttttggcattggagatcaaatcagagtcagaggaagaggaaactgcgtcattggctgagccaaatgagccaaagagcaatgatctgttcatcggattcaatgcgagtgatcatcctgagagtgtagtcttaccttcacttcccgatggaagcaaatggagaagattggtcgacacagctcttcctttcccggggtttttctctgtcgaaggagaaaccgttgtagcagaagaaccgttgcagcaactggttgtgtatgagatgaagccgtacagttgtaccctttttgaaaccatcaatactaccgcttag

SEQ ID NO: 2550 - protein, 882 aa, Arabidopsis thaliana
MAAWSPSVGIGSCCLNNGITRTWKFPSARLFTGRKNKIKLGSETLMFTRKRFMGDLVTSALQSYQFSKICASKTSIELREALSSRRAEADDLKKVTSYSFRTKAGALVKVKVEKKREKYSILVYVSSLELSGDDKSRLVMVWGVYRSDSSCFLPLDFENSSQDSQTHTTETTFVKSSLSELMLGLEFDGKESPFYLSFHLKLVSGRDPDGQEMLTHRDTDFCIPVGFTAGHPLPLGLSSGPDDDSWNFSFFSRSSTNVVLCLYDDSTTDKPALELDLDPYVNRTGDVWHASVDNTWDFVRYGYRCKETAHSKEDVDVEGEPIVLDPYATVVGKSVSQKYLGSLSKSPSFDWGEDVSPNIPLEKLLVYRLNVKGFTQHRSSKLPSNVAGTFSGVAEKVSHLKTLGTNAVLLEPIFSFSEQKGPYFPFHFFSPMDIYGPSNSLESAVNSMKVMVKKLHSEGIEVLLEVVFTHTADSGALRGIDDSSYYYKGRANDLDSKSYLNCNYPVVQQLVLESLRYWVTEFHVDGFCFINASSLLRGVHGEQLSRPPLVEAIAFDPLLAETKLIADCWDPLEMMPKEVRFPHWKRWAELNTRYCRNVRNFLRGRGVLSDLATRICGSGDVFTDGRGPAFSFNYISRNSGLSLVDIVSFSGPELASELSWNCGEEGATNKSAVLQRRLKQIRNFLFIQYISLGVPVLNMGDECGISTRGSPLLESRKPFDWNLLASAFGTQITQFISFMTSVRARRSDVFQRRDFLKPENIVWYANDQTTPKWEDPASKFLALEIKSESEEEETASLAEPNEPKSNDLFIGFNASDHPESVVLPSLPDGSKWRRLVDTALPFPGFFSVEGETVVAEEPLQQLVVYEMKPYSCTLFETINTTA

SEQ ID NO: 2551 - DNA, 1605 bp, Arabidopsis thaliana
atggcaagggaacaattacaagtgttgaatgcacttgacgtggccaagacgcaatggtaccatttcacggcgatcataatcgccggaatgggattcttcactgatgcttacgatctcttttgcatctctctcgtaacgaagctcctcggtcgtatttattaccacgtggaaggcgcacaaaagcctgggactctccctcccaacgtcgcagccgccgtcaatggcgttgccttctgtgggactctcgccggtcagctctttttcgggtggcttggtgataagctcgggaggaagaaagtttacggtatgacgttgatggtcatggtcctttgttcaatagcctctggtctctctttcggacatgagccaaaagctgtgatggccacgctctgtttttttcggttttggcttggatttggcatcggtggtgactaccctttatccgcaaccatcatgtctgaatatgcgaacaagaagactcgcggagcctttgtctctgcggtttttgctatgcaagggttcggaatcatggctggtggtattttcgctattataatttcctctgcttttgaagctaagtttccatccccggcctatgcggatgatgccttgggatccacgattcctcaagctgatttggtatggcggataatcctgatggctggtgctatccctgcggctatgacgtattactcaaggtcgaagatgcctgagaccgcaaggtacacggctttggttgctaaggacgcaaagcaggcagcttcggacatgtctaaggttctgcaagtggagatagagccagaacaacagaaattggaagagatctcaaaggagaagtccaaggcctttggattgttctcaaaggaattcatgagtcgccatgggcttcatttgctaggcactacatcgacatggttccttctcgacattgctttctacagtcaaaaccttttccaaaaggatattttcagcgcgatcggatggattcctcccgcgcaaagcatgaacgcaattcaagaggttttcaagattgcccgtgcgcaaacgctaatcgccttgtgtagcacggtacctggttactggttcacagttgcgttcatcgacgtcattggaagatttgcgattcagatgatgggtttctttttcatgacggtctttatgtttgctctggctattccttacaaccactggactcacaaggagaaccgaatcggatttgttatcatgtactcgttaacattctttttcgccaactttggacccaatgctacaaccttcgttgtgccggccgaaatcttcccagccaggttcagatcaacctgccacggtatctctgcagcatcaggaaaattaggagcaatggttggtgcgttcgggttcttgtacttggctcagaacccagacaaggacaagaccgacgcaggataccctccagggattggggtcaggaactcgcttattgtgttgggtgtagttaacttcttaggtatcctcttcactttcttggtacctgaatctaaaggtaagtcactcgaggaaatgtccggtgaaaatgaagacaatgagaatagcaacaatgatagtagaacggtcccaatagtttag

SEQ ID NO: 2552 - protein, 534 aa, Arabidopsis thaliana
MAREQLQVLNALDVAKTQWYHFTAIIIAGMGFFTDAYDLFCISLVTKLLGRIYYHVEGAQKPGTLPPNVAAAVNGVAFCGTLAGQLFFGWLGDKLGRKKVYGMTLMVMVLCSIASGLSFGHEPKAVMATLCFFRFWLGFGIGGDYPLSATIMSEYANKKTRGAFVSAVFAMQGFGIMAGGIFAIIISSAFEAKFPSPAYADDALGSTIPQADLVWRIILMAGAIPAAMTYYSRSKMPETARYTALVAKDAKQAASDMSKVLQVEIEPEQQKLEEISKEKSKAFGLFSKEFMSRHGLHLLGTTSTWFLLDIAFYSQNLFQKDIFSAIGWIPPAQSMNAIQEVFKIARAQTLIALCSTVPGYWFTVAFIDVIGRFAIQMMGFFFMTVFMFALAIPYNHWTHKENRIGFVIMYSLTFFFANFGPNATTFVVPAEIFPARFRSTCHGISAASGKLGAMVGAFGFLYLAQNPDKDKTDAGYPPGIGVRNSLIVLGVVNFLGILFTFLVPESKGKSLEEMSGENEDNENSNNDSRTVPIV

SEQ ID NO: 2553 - DNA, 555 bp, Arabidopsis thaliana
atggcaaaccaaatctacataatctccttgatcttcttgtctgtgttactttatcaatccactaccgtcttatctttccgacaaccattcaacctagcgaaaccatgcaagcgtttcgtcttctacctccataatgttgcctacgacggtgataacacggataatgctacatcagcagcaattgttaaccctttaggtctaggagacttcagttttgggaagtttgtgatcatggacaaccctgtgacaatggaccagaacatgctctcggaacaggtggctcgtgttcaaggcttcttcttctatcacggtaagacgaaatacgacacttggctctcttggtcagtagtattcaattcaacacaacacaagggggcattgaacataatgggtgaaaacgcgtttatggagccgacaagagacctaccggtcgttggtgggactggtgatttcgtcatgactcgtgggatcgctacgttcatgactgatctcgttgaaggcagtaagtatttccgtgtcaaaatggatattaaactctatgaatgttactattag

SEQ ID NO: 2554 - protein, 184 aa, Arabidopsis thaliana
MANQIYIISLIFLSVLLYQSTTVLSFRQPFNLAKPCKRFVFYLHNVAYDGDNTDNATSAAIVNPLGLGDFSFGKFVIMDNPVTMDQNMLSEQVARVQGFFFYHGKTKYDTWLSWSVVFNSTQHKGALNIMGENAFMEPTRDLPVVGGTGDFVMTRGIATFMTDLVEGSKYFRVKMDIKLYECYY

SEQ ID NO: 2555 - DNA, 990 bp, Arabidopsis thaliana
atggaagctcctccaccttcaagcgatccatacaagttcctcaacattacacttaactcagatggatctctcaccagacaccgtgatttccccaaactgcccccaacagagcaatccaaagacataccattaaaccaaaccaacaataccttcatccgaatcttcaagccacggaatattccgccggaatccaaacttccgatcctcgtttactttcacggcggtggatttatcctctacagcgccgcttcagctcctttccatgaatcttgcaccaaaatggctgatcgtcttcaaactataatcctctccgtcgaataccgtctagctcccgaacaccgtctcccggcggcgtacgaagacgccgtcgaagctatcttatggctccgtgatcaagctcgtgggccaatcaacggtggtgattgcgacacgtggttaaaagacggtgtcgatttctcgaaatgctacgtcatgggttcaagctctggaggaaatattgtctacaacgtggcgttgcgtgtagttgacacagatctttctcctgttaagatccaagggctgataatgaaccaagctttcttcggtggcgttgagccgtcggattctgagtcacggcttaaagacgataagatctgtccgttaccagctactcacttgttgtggtcactttgtttaccggacggtgtagatcgtgaccacgtgtacagtaatccaattaagagcagtgggcctcaggaaaaagataagatgggacgttttccgtcgactcttatcaacggttacggtggggatcctttagtggatcgtcagagacacgtggcggagatgttaaagggacgtggagttcacgtggagacgaggtttgataaagatgggtttcatgcttgtgagttgtttgatgggaacaaagctaaggccctgtacgaaaccgttgaggcctttatgaagagttgttcatcaactggcccatcgtccaactccaacatgtag

SEQ ID NO: 2556 - protein, 329 aa, Arabidopsis thaliana
MEAPPPSSDPYKFLNITLNSDGSLTRHRDFPKLPPTEQSKDIPLNQTNNTFIRIFKPRNIPPESKLPILVYFHGGGFILYSAASAPFHESCTKMADRLQTIILSVEYRLAPEHRLPAAYEDAVEAILWLRDQARGPINGGDCDTWLKDGVDFSKCYVMGSSSGGNIVYNVALRVVDTDLSPVKIQGLIMNQAFFGGVEPSDSESRLKDDKICPLPATHLLWSLCLPDGVDRDHVYSNPIKSSGPQEKDKMGRFPSTLINGYGGDPLVDRQRHVAEMLKGRGVHVETRFDKDGFHACELFDGNKAKALYETVEAFMKSCSSTGPSSNSNM

SEQ ID NO: 2557 - DNA, 942 bp, Arabidopsis thaliana
atgatgaagggtgccaagttttcatctcttcttgtgcttttctttatttttccgatcgcatttgctcaactgagagtcgggttttatagtcaatcatgccctcaagccgagactatcgtacgcaatctggtgcgccaacggtttggtgttaccccaaccgttaccgccgctttgctccgtatgcatttccacgactgtttcgttaagggctgtgacgcttctctcctcattgattcaaccaattccgagaaaactgctggaccaaacggaagcgtcagggaatttgacctgatagaccggatcaaggctcagctagaagctgcatgcccttccacagtctcatgtgctgacatcgtcacattggccacacgtgactcggtggccttagccggaggcccaagctacagcatccccacgggaaggcgtgacggtagggtctcaaacaatcttgatgtaaccttaccgggtccaacgatctccgtctctggagccgtgagtttattcacgaacaaagggatgaacacgttcgatgcagtagctcttttgggtgcacacactgttggtcaaggaaattgtggtctctttagtgacagaatcactagcttccaaggaactggacgaccggacccgtccatggaccccgctttggttaccagcctaaggaacacatgcagaaatagcgcgacggcggcactagaccagtcgagtccattgagattcgacaaccagttcttcaagcaaatccgtaaaaggagaggagtgttgcaagttgaccaacgcctcgcatccgacccacagactcgtgggattgtggctcggtatgctaataacaacgccttcttcaagcgtcagttcgttagagcaatggtgaagatgggagcagttgatgtgcttactggtcgtaacggtgagatcagaaggaactgcaggagattcaactaa

SEQ ID NO: 2558 - protein, 313 aa, Arabidopsis thaliana
MMKGAKFSSLLVLFFIFPIAFAQLRVGFYSQSCPQAETIVRNLVRQRFGVTPTVTAALLRMHFHDCFVKGCDASLLIDSTNSEKTAGPNGSVREFDLIDRIKAQLEAACPSTVSCADIVTLATRDSVALAGGPSYSIPTGRRDGRVSNNLDVTLPGPTISVSGAVSLFTNKGMNTFDAVALLGAHTVGQGNCGLFSDRITSFQGTGRPDPSMDPALVTSLRNTCRNSATAALDQSSPLRFDNQFFKQIRKRRGVLQVDQRLASDPQTRGIVARYANNNAFFKRQFVRAMVKMGAVDVLTGRNGEIRRNCRRFN

SEQ ID NO: 2559 - DNA, 522 bp, Arabidopsis thaliana
atggctgaaacatctgatgtatcgccattgaagcgttacagagaacaagaaaccctagtcgaggaagaaacgaacaaacgacaaaagccaacttcgtcatcatcctctgcctcttacaaccaaattctctgtcttctcaacgattcagacgaacaaaaccaacacaacaatgacctaacttccttcataaacgctcttcagcaagaaatatcatcggatgaccaatacgccgtcgtttcagaaacctccaacgtcgaagactcgttttcttcatgtgtttcctcaaaggaagaagaagtggaagatgacagcaaggagaaagtgatgcagcatcttttggaagcttccgatgacgaacttgggatccctaacacagattttggcgagagtaattatgaaaaggctaatgacggttacgtttatggagatagtttgttagatgggtttggtgatgcgttttgggagcttgaagacgaagctgctaattattacacgttgctgcagtctgagctgttcatgtag

SEQ ID NO: 2560 - protein, 173 aa, Arabidopsis thaliana
MAETSDVSPLKRYREQETLVEEETNKRQKPTSSSSSASYNQILCLLNDSDEQNQHNNDLTSFINALQQEISSDDQYAVVSETSNVEDSFSSCVSSKEEEVEDDSKEKVMQHLLEASDDELGIPNTDFGESNYEKANDGYVYGDSLLDGFGDAFWELEDEAANYYTLLQSELFM

SEQ ID NO: 2561 - DNA, 939 bp, Arabidopsis thaliana
atgtccgctaattctcatcctcctaattccaaaaacgtcctctgtaatgcagccgccggtgccgccgccggggttgttgcggctacgtttgtgtgtcctcttgatgttataaaaacgaggtttcaggttcatgggctgcctaagctcggtgatgcaaacatcaaaggtagtctaattgttggcagtcttgagcagatcttcaagagagaagggatgcgtggcttataccgcggtctttcccctactgtcatggctcttctctccaattgggccatttattttacaatgtatgaccagctcaagagctttctttgttcaaatgatcacaaactcagcgttggagctaacgtattggctgcttcgggagctggagctgcaactaccattgccacaaatcctctttgggtcgtcaagactagacttcagacacaaggaatgagagtgggtatagtgccatacaaaagcacattttctgctttaaggagaatagcttatgaggagggaattcgcggattgtacagtggtcttgtccctgcactagctggtatcagtcatgttgccattcagtttcccacatatgagatgatcaaagtgtacttggccaagaaaggtgataaatcagtcgataacctcaatgctcgtgatgtagcagttgcctcttcgattgcaaagatatttgcatccacattaacttacccgcacgaggtagtacgagctaggcttcaagagcaagggcaccacagtgagaaacgttactcaggagtaagagattgcatcaagaaagtgtttgagaaagatgggttccctggtttttacagaggctgcgccacgaatctactgagaacaactcctgcagcagttataactttcactagcttcgaaatggtgcatcgtttcctcgtcactcatataccttctgagcaaagctctatactttaa

SEQ ID NO: 2562 - protein, 312 aa, Arabidopsis thaliana
MSANSHPPNSKNVLCNAAAGAAAGVVAATFVCPLDVIKTRFQVHGLPKLGDANIKGSLIVGSLEQIFKREGMRGLYRGLSPTVMALLSNWAIYFTMYDQLKSFLCSNDHKLSVGANVLAASGAGAATTIATNPLWVVKTRLQTQGMRVGIVPYKSTFSALRRIAYEEGIRGLYSGLVPALAGISHVAIQFPTYEMIKVYLAKKGDKSVDNLNARDVAVASSIAKIFASTLTYPHEVVRARLQEQGHHSEKRYSGVRDCIKKVFEKDGFPGFYRGCATNLLRTTPAAVITFTSFEMVHRFLVTHIPSEQSSIL

SEQ ID NO: 2563 - DNA, 420 bp, Arabidopsis thaliana
atggctaatgcagcatcaggaatggcagtccatgatgactgcaagctgaaatttatggaattgaagacgaaaaggacacaccgtttcatcatttacaagattgaggagctgcagaaacaagtgattgttgagaaaatcggtgaaccgggtcaaacccatgaggaccttgctgcaagtcttccagctgatgaatgccgctatgccattttcgattttgattttgtcagttctgagggtgtcccaaggagcaggatttttttcgtggcatggtctccggacacagcaagagtgagaagcaagatgatctatgcgagctccaaggacaggttcaagagagaactagacggaattcaggtcgagcttcaggcaaccgatccaaccgagatggatcttgatgttttcaaaagccgagccaattga

SEQ ID NO: 2564 - protein, 139 aa, Arabidopsis thaliana
MANAASGMAVHDDCKLKFMELKTKRTHRFIIYKIEELQKQVIVEKIGEPGQTHEDLAASLPADECRYAIFDFDFVSSEGVPRSRIFFVAWSPDTARVRSKMIYASSKDRFKRELDGIQVELQATDPTEMDLDVFKSRAN

SEQ ID NO: 2565 - DNA, 2286 bp, Arabidopsis thaliana
atggcggagtttggagagcttgaagctcaagatggagtaagaatgccatggaacatcatccccgtcgcaacgaaaaaggaacaatcaatcgattccgaagttccagtttccgccatttacacacctctgaaacctcttagatctcaatcccttctccttccttactctcctctccgttgccggacttgtcgctccgttctaaacccttactccgtcgtagatttctccgcttgtaattggggttgtcctttctgcttcaatcggaatcctttcccgctaaattactcttcagtcgccgataacaatctcccgccggagctttttcctcattccacaactgttgagtatctctgtgattccttctcttctccttctcctcctgttttcctcttcgttgttgatacttgtttgatctctgaagaactcgatttcctcaaatcatctctcttccaagctcttgatcttcttcctgatacctccatccttggtctcattacgtttgattcgttagttcgtgtttacgagcttggattcccacactgtaccaaatcttacttcttccatggaaacaaagactgtactaaagatcagcttttggatcagctgagtttcttcgtcaagaatcctaaaccttcttcaggtgtcattgctggtgctagagatggtctctcttccgacgacattgctcggtttctgttacctgcctctgattgccactttactcttcactctgttcttgaggagctgggaaacagtccctggcccgttgcagctgatcaccgtcctgcgagatgcactggtgttgctctccgtatcgctgctagtctcttaggagcttgctttcctggctctgctgctagaatcatggcttttattggtggaccttccactcaaggccctggagctattgtttctcgggagctttcggatcctattcgttctcataaggatattgataaagattctgctatgtattaccacaaagctgttgaattctatgagatgcttgcgaaacaacttgttcatcaaggtcatgttcttgatgtttttgctagttctgttgatcaggtaggcattgctgagctcaaagttgcagttgagcagactggtggatttgtcgtgcttgctgaaagttttggccactcagtatttagagattctctcaaacgcgtgtgtcagtcaggtgaaaatgatctaggcttgtcctcatgtggtatatttgaaattaactgctcaaaggatatcaaagttcagggaattattggcccttgcgcatctctcgaaaagaaaggaccgttgtgctctgacactgccatcggtcagggacacacaagcgcatggaagatgtgtggcctcgacaacaacacttccatatgtttggtttttgaaattgctaaaatagatacagctgatgttgttttgcagtcgcagagcaatcagttttactttcaatttttgacatactatcagcactcaaatggtcaaacaagactccgggtaacaactctttctagaagatgggtaatgggaactgaaagcttacaggagttgagcaatggttttgaccaagaagcagctgctgtagtaatggcacgacttatttcctccaaaatggagactcagcctgagtttaatccccaaaggtgggtcgataaagcgttgataaatctatgcacctggtttggagattaccagaaaggcaatccttcttcctttagcttatcttctcagttatcaattttcccgcagtttgtgtttcacttgcgccgatctcagtttgtccaggtctttaacaacagcccagacgagacagcatattttcgaatgatattgtacagagagaacgtttctaattcagtcgtgatgattcaaccttcactgatttctttctcattccattcaccgccagagccaattcttcttgatgtagcatccattgcagctgacagaatcttactgttggattcatacttcacccttgtaatatttcacggctctacaatcgctcaatggcgaaaagctggataccataatcaacctgaacaccaggcatttgggcatctgttgcagtcacctcgtgactacgcagacacaatcatgagtgaaaggtttcccactccgcgtcttgttatatgcgatcagtatggttcacaggctcgttttcttctagcaaaactgaatccttgtgatggagatgctcatttttccggccaaagtaatgttttcacggatgatgttagcttgtctgtatttcttgatcatcttagacgactcattgttcattga

SEQ ID NO: 2566 - protein, 761 aa, Arabidopsis thaliana
MAEFGELEAQDGVRMPWNIIPVATKKEQSIDSEVPVSAIYTPLKPLRSQSLLLPYSPLRCRTCRSVLNPYSVVDFSACNWGCPFCFNRNPFPLNYSSVADNNLPPELFPHSTTVEYLCDSFSSPSPPVFLFVVDTCLISEELDFLKSSLFQALDLLPDTSILGLITFDSLVRVYELGFPHCTKSYFFHGNKDCTKDQLLDQLSFFVKNPKPSSGVIAGARDGLSSDDIARFLLPASDCHFTLHSVLEELGNSPWPVAADHRPARCTGVALRIAASLLGACFPGSAARIMAFIGGPSTQGPGAIVSRELSDPIRSHKDIDKDSAMYYHKAVEFYEMLAKQLVHQGHVLDVFASSVDQVGIAELKVAVEQTGGFVVLAESFGHSVFRDSLKRVCQSGENDLGLSSCGIFEINCSKDIKVQGIIGPCASLEKKGPLCSDTAIGQGHTSAWKMCGLDNNTSICLVFEIAKIDTADVVLQSQSNQFYFQFLTYYQHSNGQTRLRVTTLSRRWVMGTESLQELSNGFDQEAAAVVMARLISSKMETQPEFNPQRWVDKALINLCTWFGDYQKGNPSSFSLSSQLSIFPQFVFHLRRSQFVQVFNNSPDETAYFRMILYRENVSNSVVMIQPSLISFSFHSPPEPILLDVASIAADRILLLDSYFTLVIFHGSTIAQWRKAGYHNQPEHQAFGHLLQSPRDYADTIMSERFPTPRLVICDQYGSQARFLLAKLNPCDGDAHFSGQSNVFTDDVSLSVFLDHLRRLIVH

SEQ ID NO: 2567 - DNA, 429 bp, Arabidopsis thaliana
atgggagtagtactgatcgatggatcaacggtacgatcttttgtagacgacgaagagcaattcaaaaaaagcgtcgacgagaggttcgcagctctggatctgaacaaagacggcgttttatcgcgatcggagctacgaaaagcgtttgaatcgatgaggctacttgaatcgcactttggcgttgatgtggtgactcctcaggacgagctgacgaacctctacgattcgatcttcgagaaattcgatacggatcaaagcggttctgtggatctggaggagtttagatcggagatgaagaagatcgtgcttgcgattgctgatgggcttggatcttgtccgattacgatggtgttagatgatgatgatgataatttcttgaaaaaagctgcggatttggaagcttccaagcttgagaaagcttcttcgtaa

SEQ ID NO: 2568 - protein, 142 aa, Arabidopsis thaliana
MGVVLIDGSTVRSFVDDEEQFKKSVDERFAALDLNKDGVLSRSELRKAFESMRLLESHFGVDVVTPQDELTNLYDSIFEKFDTDQSGSVDLEEFRSEMKKIVLAIADGLGSCPITMVLDDDDDNFLKKAADLEASKLEKASS

SEQ ID NO: 2569 - DNA, 885 bp, Arabidopsis thaliana
atgatggacctaacgaaactgaagcctccacagatcactttttattgctcggcgttttccgtcttgctcacacttcatttcacgatacagcttgtatcgcagcatctcttccactggaagaaccctaaggaacaaaaggctatactcatcattgtgcttatggctcctatctacgccgttgtttcctttattggtttgttagaagtcaaaggaagtgaaaccttcttcctctttcttgaatccatcaaagaatgctacgaagctcttgtcattgccaaattcttggcattgatgtatagttatctaaacatatctatgagcaaaaacattttgcctgatggaatcaaaggaagagagattcaccattctttcccaatgactctttttcagcctcatgtagtccgtttggatcgtcacactcttaaacttttgaaatactggacatggcaatttgtggtcattcgacccgtgtgctccactttgatgatagctttacagctcatcgggttttatccttcatggttgagctggacattcactatcattgtcaatttctcggtttctctggccttgtattctcttgtgatattctaccatgtgtttgctaaggagcttgctcctcataatccactcgcaaagttcctctgcatcaaaggaattgtcttctttgtcttttggcagggaatagcactagacatactggtggcaatgggattcataaaatctcaccatttctggttggaggtagaacaaatccaagaagcaattcagaatgtgttggtatgtcttgagatggttatcttcgctgcggttcagaaacacgcttatcatgctggtccttatagcggcgagaccaagaagaaactcgataaaaagaccgaatga

SEQ ID NO: 2570 - protein, 294 aa, Arabidopsis thaliana
MMDLTKLKPPQITFYCSAFSVLLTLHFTIQLVSQHLFHWKNPKEQKAILIIVLMAPIYAVVSFIGLLEVKGSETFFLFLESIKECYEALVIAKFLALMYSYLNISMSKNILPDGIKGREIHHSFPMTLFQPHVVRLDRHTLKLLKYWTWQFVVIRPVCSTLMIALQLIGFYPSWLSWTFTIIVNFSVSLALYSLVIFYHVFAKELAPHNPLAKFLCIKGIVFFVFWQGIALDILVAMGFIKSHHFWLEVEQIQEAIQNVLVCLEMVIFAAVQKHAYHAGPYSGETKKKLDKKTE

SEQ ID NO: 2571 - DNA, 303 bp, Arabidopsis thaliana
atggaattcaccgcagagcagctaagccaatacaacggcaccgacgaatcaaagccgatctacgtcgcaatcaaaggccgtgtgttcgatgtcaccaccggaaaatccttctacggctccggaggcgattactcgatgttcgccggaaaagacgcgagcagagctttgggtaagatgagtaagaacgaagaagatgtgtctccttctcttgaaggtctcactgagaaagagatcaatactcttaatgattgggagaccaaatttgaagctaagtatcctgtcgttggccgtgttgtctcttag

SEQ ID NO: 2572 - protein, 100 aa, Arabidopsis thaliana
MEFTAEQLSQYNGTDESKPIYVAIKGRVFDVTTGKSFYGSGGDYSMFAGKDASRALGKMSKNEEDVSPSLEGLTEKEINTLNDWETKFEAKYPVVGRVVS

SEQ ID NO: 2573 - DNA, 372 bp, Arabidopsis thaliana
atggctggtcttatgaagttaggatgcttggtctttgtcttcgtgattgcggccggtccaatcacagcaaaggcggctctgagctgtggcgaagttaacagcaatttgaaaccgtgcactggctacttgaccaatggtggtatcactagcccaggcccacagtgctgcaatggtgttagaaagcttaacggcatggtccttacaaccctagaccgtcggcaagcatgtcgttgcattaaaaatgccgctagaaacgtcggccctggtctcaacgctgaccgtgctgctgggattcctaggagatgcggaatcaaaataccttacagtacccaaatcaggttcaacaccaagtgcaacacgtacatatgttaa

SEQ ID NO: 2574 - protein, 123 aa, Arabidopsis thaliana
MAGLMKLGCLVFVFVIAAGPITAKAALSCGEVNSNLKPCTGYLTNGGITSPGPQCCNGVRKLNGMVLTTLDRRQACRCIKNAARNVGPGLNADRAAGIPRRCGIKIPYSTQIRFNTKCNTYIC

SEQ ID NO: 2575 - DNA, 864 bp, Arabidopsis thaliana
atggcttcatctgcatttgcgtttccttcttacataataaccaaaggagcctcaacagattctttcaaatcaacttctctgtcttcttctcgatctttggttacagatttccatcttttgttctccagacccatctcttccggtcctaaataccaatctgccaagtccgctaaaccggaatctccagtcgccataaactgcttaaccgatgccaaacaggtttgtgcagttgggaggaggaagagcatgatgatgggcttgctcatgtctggtttaatagtttcacaagccaatcttccaacagcatttgcttcaactccagtgtttagagaatacatagatacatttgatggatactccttcaagtaccctcaaaattggatccaagtccgaggagctggtgctgatatattctttagagaccctgttgtcctcgacgagaacctttcagtcgagttttcttcgccttcttcctcaaattacacgtcacttgaagacttgggatcccctgaagaagtaggaaagagagtacttagacagtacttgactgagtttatgtccactagactcggggttaagcgccaggccaacattctaagcacttcctctagagttgcagatgatggtaaactctactaccaagttgaggtgaacataaagtcatacgcaaacaacaacgagctagctgtgatgccacaagatcgagtggctcgtttggaatggaaccggcgctaccttgcagttctaggagttgagaacgatagactctattcaattagactccaaacacccgagaaagttttcctggaagaagaaaaagatctaagaagagtcatggattcgtttagggtcgagaagatttag

SEQ ID NO: 2576 - protein, 287 aa, Arabidopsis thaliana
MASSAFAFPSYIITKGASTDSFKSTSLSSSRSLVTDFHLLFSRPISSGPKYQSAKSAKPESPVAINCLTDAKQVCAVGRRKSMMMGLLMSGLIVSQANLPTAFASTPVFREYIDTFDGYSFKYPQNWIQVRGAGADIFFRDPVVLDENLSVEFSSPSSSNYTSLEDLGSPEEVGKRVLRQYLTEFMSTRLGVKRQANILSTSSRVADDGKLYYQVEVNIKSYANNNELAVMPQDRVARLEWNRRYLAVLGVENDRLYSIRLQTPEKVFLEEEKDLRRVMDSFRVEKI

SEQ ID NO: 2577 - DNA, 2820 bp, Arabidopsis thaliana
atggggtttgttgttgctgcttccattgcagcagttactgttaagcggctcaacgttaaaccctccaaaccaagcaaaccatcagataatggcgaaggaggcgacaaagaacagtctgtggatcccgactacaatctcaatgacaagaataaagagaggaaatatgaagtcgagatggcttataacgatggtgagctcgaacggttaaagcaattagttaaggagctagaagaaagagaagtgaaacttgaaggtgaattactcgagtattatggacttaaagagcaagaatcagatatcgttgagttacaaagacagctcaagatcaagactgttgagattgatatgttaaacatcactattaattctctgcaagctgagagaaaaaagcttcaagaagagctctcacaaaacggtattgtaagaaaggagcttgaagtggcgagaaacaagatcaaggagttgcagaggcaaatccaactcgatgctaaccagacgaaaggacagttactgttgcttaagcagcatgtatcaagtcttcaaatgaaagaagaagaagctatgaataaagatactgaagttgagaggaagcttaaagctgtacaggatttggaagtgcaagttatggaactcaagagaaaaaatagagagcttcaacatgagaagagagagttatccattaaactcgattcagcggaagcaagaattgcaactctttcaaacatgactgagagcgataaagtggcgaaagttagagaagaggttaacaatttgaagcataacaatgaggatttgttaaagcaagtggaagggcttcaaatgaataggtttagtgaagttgaggaattggtttatctacgttgggtcaatgcatgtttacggtatgagttaagaaactaccagacaccagctggtaaaatctcagctcgtgacttaagcaagaacctaagccccaagtcccaagcaaaagcaaaacggttaatgttagagtatgctggttcagagcgtggccaaggagataccgacttagaaagcaactattctcaaccttcatctccgggaagcgatgatttcgataatgcttcaatggatagttccacaagtaggtttagtagttttagcaagaagccaggattgattcagaaacttaagaaatggggcaaaagcaaggatgattcaagcgttcaatcatcgccttcaagatcattttacggaggatcaccgggaagacttagctcgagtatgaataaacagagaggtcctttagaatctttgatgattagaaacgctggtgaatccgtagccataacaacatttggtcaagtggatcaagaatctcctggtacccctgaaacaccgaatcttccaagaatcagaacacaacaacaagcttcttctccgggtgagggtttgaattccgttgcagcatcgttccacgtgatgtctaaatcggttgacaatgttttggatgagaagtatcctgcgtacaaagacaggcataagttggcagttgaaagagagaagcacattaagcataaagcagatcaagcaagagcagagagatttggcggtaatgtggctttgcctcctaaacttgctcaactaaaggagaaaagggttgttgttccctctgtgatcacagccacaggtgatcagtctaacgagtcaaatgaatctaacgaaggtaaagccagcgaaaacgctgcaaccgtaaccaaaatgaagcttgtagacattgagaaacgacctcctagagtacctcgcccgcctccaagatcagctggaggtggtaaaagtactaacttgccttcagcaagacctcctttacctggtggtggtccaccaccacctcctccaccacctggcggtggaccgcctcctccacctggcggtggaccacctccaccaccacctcctcctggagcacttggaagaggagcgggaggcgggaacaaagttcaccgagctcctgagcttgttgagttttatcaatcattgatgaaacgtgaatcgaagaaagaaggtgcaccttctttgatctcttcaggaactggtaattcttcagcagctaggaacaatatgattggggaaatcgagaaccgatcaacattcctcttagcagtaaaagcggatgtggagacacaaggggactttgtacagtcgttagcaactgaagtccgagcttcttctttcaccgacatagaagatctcttggcgttcgttagctggctagatgaagagctctccttcttggttgatgaaagggcagttcttaaacactttgactggccagaaggtaaagctgatgcgctacgagaagcagcttttgaatatcaagatcttatgaaactggagaagcaagttacgtcctttgttgatgatcctaatctctcttgtgaacctgctttgaagaagatgtacaagttgctagagaaggttgaacaaagtgtatacgcgcttttacgtacgagagacatggcgatttcacgatataaagaattcgggattccagttgattggttatctgatactggcgtcgtaggaaagatcaagctttcgtcagtccagctcgcgaagaagtacatgaaacgagtagcttatgagctagattcagtgagcggatccgataaagatccgaacagagagttcttgcttctccaaggtgttcgtttcgcgtttagagtccatcagtttgctggagggtttgatgcagagagcatgaaagcatttgaggaacttagaagcagagccaaaactgaaagtggagacaataataataataataataataatagcaatgaagaagaatctgtaaactga

SEQ ID NO: 2578 - protein, 939 aa, Arabidopsis thaliana
MGFVVAASIAAVTVKRLNVKPSKPSKPSDNGEGGDKEQSVDPDYNLNDKNKERKYEVEMAYNDGELERLKQLVKELEEREVKLEGELLEYYGLKEQESDIVELQRQLKIKTVEIDMLNITINSLQAERKKLQEELSQNGIVRKELEVARNKIKELQRQIQLDANQTKGQLLLLKQHVSSLQMKEEEAMNKDTEVERKLKAVQDLEVQVMELKRKNRELQHEKRELSIKLDSAEARIATLSNMTESDKVAKVREEVNNLKHNNEDLLKQVEGLQMNRFSEVEELVYLRWVNACLRYELRNYQTPAGKISARDLSKNLSPKSQAKAKRLMLEYAGSERGQGDTDLESNYSQPSSPGSDDFDNASMDSSTSRFSSFSKKPGLIQKLKKWGKSKDDSSVQSSPSRSFYGGSPGRLSSSMNKQRGPLESLMIRNAGESVAITTFGQVDQESPGTPETPNLPRIRTQQQASSPGEGLNSVAASFHVMSKSVDNVLDEKYPAYKDRHKLAVEREKHIKHKADQARAERFGGNVALPPKLAQLKEKRVVVPSVITATGDQSNESNESNEGKASENAATVTKMKLVDIEKRPPRVPRPPPRSAGGGKSTNLPSARPPLPGGGPPPPPPPPGGGPPPPPGGGPPPPPPPPGALGRGAGGGNKVHRAPELVEFYQSLMKRESKKEGAPSLISSGTGNSSAARNNMIGEIENRSTFLLAVKADVETQGDFVQSLATEVRASSFTDIEDLLAFVSWLDEELSFLVDERAVLKHFDWPEGKADALREAAFEYQDLMKLEKQVTSFVDDPNLSCEPALKKMYKLLEKVEQSVYALLRTRDMAISRYKEFGIPVDWLSDTGVVGKIKLSSVQLAKKYMKRVAYELDSVSGSDKDPNREFLLLQGVRFAFRVHQFAGGFDAESMKAFEELRSRAKTESGDNNNNNNNNSNEEESVN

SEQ ID NO: 2579 - DNA, 402 bp, Arabidopsis thaliana
atggcggaaaaagctgtcactatcaggaccagaaacttcatgaccaacaggcttctcgccagaaagcaattcgttattgatgttcttcatcctggaagagccaatgtttcaaaggctgagcttaaggagaaattggcgaggatgtatgaggttaaggacccaaatgctatcttctgtttcaagttcagaactcactttggaggtggtaaatcttctggatatggtttgatctatgatactgtcgagaacgctaagaagtttgagcctaagtacagacttatcaggaatggacttgacaccaagattgagaaatcaaggaaacagatcaaggagaggaagaacagggcgaagaagatccgtggtgttaagaagaccaaggctggtgataccaagaagaagtaa

SEQ ID NO: 2580 - protein, 133 aa, Arabidopsis thaliana
MAEKAVTIRTRNFMTNRLLARKQFVIDVLHPGRANVSKAELKEKLARMYEVKDPNAIFCFKFRTHFGGGKSSGYGLIYDTVENAKKFEPKYRLIRNGLDTKIEKSRKQIKERKNRAKKIRGVKKTKAGDTKKK

SEQ ID NO: 2581 - DNA, 297 bp, Arabidopsis thaliana
atggctatcagaatttctcgagtgctgcaatcatcaaagcaacttctaaaatcgttgtcacactcatcaaacaatgtcgctattcctaaaggacaccttgcggtttacgtaggagagatgatgcagaagaggagattcgtggttccagtgacatacttaagtcacccttgttttcaaaagcttctaagaaaagcagaagaagagtttgggtttgatcacccaatgggtggcctcactattccctgcactgaacaaatcttcatcgatctcgcctctcgccttagcacttcatcgtga

SEQ ID NO: 2582 - protein, 98 aa, Arabidopsis thaliana
MAIRISRVLQSSKQLLKSLSHSSNNVAIPKGHLAVYVGEMMQKRRFVVPVTYLSHPCFQKLLRKAEEEFGFDHPMGGLTIPCTEQIFIDLASRLSTSS

SEQ ID NO: 2583 - DNA, 1008 bp, Arabidopsis thaliana
atgacgtctgacggagcaacgtcgacgtcagctgcagctgcagcagcagcgatggcgacgaggaggaaaccgtcgtggagagagagggagaacaatcggagaagagagcggcggagaagagctgttgcggcgaagatttatactggtcttagagctcaaggtaactacaatcttccaaaacattgtgacaacaatgaggttcttaaggctctttgttctgaagctggttgggttgttgaagaagacggaactacttatcgcaagggacacaagcctctacctggtgacatggctggatcatcttctcgagcaactccttactcttcccataaccaaagtcctctttcttccacttttgatagccccatcttatcttaccaagtcagtccttcctcttcttcattcccgagtccttctcgagttggtgatccacacaatatctccacaatcttccctttcctcaggaatggtggtattccttcatcgcttcctccacttagaatctcaaacagtgctcctgtcactccaccagtgtcatccccaacttctagaaaccccaaaccattgcctacttgggaatcttttaccaaacaatccatgtccatggctgctaaacagtcaatgacttctttgaactacccgttttatgcggtgtctgcacctgccagtcctactcatcatcgccagttccatgctccggctactatacctgaatgtgatgagtctgactcttccactgttgattctggtcattggataagctttcaaaagtttgcacaacaacagccattctctgcctctatggtgccaacctcgcctaccttcaatctcgtgaaacctgcaccacagcaattgtctccaaacacagcagcaatccaagagattggtcaaagctccgagtttaagtttgagaacagccaagttaagccatgggaaggggagaggatccatgatgtggctatggaggatctagagctcacgcttggaaatggtaaagctcatagttga

SEQ ID NO: 2584 - protein, 335 aa, Arabidopsis thaliana
MTSDGATSTSAAAAAAAMATRRKPSWRERENNRRRERRRRAVAAKIYTGLRAQGNYNLPKHCDNNEVLKALCSEAGWVVEEDGTTYRKGHKPLPGDMAGSSSRATPYSSHNQSPLSSTFDSPILSYQVSPSSSSFPSPSRVGDPHNISTIFPFLRNGGIPSSLPPLRISNSAPVTPPVSSPTSRNPKPLPTWESFTKQSMSMAAKQSMTSLNYPFYAVSAPASPTHHRQFHAPATIPECDESDSSTVDSGHWISFQKFAQQQPFSASMVPTSPTFNLVKPAPQQLSPNTAAIQEIGQSSEFKFENSQVKPWEGERIHDVAMEDLELTLGNGKAHS

SEQ ID NO: 2585 - DNA, 615 bp, Arabidopsis thaliana
atgtcaagtcttcttaatatatctcactgtagctatcatggatactcaggactcactagtaggggaggcataaacactgttgaaaaccatagatgggtctggcacaacaacggagtcaggttgtcgtttccaagagccgagtcttctataaacatcactatgggttgtacgcttcagcgtgggatagcaaaaagcttaagtcaggaaaacctagtggagttatctgatgaaaatgatgatctatgtcctgtggagtgtgtcactgagttcaagacagatgatgaattgcttagcgttcttgaaaagtcgaaagaaactaattctttggttgtggttgatttttatcgcactgcatgtgggagttgtaaatacatagagcagggcttctcaaaactgtgcaagcaatctggtgaccaagaagctcctgttatcttccttaagcataatgtggtagatgaatatgatgaacaatctgaagtcgcagaaaggctccgtatcaaggcggttcctctcttccacttctacaaaaacggagttctcttagaatcatttgcaactagagacaaggagaggatcgacgcagctattctcaaatatacatcctcggaatcttga

SEQ ID NO: 2586 - protein, 204 aa, Arabidopsis thaliana
MSSLLNISHCSYHGYSGLTSRGGINTVENHRWVWHNNGVRLSFPRAESSINITMGCTLQRGIAKSLSQENLVELSDENDDLCPVECVTEFKTDDELLSVLEKSKETNSLVVVDFYRTACGSCKYIEQGFSKLCKQSGDQEAPVIFLKHNVVDEYDEQSEVAERLRIKAVPLFHFYKNGVLLESFATRDKERIDAAILKYTSSES

SEQ ID NO: 2587 - DNA, 597 bp, Arabidopsis thaliana
atggcgatggcaacatcgatgagtttgaatctaattggggcattcaaaggcttgtctctttcttcgacttcgtcttttcttagaggcgatttgagtttttcccccaaaacctctttcacggtgactcttcctctggaaaatcttcaagctccgattccgttgacaattgaatcggcccataagaaaggagctggtagcaccaagaacggtcgtgattctcctgggcaacgactcggcgtcaagatctacggtgaccaagttgctaaacctggtgctatcattgttcgtcaacgtggcactaagttccatgctgggaaaaatgttgggattggtaaagatcataccatcttctctttaatcgatggattagtcaagttcgagaagtttggtcctgacaggaagaagataagtgtgtatccaagagaaattgtaccagagaatcccaatagctacagagcaagaaagagagaaaacttcagattgcaaagggagaagaagaaggcgagacgcgagaattactcgtacacacttcctacaccagaacttgttcttgcatctgcctcagtcgatgatgctgaagccaatccggagtgctag

SEQ ID NO: 2588 - protein, 198 aa, Arabidopsis thaliana
MAMATSMSLNLIGAFKGLSLSSTSSFLRGDLSFSPKTSFTVTLPLENLQAPIPLTIESAHKKGAGSTKNGRDSPGQRLGVKIYGDQVAKPGAIIVRQRGTKFHAGKNVGIGKDHTIFSLIDGLVKFEKFGPDRKKISVYPREIVPENPNSYRARKRENFRLQREKKKARRENYSYTLPTPELVLASASVDDAEANPEC

SEQ ID NO: 2589 - DNA, 198 bp, Arabidopsis thaliana
atgccggtcatggagaaattgaggatgttcgtggcgcaggaaccagttgtggctgcttcttgcttaatcggcggtgttggactatttttgcctgcggttgtgaggcctattctagactctctcgaggcttccaaacaagttaaagctcctccacttaccgatgtgattgctggtgtcacagggaagaaacagagttaa

SEQ ID NO: 2590 - protein, 65 aa, Arabidopsis thaliana
MPVMEKLRMFVAQEPVVAASCLIGGVGLFLPAVVRPILDSLEASKQVKAPPLTDVIAGVTGKKQS

SEQ ID NO: 2591 - DNA, 1398 bp, Arabidopsis thaliana
atggcttccatgtccaccgtcttccccaaaccaacctctttcatctctcaacctctaacaaaatctcacaaatccgattccgtaaccacatccatttcattcccttcgaattcgaaaactcgtagcttaagaaccatctctgtacgagctggcttaatcgagccagatggtgggaaacttgtggatcttgttgtaccggaaccgagacggcgagagaagaaacacgaagcggcggatttgccgagagtgagattgacggcgattgatttgcaatggatgcatgtgttgagtgaaggttgggctagtcctcttcgtgggtttatgagggaatctgagttcctccaaactcttcatttcaatttgttgaatctcgatgatgggtctgttgttaatatgtctgtgcctattgttcttgcgattgatgatcaacaaaaagccctaatcggtgaatctaaacgtgtctcccttgttgattctgatgataatccaatcgctattctcaatgatattgagatttataaacatccgaaagaagagcgaatagcgagaacttggggtacgactgcaccgggtttgccttatgtagaagaggcgataaccaatgctggagactggctcattgggggtgatcttgaggttttggaacctgttaagtacaatgatgggcttgatcgtttcaggctttccccgtttgaactgcgtaaggagctagagaaacgtggtgcggatgcggtctttgcgtttcagcttaggaacccagttcataatggacatgctcttcttatgactgatactcgtaggagacttcttgagatgggttataaaaaccctatccttttgcttcatccattgggagggtttacaaaagctgatgatgttcctctaagctggcgaatgaaacagcacgagaaggtgctagaggatggtgttcttgatccagagactactgtggtttccatattcccatctccaatgctctatgctggtccaaccgaagtccaatggcacgcaaaggctaggatcaatgctggtgctaacttctacattgtcggtagggatccggctggaatgggtcatcccgtggagaaacgtgatctgtacgatgctgatcacgggaagaaagttctaagcatggctcctggactcgaacgactcaacattcttcctttcagggttgctgcgtacgataagacacaaggaaagatggctttctttgatccctcaagggctcaggacttcttgttcatttctggcactaagatgagagcattggcaaagaacagagagaacccaccagatggatttatgtgccctggaggctggaaagtccttgtggattactacgacagtttgacactaaccggaaacaccaaacttccggaaaagattccggtttaa

SEQ ID NO: 2592 - protein, 465 aa, Arabidopsis thaliana
MASMSTVFPKPTSFISQPLTKSHKSDSVTTSISFPSNSKTRSLRTISVRAGLIEPDGGKLVDLVVPEPRRREKKHEAADLPRVRLTAIDLQWMHVLSEGWASPLRGFMRESEFLQTLHFNLLNLDDGSVVNMSVPIVLAIDDQQKALIGESKRVSLVDSDDNPIAILNDIEIYKHPKEERIARTWGTTAPGLPYVEEAITNAGDWLIGGDLEVLEPVKYNDGLDRFRLSPFELRKELEKRGADAVFAFQLRNPVHNGHALLMTDTRRRLLEMGYKNPILLLHPLGGFTKADDVPLSWRMKQHEKVLEDGVLDPETTVVSIFPSPMLYAGPTEVQWHAKARINAGANFYIVGRDPAGMGHPVEKRDLYDADHGKKVLSMAPGLERLNILPFRVAAYDKTQGKMAFFDPSRAQDFLFISGTKMRALAKNRENPPDGFMCPGGWKVLVDYYDSLTLTGNTKLPEKIPV

SEQ ID NO: 2593 - DNA, 1926 bp, Arabidopsis thaliana
atggaaggaacttgttttctccgtggacaacctctcacaacaataccctctcttcccagcagaaaagggtttcttctccaaagatggaagaccaatcggattgtcaggttttcaggttttaagaatcactcggtttctggaaagtcgaggtctttcgatcttagcctcagagcttcaggtcccattagagcaagctctgtagtaacagaagcaagccctaccaacttaaattccaaagaagaagaccttgtctttgtagccggtgctactggtaaagttggttctagaactgtgagagagctactgaagctgggatttcgggttagagctggagttcgaagtgctcagagagcaggaagtcttgtgcaaagtgttaaggaaatgaagctccagaacacagatgaaggaactcaacctgtagaaaagcttgaaattgtggagtgtgacttggagaagaaagattcaatacagcccgcattgggaaatgcatcggtgattatatgctgtattggtgctagcgagaaagagatctccgatattaccggtccttacaggatcgattacctagccaccaaaaaccttgttgatgctgcaacatcagcaaaagttaataacttcattttggtgacatccttggggacaaataaatttggatttcccgctgcgattctcaacctattctggggagttctttgctggaagagaaaagctgaagaagcattgattgaaagcggtcttaattacgcaatagttagacctggaggaatggagagaccgactgatgcatacaaagaaactcataatctcactcttgctctagacgatacattgtttggtggtcaggtctcaaatctccaggttgcagagttgcttgcttgcatggcaaagaatcctcaactttctttctctaagattgtggaagtggttgctgaaacaactgcaccattaactccaattgaaaagcttcttgaaaagattccttccaaacggccttatgtccctccaccgaaggcatcagttgcaaccaaagaggtcaaaccagtccctactaagcctgtcactcaagaaccaacagctcctaaagaggatgaagcacctccaaaagaaaaaaatgtgaaacctaggccgctgtctccttatgcctcctacgaagacttgaaacctccaacatctcctattccaaattcgaccacatcggtcagtcctgccaaatctaaggaggtagatgccactcaggttcctgttgaggccaatgtagtgccagtgccagatagtacctcaaatgtcccagtagtagaagtaaagcaagttgaggaaaagaaagagaggcctctttccccttatgcccgctatgagaacctaaaaccaccctcatcgccctctcctacagcttcgagtaccagaaagagtgattctttgtcgcctggtccaaccgattctgatactgataaaagctcaacagttgcaaaaactgtcactgagacggcagttgcaacaagtgtcactgagacctcagttgcaacaagtgtacctgagacagcagttgcaacgagtgtcactgagacagcagcaccagccacatcaaaaatgaggcctctttctccttatgcaatttacgcagacctgaaaccaccaacctcaccaactcctgcatcaacaggtcccaaggaagcagcatctgtagaagacaactcagagttacctggaggcaataatgatgtgctgaaaacagttgatggaaatctgaacacaattccaccttctacaccggaagcagtacctgttgttagcagtgcgatagacacttcccttgcttcaggagacaatacagctcagccaaagccaaggcctttatcaccttacacaatgtacgcggacatgaagcctccaacatcaccacttccatctccagtcaccaatcattag

SEQ ID NO: 2594 - protein, 641 aa, Arabidopsis thaliana
MEGTCFLRGQPLTTIPSLPSRKGFLLQRWKTNRIVRFSGFKNHSVSGKSRSFDLSLRASGPIRASSVVTEASPTNLNSKEEDLVFVAGATGKVGSRTVRELLKLGFRVRAGVRSAQRAGSLVQSVKEMKLQNTDEGTQPVEKLEIVECDLEKKDSIQPALGNASVIICCIGASEKEISDITGPYRIDYLATKNLVDAATSAKVNNFILVTSLGTNKFGFPAAILNLFWGVLCWKRKAEEALIESGLNYAIVRPGGMERPTDAYKETHNLTLALDDTLFGGQVSNLQVAELLACMAKNPQLSFSKIVEVVAETTAPLTPIEKLLEKIPSKRPYVPPPKASVATKEVKPVPTKPVTQEPTAPKEDEAPPKEKNVKPRPLSPYASYEDLKPPTSPIPNSTTSVSPAKSKEVDATQVPVEANVVPVPDSTSNVPVVEVKQVEEKKERPLSPYARYENLKPPSSPSPTASSTRKSDSLSPGPTDSDTDKSSTVAKTVTETAVATSVTETSVATSVPETAVATSVTETAAPATSKMRPLSPYAIYADLKPPTSPTPASTGPKEAASVEDNSELPGGNNDVLKTVDGNLNTIPPSTPEAVPVVSSAIDTSLASGDNTAQPKPRPLSPYTMYADMKPPTSPLPSPVTNH

SEQ ID NO: 2595 - DNA, 1989 bp, Arabidopsis thaliana
atggtttataacatgagtgaagcttttgtagcgagtgatgagggactgacatatgtagaaaatggagaagatgtgttccctgttgaagctgttgcagcagatgtttctcctgttgaagctgttgtaccagatgtttcccccattgaatgcctttctgctgagactttaaccgataagaccagtagccttatagactctgttgaatcgggaaccaatgcgactgttaaaatatctccggatagttcagtctcacttcctgatgcgaaagctagctttgatgacttttcttctgggctcaagcagtccttcagctcttcacttcctgatgcgaaagctagcgttgatgacttttcttctggggtcaaggagtccttcagctcttcacttaaccaaggagaaaatgctgtaaagaacactttggagtccttctcctcgtctgtgacatccattacaaagaatgcttctgaagttgtagatagtgcagttaacagagcgttttctacgctagaccaaacgggagatgtagctggagacaagttttcgagtttttctactggcttgaaggaagcttcaaacagagcagctgttattgccattgatctgctgaggcaatcagttagtcttggagagagatctgtaacaaatggagtttcttttgttgtgtactcttatggatcagcaaaagaattacttcctccagatgtaaagagtgcccttaactcgtcagaagatgttgctctaaaagtattgagtcccgtgggagctgtattgcagcaggtatctgttgccattggaggtttggagagaaatatcggtttggatccagatgacccaatccttcacctttttctcttcgtaggcaccacaggaaccttttgggttctatatcgggtttggacatatggtggatatgctggagatttgtctcccaagtcaactctggaccttttaaaatcaagagacaagtcagtgctcatagatgtcaggcctgaagccttgagagagaaagatggaatacctgatctgcggagatcagctcgatttcgatattctagcgtgacactgcctgaggttggttttagcatcctcattgttgttgaccacagcgaatatagaaactctacacatgtaatctatgaacacaacgaggtttcagcaatcagtgcaacagaagttgacggtgatgtcaaacggctactgaaaggtggaagtgaagtagatgatatcttgacagcagtaatcatcaagaacttgaaaatagttcaggacaggtccaaggttgttgttatggatgctgatggaactcgttcaaagggtgggtatagatcatgggtacaggaaggtcttcgtgtgaaagagccaaaacctgagacaacacttaccatcctcaacgaggaagctgaggcgatttttgaggacataaatccctctccattgcaactatttggagttgaatatctcatattctccacaacacacaagctcctcacatccacgttttgcactaacatgattgctctatctctcgcagagtgggagaaaacactgcaactcatagctgtcatcggccttagtctgtttcaaacattatgcagactatatacctacgactttcttcatatgatgactccgaagacttcaaacaagacgtcaggtataaaagcgccatcattagaccctttttccatagcaaaaactcagcgaaacctctgttctgtcttaacaaagattgtttcatcttcttcttcaaggctgttgcttgcacctgtgaaactcggagctcaggctttctcgtgggctgcaggaaaactagaaacaaatggtgttggcctcccaacttcgccttcttcttcagatgttcgaagccgggttttgcaagctgctgctaagcatgaatcgaaaccctctgatgaaacttctgaaagtctccaagatgcatcatcgtcaccagaagaagctttgaacaacgttgatgtctccgaagcgtaa

SEQ ID NO: 2596 - protein, 662 aa, Arabidopsis thaliana
MVYNMSEAFVASDEGLTYVENGEDVFPVEAVAADVSPVEAVVPDVSPIECLSAETLTDKTSSLIDSVESGTNATVKISPDSSVSLPDAKASFDDFSSGLKQSFSSSLPDAKASVDDFSSGVKESFSSSLNQGENAVKNTLESFSSSVTSITKNASEVVDSAVNRAFSTLDQTGDVAGDKFSSFSTGLKEASNRAAVIAIDLLRQSVSLGERSVTNGVSFVVYSYGSAKELLPPDVKSALNSSEDVALKVLSPVGAVLQQVSVAIGGLERNIGLDPDDPILHLFLFVGTTGTFWVLYRVWTYGGYAGDLSPKSTLDLLKSRDKSVLIDVRPEALREKDGIPDLRRSARFRYSSVTLPEVGFSILIVVDHSEYRNSTHVIYEHNEVSAISATEVDGDVKRLLKGGSEVDDILTAVIIKNLKIVQDRSKVVVMDADGTRSKGGYRSWVQEGLRVKEPKPETTLTILNEEAEAIFEDINPSPLQLFGVEYLIFSTTHKLLTSTFCTNMIALSLAEWEKTLQLIAVIGLSLFQTLCRLYTYDFLHMMTPKTSNKTSGIKAPSLDPFSIAKTQRNLCSVLTKIVSSSSSRLLLAPVKLGAQAFSWAAGKLETNGVGLPTSPSSSDVRSRVLQAAAKHESKPSDETSESLQDASSSPEEALNNVDVSEA

SEQ ID NO: 2597 - DNA, 1506 bp, Arabidopsis thaliana
atgtttaactatgtgattattcttcctttagctctcttcctcttggcttacaaattcttctttacatctaaaaagcagcgttactatctccctccctctccatcttactctctcccaatcctcggccaccacctcctcatcaaaccgccggttcaccgtctcttccaccgcctttccaatatccatggcccaatcttctacctccgacttggttcccgccgtgccgtcgtcatatcttcctcctcgctggcaagagaatgcttcacaggtcaaaacgatgtcattgtatcaaaccgccctcgttttctaacctccaaatacattgcttacaactacacaaccatcgcaacaacatcttacggtgaccactggcgtaacctccgccgcatttgctccctcgaaatcgtctcctcaaaacgtctcgccaactttctccacatccgcaaagaggagatccagcgcatgctaacgagactctcacgtgacgcccgtgtcggcaaagaggtcgagctcgagtctatcttgtacgacctaacgttcaacaatatcgtgaggatggttacagggaagatatactacggcgacgatgtcagcgacaaagaagaagcagagttgttcaagaagctttttactttcatcaccactaatagtggcgcgaggcatcctggagaatacttgcccttcatgaagatattcggagggagctttgagaaggaggtgaaagctgcagcaaaagtcatcgatgaaatgttgcagcgtctgcttgacgagtgcaagagtgataaagacggtaacactatggttaatcacttgctctctttgcaacaggacgaccctgagtactacactgacatcattatcaaaggcttaatgctgggtataatggttgcctcatcagagacctccgctttgacaatagagtgggcgatggcgagtttgttgaaccacccaaaagttttggacaaagtaaaattagagatcgacgagataatcggacaagaccgtttgatcgaagaatcagacatagcaaaccttccttacctccaaaacgtagtatccgagacactccggctacatccagcagcgccggttcttgtgccaagatcaacagcagaagacatcaagatcggaggatacgatgtgccacgtgacacaatggtaatggtgaacgcgtgggcgatacatagagatccagatctttggaccgaaccggagaggtttaaccctgagaggttcaacggtggagaaggagaaaaagatgatgttcgtatgctgatagcgtttggaagcggacggagaatatgtcccggtgttggactagcgcacaagattgtgacattagcgttaggatcgttaattcaatgctttgattggaaaaaggtgaacgaaaaagagattgatatgagtgagggtccggggatggctatgcgtatgatggtgccgttacgagccttgtgtaagactcgacccataatgaataagctcccggcctacacgaaagtttag

SEQ ID NO: 2598 - protein, 501 aa, Arabidopsis thaliana
MFNYVIILPLALFLLAYKFFFTSKKQRYYLPPSPSYSLPILGHHLLIKPPVHRLFHRLSNIHGPIFYLRLGSRRAVVISSSSLARECFTGQNDVIVSNRPRFLTSKYIAYNYTTIATTSYGDHWRNLRRICSLEIVSSKRLANFLHIRKEEIQRMLTRLSRDARVGKEVELESILYDLTFNNIVRMVTGKIYYGDDVSDKEEAELFKKLFTFITTNSGARHPGEYLPFMKIFGGSFEKEVKAAAKVIDEMLQRLLDECKSDKDGNTMVNHLLSLQQDDPEYYTDIIIKGLMLGIMVASSETSALTIEWAMASLLNHPKVLDKVKLEIDEIIGQDRLIEESDIANLPYLQNVVSETLRLHPAAPVLVPRSTAEDIKIGGYDVPRDTMVMVNAWAIHRDPDLWTEPERFNPERFNGGEGEKDDVRMLIAFGSGRRICPGVGLAHKIVTLALGSLIQCFDWKKVNEKEIDMSEGPGMAMRMMVPLRALCKTRPIMNKLPAYTKV

SEQ ID NO: 2599 - DNA, 1506 bp, Arabidopsis thaliana
atgaattcagaatcgctagaaaatcttcaccgtccattaatcgaatcatcgaagtcgttcgtcgattatcgtctcgagactgtgttaacagatcgagagttaccgtattttcgccggatttatctagcgatgatgattgagatgaagtttctctttcatctggcggctccggcgatctttgtttacgtcatcaacaacggcatgtcaattcttacacgtatcttcgctggacacgtaggaagcttcgaactcgccgccgcttcacttggaaacagtggtttcaacatgttcacctatggacttctgcttggaatgggaagtgcagtggaaacattatgtggtcaagcacatggagctcatagatacgaaatgcttggagtttacctccaaagatcaacagttgttctaatcctaacatgtctaccaatgtcatttctcttcctcttctcaaatccgatcctcacagcacttggagagccagagcaagtggcaacattggcttcagtattcgtctacggtatgatcccggtgatcttcgcttacgcagtcaatttccctatccagaagtttctccaatcacaaagcatcgtcactccaagtgcctacatatcagctgcaacgcttgtgatccatctcatactttcgtggatcgctgtgtatcgtcttggttacggtcttttggctttgtctttgatacatagcttctcgtggtggatcattgttgtggctcagattgtttatattaaaatgagtccgagatgtcgtcggacttgggaaggttttagttggaaagcttttgaaggtctttgggattttttccgattatcagctgcttctgccgtcatgctttgtcttgaatcttggtactctcagattcttgttttactcgccggacttctcaagaaccctgagcttgctttggattctcttgctatctgcatgtcaatttctgcaatctcattcatggtctccgttggattcaacgcagctgcaagtgtgagagtaagcaacgagctaggagccggaaacccgagagcagccgcgttctccacagtcgtgacaacgggagtatcattcttactatcggttttcgaagccatcgtggtcttatcgtggcgtcacgtcatcagctatgcgtttactgatagtccagcagtggctgaggccgttgcggatttatctccctttttagccatcacaattgtcctcaatggaattcagcctgttttgtccggtgtggctgttggatgtggatggcaagcatttgttgcgtacgtaaacattggatgttactacgttgtggggattccagtgggattcgttcttggcttcacttatgatatgggagctaagggaatatggactgggatgattggtggtactttaatgcaaacaataatcttagtgattgtcactttacgaactgattgggacaaagaggttgagaaagcttcgagcagattggaccagtgggaagagagccgtgagccgcttttgaagcaataa

SEQ ID NO: 2600 - protein, 501 aa, Arabidopsis thaliana
MNSESLENLHRPLIESSKSFVDYRLETVLTDRELPYFRRIYLAMMIEMKFLFHLAAPAIFVYVINNGMSILTRIFAGHVGSFELAAASLGNSGFNMFTYGLLLGMGSAVETLCGQAHGAHRYEMLGVYLQRSTVVLILTCLPMSFLFLFSNPILTALGEPEQVATLASVFVYGMIPVIFAYAVNFPIQKFLQSQSIVTPSAYISAATLVIHLILSWIAVYRLGYGLLALSLIHSFSWWIIVVAQIVYIKMSPRCRRTWEGFSWKAFEGLWDFFRLSAASAVMLCLESWYSQILVLLAGLLKNPELALDSLAICMSISAISFMVSVGFNAAASVRVSNELGAGNPRAAAFSTVVTTGVSFLLSVFEAIVVLSWRHVISYAFTDSPAVAEAVADLSPFLAITIVLNGIQPVLSGVAVGCGWQAFVAYVNIGCYYVVGIPVGFVLGFTYDMGAKGIWTGMIGGTLMQTIILVIVTLRTDWDKEVEKASSRLDQWEESREPLLKQ

SEQ ID NO: 2601 - DNA, 546 bp, Arabidopsis thaliana
atggcgacggttaatgggtacacagggaatactccggcggcgactacaccggcagccaccggatcaaagcaatctgctcctccgactaagaccgtcgatagccactccgttctaaaaaggctgcaatctgaactaatgggattgatgatgggagctgatccggggatatctgcgtttccagaggaagacaacatattttgctggaaaggaacaattacaggaagcaaagatactgtgttcgaaggaactgagtacagactctcactcactttctctaacgattatccttttaagtctcccaaagttaagtttgagacatgctgcttccaccccaatgtggatctctatggcaatatttgcttggacattcttcaggataaatggtcatctgcttatgatgtgaggacgatattactctcaattcaaagccttctcggagaaccgaacatcagctcaccattgaacaatcaagcggctcagctttggagcaatcaagaagagtacaggaagatggttgagaagctctacaagcctttaaacgcatga

SEQ ID NO: 2602 - protein, 181 aa, Arabidopsis thaliana
MATVNGYTGNTPAATTPAATGSKQSAPPTKTVDSHSVLKRLQSELMGLMMGADPGISAFPEEDNIFCWKGTITGSKDTVFEGTEYRLSLTFSNDYPFKSPKVKFETCCFHPNVDLYGNICLDILQDKWSSAYDVRTILLSIQSLLGEPNISSPLNNQAAQLWSNQEEYRKMVEKLYKPLNA

SEQ ID NO: 2603 - DNA, 699 bp, Arabidopsis thaliana
atggcttccattagtagcttacacagatgggcatctaatcaacactctcgtcttcctcgaatcacttctatttctgaggctgaccaatctcgacccattaaccaagtcgtcgccttttcggttcctatatccagaagagacgcgagtattattcttctcagctcgattccattgacaagcttcttcgttctaacaccgagctcttccgaagctagagagagacgtagcagaaaagttatccctctcgaggaatattccactggccctgaagggttgaaattctatgacattgaggaaggcaaaggtccagtagcaacagagggatcaactgctcaggtgcattttgattgccgttacagaagcatcactgcaatttctacccgagaatccaagcttttagctggaaaccgtagtattgctcagccttacgagttcaaggtgggatctacgccaggaaaggaaaggaagcgtgaattcgttgataatccaaatgggttattctctgcacaggctgcaccaaaacctcctccagcaatgtatttcattaccgaaggaatgaaagtcggaggcaagagaacggtgattgttcctcctgaagctggttatggtcagaaaggaatgaatgagataccgcctggagctacttttgagttaaacatagagctgcttcgggtgactcctccaccagaagagaagtga

SEQ ID NO: 2604 - protein, 232 aa, Arabidopsis thaliana
MASISSLHRWASNQHSRLPRITSISEADQSRPINQVVAFSVPISRRDASIILLSSIPLTSFFVLTPSSSEARERRSRKVIPLEEYSTGPEGLKFYDIEEGKGPVATEGSTAQVHFDCRYRSITAISTRESKLLAGNRSIAQPYEFKVGSTPGKERKREFVDNPNGLFSAQAAPKPPPAMYFITEGMKVGGKRTVIVPPEAGYGQKGMNEIPPGATFELNIELLRVTPPPEEK

SEQ ID NO: 2605 - DNA, 1581 bp, Arabidopsis thaliana
atggacccatggtcatggatatgtgagcttccagaagatcctgagttcagcgagtctgattcacacgcagtgtttcagctcgctggcgatttgacacgttcgatcaaacttagagccgaacggactttgggttctgaccaagaatctcactctctcacctttacagttgtagcagagggttttaacctccttaagtcgtcgaccatttgggtctccaacacatgtcccttgtcgtcggagaaaccgttcctccctcttgttctccagcttcttcaagaactaatcacccgttcccctaccacacacgacggcgcgtgcacaaagtttgaacaacttgaaatcaaaccaagtccagttagctgggtcatggactctcactcacctgaatccttctcatcagtctttaatctaatcctcctcacacgcctcttctggttgtgtgtgtttgacgcgccaagcgaagtaggctctttcttcttccaacacttactaggtccacacgtgaacgcgcttacatgtcaacatgcacctgtcttacggacgtttctcgtctctctcggtgtagacgccgagctttgtattgtacgagctgcttcgtatgccttatccaaatggatgatctctaaagagataggacttgggaatcttggtttgaaacagttcagtagcagcctcatgccacgtcattcgttggggttttcgtatgccacagaagctcatggtctttggatcttgaaaggttatttcccaatcttgtcaatgaacgtcacaaataatagctctaacgaggttcacaacaagatcgtcaagtttccattcgtagagcctaaagaagctgtcctacgttacgctttgtcgcatcaacaagctgaaatactagtacagtttgaatactccgttaagttctatgagaactacataaaagtaaacgcacgtgtagacaacatacgcatccacgtctcgaagctagggtttcacaaaggaggagttggcgtggagaatcagatagcggattgttactccgaggagaggtacttcccatcacgggtacgggtctggctcgggccagaactcgggtccagccacgtatcggggctaagtctaggaaggtcaacgaagaacgaggagagagatatcgaggtgactagagtgctaaagggaaatttcggaaaaggtaaagtggctccgagagtcaaggcaagagcaagaatggcaacaaagaggaaggttaaagattggagaatagagcaggaaagcgaaggaaacgctgccgtttttgatgcggtgttgtacgatagagagagcggtcaagaagtgacaaccgttaagccgaagccaaaccaagagggtttaaagaatgtgtttacgaagagtggggggatggtgtttggaagggatgagtatggagatgaagttgggtggagagttgggagagagatggaaggaagtgtgttgaagtggagactgggtggcaaaatttggctaacttattggccaaacaagttgaacactttgttttatgagactagatgtgtagagtggtgtgatgaggttgatttgccgttgcttcctacttcttag

SEQ ID NO: 2606 - protein, 526 aa, Arabidopsis thaliana
MDPWSWICELPEDPEFSESDSHAVFQLAGDLTRSIKLRAERTLGSDQESHSLTFTVVAEGFNLLKSSTIWVSNTCPLSSEKPFLPLVLQLLQELITRSPTTHDGACTKFEQLEIKPSPVSWVMDSHSPESFSSVFNLILLTRLFWLCVFDAPSEVGSFFFQHLLGPHVNALTCQHAPVLRTFLVSLGVDAELCIVRAASYALSKWMISKEIGLGNLGLKQFSSSLMPRHSLGFSYATEAHGLWILKGYFPILSMNVTNNSSNEVHNKIVKFPFVEPKEAVLRYALSHQQAEILVQFEYSVKFYENYIKVNARVDNIRIHVSKLGFHKGGVGVENQIADCYSEERYFPSRVRVWLGPELGSSHVSGLSLGRSTKNEERDIEVTRVLKGNFGKGKVAPRVKARARMATKRKVKDWRIEQESEGNAAVFDAVLYDRESGQEVTTVKPKPNQEGLKNVFTKSGGMVFGRDEYGDEVGWRVGREMEGSVLKWRLGGKIWLTYWPNKLNTLFYETRCVEWCDEVDLPLLPTS

SEQ ID NO: 2607 - DNA, 1008 bp, Arabidopsis thaliana
atgtctttagctccgagcagttatccatctctgtattcttcgccttcactgccaagaacccagcaaaccaagcaaaaccctagtttgatcactcaatccagtttcatttccgccaaaagtctcttcctttcgagcaattcggcttctttatgcaatacccatgttgccaaacgccggaatttagctttgaaggcgtcggagacagagtcttcagctaaagctgaagcaggaggagacggagaagaagaagagaagtatgaaacatatgaaattgaagtggagcagccttatggtttgaaattcaggaaaggaagagatggtggcacttacattgatgctatcttaccaggtggatcagctgacaaaaccggaaagttcactgttggcgatagagttattgccacaagtgcagtatttggaacagagatttggcctgcagctgagtacggtaggacaatgtacacaattcgtcagagaattggtcccttgcttatgcaaatggagaagagaaatggtaaggctgaagatactggtgagttaacagagaaggagatcataagagctgagagaaatgccggatacattagcagtagattgagagagattcagatgcaaaactatttgaagaagaaagaacagaaagctcaacgggagaaggatcttcgtgaagggctgcaattttccaagaatggtaagtatgaggaagcattggagaggtttgagtcggtgttaggttctaaaccaacaccagaagaagcatcagttgcaagttacaatgttgcttgttgctactcaaagcttaatcaggttcaagctggtctctcggctctggaagaagcattgaagtcaggatatgaagattttaagagaatcagaagtgatccagatctggaaactctcaggaagtcgaaggatttcgatccacttctgaagcaattcgacgaatctttcatcaatgagagtgccattaacgccatcaaatccttgtttggctttaacaagaaatag

SEQ ID NO: 2608 - protein, 335 aa, Arabidopsis thaliana
MSLAPSSYPSLYSSPSLPRTQQTKQNPSLITQSSFISAKSLFLSSNSASLCNTHVAKRRNLALKASETESSAKAEAGGDGEEEEKYETYEIEVEQPYGLKFRKGRDGGTYIDAILPGGSADKTGKFTVGDRVIATSAVFGTEIWPAAEYGRTMYTIRQRIGPLLMQMEKRNGKAEDTGELTEKEIIRAERNAGYISSRLREIQMQNYLKKKEQKAQREKDLREGLQFSKNGKYEEALERFESVLGSKPTPEEASVASYNVACCYSKLNQVQAGLSALEEALKSGYEDFKRIRSDPDLETLRKSKDFDPLLKQFDESFINESAINAIKSLFGFNKK

SEQ ID NO: 2609 - DNA, 1383 bp, Arabidopsis thaliana
atgaccaaaccctccgacccaaccagagactcccacgtggcagttctcgcttttcctttcggcactcatgcagctcctctcctcaccgtcacgcgccgcctcgcctccgcctctccttccaccgtcttctctttcttcaacaccgcacaatccaactcttcgttattttcctccggtgacgaagcagatcgtccggcgaacatcagagtatacgatattgccgacggtgttccggagggatacgtgtttagcgggagaccacaggaggcgatcgagctgtttcttcaagctgcgccggagaatttccggagagaaatcgcgaaggcggagacggaggttggtacggaagtgaaatgtttgatgactgatgcgttcttctggttcgcggctgatatggcgacggagataaatgcgtcgtggattgcgttttggaccgccggagcaaactcactctctgctcatctctacacagatctcatcagagaaaccatcggtgtcaaagaagtaggtgagcgtatggaggagacaataggggttatctcaggaatggagaagatcagagtcaaagatacaccagaaggagttgtgtttgggaatttagactctgttttctcaaagatgcttcatcaaatgggtcttgctttgcctcgtgccactgctgttttcatcaattcttttgaagatttggatcctacattgacgaataacctcagatcgagatttaaacgatatctgaacatcggtcctctcgggttattatcttctacattgcaacaactagtgcaagatcctcacggttgtttggcttggatggagaagagatcttctggttctgtggcgtacattagctttggtacggtcatgacaccgcctcctggagagcttgcggcgatagcagaagggttggaatcgagtaaagtgccgtttgtttggtcgcttaaggagaagagcttggttcagttaccaaaagggtttttggataggacaagagagcaagggatagtggttccatgggcaccgcaagtggaactgctgaaacacgaagcaacgggtgtgtttgtgacgcattgtggatggaactcggtgttggagagtgtatcgggtggtgtaccgatgatttgcaggccattttttggggatcagagattgaacggaagagcggtggaggttgtgtgggagattggaatgacgattatcaatggagtcttcacgaaagatgggtttgagaagtgtttggataaagttttagttcaagatgatggtaagaagatgaaatgtaatgctaagaaacttaaagaactagcttacgaagctgtctcttctaaaggaaggtcctctgagaatttcagaggattgttggatgcagttgtaaacattatttga

SEQ ID NO: 2610 - protein, 460 aa, Arabidopsis thaliana
MTKPSDPTRDSHVAVLAFPFGTHAAPLLTVTRRLASASPSTVFSFFNTAQSNSSLFSSGDEADRPANIRVYDIADGVPEGYVFSGRPQEAIELFLQAAPENFRREIAKAETEVGTEVKCLMTDAFFWFAADMATEINASWIAFWTAGANSLSAHLYTDLIRETIGVKEVGERMEETIGVISGMEKIRVKDTPEGVVFGNLDSVFSKMLHQMGLALPRATAVFINSFEDLDPTLTNNLRSRFKRYLNIGPLGLLSSTLQQLVQDPHGCLAWMEKRSSGSVAYISFGTVMTPPPGELAAIAEGLESSKVPFVWSLKEKSLVQLPKGFLDRTREQGIVVPWAPQVELLKHEATGVFVTHCGWNSVLESVSGGVPMICRPFFGDQRLNGRAVEVVWEIGMTIINGVFTKDGFEKCLDKVLVQDDGKKMKCNAKKLKELAYEAVSSKGRSSENFRGLLDAVVNII

SEQ ID NO: 2611 - DNA, 3942 bp, Arabidopsis thaliana
atgaagcatttcatgatgccaaggaacgctatcttgcgtgatatcggagagtcacaatcgccaaaccctagcttgacgaaatcgaagtcacaaaggaagattaaatcttctaaagagaatgctccacctccggatctgaactcgttgattcctgatcatagatcttctccggcgaaattgaaaagtccattgcctccgcgtcctccgtcgtctaatcctcttaaacggaagctgattgcggaagctacggcggataatggagtagcgattggggtttcagactctggtgtcaaggttatagtaagaatgaagcctccaagcaaaggtgaggaagaggagatgatagtaaaaaagatctccaacgacgccctcactattaatgaacagactttcacattcgattcgattgctgacccggagtcaacacaggatgagatctttcagcttgttggagcccctcttgttgagaactgtcttgctggatttaacagttctgtttttgcctatggacagactggcagtgggaaaacgtataccatgtggggtcctgcaaatggattgttggaagagcaccttagtggtgaccaaagaggtttgactccacgtgtctttgaattgctcttcgcccgtctcagtgaggagcaagcaaagcatgctgaaaggcagctaaagtaccagtgccgctgttcgtttctcgagatatacaacgagcaaataacagatcttttggatccgagcctaaaaaacctgatgattagagaagatgtcaagtccggtgtttatgttgaaaatctgactgaggaatacgtgaaaaacttgaaggatttgtcaaagcttctggttaagggattggcaaacagaaggactggtgcaacaagtgtaaacgcagaaagttcaaggtcgcactgtgtattcacttgtgttgtcgagtcccactgcaagagtgttgcagacggtctaagcagcttcaaaacaagtagaatcaatcttgttgatctggctggttcagaaaggcaaaagttaaccggtgcagcaggcgatcgtttgaaggaagctgggaatataaatcgatcactttcccaacttgggaatttgatcaacattctagcagaaatttcacaaacagggaagcaaaggcatataccctacagagattccaggttgacatttctattacaagagtctctaggagggaatgcaaaattagctatggtttgtgcagtttctccctcgcaaagttgtaggagtgaaaccttcagcaccttgagatttgctcagcgtgctaaggcgatacagaataaggcaattgtcaatgaagtaatgcaagatgatgtaaatttcttgcgggaagtgatacgccagctgagggatgaactgcaaagggtgaaggatgataaaggaaacaacccaaccaacccaaatgcagcttataccacttcctggaatgcgcgtagaagtctgagtttgttaagaagctttggcctgggtcatccaaagtcattaccaaatggagatgatgatggtgatactgagatggaaattgatgaggaggctgttgaaaggctttgtgctcaaatgggcttgtctccacctgccgaggacaacaatcaggagatgagcagagtagaaaaaataaattcatcattacagactgtggtcctgaaggatgaatcttacaataactcccaccttaaatcatcagaagctacagatgttaacatggaggatgcgtgttgccaaactgagaacaatgggtcagagactgataatgcgttaactgtggcagaaactatggatgatggttctagtgtacagcctgattccataacaaattctcttcattcttgtattagcgacacaaaccagggaaattcaccaagcaaggcggagaacattccatcatgccaagacttggttatagaagctgatgtttctgcaattgtatcagtagctgatacatcaaataatacagaacaggtctcagtaaatcctgtgtcgccttgccttagcgtcgctccagtaagtgtttctcctgtactaatacctcccactgagagcgcctctcctaagattagaaatagcaggaaaagcttgagaacaacatcaatgtccaccgcatcacaaaaagatattgagagagccaaccagttaactccagaagttgtggaaccgtcgccagctatgtccacagaggtgttaaacctatatagtgctttgtctacaaagaaaagtgaagcttttcctgtgccaactaggcaattggcagctagcctccacagaggcatgaaacttcttgactcatatcgccagagtacagctcttagacgatcgacattcagattgtcctacaaagctctagaatgcaaaccctcgaccgttttaagtaaggctgatgtaggtgttcaaacttatccccaagctgatgaaatagcggaagacaactctaaagaagtactgtgcagtagatgtaaatgcagggcagaatgtgatgcccaagaaataagtgacacttctaatcttcagttggtacctattgacaattcagaaggttcagaaaagtctaatttccaagttcctaaagcagtggaaaaggttctagcagggtcaatcagaagagaaatggctatggaagagttctgcactaagcaagcctctgaaatatcacagcttaatcggctggtgcaacagtacaagcatgagagagagtgcaatgctatcataggacaaacaagggaggacaagattgttcgccttgaaagtctcatggatggcgtgttatctaaagatgattttctggatgaagaatttgcatcactcatgcatgagcataagcttctgaaggacatgtatgagaaccaccccgaagtattgcagacgaggattgagttgaaacgagtgcaagaagagctcgaaagtttcaagaacttctatggtgacatgggagaaagggaagtattattagaagagattcacgatttaaaggcacagctacaatgttacactgactcttctcttacatctgctcggagaagaggttccttgcttaagctgacatacgcttgtgatcctaaccaagctccacaacttaataccattcctgagtcagtggacgagggtcctgagaagacactagaacaggaaagacttcgttggactgaagcagagagcaactggatctctcttgctgaggaattaagaactgagcttgataccaatagattgctaatggaaaagcagaaacgtgaattggatacagagaaaagatgtgctgaagagttgacagaagcaatgcaaatggcaatgcagggtcatgcacggatgattgaacaatatgcagacctggaagagaagcatatccaattgcttgcaaggcataggaggattcgagaaggaatagatgatgtcaaaaaagcagcagcaagagccggagtcaagggagctgagtctagattcataaacgcacttgcagcagaaatttcagctttgaaggtgcaaagagagaaggaggtacgatacttcagggatgaaaacaagagtctccagtcacaactaagagatactgctgaagctgttcaagcagcaggagagttacttgttcgatttaaagaagctgaagaaggattgacatttgcacagaaacgagcaatggatgcagagtatgaagcatcagaagcatataaaaaggtggacaagttgaagaggaaatacgaaaccgaaatcagcactgtaaaccaacaacataatgcagagccacaaaatcccatagaatctttgcaagcttcttgtaatgacgatgctatggccaaatatgatgaaccatcagctagtgatggtgataaccaatggagagaagaattccaaccattttacaagaaagacgaagagttgtcaaagctcgctgaaccctcttggttctcggggtatgaccgatgcaacatataa

SEQ ID NO: 2612 - protein, 1313 aa, Arabidopsis thaliana
MKHFMMPRNAILRDIGESQSPNPSLTKSKSQRKIKSSKENAPPPDLNSLIPDHRSSPAKLKSPLPPRPPSSNPLKRKLIAEATADNGVAIGVSDSGVKVIVRMKPPSKGEEEEMIVKKISNDALTINEQTFTFDSIADPESTQDEIFQLVGAPLVENCLAGFNSSVFAYGQTGSGKTYTMWGPANGLLEEHLSGDQRGLTPRVFELLFARLSEEQAKHAERQLKYQCRCSFLEIYNEQITDLLDPSLKNLMIREDVKSGVYVENLTEEYVKNLKDLSKLLVKGLANRRTGATSVNAESSRSHCVFTCVVESHCKSVADGLSSFKTSRINLVDLAGSERQKLTGAAGDRLKEAGNINRSLSQLGNLINILAEISQTGKQRHIPYRDSRLTFLLQESLGGNAKLAMVCAVSPSQSCRSETFSTLRFAQRAKAIQNKAIVNEVMQDDVNFLREVIRQLRDELQRVKDDKGNNPTNPNAAYTTSWNARRSLSLLRSFGLGHPKSLPNGDDDGDTEMEIDEEAVERLCAQMGLSPPAEDNNQEMSRVEKINSSLQTVVLKDESYNNSHLKSSEATDVNMEDACCQTENNGSETDNALTVAETMDDGSSVQPDSITNSLHSCISDTNQGNSPSKAENIPSCQDLVIEADVSAIVSVADTSNNTEQVSVNPVSPCLSVAPVSVSPVLIPPTESASPKIRNSRKSLRTTSMSTASQKDIERANQLTPEVVEPSPAMSTEVLNLYSALSTKKSEAFPVPTRQLAASLHRGMKLLDSYRQSTALRRSTFRLSYKALECKPSTVLSKADVGVQTYPQADEIAEDNSKEVLCSRCKCRAECDAQEISDTSNLQLVPIDNSEGSEKSNFQVPKAVEKVLAGSIRREMAMEEFCTKQASEISQLNRLVQQYKHERECNAIIGQTREDKIVRLESLMDGVLSKDDFLDEEFASLMHEHKLLKDMYENHPEVLQTRIELKRVQEELESFKNFYGDMGEREVLLEEIHDLKAQLQCYTDSSLTSARRRGSLLKLTYACDPNQAPQLNTIPESVDEGPEKTLEQERLRWTEAESNWISLAEELRTELDTNRLLMEKQKRELDTEKRCAEELTEAMQMAMQGHARMIEQYADLEEKHIQLLARHRRIREGIDDVKKAAARAGVKGAESRFINALAAEISALKVQREKEVRYFRDENKSLQSQLRDTAEAVQAAGELLVRFKEAEEGLTFAQKRAMDAEYEASEAYKKVDKLKRKYETEISTVNQQHNAEPQNPIESLQASCNDDAMAKYDEPSASDGDNQWREEFQPFYKKDEELSKLAEPSWFSGYDRCNI

SEQ ID NO: 2613 - DNA, 957 bp, Arabidopsis thaliana
atgctctcttttttctctaaccagatcgaccggcaaaaagatgtgtctaatgaggaaaaaaccctaaccaatctcgaaaaatctgacggttcacaattccctggcgatgactaccgtccgtccgatcggaaaaactggatggctggtcttacgttggagaaactaactctaaacaagatcgtgtggccaggaacgcatgattcagccaccaacgatatcggaatacctctgatctctcgtcctttagctgaatgccaatcgctctctatctacgagcagctcgtcctcgggacacgtgtcctcgatatccgtgtgcaagaggatcgccaaatctgccacgggattctgacgtcatacgaaattgatgttgtcattgatgacgttatcagattcttgtcggagactcactcggagattgtaatcctggagataaggactgagtttggacacaaagatcctccggggttcgagacttacttggcagacaagttaggtcaattcttgatacatcaagatgatagcttgttcaacaagccggtatcagagattttgccgaaaagggttatatgcatctggaaacctagagagtctccaaagccgagccgtggtggaattctctggaactcagattatctaaaagataattggatcgatacggatcttccatggacgaaatttcagagcaatttgaagcatctgagtgagcagcagccgacatcttctagaaaattcttttaccgggttgagaacacggtcacgccgcaagcagataatccggttgtgtgggttaaaccggtgactgatcggatccgaaaacacgccagactatttatttctcagtgtgtttccaagggatgtggagataagttgcagattttgtccactgatttcatcgaaggagatttcgttgatgcctgtgtcggccttactcacgcaagaatcgaaggaaaggtttga

SEQ ID NO: 2614 - protein, 318 aa, Arabidopsis thaliana
MLSFFSNQIDRQKDVSNEEKTLTNLEKSDGSQFPGDDYRPSDRKNWMAGLTLEKLTLNKIVWPGTHDSATNDIGIPLISRPLAECQSLSIYEQLVLGTRVLDIRVQEDRQICHGILTSYEIDVVIDDVIRFLSETHSEIVILEIRTEFGHKDPPGFETYLADKLGQFLIHQDDSLFNKPVSEILPKRVICIWKPRESPKPSRGGILWNSDYLKDNWIDTDLPWTKFQSNLKHLSEQQPTSSRKFFYRVENTVTPQADNPVVWVKPVTDRIRKHARLFISQCVSKGCGDKLQILSTDFIEGDFVDACVGLTHARIEGKV

SEQ ID NO: 2615 - DNA, 1380 bp, Arabidopsis thaliana
atgggattgtggaatggaaaaggcaccggaggatttatcctctaccttctcgtggctttctccgtcgccgtcttctctgtttcttacgtcggagacacaacaaaccctattcatcatcatctctcttctctctctgccaccgaaaaaatttggccggatttgaagtttagctggaaacttgtgttggctacagtgatagcgtttctaggatcagcttgtgggactgttggtggtgttggaggtggtgggatttttgttcctatgctcactcttatactcgggttcgatacaaaatccgcagctgcaatatcaaaatgtatgataatgggagcatcagcatcatcagtttggtacaatgtacgagttcgtcatccgacaaaagaagtaccaatcttagattatgatcttgctcttctctttcaaccaatgcttcttctcggtatcactgttggtgtttctctcagtgttgtgttcccttattggctcattactgtcctcatcatcattcttttcgtcggtacttcttcgagatctttttttaaaggcattgagatgtggaaggaagagacattgttaaagaacgaaatggcgcagcaacgagctaatatggttaattcccggggagaacttttaatcgatacagagtatgagccgctttacccgagagaagaaaaatcagagctggaaataatacgctccaacctcaaatggaaagggcttctaattctagtaactgtgtggttgactttcttgctcattcaaattgtcaagaacgaaataaaggtctgcagcacaatatattggatactattcatcgtacagttcccagttgctttagcggtgtttgggtttgaagcaagcaaattgtatacagcgaacaaaaagaggttaaacagtggcaacactgaatgtatctgtgaagctacgattgagtggactcctctgagtctaatcttctgtggtctctgtggtctcattggaggtatcgtaggtggtctccttggatccggtggtggatttgttctcgggcctttgcttcttgagattggagtcatcccacaggttgctagcgcaacagctacctttgtgatgatgttttcttcgtccttatccgtagtcgagttctatctcctcaagagattcccaataccatacgcaatgtacttgatttcggtatcgattcttgccggtttttggggacaatcctttataagaaagctcgtggcgatcctgagaagagcttccataatcgttttcgttctctcaggagtcatttgtgcaagtgctctcacaatgggagtgattgggatagagaagagcataaagatgatacataaccatgaattcatgggattcttaggattctgcagcagtcaatga

SEQ ID NO: 2616 - protein, 459 aa, Arabidopsis thaliana
MGLWNGKGTGGFILYLLVAFSVAVFSVSYVGDTTNPIHHHLSSLSATEKIWPDLKFSWKLVLATVIAFLGSACGTVGGVGGGGIFVPMLTLILGFDTKSAAAISKCMIMGASASSVWYNVRVRHPTKEVPILDYDLALLFQPMLLLGITVGVSLSVVFPYWLITVLIIILFVGTSSRSFFKGIEMWKEETLLKNEMAQQRANMVNSRGELLIDTEYEPLYPREEKSELEIIRSNLKWKGLLILVTVWLTFLLIQIVKNEIKVCSTIYWILFIVQFPVALAVFGFEASKLYTANKKRLNSGNTECICEATIEWTPLSLIFCGLCGLIGGIVGGLLGSGGGFVLGPLLLEIGVIPQVASATATFVMMFSSSLSVVEFYLLKRFPIPYAMYLISVSILAGFWGQSFIRKLVAILRRASIIVFVLSGVICASALTMGVIGIEKSIKMIHNHEFMGFLGFCSSQ

SEQ ID NO: 2617 - DNA, 501 bp, Arabidopsis thaliana
atgggtttggttacagatgaagtgagagctagggcagagaaatacacaggagatgagatatgccgtgagaagacaaaggagtttctcaaggaagtttctatgcctaatggtttattgccattgaaggacattgaagaagttggttacgacagagagacaggtattgtctggctgaagcagaagaagagcatcacccacaagtttgaagccattggtaaacttgtctcttacgccaccgaggtcattgcacaggtggaggtcggaaagatcaagaagcttaccggtgttaaggccaaggagcttcttatttgggtcactctcaatgagcttgtcttggagcagccgacaagttcagggaagatcaatttcaggacaccaactggtctgtccaggactttcccagtgtctgctttcgttgttcctgaagttgagaagcctgcaacggagaagaacaatggaaccactgaggtcaaagaagctgttgcagtcacagatgcttag

SEQ ID NO: 2618 - protein, 166 aa, Arabidopsis thaliana
MGLVTDEVRARAEKYTGDEICREKTKEFLKEVSMPNGLLPLKDIEEVGYDRETGIVWLKQKKSITHKFEAIGKLVSYATEVIAQVEVGKIKKLTGVKAKELLIWVTLNELVLEQPTSSGKINFRTPTGLSRTFPVSAFVVPEVEKPATEKNNGTTEVKEAVAVTDA

SEQ ID NO: 2619 - DNA, 1341 bp, Arabidopsis thaliana
atggagacgatgacgatgaaggttgaaaccattagtaaagaaatcataaagccatcttcgccaactccaaataatctccaaactctccaactctcaatttacgatcacatccttcctccagtttacacagtagcctttctcttctacaccaaaaatgatttgatctctcaagaacacacttcccacaaactcaagacttctctgtctgaaaccctgaccaagttctaccctcttgccggaagaatcaccggagtaaccgtcgattgtaccgatgaaggagctatctttgtcgatgctcgtgtcaataactgtcctctcactgaatttctcaagtgccctgatttcgacgccctccaacagttgcttcctctagatgttgtagacaacccatacgtggctgctgccacgtggcctttgctgctcgtgaaggcaacttacttcggatgcggaggcatggccataggaatctgcatcactcacaaaatcgcggacgcagcctccatctcgactttcattcggtcctgggccgccacggctcgaggagagaacgatgccgctgcgatggaaagtcctgtatttgctggtgcgaatttctacccaccagccaatgaggcttttaagctacctgcggacgaacaagccggcaagagaagcagcattacaaagagatttgtgttcgaagcttctaaggtggaagatctcaggaccaaagccgctagtgaagaaacagtagaccaacctacgcgggtggagagcgttactgcgctcatctggaaatgcttcgtcgcatcctcaaagacaactacttgtgatcacaaagtgctggtccagcttgctaacttgcggtccaagataccttcccttctgcaagaaagctctatcggaaatctcatgttctcttctgtggtcttgagtattggtcgaggaggggaagttaaaattgaagaggccgttagagacttacgaaaaaaaaaggaggagttaggaactgtgatcctagacgagggtgggtcatctgactcatcttccatgatcggttcgaaactagcaaatctgatgctcaccaactattctcggttgagctatgagactcatgaaccctataccgtgagtagctggtgtaagctacctctttacgaggctagctttggatgggattctccggtttgggttgttgggaatgtgtcccccgtgttaggcaacttggccatgttgatagattccaaggacggacaaggaattgaagcgttcgtcacactgcctgaagagaacatgtcgtccttcgagcagaacccagagttgctcgcctttgctaccatgaaccctagtgtcttggtttaa

SEQ ID NO: 2620 - protein, 446 aa, Arabidopsis thaliana
METMTMKVETISKEIIKPSSPTPNNLQTLQLSIYDHILPPVYTVAFLFYTKNDLISQEHTSHKLKTSLSETLTKFYPLAGRITGVTVDCTDEGAIFVDARVNNCPLTEFLKCPDFDALQQLLPLDVVDNPYVAAATWPLLLVKATYFGCGGMAIGICITHKIADAASISTFIRSWAATARGENDAAAMESPVFAGANFYPPANEAFKLPADEQAGKRSSITKRFVFEASKVEDLRTKAASEETVDQPTRVESVTALIWKCFVASSKTTTCDHKVLVQLANLRSKIPSLLQESSIGNLMFSSVVLSIGRGGEVKIEEAVRDLRKKKEELGTVILDEGGSSDSSSMIGSKLANLMLTNYSRLSYETHEPYTVSSWCKLPLYEASFGWDSPVWVVGNVSPVLGNLAMLIDSKDGQGIEAFVTLPEENMSSFEQNPELLAFATMNPSVLV

SEQ ID NO: 2621 - DNA, 849 bp, Arabidopsis thaliana
atggcgtatttagctccgatttcttcatccttatccatattcaagaatccccaactctcaagattccaattttcttcttcctcaccgaacccacttttccttcgacctaggattcagattctgagtatgaccatgaacaagtcgccgtctttagtggtggttgcggctactactgcggcagagaagcagaagaagaggtatcctggagaatcaaagggttttgtggaggagatgaggtttgtggctatgagacttcatactaaagatcaagctaaggaaggtgagaaagagactaaatctattgaggaacgtcctgttgctaaatgggaacctactgttgaaggttacttgaggtttcttgtggatagtaaattggtttatgatactcttgaactgattattcaagactccaatttcccaacttatgccgagttcaagaacacggggctggaaagagcggagaaattatccacggatttggagtggttcaaggaacaaggttacgagattccagaaccaacagctcctggtaaaacatattctcaatatttaaaggaattagcagagaaggatcctcaagcattcatttgtcacttctacaacatctactttgctcatagtgctggtggacgaatgattggcagaaaggtggcagagcggatactcgataataaagaactcgagttctacaaatgggacggcgaactttctcaattgttgcagaacgttagggagaaactgaacaaggttgcagaggagtggactagagaagaaaagaatcattgtttggaagagactgagaaatcgttcaagtattctggtgagatacttcgtctcatattgtcctga

SEQ ID NO: 2622 - protein, 282 aa, Arabidopsis thaliana
MAYLAPISSSLSIFKNPQLSRFQFSSSSPNPLFLRPRIQILSMTMNKSPSLVVVAATTAAEKQKKRYPGESKGFVEEMRFVAMRLHTKDQAKEGEKETKSIEERPVAKWEPTVEGYLRFLVDSKLVYDTLELIIQDSNFPTYAEFKNTGLERAEKLSTDLEWFKEQGYEIPEPTAPGKTYSQYLKELAEKDPQAFICHFYNIYFAHSAGGRMIGRKVAERILDNKELEFYKWDGELSQLLQNVREKLNKVAEEWTREEKNHCLEETEKSFKYSGEILRLILS

SEQ ID NO: 2623 - DNA, 1521 bp, Arabidopsis thaliana
atgaaacatttctctctacttttcatttttctggtcatcctcttggcaacaagctacagtgatgcctttaccagaaacagttttccaaaggatttcctcttcggagccgccacttctgcttatcagtgggaaggagctgttgctgaagatggaagaactcctagtgtctgggatactttctccaactcttacgatacaggtaatggagatgtaacatctgatgggtatcacaaatacaaggaagatgttaagctgatggcaacaatgggcttagaatcattcagattctctatctcctggtcaagacttatacctaatggaagaggactcattaatccaaaaggactattgttttacaacaatctcatcaaagacctaaaaagccatggaatcgaaccacatgttacactttaccactatgatcttcctcagtctcttgaagatgagtacggcggatggatcaaccgcaaaatcatagaagacttcactgcttatgcagatgtatgcttcagagagtttggggaggatgtgaagttatggactacaataaacgaagctacaattttcgccattggttcttatgaccaaggaaccgcgccgcctggacattgttctcctaataaattcgtcaattgttctactggaaattcttctacagaaccatatattgcaggccataacatattgctagctcatgcctctgcttcaaagttgtataaactaaagtacaagagtaagcagaaaggatccatagggcttagtatatttgcattcgggttatctccatatacaaactccaaggatgatgaaatcgcaactcaaagagctaaaactttcttatatggctggatgttgaagcctttggtatttggagactatccggatgaaatgaagaaaactgtgggatcgagattaccagttttctcagaggaagagtcagagcaagttaaaggatcatctgactttataggaattattcattacacaacattctatgtcacaaaccaccaaccttcagcttctctctttcccagcatgggtgaaggcttctttaaagacatgggagtatatataattcccactgggaattcttcatttcttgtgtgggaggctactccatggggtcttgaaggtattcttgagtatataaagcagagctataacaatcctccagtctatattcttgaaaatggtatgccgatggtacgcgattcgacactacaagacacacaaagaattgaatacattcaagcttacattgacgctgtactcaacgcaatgaagaatggatcggacacgagaggttactttgtatggtcgatggttgatgtgtatgagatattgagtggatatacgaccagcttcggaatgtaccatgtgaatttcagcgatcctggtcgcaagaggactccaaagctctctgcttcttggtacactggtttccttaatggtacaattgatgttgcttctcaagatactattcagttgtggagcaacttctctgtctcttcttcattgtaa

SEQ ID NO: 2624 - protein, 506 aa, Arabidopsis thaliana
MKHFSLLFIFLVILLATSYSDAFTRNSFPKDFLFGAATSAYQWEGAVAEDGRTPSVWDTFSNSYDTGNGDVTSDGYHKYKEDVKLMATMGLESFRFSISWSRLIPNGRGLINPKGLLFYNNLIKDLKSHGIEPHVTLYHYDLPQSLEDEYGGWINRKIIEDFTAYADVCFREFGEDVKLWTTINEATIFAIGSYDQGTAPPGHCSPNKFVNCSTGNSSTEPYIAGHNILLAHASASKLYKLKYKSKQKGSIGLSIFAFGLSPYTNSKDDEIATQRAKTFLYGWMLKPLVFGDYPDEMKKTVGSRLPVFSEEESEQVKGSSDFIGIIHYTTFYVTNHQPSASLFPSMGEGFFKDMGVYIIPTGNSSFLVWEATPWGLEGILEYIKQSYNNPPVYILENGMPMVRDSTLQDTQRIEYIQAYIDAVLNAMKNGSDTRGYFVWSMVDVYEILSGYTTSFGMYHVNFSDPGRKRTPKLSASWYTGFLNGTIDVASQDTIQLWSNFSVSSSL

SEQ ID NO: 2625 - DNA, 921 bp, Arabidopsis thaliana
atggaggtaccggtgattaatagaataagagatttcgaagttggtataaactcgattaatgatccttcgtttctttctcgatctgttgctgtttccggaatcggaaagctacaccaagcttatggtttttggaaatggggagctttgattatcgcatttctagcttatttcaccaactttgttagtaaactcaacagtctagttgttaggttaagaaaaatagatgtctctgtttcctctccaactctttttgatgattacgatagcgattccgatgtttcttgttcctctaccgtctcctctgacgatgaaaaagacgaagaagatgaggctgatgatgaagatgaggatgttgactcgatctttaatcgaagacgagtcaacggaggtttccgcgttagaggatctgattattacgatgatgatgatgatcagggagacaatggtaattgcacatggatggggaggcgatatagtggtagttttggagatttgttctcatggcctgatcttggtgggattggttcgagtggagtcgtgaagctttgggatcatttagatatcgatggcgatgatcatgagaatgttgtggcaacgtttctcaagaactataactcaacctcgtcaccgtttttttgggcggcggagaaaaaaggtgttgacgccgttaaagtgaaggcgtgtgatccacgcgccggttttcggatgccggctttgctcgcggagtggaggcagccggggcggttgttagggaatataatcggagttgataccggtggtgtggagaaagtatacgtcagggatgatgttagcggagagatagccgtgggagatttgaggaagtttaacggtgtgttgacggacttgacggaatgtgaggctgagacttggtgggacgctgacgtccttatctcgggctga

SEQ ID NO: 2626 - protein, 306 aa, Arabidopsis thaliana
MEVPVINRIRDFEVGINSINDPSFLSRSVAVSGIGKLHQAYGFWKWGALIIAFLAYFTNFVSKLNSLVVRLRKIDVSVSSPTLFDDYDSDSDVSCSSTVSSDDEKDEEDEADDEDEDVDSIFNRRRVNGGFRVRGSDYYDDDDDQGDNGNCTWMGRRYSGSFGDLFSWPDLGGIGSSGVVKLWDHLDIDGDDHENVVATFLKNYNSTSSPFFWAAEKKGVDAVKVKACDPRAGFRMPALLAEWRQPGRLLGNIIGVDTGGVEKVYVRDDVSGEIAVGDLRKFNGVLTDLTECEAETWWDADVLISG

SEQ ID NO: 2627 - DNA, 531 bp, Arabidopsis thaliana
atgggatcggaacaaaacgatagcacaagcttcacgcaatcgcaagcttcagagccaaagctatgtgttaaaggatgtggtttctttggatcaccatcaaacatggatctctgttctaaatgttacagaggcatttgtgctgaggaagctcaaacagcagttgctaaagctgctgttgaaaaatctttcaagccttctcctcctcgtagtctcttcatagcagaacctcctgctgttgttgtggaacccaaacccgaaaaggcggcagttgttgttgtctcggccgagccatcttcctcggcggttcctgaggcgaacgagccatcgagacctgcacgaaccaaccggtgtttgtgttgtaacaagaaggttgggatcatggggtttaagtgcaaatgcgggagcactttctgcggcgaacatcggtacccggagactcatgattgcagctttgatttcaaagaagttggacgtggagagattgccaaagctaatcctgtggttaaggctgataaaattcaaaggttctga

SEQ ID NO: 2628 - protein, 176 aa, Arabidopsis thaliana
MGSEQNDSTSFTQSQASEPKLCVKGCGFFGSPSNMDLCSKCYRGICAEEAQTAVAKAAVEKSFKPSPPRSLFIAEPPAVVVEPKPEKAAVVVVSAEPSSSAVPEANEPSRPARTNRCLCCNKKVGIMGFKCKCGSTFCGEHRYPETHDCSFDFKEVGRGEIAKANPVVKADKIQRF

SEQ ID NO: 2629 - DNA, 3207 bp, Arabidopsis thaliana
atggatgatgttcagatcgatgatacttttccggtggatctaaatggggttacgtcactttgttcaccggagattcctagtttcgatttcgttagtgatgaaacagagaaattagagatcggagatacttccattgatgactgtgacgatgcattgggcgactccatggattcgggattttattcatttcgcctaattctgggtgaagatggatttaatctgatgttaacgaggagagttaggtttctaattcaatatgagacaattatgttcataaatgctggaggagatgattcaaaggtattagattctgaattgaatatctccagagatgactatttcgaaggaggagatgtgttgagaacagaagagtctatagttgaagctggagactttccgttcatttatcagtcagcacgtgttgggaacttttgttaccagttaaacaatcttcttccgggagagtacttgatcgatttccatttcgcggagattattaacaccaatggacctaaagggataagggttttcaacgtctatgttcaagatgagaaggcaactgagtttgatatattctcggttgttggcgcaaataggccactcctgttggttgacttaagggtcatggtgatggatgatggattgattagggtaaggtttgaaggaataaatggaagtccagtggtttgtgggatttgtcttaggaaagcgccacaggtttcagttccaaggacatcacaagattttattaagtgtgagaattgtgctaccgaaatcgagatttctcctactcggaagagacttatgcgagccaaagctcatgacaagtatgagaagaaaatagcagagctttctgaacgatatgaacataagacaaatgagtgccacgaagcatggatgtcactgacctctgccaatgagcaactagagaaagtgatgatggaactcaacaataagatatatcaggcacgctctctagaccaaactgtgataacacaagctgattgtttgaagagtatcactagaaagtatgagaatgacaagagacattgggccacagcaattgattctctacaggagaaaatagagataatgaaaagggaacaatctcagctatcacaggaagcacatgaatgcgttgaagggatccccgaactgtataaaatggttggtggagttcaggcactcgtttcacagtgtgaagatctaaagcagaagtacagtgaagagcaagcaaaacgaaaggagctgtacaaccatatacaggagacgaaaggcaatattagggtcttttgtcgctgccgccctttgaatacggaggagacatcaaccaagtctgccacaattgttgactttgatggagcaaaagatggagagcttggtgttattacaggaaataattccaagaaaagtttcaagtttgacagagtttatacaccgaaagatggtcaagttgatgtcttcgccgatgcttctccgatggttgtttcagtcctagacggctacaatgtttgtatttttgcctacggacaaacaggaacaggaaagacgtttacaatggaaggtactccgcagaacaggggtgtcaattatagaaccgtcgagcaattgtttgaagttgctagagaaaggagagagaccatttcatataacatatcggttagtgtccttgaggtctacaatgaacaaataagagacttgttggcaacatcaccagggtcaaagaagttggagataaaacaatcctctgatggctctcatcacgttcctggattagtagaagcaaatgtggaaaatataaatgaagtctggaatgtgcttcaagctgggagcaacgcaagatcagttggatcaaataatgtgaacgagcatagcagccgctctcactgcatgctctctataatggtgaaagcaaagaacctgatgaatggtgattgcacaaaaagcaagctttggcttgtagatttagctggaagtgagagattggcaaagacggatgtgcaaggtgagcgtctgaaggaagcacaaaacatcaacaggtcactctcagctctgggggatgtgatttatgctttggcaacaaagagtagtcatattccatacagtccatctgagcatgatgtgagtgaaactctaagttcacttaactttgcaactcgtgtaagaggggttgaattgggtcctgcaaggaagcaagttgataccggtgagatccagaagttgaaagcaatggtggagaaagcaagacaagaaagccgatctaaagatgaatccataaagaaaatggaggagaacattcagaatctggaaggtaagaacaaaggaagagacaactcatacagaagtctccaggaaaaaaacaaagaccttcaaaaccaacttgattcagtccacaaccaatcagaaaaacaatatgcacagcttcaagagagactaaagagcagagatgagatttgtagcaatcttcaacaaaaggtcaaggagctagagtgcaagctacgggagagacaccaatcagattctgcagctaacaaccagaaggttaaggatcttgagaataatttgaaagaatctgaaggaagctcccttgtgtggcaacagaaggttaaggattacgagaataagttgaaagagtctgaaggaaactctcttgtgtggcaacagaagattaaagagttggagataaaacacaaagacgagcagagccaagaagcagtgttactacgacaaaagatcaaagaacttgagatgaggctaaaggagcaagagaagcatatacaggaaatggcaacaactagagaattccctgaagttgcaaacgctacgcctaatgaagtgaaaacttgcttcaaagaagataactttggcaatgagaatatggaatccaacaccaacatcctgagaacatcaaaccgtctcaagactaaaagacacgattcattaaatctcaatgagatgactagaaagaagagggcctcgagaagcggcgaaacagagaacaatggtgatgatcctcaaatgaaggagaaacggatcagaaaatcagacccaccaaaagttttctccagagtagtcagaccaactagaacagcttctggttcatcaagccaagtccctgtggctcagaagagagttattaaaagagaacaacaagaagttccggtcgtgaaagagagagactccaagaagaagatttggtcaagataa

SEQ ID NO: 2630 - protein, 1068 aa, Arabidopsis thaliana
MDDVQIDDTFPVDLNGVTSLCSPEIPSFDFVSDETEKLEIGDTSIDDCDDALGDSMDSGFYSFRLILGEDGFNLMLTRRVRFLIQYETIMFINAGGDDSKVLDSELNISRDDYFEGGDVLRTEESIVEAGDFPFIYQSARVGNFCYQLNNLLPGEYLIDFHFAEIINTNGPKGIRVFNVYVQDEKATEFDIFSVVGANRPLLLVDLRVMVMDDGLIRVRFEGINGSPVVCGICLRKAPQVSVPRTSQDFIKCENCATEIEISPTRKRLMRAKAHDKYEKKIAELSERYEHKTNECHEAWMSLTSANEQLEKVMMELNNKIYQARSLDQTVITQADCLKSITRKYENDKRHWATAIDSLQEKIEIMKREQSQLSQEAHECVEGIPELYKMVGGVQALVSQCEDLKQKYSEEQAKRKELYNHIQETKGNIRVFCRCRPLNTEETSTKSATIVDFDGAKDGELGVITGNNSKKSFKFDRVYTPKDGQVDVFADASPMVVSVLDGYNVCIFAYGQTGTGKTFTMEGTPQNRGVNYRTVEQLFEVARERRETISYNISVSVLEVYNEQIRDLLATSPGSKKLEIKQSSDGSHHVPGLVEANVENINEVWNVLQAGSNARSVGSNNVNEHSSRSHCMLSIMVKAKNLMNGDCTKSKLWLVDLAGSERLAKTDVQGERLKEAQNINRSLSALGDVIYALATKSSHIPYSPSEHDVSETLSSLNFATRVRGVELGPARKQVDTGEIQKLKAMVEKARQESRSKDESIKKMEENIQNLEGKNKGRDNSYRSLQEKNKDLQNQLDSVHNQSEKQYAQLQERLKSRDEICSNLQQKVKELECKLRERHQSDSAANNQKVKDLENNLKESEGSSLVWQQKVKDYENKLKESEGNSLVWQQKIKELEIKHKDEQSQEAVLLRQKIKELEMRLKEQEKHIQEMATTREFPEVANATPNEVKTCFKEDNFGNENMESNTNILRTSNRLKTKRHDSLNLNEMTRKKRASRSGETENNGDDPQMKEKRIRKSDPPKVFSRVVRPTRTASGSSSQVPVAQKRVIKREQQEVPVVKERDSKKKIWSR

SEQ ID NO: 2631 - DNA, 1836 bp, Arabidopsis thaliana
atggatcccaccatgaatccaactccaactccaagctccgccggcaacagtgtctgcacagatgaattgaccaaccttcccccggaggactcgccactcgacagcgagaaggatgatagcgttgacttcagccaggagcaaggatcggagtcaaatgaagctattgacactgagaatggttcaagatccgtagacaagaaccaatactctgaaactgaagttgtagttagagcaaaagatttacagacagaacctgattcactggatgatgatgtggagattgtgatcaaaaaccaacataagtattacatatactgcccttgctgtggtgaagatatcaccaaaacagtcaagctcgtgaagatatcagatcccaaacacacaaaagaccatgacaaagctgttgacagtgacactgagaatggttcaaaatccaaagacaagaacacaaaggttccatcatggttctctgattttattcagccgctgttttcttctgaagacagaggaaagaaaggggttgttgattcagagttactaggaacttacgaagatctcggtatcattggtgaggaaccgagcatagatgtcagtaacgagaaagacagaccgagttttccaaagtggtacctcgatgtttttgcttggttattcctctgtattattattgctctttctgtcctttcgacttctccaccgcctttcattcaaccacatctgcaattaccatctatgcctacattgaggatgccttctgcttctgtacttttgttacttcccacatctgcggtgttgcttctcttcattatttcaatgaggtcccgtttcactccgagatatcacaaggagaaaggcgaggtcgttcccaagtctactgattccaagtctcacgatgaccaagctgcaaatactgatcaagattttgacaagaaaacagacaacaaaagaaatcgcctaactcctatatacccttcatcactagagaaaccttccaagcaaactgtcaataaggaaactcaaaatcacgataaagaagctgcagatcctgaccaagatgtagacaaggaaacagagaaccaaaaaagtcacctaactccgatatatccttcaccactggagcaaccttccaagcaaattatcaataaggaaactcaaacagaacctatgttgccacctaatgctcaatcagagatcccaaatagtgttgaaccacgcaaaggcggtaataaagtagaaattctgaaaagtattgtgtatggaggtcttacagaatccatcacaagcctatgcacggtaacatctgcggcagcttctggtgcttcaactctgaacgttttagccttgggagttgccaatttgtcaagcggtcttcttctgactgttcacagcctccaagaactaataaacgagaaacccagaaaacaaaccaacactgatgattctccagaagaaggagaaggagaagaagatcgatacgaggaagtactcgggagaagagagtattcgaggattcacagagtgatcgcaatctcttctttcgtcatcttcggattgatcccacctttagtatacggtttctcgtttcgaaaaaagatggaaaagagacaagagtacaaggttttagctgtttacgcagtgtctctactctgcatcgtcttgctctcaatagcgaaagcttacgtgtcgaagaaacgcgattatgtcaagactctgtttcggtacacgacgacggcgacgacggcgtcgggattctctcaatttgtgggatacttggtgagtcaatggcttgagaaaagcgggttttatgatgattctccagaaactcaacgagtttga

SEQ ID NO: 2632 - protein, 611 aa, Arabidopsis thaliana
MDPTMNPTPTPSSAGNSVCTDELTNLPPEDSPLDSEKDDSVDFSQEQGSESNEAIDTENGSRSVDKNQYSETEVVVRAKDLQTEPDSLDDDVEIVIKNQHKYYIYCPCCGEDITKTVKLVKISDPKHTKDHDKAVDSDTENGSKSKDKNTKVPSWFSDFIQPLFSSEDRGKKGVVDSELLGTYEDLGIIGEEPSIDVSNEKDRPSFPKWYLDVFAWLFLCIIIALSVLSTSPPPFIQPHLQLPSMPTLRMPSASVLLLLPTSAVLLLFIISMRSRFTPRYHKEKGEVVPKSTDSKSHDDQAANTDQDFDKKTDNKRNRLTPIYPSSLEKPSKQTVNKETQNHDKEAADPDQDVDKETENQKSHLTPIYPSPLEQPSKQIINKETQTEPMLPPNAQSEIPNSVEPRKGGNKVEILKSIVYGGLTESITSLCTVTSAAASGASTLNVLALGVANLSSGLLLTVHSLQELINEKPRKQTNTDDSPEEGEGEEDRYEEVLGRREYSRIHRVIAISSFVIFGLIPPLVYGFSFRKKMEKRQEYKVLAVYAVSLLCIVLLSIAKAYVSKKRDYVKTLFRYTTTATTASGFSQFVGYLVSQWLEKSGFYDDSPETQRV

SEQ ID NO: 2633 - DNA, 747 bp, Arabidopsis thaliana
atggcgattgctctctcgtcgtcgtcgacgatcacgtccattactctgcagccgaagctgaagacgattcatggattagggacagtacttcctggttattcggtcaaatctcactttcgtagtgtctctctccggcgtagcgccgtggtcgtgtcggccattaccggagcttcttccggagctggaatagggaaaggtacagctgattcgctagatacagtgaaagtcttggatttgagaggaaatgagattccgatttctgatttatggaaagataggaaggccgttgttgcatttgctcgtcattttggatgtgtgctctgtcggaaacgagcagcttatcttgcagaaaagaaggatgtgatggatgcatctggtgttgctcttgttctgatcggaccgggaagcatcgatcaggctaatacttttgtggaacagactaagtttaaaggagaggtctatgcggatccaaaccacgcatcatacgaggcgcttgagttcgtttcaggggtttctgttacatttacacccaaagctgctatgaagatactagagtcttacatggaaggataccgccaagactggaaactctcgtttatgaaagatacagttgaaagaggcggctggcaacaaggcggaatcttagttgctggccctgggaaagataacatctcttatatacgcaaggacaaagaagccggtgatgacccgcctgttgaagagatccttaaagcgtgttgtgcttga

SEQ ID NO: 2634 - protein, 248 aa, Arabidopsis thaliana
MAIALSSSSTITSITLQPKLKTIHGLGTVLPGYSVKSHFRSVSLRRSAVVVSAITGASSGAGIGKGTADSLDTVKVLDLRGNEIPISDLWKDRKAVVAFARHFGCVLCRKRAAYLAEKKDVMDASGVALVLIGPGSIDQANTFVEQTKFKGEVYADPNHASYEALEFVSGVSVTFTPKAAMKILESYMEGYRQDWKLSFMKDTVERGGWQQGGILVAGPGKDNISYIRKDKEAGDDPPVEEILKACCA

SEQ ID NO: 2635 - DNA, 669 bp, Arabidopsis thaliana
atggcggaagaagttgggcttgatttggaagaactcaggcaactccagaacatcgccaagagacctcgtgttctcaatctcatcaattccgagatttcaaacttggagaagctgagagactctgcagtcagttcaaatgcgaaaccaaaggtaccagttacagttcctgcaccggtttcttcttcgggtaagccggtttcttcttcggcattgaactatgtaactctcggaacattcagctgggatcaagacaatgacaaagtcaagatgtacatatccttggaaggtgttgatgaggacaaggttcaagctgagttcaagccaatgtctttagacatcaagatccatgatgtacaaggaaaaaattaccgatgtgccatcccgaagttgtgtaaggagattatgcctgagaaatgtaaagtgcttgtaaagcctaagaggatagttatcactatggtcaagtcttccagaggaaactggcttgacattcaccacaaagaagacaagattaaaccgagtttggagaaagagaaagacccaatggctggaattatggggatgatgaagaacttgtatgaggatggagatgaagaaatgaagaagacaatagctaaagcctggacagatgctaggtcaggcaaagcagcagatcctttaaaaggactatga

SEQ ID NO: 2636 - protein, 222 aa, Arabidopsis thaliana
MAEEVGLDLEELRQLQNIAKRPRVLNLINSEISNLEKLRDSAVSSNAKPKVPVTVPAPVSSSGKPVSSSALNYVTLGTFSWDQDNDKVKMYISLEGVDEDKVQAEFKPMSLDIKIHDVQGKNYRCAIPKLCKEIMPEKCKVLVKPKRIVITMVKSSRGNWLDIHHKEDKIKPSLEKEKDPMAGIMGMMKNLYEDGDEEMKKTIAKAWTDARSGKAADPLKGL

SEQ ID NO: 2637 - DNA, 1374 bp, Arabidopsis thaliana
atggatgcaggtatgaacaacacttcttctcactacaagacgcaggctcgttgccctcttcaagaacactttcttcccaggaaaccttctaaggaaaacctggacaggttcataccgaacagatcagcgatgaattttgactatgctcactttgccctcactgaaggaagaaaaggtaaggatcagactgcagcggtaagttcaccatccaaagaggcctacaggaagcaattggctgagaccatgaacttgaaccacacaaggattctcgccttcagaaacaaacctcaggctcctgtcgaactgcttcccagcaatcactctgcttctcttcaccaacagcccaaatctgtaaagcctcgtcgatacattcctcagacttctgagaggaccttggatgcacctgacattgttgacgatttctacctcaacttgctggactggggaagtgcaaatgtcttagccatagcgttggaccacactgtctacttgtgggatgcttccactggttctacatctgagcttgtgaccattgatgaggagaagggacctgtcacaagtatcaactgggctcctgatggtcgtcatgttgcagttggactcaacaactctgaagtccagctgtgggattctgcatccaaccgtcaactgagaacattgaagggtggtcaccagtcacgagtaggatcactggcatggaacaatcacatccttactactggaggaatggatggactgatcatcaacaatgatgtgaggatcagatcacccattgtggaaacttacagaggtcacactcaagaagtttgtgggctcaagtggtcaggatctggacaacaactagcaagtggtggcaacgacaatgtggtacacatctgggatcgttctgtcgcttcctcaaactcaaccacacaatggctgcacaggcttgaggaacatacatctgctgtgaaggctcttgcgtggtgccctttccaagcgaatttgcttgcaactggtggtggtggaggagacaggacgatcaagttctggaatactcacactggggcttgcttgaattcagtagacactggttcccaagtttgttcgttgttatggagcaagaatgaaagagagttgcttagctcacacgggtttacacagaatcagctcacactttggaagtatccatccatggtgaaaatggctgagctcactggtcatacatcaagagttctatatatggcccagagtccagatggttgtaccgtagcttcagcagcaggagatgagactctgaggttctggaatgtttttggagtaccagagaccgccaaaaaagctgctccaaaagcagtttccgagccattttctcacgtgaatcgtattcgttga

SEQ ID NO: 2638 - protein, 457 aa, Arabidopsis thaliana
MDAGMNNTSSHYKTQARCPLQEHFLPRKPSKENLDRFIPNRSAMNFDYAHFALTEGRKGKDQTAAVSSPSKEAYRKQLAETMNLNHTRILAFRNKPQAPVELLPSNHSASLHQQPKSVKPRRYIPQTSERTLDAPDIVDDFYLNLLDWGSANVLAIALDHTVYLWDASTGSTSELVTIDEEKGPVTSINWAPDGRHVAVGLNNSEVQLWDSASNRQLRTLKGGHQSRVGSLAWNNHILTTGGMDGLIINNDVRIRSPIVETYRGHTQEVCGLKWSGSGQQLASGGNDNVVHIWDRSVASSNSTTQWLHRLEEHTSAVKALAWCPFQANLLATGGGGGDRTIKFWNTHTGACLNSVDTGSQVCSLLWSKNERELLSSHGFTQNQLTLWKYPSMVKMAELTGHTSRVLYMAQSPDGCTVASAAGDETLRFWNVFGVPETAKKAAPKAVSEPFSHVNRIR

SEQ ID NO: 2639 - DNA, 891 bp, Arabidopsis thaliana
atgacttcgtttcttagtttctccgccatttcagctcatccacctactttttccggcgcttcatttcgtcctcgctctttctctccccgattgttcaagtcttgtgttaagtgcacttatgctgaagctggattaagcagcgcttcatggtcagcccctattgacattgtggcagatgtcaaatccgaaagggttgtagttcttggtgggaatggtttcgttggctcagctatctgcaaagcagcaatctccaatggtattgaggttgtgagtgttagcaggtcaggtcgtcctaacttcgaagattcatggttggatcaggttacatgggttactggtgatgttttctatttgaattgggatgaagtacttcttggtgctactgctgtagtttcaaccattggtggttttggaaatgaagaacagatgaaaagaatcaatggtgaagctaacgttaccgctgtgaatgctgctaaggattttggggtccctaagttcgtcttgatcacggttcacgattacaatcttccgccatttattctctccaacggatatttcactggaaaacgtaacgcggaggcagaacttctttccaagtatcccacctcaggagttgtgctaagacccggtttcatatacgggaaacgaaaagtgaacggaatcgaggtcccgcttgatctagtcggggagccactagacaagatctatgattcagcagagaggttcattagaccattgaggtctctccctgcatctgatctcatcttggctccaccggttaacgtcgatgatttagcacttgctgtgatcaacgctgttaaagatgacgacttctttggcattttcactattgagcagatcaaagaagcagctgcaaaaatgagagcgtga

SEQ ID NO: 2640 - protein, 296 aa, Arabidopsis thaliana
MTSFLSFSAISAHPPTFSGASFRPRSFSPRLFKSCVKCTYAEAGLSSASWSAPIDIVADVKSERVVVLGGNGFVGSAICKAAISNGIEVVSVSRSGRPNFEDSWLDQVTWVTGDVFYLNWDEVLLGATAVVSTIGGFGNEEQMKRINGEANVTAVNAAKDFGVPKFVLITVHDYNLPPFILSNGYFTGKRNAEAELLSKYPTSGVVLRPGFIYGKRKVNGIEVPLDLVGEPLDKIYDSAERFIRPLRSLPASDLILAPPVNVDDLALAVINAVKDDDFFGIFTIEQIKEAAAKMRA

SEQ ID NO: 2641 - DNA, 807 bp, Arabidopsis thaliana
atgtgtagtttgtcggcgattatgttgttaccaacgaagctgaaaccagcttattcagacaaacggagtaacagtagcagcagcagctcactcttcttcaacaatagaagatccaagaagaagaaccaatcgattgttcccgttgcaaggttgtttggaccggcgattttcgaatcatccaaattgaaagtactcttcttaggggttgatgagaagaagcatccttcaacgctccctaggacttacacactcactcacagtgacattacagctaaactaaccttagctatttctcaatccataaacaactctcagttgcaaggatgggcaaataggctataccgggatgaagttgtggcagaatggaagaaagtgaaagggaaaatgtcgcttcacgttcattgtcacataagcggtggccatttccttttagatctctttgcaaagtttcgatatttcatcttttgcaaagaactacctgtggtgttgaaggcttttgtgcatggagatgggaacttgttgaacaactatcctgagctacaagaagctcttgtttgggtctatttccattctaatgtcaatgagttcaacaaagtcgagtgttggggtccgctttgggaagctgtttcgcctgatggtcacaagactgagactcttcccgaggctcggtgtgcggacgagtgtagttgttgttttccaaccgttagctcgattccatggtctcatagtcttagtaatgaaggtgtaaatggttactctgggactcagactgagggaattgctactccaaatccggagaaactctag

SEQ ID NO: 2642 - protein, 268 aa, Arabidopsis thaliana
MCSLSAIMLLPTKLKPAYSDKRSNSSSSSSLFFNNRRSKKKNQSIVPVARLFGPAIFESSKLKVLFLGVDEKKHPSTLPRTYTLTHSDITAKLTLAISQSINNSQLQGWANRLYRDEVVAEWKKVKGKMSLHVHCHISGGHFLLDLFAKFRYFIFCKELPVVLKAFVHGDGNLLNNYPELQEALVWVYFHSNVNEFNKVECWGPLWEAVSPDGHKTETLPEARCADECSCCFPTVSSIPWSHSLSNEGVNGYSGTQTEGIATPNPEKL

SEQ ID NO: 2643 - DNA, 1299 bp, Arabidopsis thaliana
atggcgatcaaagacctgacggcgacgaccggtgattcatctcttcctttaataaaatctccgccgtctgaaacaaccggcggtgacagaacctctgctcttcaaacgctcggtaacattatcgtctccatcgtcggtacaggcgtccttggtcttccttacgcattccgcatcgccggttggttagccggatctctcggtgtcattatcgtcggattcgccacctattactgcatgctcctcctcattcagtgcagagataagctagaatcggaagaaggagaagaagaatcgaaaacttatggtgatttaggtttcaaatgtatgggaacaaaaggtcgatacttaaccgaattcctcattttcactgctcaatgtggtggatcagtagcgtatttagtgttcataggtcgaaacttgtcatccatatttagttcgtatgggttaagtatggtttctttcatattgattctggttccaatcgaagttggattgtcgtggatcacttctttatcagctctctcgcctttcagtatctttgctgatatatgcaacatcatagcaatgtgttttgttgtcaaagaaaatgtggaaatggtgattgaaggagacttctcgtttagtgatagaactgctatttcgtctaccattggtggtttaccttttgctggaggagttgcggtgttctgttttgagggttttgcaatgacgttggctttggagagttctatgagggaaagagaagctttccctaaattgttagctaaagtgcttgccgggattacgtttgtctatgtgttgttcgggttttgtggttatatggcttatggtgatcaaacaaaggatatcatcactcttaacctcccaaataattggtctgccattgctgttcagattgggttatgtgtgggattgacgtttacatttccgatcatggtacatccgcttaacgagatcatagagcagaaactgaagaggatagactggcttcaaaagcatcataatgggtacagcaacgaaacaggttcagtctcaaaatttgcaatctttacaacgaggacacttttggtggtaggacttgcagcaatcgcgagtttagtcccagggtttggtacatttgcatctcttgttggaagtactttgtgcgcactcatctcctttgtgttgccggcttcttatcacctcacgctgctcggtccatcactaaatgtatggaacaaatccatcgacgtattcattgtgatttgcgggttgatctttgctgtttatggtacgtacaacacaatcgtcggagtgtga

SEQ ID NO: 2644 - protein, 432 aa, Arabidopsis thaliana
MAIKDLTATTGDSSLPLIKSPPSETTGGDRTSALQTLGNIIVSIVGTGVLGLPYAFRIAGWLAGSLGVIIVGFATYYCMLLLIQCRDKLESEEGEEESKTYGDLGFKCMGTKGRYLTEFLIFTAQCGGSVAYLVFIGRNLSSIFSSYGLSMVSFILILVPIEVGLSWITSLSALSPFSIFADICNIIAMCFVVKENVEMVIEGDFSFSDRTAISSTIGGLPFAGGVAVFCFEGFAMTLALESSMREREAFPKLLAKVLAGITFVYVLFGFCGYMAYGDQTKDIITLNLPNNWSAIAVQIGLCVGLTFTFPIMVHPLNEIIEQKLKRIDWLQKHHNGYSNETGSVSKFAIFTTRTLLVVGLAAIASLVPGFGTFASLVGSTLCALISFVLPASYHLTLLGPSLNVWNKSIDVFIVICGLIFAVYGTYNTIVGV

SEQ ID NO: 2645 - DNA, 1863 bp, Arabidopsis thaliana
atggagaaatttgcgcctgtcgctgctctgttactgcttcttctctgttttccggtagctttctccggtcatgattatggtcaagctctttccaagagtcttctcttcttcgaagctcagagatctggtgttcttcctcgtaaccaaagagtcacttggcgctctcactccggtctcaccgacggcaaatcaagcggcgtgaatctggtcggaggttactacgacgccggagacaatgtgaaatttggattaccgatggctttcacggtgacgatgatggcgtggagtgtgattgagtacgggaatcaattacaagccaacggcgagcttggaaactccattgacgccattaaatggggtactgattatttcatcaaagcccatcctgagcccaacgtcctttacggcgaggttggagatggcaacaccgaccattactgttggcagagaccggaagaaatgacgacggaccggaaagcttacaggatagatccgagtaatcccgggtcggatcttgccggagaaacagcagccgccatggccgccgcatcaattgttttccgccgatctaaccctgtttactctaggctactactcactcacgcctatcagttgtttgatttcgccgacaaatacagaggaaaatacgacagcagtatcactgttgcccagaaatactaccgatccgtcagcggttacaatgacgagttattgtgggccgctgcgtggctataccaagcttcgaacaatcagttctacttggactacttgggtcgcaacggtgacgccatgggtggtaccggttggtccatgactgagtttggttgggacgttaagtacgctggtgttcaaacccttgttgccaagtttttgatgcaaggcaaagcaggacgtcacgcacctgtgttcaggaagtatcaagagaaagctgattcctttatgtgttccttgttgggtaaaagctcgaggaacattcagaagacaccaggtggtttgattttcagacaacgttggaacaatatgcagtttgtcacaagcgcttccttcttgaccacggtttactcagattacctaacttcttctcgaagcaacttgagatgtgccgcgggaaatgtcgcaccttcgcagcttctttcctttgctaaatctcaggtggattatattcttggagataacccgagagctaccagctacatggttggttatggtaacaatttccctcagagagttcaccacagaggctcttccatcgtctctgtcaaggtggaccgtacatttgtcacctgccgaggtggatatgccacttggttcagccgtaaaggcagtgacccgaaccttctcactggtgctattgtcggtggccctgatgcttacgacaatttcgctgacaggagagataactatgagcagactgagcctgctacttacaacaatgcaccactccttggtgttcttgctcgtctcagcagtggtcattccggttatagccagtttcttccagtggttcctgctcctgttgtccgaagaccaatgcctattcgtagaccgaaagtgactactccagtccgagcttctggtccagtggctatagttcagaagataactagttcatgggtctcaaagggaaggacttactacagatactcaacaactgtgattaacaaatcttctagacctctgaaaagtctcaacctttcgatcaagaatctctatggaccaatctggggactctcgagatcaggcaactcgttcggtttaccctcgtggatgcactcattgccatccggaaaatccctagagttcgtctacattcactcaacaacacctgcaaatgtcgcggtatccagctacactttggcttga

SEQ ID NO: 2646 - protein, 620 aa, Arabidopsis thaliana
MEKFAPVAALLLLLLCFPVAFSGHDYGQALSKSLLFFEAQRSGVLPRNQRVTWRSHSGLTDGKSSGVNLVGGYYDAGDNVKFGLPMAFTVTMMAWSVIEYGNQLQANGELGNSIDAIKWGTDYFIKAHPEPNVLYGEVGDGNTDHYCWQRPEEMTTDRKAYRIDPSNPGSDLAGETAAAMAAASIVFRRSNPVYSRLLLTHAYQLFDFADKYRGKYDSSITVAQKYYRSVSGYNDELLWAAAWLYQASNNQFYLDYLGRNGDAMGGTGWSMTEFGWDVKYAGVQTLVAKFLMQGKAGRHAPVFRKYQEKADSFMCSLLGKSSRNIQKTPGGLIFRQRWNNMQFVTSASFLTTVYSDYLTSSRSNLRCAAGNVAPSQLLSFAKSQVDYILGDNPRATSYMVGYGNNFPQRVHHRGSSIVSVKVDRTFVTCRGGYATWFSRKGSDPNLLTGAIVGGPDAYDNFADRRDNYEQTEPATYNNAPLLGVLARLSSGHSGYSQFLPVVPAPVVRRPMPIRRPKVTTPVRASGPVAIVQKITSSWVSKGRTYYRYSTTVINKSSRPLKSLNLSIKNLYGPIWGLSRSGNSFGLPSWMHSLPSGKSLEFVYIHSTTPANVAVSSYTLA

SEQ ID NO: 2647 - DNA, 681 bp, Arabidopsis thaliana
atgatggtctcactagcttcatgtgtttcgtccccatcttcttcgtctctgttctttagtcgtcgggagagattacatttggtgaaagccacggtggatggcaggaaccagattgtcccaccggcaaaagatcaaatccctaacaaacaagtaacggagagtgtgaatgtattaaaaacggctgcaaaaactcggaaagttgcagcagatgagattttagctgctttctctgctatcgaaaaggctaagattgatccatccactttccttgaaacgcttggtggtcccgagtctcctggacgaacatggatgcttatcttcaccgccgagaagaaactgacgaaaggtcgttatttccctctaactgctgttcagagatttgatgctgcgggaaaaagaatagagaatggggtgtatcttggtccatttggagcattaacattcgaaggaaggttttcatggaagaatcggatactagcttttgtcttcgaacagatccgcataaagattggaccattagatcctctagagttcagcttggggaagaaagacgctgtggaagagcctagtaataaagaccctttcttcatttggttctacatcgatgaagaaatagccgttgctcgaggtagaagtggcggtacagctttctggtgtcgttgtcgtcgcattgcttcctaa

SEQ ID NO: 2648 - protein, 226 aa, Arabidopsis thaliana
MMVSLASCVSSPSSSSLFFSRRERLHLVKATVDGRNQIVPPAKDQIPNKQVTESVNVLKTAAKTRKVAADEILAAFSAIEKAKIDPSTFLETLGGPESPGRTWMLIFTAEKKLTKGRYFPLTAVQRFDAAGKRIENGVYLGPFGALTFEGRFSWKNRILAFVFEQIRIKIGPLDPLEFSLGKKDAVEEPSNKDPFFIWFYIDEEIAVARGRSGGTAFWCRCRRIAS

SEQ ID NO: 2649 - DNA, 1284 bp, Arabidopsis thaliana
atggtatctattggaaagacgacccaaatccaaagaccaaaccaggttacttccacaatgttcacggagtcatctccagcaatggatccggatttacccgaatccgaaacccgacccgaattcaatccctcctccactgattccaccgccatggcagagtcaaccgatgcaggggaaccgacggcattcgaattagcctcatcccaagtcacatccgtcgccgatctaccaccggaacgattcaattcgctcgacgaattaacacacgatctcggctcgctccacgagctttcgacccgtggctcatggcaagcgatcctcgagaagatatctcaagccagagctctcttcctcctcacaaagcctcacgagcatctcacttatctcacttaccaagttatggctctcgcgaagcttcgtcgctccgatgaagcttctcatgagcttaattccttgcacgatttcgacgggacgcattacaggtacgaatcgttccctgagatttaccctaatcggagaggatctatggttcctttctctttacgatggctctacgctttgatcccgactaagcttggtaatcgtcaggaagggttagatcgtttatatgttttgcttgactttgttcgagatcgaatcagagagaaagaatctcagagtttagagagttctgtggaattgtggaagaaaagagagacatttgtgatgaattgcttgctagggtttcatttaggtcacaaggaatttggggtgtctttggatttgatgaaggaattgatcaatcgtgatccgttagacccggttttgatttcgaaactagggtctgttcagatgcagtttggtgatgtagaaggagctaaaactacgtttgatagagttgagaagatgttgaatgaaggaaagagcaatggtttattgaacgagatacagttcaacaatcttgttggtaggaataaggctttggtttatgttgtggcaaaggactatgtttctgctgtgagagagtatgacaaatgcattgaaagggataactctgatattatcgctgtcaacaataaggctctttgtttgatgtacttgagagatctatcggatgcgattaaggtgatggaaagtgcattggagagagtgccaaccgcggctttgaacgagagcttggtggtgaatttgtgtagtatgtatgagttggcttatgttaatcatactgatgttaagcggacgttaaacaattggattgcacgtgttgctcctgatgactttgattcatcttgtaccagagtttga

SEQ ID NO: 2650 - protein, 427 aa, Arabidopsis thaliana
MVSIGKTTQIQRPNQVTSTMFTESSPAMDPDLPESETRPEFNPSSTDSTAMAESTDAGEPTAFELASSQVTSVADLPPERFNSLDELTHDLGSLHELSTRGSWQAILEKISQARALFLLTKPHEHLTYLTYQVMALAKLRRSDEASHELNSLHDFDGTHYRYESFPEIYPNRRGSMVPFSLRWLYALIPTKLGNRQEGLDRLYVLLDFVRDRIREKESQSLESSVELWKKRETFVMNCLLGFHLGHKEFGVSLDLMKELINRDPLDPVLISKLGSVQMQFGDVEGAKTTFDRVEKMLNEGKSNGLLNEIQFNNLVGRNKALVYVVAKDYVSAVREYDKCIERDNSDIIAVNNKALCLMYLRDLSDAIKVMESALERVPTAALNESLVVNLCSMYELAYVNHTDVKRTLNNWIARVAPDDFDSSCTRV

SEQ ID NO: 2651 - DNA, 1026 bp, Arabidopsis thaliana
atggttatgttgttacatagtgtgggactaattccatgttcaaaccaacaaaagtcttttctcttccatagttattaccgttacagatgcatagtttgttcatctgaaacaggtttgtccataagaagacaagctttggagcaagttgattctaagttgtctagtggagacgaaagagctgcattgtctcttgtcaaagatctccaaggaaaacctgatggccttcgatgttttggcgctgcaaggcaggtgcctcagagactctacacgttggaggaactgaaactgaatggtattaacgcagcttcacttctctcgccaacagatacaacgcttggctccatcgaaagaaaccttcagatcgcagctgtctcagggggaatagttgcttggaaagcctttgacttgagttctcaacagcttttctttcttactcttgggtttatgttcctgtggactttggatttggtctcttttaatggcggaattgggagtttggttcttgatacaactggtcatacgtttagccaacgataccataacagagttgttcagcacgaagcgggtcatttcttggtggcctacttagtcgggattctaccacgcggatacacgctctctagccttgaagctttacagaaagaaggatctctcaacattcaagctggctcagcttttgtagactatgaattccttgaagaagttaattctggaaaagtctccgctacgatgctgaacagattctcatgcattgctctggctggtgtagcaacagaatatctcctgtatggttatgctgaaggaggccttgacgatatcagcaagttagatggtttggtgaagagtttggggttcacacagaagaaagcggactcgcaggtgaggtggtcagtccttaacaccatactgctactacgtcgccatgagatagctcgatcgaagctcgcgcaggctatgtccaaaggagaatctgtcggatcttgtatccaaatcatcgaagattctatcgatccttctgatatctag

SEQ ID NO: 2652 - protein, 341 aa, Arabidopsis thaliana
MVMLLHSVGLIPCSNQQKSFLFHSYYRYRCIVCSSETGLSIRRQALEQVDSKLSSGDERAALSLVKDLQGKPDGLRCFGAARQVPQRLYTLEELKLNGINAASLLSPTDTTLGSIERNLQIAAVSGGIVAWKAFDLSSQQLFFLTLGFMFLWTLDLVSFNGGIGSLVLDTTGHTFSQRYHNRVVQHEAGHFLVAYLVGILPRGYTLSSLEALQKEGSLNIQAGSAFVDYEFLEEVNSGKVSATMLNRFSCIALAGVATEYLLYGYAEGGLDDISKLDGLVKSLGFTQKKADSQVRWSVLNTILLLRRHEIARSKLAQAMSKGESVGSCIQIIEDSIDPSDI

SEQ ID NO: 2653 - DNA, 3267 bp, Arabidopsis thaliana
atgggtctgcttaaaacttcatggcttcttctgcttttctgggttgtctcttcccctttgtgtttcaggtttcattactgttatggttcagagctctctgtgaagttcttgaaagcacctcctactacttctagatttacttcagccaaattttcctttcttgcttttgaggatggaaacagaacttgttcaagctgcaaattccgttgcaagctagatgaccgtattagtttggactgccatcaaagaaaagtttcttactcgaagttgctagatggagatcatacacttgaggtttgcgcaaataggatgcatggatttggctgcaatcactataattggactgttgatacggtttctcctacagcctttgtgactgcatcaatgccatttacaagtgcacaaaacgtgtctgttaatattacttttactgagccatgtgttggtagaggaggattcggctgttcatctgtgaattcctgcgaccttcttgtctatggtgctggccaagttataccgtcttcatttaccgttcttgaccaatatcttagatattcactgcttgtgggattatctcctgatgctcaatatggaaggattgtgttggtgatgaataagagtgtttgttctgatatagctggtaacaattttaaaagagctttgggttcgcgtttctttgtccattttgatagaagaaatgttttagtcaatctacgaactcatgtaccagagaagttacttaagctaaacaaccaaactaggacggtgcaggcaaccaatgataacaacaagttgaatgtttacttgtatttctctgaaccggtactgaattcttcggctgaaattctcagacgactaaacacaaaccaaggtgatttgcttcctatcgacggaaataccaacgggaatcgccgtttcgcgtttatggtcacaaatacatcacggcgtgcaatagtcacggtgacccttgactcgaattcaattagaagcagacatgggacacctgcatctccaactgcaccactcacttttctttatgataccgagagacctcatgttatattgaacacaacatctggtatgaggacaagaaagcacaccatccctgtctggatcaaattcatgaagccagtgtttgggtttaactcctcatttgtatcaatctcaggtggatatcttgatagctttgaggaactgagtggaagcatatacattgtatatgtaaaagccaacaccagtacactttctattaagattcctgaaaatgttactcaggatgtcgcgggaaacaaaaatcttgcatccaatatcctaaaagtgaaacattattctgtgcctatgatatcttctgtgatttcttgggtaacaacttacattttcttggtgacgtctttcgttgcgggactcctcactctttcaaccacaagcctttattctcttggcgcattcccaagaccatctccttatctgatatcagaccccacgaggaacctttttagaactgcctgtcacattcagttttttgcactcacgagatggctaccggtgacattgcctgttgattactatgaacttgtgagagggattcagtggataatcccttattttcctctcccatgggaaactaagatcaaggaacagatcatggtggccacaagtccttacattggtccacactccttcatttctaaaactcataacaacatgattaatcttaagacatcaaccaacgcggagtcagtattcggattgccactcaccgcaatggagtacagattattctttgagacttcaaatcttaagccagaagcagaacacgttcttggcctaccacattcaacagtgtggagagatttcaataggatcatgttttggatagctataattggaggaagtttggtactactgcatatagtcctctctctgatactgaagttcaagaaagcacacagtgagaagaagaggagttttggtgcgtttgtcttcccaagattcgagctgtttcttctcattctcgccttaccttcaatctgcaaagctgcaaggagccttatacaaggctattttaaacaccaaggagctgcagaagccagtgtcattgttggtatccttgtgctttgcgtggtagctattctgcttctggcattgtttctcttcctctcggtcgggataacgtttgggaagttgttacagtataaagagattcatcaagaaggccaaactttccactggtaccaagaactcatccgagtgacccttggtcctggtaaaagaggccaatggacatggaaaacagagaactctgtctatctaactaggttaggtccagttttcgaagatttaaggggtccaccaaagtacatgctcacacagatttcaggaagcaatccactcaagcaacaagatgatcggatcatcgcatcagatgatgaaaacgaagatgctgaagctccttgcatacagaaactctttggaatccttagaatttactacacatttctcgaaactgtgaagagggtgtgtttggggattattgctggtgctttccttgacaatgaaactgcgaaaactccgatagtggtcttgttgagcatcacttcctttcagctgtttttccttcttctgaagaagccattcatcaagaaaaaggtacagcttgtagagatcatctctatagcatgtcaagtcggcgtattcgcctcatgtctaatgctcttggcgaaagactttcccgaggcaagcggaaagaaactcgggatattcatggtcgtattgttcttgattggattcattatgctgatgtgcaacgaatggtactcattgtacaaacaaacaaagcggttagaccaaatcaacagatctttcttgagtggtcttaagatgtttatcattggacttgccgcgttaatcctacctcagaaaatgatcaagaacaagatccccgtggctcaactagaagcacgaagcagcagcaatggaggcacaaccccagaattcaggtatagaaattcttccggaagccgaagctcgggtagcttggacaagccatggttgaaacagattagagaaatggcaaagtctagcttcacaagagataggagcaatagtaaggttcctagtgatccttcgtgtagcaaaagcggttggagcagtagtatttggggaacaaagacaagtggaagctcttctaaggaatcatctgcagattacaaatccagacctaagggactttacaaagatttagaggccatttttgcttcaaagtaa

SEQ ID NO: 2654 - protein, 1088 aa, Arabidopsis thaliana
MGLLKTSWLLLLFWVVSSPLCFRFHYCYGSELSVKFLKAPPTTSRFTSAKFSFLAFEDGNRTCSSCKFRCKLDDRISLDCHQRKVSYSKLLDGDHTLEVCANRMHGFGCNHYNWTVDTVSPTAFVTASMPFTSAQNVSVNITFTEPCVGRGGFGCSSVNSCDLLVYGAGQVIPSSFTVLDQYLRYSLLVGLSPDAQYGRIVLVMNKSVCSDIAGNNFKRALGSRFFVHFDRRNVLVNLRTHVPEKLLKLNNQTRTVQATNDNNKLNVYLYFSEPVLNSSAEILRRLNTNQGDLLPIDGNTNGNRRFAFMVTNTSRRAIVTVTLDSNSIRSRHGTPASPTAPLTFLYDTERPHVILNTTSGMRTRKHTIPVWIKFMKPVFGFNSSFVSISGGYLDSFEELSGSIYIVYVKANTSTLSIKIPENVTQDVAGNKNLASNILKVKHYSVPMISSVISWVTTYIFLVTSFVAGLLTLSTTSLYSLGAFPRPSPYLISDPTRNLFRTACHIQFFALTRWLPVTLPVDYYELVRGIQWIIPYFPLPWETKIKEQIMVATSPYIGPHSFISKTHNNMINLKTSTNAESVFGLPLTAMEYRLFFETSNLKPEAEHVLGLPHSTVWRDFNRIMFWIAIIGGSLVLLHIVLSLILKFKKAHSEKKRSFGAFVFPRFELFLLILALPSICKAARSLIQGYFKHQGAAEASVIVGILVLCVVAILLLALFLFLSVGITFGKLLQYKEIHQEGQTFHWYQELIRVTLGPGKRGQWTWKTENSVYLTRLGPVFEDLRGPPKYMLTQISGSNPLKQQDDRIIASDDENEDAEAPCIQKLFGILRIYYTFLETVKRVCLGIIAGAFLDNETAKTPIVVLLSITSFQLFFLLLKKPFIKKKVQLVEIISIACQVGVFASCLMLLAKDFPEASGKKLGIFMVVLFLIGFIMLMCNEWYSLYKQTKRLDQINRSFLSGLKMFIIGLAALILPQKMIKNKIPVAQLEARSSSNGGTTPEFRYRNSSGSRSSGSLDKPWLKQIREMAKSSFTRDRSNSKVPSDPSCSKSGWSSSIWGTKTSGSSSKESSADYKSRPKGLYKDLEAIFASK

SEQ ID NO: 2655 - DNA, 1107 bp, Arabidopsis thaliana
atggggtgtacatcttccaagcaagcaaaagctaacgtcgtcgccgacgtttacaaaccaccgccgtctagtttcgcggtgtttgatgtcaacgccatccaagagccatggctaaaatttgaacatgaagatgatgagaaaccgccacgctccaccgtcttcgaccgtctcgacgaggatgatgatgatgatgatgatgatggtgatgacgctcctaaaacatgggaagaagtcagcaaatctctagaaactaaacttaaacctgccgccgttaaaccgccggaagtagactctgttaaacctccggcgactcctccacggcggcttccgcggaagagcgcatcgttccacacactggacgagcttgaagtgagggccaaaagaagcatcgccgcgcaaatcccgacgacaatggttaagcttaagagaaccgagtcgatgtccaagctaagacccgagtcagatgatcgaaccgagtccactcagtcgtcctactcggggcctcggtcagtgaaggagaacatattcgtcaagagagacagagaacggagggagaaagaagggaacaagaagccggtgatgaactgggacccacttagggagttcccggagaagtgtccgccgggaggaggggaaggtttgattgtctacacgacgtcgttgcaaggagtgcgtcgcacgtacgaggattgtatgcgtgtgagggccatcatggagcagcaaggagttgtggtggacgagagggacgtgtctttagacgccggagtcttgagcgagcttaaggagcttctccaagacgaagcatcagtggcgccgccgcgagtgtttgtgaaagggaggtacttgggaggagcagcggaagtgacagcgatgaatgagaacgggaagttagggagggtgttgcggtgggcacgtgtggagagagtaggggaggaagggaggctcacgtgtgaagggtgcggaggagcgaggtggttgccttgtttcgagtgcggcggaagctgtaaggtggcggcggttggggcggccaaaggtgaaaggtgggagaggtgtgtcaagtgtaatgagaatggattgattcgttgtcccgtgtgttttgttaattaa

SEQ ID NO: 2656 - protein, 368 aa, Arabidopsis thaliana
MGCTSSKQAKANVVADVYKPPPSSFAVFDVNAIQEPWLKFEHEDDEKPPRSTVFDRLDEDDDDDDDDGDDAPKTWEEVSKSLETKLKPAAVKPPEVDSVKPPATPPRRLPRKSASFHTLDELEVRAKRSIAAQIPTTMVKLKRTESMSKLRPESDDRTESTQSSYSGPRSVKENIFVKRDRERREKEGNKKPVMNWDPLREFPEKCPPGGGEGLIVYTTSLQGVRRTYEDCMRVRAIMEQQGVVVDERDVSLDAGVLSELKELLQDEASVAPPRVFVKGRYLGGAAEVTAMNENGKLGRVLRWARVERVGEEGRLTCEGCGGARWLPCFECGGSCKVAAVGAAKGERWERCVKCNENGLIRCPVCFVN

SEQ ID NO: 2657 - DNA, 780 bp, Arabidopsis thaliana
atggcgtcacgtttatgtcttctccttctcgttgcgtgtatcgccggagcatttgccggagacgtcatcgaactcaatcgatctcagagggagttcgattatttcgctctatctcttcaatggcctggaacctattgccgtggaactcgccattgttgctccaaaaacgcttgctgcagaggctccgatgctccaactcaattcacaattcatgggttatggcctgactataacgatggttcgtggccttcatgttgttatcgatctgactttaaagagaaggagatttcaacgttgatggatggtcttgagaagtactggcctagtctcagttgtggttctccatcatcatgcaatggtgggaaagggtcattttggggccacgagtgggagaaacatgggacttgttcttctcctgtttttcatgatgagtataattacttccttaccacacttaatctctacttgaagcataatgtcacggatgtcctttatcaagctggctatgttgcttccaacagtgaaaagtatcctctaggaggtatcgtaacagccattcagaatgcatttcatatcacccctgaagtggtttgcaaaagagatgcaatcgatgaaatacgtatatgcttctataaagattttaagcccagggactgtgttggttcacaagatttgacatctagaaagtcatgccccaagtacgtaagtttgccggaatacacgccattagatggtgaagctatggttctgaagatgccaacagaaagagaagctctttga

SEQ ID NO: 2658 - protein, 259 aa, Arabidopsis thaliana
MASRLCLLLLVACIAGAFAGDVIELNRSQREFDYFALSLQWPGTYCRGTRHCCSKNACCRGSDAPTQFTIHGLWPDYNDGSWPSCCYRSDFKEKEISTLMDGLEKYWPSLSCGSPSSCNGGKGSFWGHEWEKHGTCSSPVFHDEYNYFLTTLNLYLKHNVTDVLYQAGYVASNSEKYPLGGIVTAIQNAFHITPEVVCKRDAIDEIRICFYKDFKPRDCVGSQDLTSRKSCPKYVSLPEYTPLDGEAMVLKMPTEREAL

SEQ ID NO: 2659 - DNA, 537 bp, Arabidopsis thaliana
atgcctctttctctccgtctttctccttcgccgacggctttatctccgactaccggaggatttggtccatcgaggaaacagtgccggattccttactccggcgtcccgacgacgaagattggtttctgttctttggattctaggaaaagaggagattcctctgttgttaggtgtagcttagaaaccgttaatgtcagtgttggtcaggtgacggaggtcgataaggacacgttctggcccatcgttaaagccgccggtgaaaagcttgtcgtacttgacatgtacactcaatggtgtggtccatgtaaagtgattgcccctaaatacaaagctttatcagagaagtacgacgacgttgtgtttctaaagcttgactgcaatccagataaccggccattggcaaaagagctaggaataagagtggttccaactttcaagattttgaaggataacaaggttgtcaaggaagtgaccggtgcaaaatacgatgatctggttgcagcgattgaaacagcgaggtctgctgcttccggatga

SEQ ID NO: 2660 - protein, 178 aa, Arabidopsis thaliana
MPLSLRLSPSPTALSPTTGGFGPSRKQCRIPYSGVPTTKIGFCSLDSRKRGDSSVVRCSLETVNVSVGQVTEVDKDTFWPIVKAAGEKLVVLDMYTQWCGPCKVIAPKYKALSEKYDDVVFLKLDCNPDNRPLAKELGIRVVPTFKILKDNKVVKEVTGAKYDDLVAAIETARSAASG

SEQ ID NO: 2661 - DNA, 885 bp, Arabidopsis thaliana
atggatcggcaaaattccgatgacatcatgagatttctcgatggaatggctagctccgacgacgttcttttcggttttcttgacgaaggaaaccagtcaccggaagatttctccgtaaacctcaacgccggcgaagatgacggtgacgaagacgacaataataacaattctgaagataacaaagctttttggcaggaacacgaacaacttcttcaggggacactgtataggacaagttccattgagacaaagattagacaagctacaaaagaagcgttgaaacaagttaaatctaagggtctttattgtgtttgccggcgaccagtggacggcggttgccggagttgcttacgtggcgaaatctctagacacctaagagatgtcgccggctacgattgcgtcatctctaaatctaaatggagaagttgtcaagacatccctgcaggggaacacgaatttatagagattgtggaccgatcgggttcaaagaaaagcgagatgcgagtggtgattgagttatcatttagggcagagtttgagattgcaaaaggcagtgaagagtacaaaagacttatcagtcgattgcctgaggtttacgtcgggaaaaccgagaggcttcgatctctgataaagatattgtgcatagcgggaaagaaatgcttgagagacaagaaaatgcatatggctccttggagaaaacacaagtacatgcaagccaagtggcttggcacatgtgatcgatctagctccttggaagcttcggtttccgaggccatggagccagaaaattgggtgccggtggcgaagcctagggtttctatgttgaactatgatggtctcttaggtggtttctctgccggtccggccactgtagcggtcgtgtga

SEQ ID NO: 2662 - protein, 294 aa, Arabidopsis thaliana
MDRQNSDDIMRFLDGMASSDDVLFGFLDEGNQSPEDFSVNLNAGEDDGDEDDNNNNSEDNKAFWQEHEQLLQGTLYRTSSIETKIRQATKEALKQVKSKGLYCVCRRPVDGGCRSCLRGEISRHLRDVAGYDCVISKSKWRSCQDIPAGEHEFIEIVDRSGSKKSEMRVVIELSFRAEFEIAKGSEEYKRLISRLPEVYVGKTERLRSLIKILCIAGKKCLRDKKMHMAPWRKHKYMQAKWLGTCDRSSSLEASVSEAMEPENWVPVAKPRVSMLNYDGLLGGFSAGPATVAVV

SEQ ID NO: 2663 - DNA, 1557 bp, Arabidopsis thaliana
atggatcgacggggcaagtattgggccggaccgatgtggatcgggttgagtatgtgcggatcgggctctgataccatattagagtgtaggttaagattattcaaacttcaaaggcaaaaccaaatgagcttcgtgtggtccgctgcggtgtgggtcatagctgtagccgctgttgtgattagcaaatggttataccgatggtcgaacccgaagtgcaatggcaagttaccaccgggatcaatgggtttaccgatcatcggagagacatgcgacttctttgagccccatggattatacgagatctcaccctttgtcaagaagaggatgttaaagtacgggccattgtttcggacaaatattttcggatcgaacaccgtggttttgacagaacctgatatcatcttcgaagtttttcggcaagagaacaagtcttttgtgtttagctatccagaagcttttgtcaagccatttggaaaagaaaacgtgttcctcaaacatggaaacatccacaagcacgtcaagcaaatcagtcttcaacatcttggctctgaggctttaaaaaaaaagatgataggagaaatagacagagtaacctatgagcatcttagatcgaaggctaaccagggtagcttcgatgctaaggaggcagttgaaagtgttataatggcgcacttgaccccaaagataataagtaacctcaaaccagaaacacaagcaactcttgtggacaatataatggccctaggatctgaatggtttcagtcacccttgaagcttacgactttgatttctatctacaaagtctttattgcacgtagatacgccctccaggtgataaaggacgttttcacgaggaggaaagcgtccagagaaatgtgcggagacttcctcgacacaatggtagaagagggggagaaagaagacgtcatttttaatgaagaaagtgctataaatctcatattcgctattttggtcgtcgctaaagaatctacctcttccgttactagcttggccatcaaatttcttgccgaaaaccataaagctctcgcagagttgaagagggagcatgcggccatccttcaaaatagaaatggtaaaggagctggagttagctgggaagaatacagacaccaaatgactttcactaacatggtgataaatgagactcttcgaatggcaaacatggctcctataatgtatagaaaggctgtgaacgatgtcgaaatcaaaggttacacaattccagcgggctggattgtggcggttataccaccagctgtccatttcaatgatgctatttatgagaatcctttggagttcaatccatggagatgggaggggaaagagttgcggtctggatctaagacgttcatggtgtttggaggtggagtgagacagtgtgtcggcgcggagtttgcgagactacaaatttctatcttcattcatcatcttgtaacaacctacgatttctcattggcccaagaatcggagttcatccgtgcaccactcccatacttccccaaaggactgcctatcaagatttcccagtcactctag

SEQ ID NO: 2664 - protein, 518 aa, Arabidopsis thaliana
MDRRGKYWAGPMWIGLSMCGSGSDTILECRLRLFKLQRQNQMSFVWSAAVWVIAVAAVVISKWLYRWSNPKCNGKLPPGSMGLPIIGETCDFFEPHGLYEISPFVKKRMLKYGPLFRTNIFGSNTVVLTEPDIIFEVFRQENKSFVFSYPEAFVKPFGKENVFLKHGNIHKHVKQISLQHLGSEALKKKMIGEIDRVTYEHLRSKANQGSFDAKEAVESVIMAHLTPKIISNLKPETQATLVDNIMALGSEWFQSPLKLTTLISIYKVFIARRYALQVIKDVFTRRKASREMCGDFLDTMVEEGEKEDVIFNEESAINLIFAILVVAKESTSSVTSLAIKFLAENHKALAELKREHAAILQNRNGKGAGVSWEEYRHQMTFTNMVINETLRMANMAPIMYRKAVNDVEIKGYTIPAGWIVAVIPPAVHFNDAIYENPLEFNPWRWEGKELRSGSKTFMVFGGGVRQCVGAEFARLQISIFIHHLVTTYDFSLAQESEFIRAPLPYFPKGLPIKISQSL

SEQ ID NO: 2665 - DNA, 2301 bp, Arabidopsis thaliana
atgaataactctttacaaagttctaaacttgtgcttctattggctattgctttggtcctatttcttaacacggagctggattttcttacagctgctggagccttagacagtgatagcaaagtttatatagtgtatcttggcgaaagagaacacgatgatcctgaacttgtcacagcttctcatcaccagatgcttgaatcacttcttcaaagcaaagaagacgcacaaaactccctgatctacagctaccaacatggattctctggtttcgcggcgcttcttacatcatcacaagctaagaaaatttcagagcatccagaagttatccatgttataccaaaccggattcggaaacttaaaaccacaagagcttgggatcaccttggcctctctccaattccaacttctttttcttcattatcatctgtaaaaggtcttcttcatgacaccaacttgggcagtgaagctatcatcggtgtcattgattccgggatatggccagagtcaaaggcagtcaacgatcaaggccttggaccaatacctaagcgttggagaggaaaatgtgaacctggagaacagtttaacgccacaatacattgcaacaacaagctaataggagctaggtactatctaaacggtgtagtcgccgcaattggaggaaaattcaacagaacaatcatccaagatttccaatccaccagagatgcaaacggtcacggtacacatacagccacaatagctggtggctcatttgtccccaacgtgagctactttggtttagcccaaggtcttgtccgaggtggtgctcctcgagcccgaatagcctcgtacaaggcgtgttggaacgtaatgagagatgaaggaggaggaactgatggaagatgcacatctgctgatatgtggaaggcttttgatgatgctatacatgatggggttgatgttttgtcggtttctatcgggggaggtattcccgaggattcggaagtcgataagctcgattatatcgcggcttttcacgcggtggctaaagggattacggttgtggctgctgcgggtaacgaagggcctggtgctcacactgttgacaatgttgctccttggcttttgactgttgctgcaactactcttgaccggtcttttcctacaaagatcacacttgggaataatcaaaccctcttcgctgaatctctgttcactggaccggagatttcaaccggtttagctttcttggactcagacagtgatgacactgttgatgtgaaggggaaaacagttcttgttttcgatagtgcaactccaattgcagggaaaggtgtagcagcagtgatcctagcccaaaagcctgatgatcttctttctcgatgcaatggtgtaccatgcatttttccagattacgagtttggaactgagattttaaaatacatacgtaccaccagatctcccacggtgagaattactgcagctactacactaactggtcagcctgcaacaactaaggttgctgcattctcatgtagagggcctaattcggtttcaccagccattctcaagcctgatatagcagctccgggtgtgagcatactcgcggcaataagtccgcttaatccagaagaacagaacggatttggacttctttcagggacatcaatgtcaactcctgttgtttctggaataatagctctcctaaaatctcttcaccctaagtggtctcctgctgcagtgagatcagctttggtcacaacagcttggaggacaagtccatctggagaaccaatctttgctgaaggatcaaacaagaagcttgcagatccatttgactatggaggaggacttgtaaaccctgaaaaagctgctaaaccaggacttgtctacgatatggggattgtggattacatcaagtatatgtgttctgcgggttacaacgactcttcaatctctcgtgtgctcggtaaaaagactaattgcccaattcctaagccatcaatgcttgatatcaacttaccttcaatcacaattccaaatcttgagaaagaagtcacactcacaagaactgtaaccaatgttggacccatcaagtcagtctatagagctgtgatcgagtctcctctcggtataactctcaccgtgaacccaaccacactcgtgtttaagtctgcagctaagagagtactcactttctcggttaaggctaaaacaagtcacaaagtcaacactggctacttctttggaagcttaacatggagtgatggtgttcatgatgttataatccctgtctctgttaagacaacgatttcgatgtaa

SEQ ID NO: 2666 - protein, 766 aa, Arabidopsis thaliana
MNNSLQSSKLVLLLAIALVLFLNTELDFLTAAGALDSDSKVYIVYLGEREHDDPELVTASHHQMLESLLQSKEDAQNSLIYSYQHGFSGFAALLTSSQAKKISEHPEVIHVIPNRIRKLKTTRAWDHLGLSPIPTSFSSLSSVKGLLHDTNLGSEAIIGVIDSGIWPESKAVNDQGLGPIPKRWRGKCEPGEQFNATIHCNNKLIGARYYLNGVVAAIGGKFNRTIIQDFQSTRDANGHGTHTATIAGGSFVPNVSYFGLAQGLVRGGAPRARIASYKACWNVMRDEGGGTDGRCTSADMWKAFDDAIHDGVDVLSVSIGGGIPEDSEVDKLDYIAAFHAVAKGITVVAAAGNEGPGAHTVDNVAPWLLTVAATTLDRSFPTKITLGNNQTLFAESLFTGPEISTGLAFLDSDSDDTVDVKGKTVLVFDSATPIAGKGVAAVILAQKPDDLLSRCNGVPCIFPDYEFGTEILKYIRTTRSPTVRITAATTLTGQPATTKVAAFSCRGPNSVSPAILKPDIAAPGVSILAAISPLNPEEQNGFGLLSGTSMSTPVVSGIIALLKSLHPKWSPAAVRSALVTTAWRTSPSGEPIFAEGSNKKLADPFDYGGGLVNPEKAAKPGLVYDMGIVDYIKYMCSAGYNDSSISRVLGKKTNCPIPKPSMLDINLPSITIPNLEKEVTLTRTVTNVGPIKSVYRAVIESPLGITLTVNPTTLVFKSAAKRVLTFSVKAKTSHKVNTGYFFGSLTWSDGVHDVIIPVSVKTTISM

SEQ ID NO: 2667 - DNA, 552 bp, Arabidopsis thaliana
atgtctttttcttccctcaaattgccaatctttctcattctctcaagtcttctccatgcggctataggggaaaacattgtttgcgagaatctgccaacaaatatgtgctcgttctcaatatccgcttccgggaaaagatgtatattggagacggctaatgtcgccggagaattcacttgccgcacttccgcagtggacgtggaagggattgtaaaccacgtggagaccgacgagtgcgtttccgcttgtggggttgatcggaaaaccgtagggatctcgtcagactccttgatggaggcaggtttcgccgctaagctttgctcatccgcttgcttggactattgccctaacattcttgatctctatttcaacctcgccgccggtgaaggtgcatttttacctgatctatgtgatgctcaacggatgaatccccagcgttcgatgatggaattcatcagctccggcgccgcaccaggccctgtctccgaaattgcaccaggccccacctccgaagaagtctcatctcctgctctagctccggcttctatgtaa

SEQ ID NO: 2668 - protein, 183 aa, Arabidopsis thaliana
MSFSSLKLPIFLILSSLLHAAIGENIVCENLPTNMCSFSISASGKRCILETANVAGEFTCRTSAVDVEGIVNHVETDECVSACGVDRKTVGISSDSLMEAGFAAKLCSSACLDYCPNILDLYFNLAAGEGAFLPDLCDAQRMNPQRSMMEFISSGAAPGPVSEIAPGPTSEEVSSPALAPASM

SEQ ID NO: 2669 - DNA, 1170 bp, Arabidopsis thaliana
atggcgaatggagctaatagagtggatctcgacgggaaaccgatacaaccgttgacaatatgcatgatcggcgccggaggtttcatcggttcacatctctgtgaaaagctcttgaccgagacgccacataaggtgcttgcgctcgatgtttacaacgataagatcaaacacttgcttgagcctgataccgttgaatggagtggtcggatccagtttcatcgtatcaatattaagcatgattcgagacttgaaggtcttgttaagatggcggatctgattataaatcttgctgcgatctgtactccagctgattacaatacacgtcctcttgatactatctacagcaatttcattgatgcgcttccagttgtgaaatactgttctgagaacaacaagcgtctcattcacttttctacctgtgaagtttatggaaaaaccattggaagctttcttcctaaggatcatcctctgcgtgatgatcctgctttctatgttcttaaagaagatatttccccttgcatatttggttcaattgagaagcagaggtggtcatatgcgtgtgcaaagcaactgattgagagacttgtttacgctgagggtgctgagaatgggcttgagttcaccatcgtacgaccttttaactggattggacctaggatggatttcatccccggcattgatggtcctagcgaaggtgtcccacgtgtccttgcctgctttagtaacaatcttctacgtcgtgagcctctcaagcttgtagatggtggagaatcacagagaactttcgtctacatcaatgatgctattgaagctgtccttttgatgattgaaaacccagagagggcaaatgggcacatcttcaacgtaggcaacccgaacaacgaagttacagtaagacagctcgctgaaatgatgaccgaggtttacgcaaaagtgagtggagaaggagccattgagagcccaacggttgatgttagctccaaagagttttacggggaaggttatgatgacagtgacaagagaatcccagacatgaccatcattaaccgccaactcggatggaacccgaaaacatcgctatgggacttgctcgagtcgaccttaacctaccagcacaggacatacgctgaagctgtgaagaaggcaacatccaaaccagtggcttcctaa

SEQ ID NO: 2670 - protein, 389 aa, Arabidopsis thaliana
MANGANRVDLDGKPIQPLTICMIGAGGFIGSHLCEKLLTETPHKVLALDVYNDKIKHLLEPDTVEWSGRIQFHRINIKHDSRLEGLVKMADLIINLAAICTPADYNTRPLDTIYSNFIDALPVVKYCSENNKRLIHFSTCEVYGKTIGSFLPKDHPLRDDPAFYVLKEDISPCIFGSIEKQRWSYACAKQLIERLVYAEGAENGLEFTIVRPFNWIGPRMDFIPGIDGPSEGVPRVLACFSNNLLRREPLKLVDGGESQRTFVYINDAIEAVLLMIENPERANGHIFNVGNPNNEVTVRQLAEMMTEVYAKVSGEGAIESPTVDVSSKEFYGEGYDDSDKRIPDMTIINRQLGWNPKTSLWDLLESTLTYQHRTYAEAVKKATSKPVAS

SEQ ID NO: 2671 - DNA, 585 bp, Arabidopsis thaliana
atgcaggatctgacgtcagcagcagcgtattatcatcagtcgatgatgatgacgacggcgaaacagaaccaaccagagttaccagaacaagaacagctaaagtgtcctcgctgtgactcacctaacactaaattctgttactacaacaattacaatctgtcacagccccgtcacttttgcaaaaactgtcgtcgttactggactaaaggcggtgctcttcgtaacatccccgtcggtggtggaactcggaaaagcaacaaacgatccggttcttctccgtctagtaatctcaagaaccaaaccgtcgctgagaaacctgatcatcatgggtccgggtcagaagaaaaagaagagagagtttcgggtcaagaaatgaatccgacccggatgttatacgggttaccagttggagatccgaatggtgcgagttttagttcgttgttggcgtcgaatatgcagatgggtgggcttgtttacgagtccgggtcgcgttggttaccaggtatggatttgggtttgggttcggtacggaggagtgatgacacgtggactgacttagctatgaacagaatggagaagaattga

SEQ ID NO: 2672 - protein, 194 aa, Arabidopsis thaliana
MQDLTSAAAYYHQSMMMTTAKQNQPELPEQEQLKCPRCDSPNTKFCYYNNYNLSQPRHFCKNCRRYWTKGGALRNIPVGGGTRKSNKRSGSSPSSNLKNQTVAEKPDHHGSGSEEKEERVSGQEMNPTRMLYGLPVGDPNGASFSSLLASNMQMGGLVYESGSRWLPGMDLGLGSVRRSDDTWTDLAMNRMEKN

SEQ ID NO: 2673 - DNA, 588 bp, Arabidopsis thaliana
atggcaacagcatcgttcaacatgcaatcagtcttcgccggtggattaaccactcgcaagatcaacaccaacaagcttttctccgccggtagcttccctaacctcaagaggaattatccggtgggagtgagatgcatggctgagggaggacccacgaatgaagactcttcaccagcaccatctacctcggccgctcagccgttgccgaagtcaccatctcctcctcctcctatgaaacctaaggtgagcacaaagtttagcgacttgctagcgtttagcggtccagcaccagagaggattaacggacgtttagcgatggttggattcgttgcggcgttggctgtcgagctatccaagggtgaaaacgttttagctcagatctccgacggtggcgtctcatggttcctcggtacaacagcgatcttgacacttgcgtcgcttgtgccgcttttcaagggcataagcgttgagtccaagtccaaaggtatcatgacgtcagacgctgagctttggaacggacgtttcgcgatgctcggtttggtcgcgttggcgttcactgagttcgtcaaaggtgggacactcgtctaa

SEQ ID NO: 2674 - protein, 195 aa, Arabidopsis thaliana
MATASFNMQSVFAGGLTTRKINTNKLFSAGSFPNLKRNYPVGVRCMAEGGPTNEDSSPAPSTSAAQPLPKSPSPPPPMKPKVSTKFSDLLAFSGPAPERINGRLAMVGFVAALAVELSKGENVLAQISDGGVSWFLGTTAILTLASLVPLFKGISVESKSKGIMTSDAELWNGRFAMLGLVALAFTEFVKGGTLV

SEQ ID NO: 2675 - DNA, 1188 bp, Arabidopsis thaliana
atggctgtctcaactatctactcaacacaagctctcaattcaactcatttcttaacctcttcttcctcctccaaacaagtcttcctctaccgtcgtcaaccacaaaccaaccgtagattcaacacactcatcacttgcgcacaagaaaccatcgtgatcggactagctgctgactctggctgcggcaaaagtacctttatgcggaggctcaccagcgtctttggtggcgctgctaagccaccaaaaggcgggaaccctgattccaacacactcatcagcgacacgaccactgtgatctgtcttgatgattaccattctttggataggtacggtaggaaagagcagaaagtcaccgctttggacccacgcgccaatgactttgatctcatgtatgagcaagtcaaagctcttaagaatggtatagccgtcgagaaaccgatttataaccatgtcactggacttcttgaccctccggagcttattcagcctcctaagattcttgtcatcgaaggtcttcacccaatgtttgatgagcgagtaagagacttactagacttcagtatctacttggacattagcaacgaagtcaaattcgcttggaaaattcagagggacatggctgaaagaggtcacagtttggagagcatcaaagcgagtatcgaagcccgaaagcccgacttcgatgcattcatcgacccgcaaaagcagtacgcggatgcggtcatagaagtgcttcctacgactctgatcccagatgacaacgaagggaaagtgttgagagtgagattgataatgaaggaaggtgttaagtacttcagcccggtttacctgttcgatgaaggttcaaccatctcgtggattccttgcggccgcaaactcacttgctcgtaccctggcatcaagttcaactacgaacctgactcctacttcgaccatgaggtatcagttttggagatggatggacaatttgatagactggacgagctgatttacgtggaaagtcacttgagcaacctctcgaccaaattctacggagaagtcactcaacaaatgctcaaacatgctgatttcccgggtagcaacaacggtactggtcttttccaaaccattgttggattgaagatcagagatctctatgagcagctcattgccaacaaagccactgctcgtgcagaagctaaagcctaa

SEQ ID NO: 2676 - protein, 395 aa, Arabidopsis thaliana
MAVSTIYSTQALNSTHFLTSSSSSKQVFLYRRQPQTNRRFNTLITCAQETIVIGLAADSGCGKSTFMRRLTSVFGGAAKPPKGGNPDSNTLISDTTTVICLDDYHSLDRYGRKEQKVTALDPRANDFDLMYEQVKALKNGIAVEKPIYNHVTGLLDPPELIQPPKILVIEGLHPMFDERVRDLLDFSIYLDISNEVKFAWKIQRDMAERGHSLESIKASIEARKPDFDAFIDPQKQYADAVIEVLPTTLIPDDNEGKVLRVRLIMKEGVKYFSPVYLFDEGSTISWIPCGRKLTCSYPGIKFNYEPDSYFDHEVSVLEMDGQFDRLDELIYVESHLSNLSTKFYGEVTQQMLKHADFPGSNNGTGLFQTIVGLKIRDLYEQLIANKATARAEAKA

SEQ ID NO: 2677 - DNA, 561 bp, Arabidopsis thaliana
atggcggcatcatcatctcatctcttcgcactcccttcgcctgcttctccgtttctatctgcaccaaaccggaatcgagttcgtgttcttgcgaaatcatgcccggagaatcagagcttcgactccaacgattcggattcttcctcagagactacccacaaagcccagggagatcagaaatcagtgtcacggagacagtggatgacggcatgtgtgtgcgcatctgcagctttaattagcaattcttatacctttgtctctgtacaaagcgcagccgctttagacaagaaaccaggaggttcatgtcgtaactgccagggcagtggtgctgttctttgtgatatgtgtggtggtacaggaaaatggaaagctctcaaccgaaaacgtgcgaaagatgtatatgagtttacggaatgtccaaactgttacggtcgaggtaagcttgtttgtccggtctgtttaggtacaggtttaccaaacaacaaaggccttcttagaaggcctggtgctcgtgagctactcgaaaagatgtacaatggtcggcttcttcctgattcatga

SEQ ID NO: 2678 - protein, 186 aa, Arabidopsis thaliana
MAASSSHLFALPSPASPFLSAPNRNRVRVLAKSCPENQSFDSNDSDSSSETTHKAQGDQKSVSRRQWMTACVCASAALISNSYTFVSVQSAAALDKKPGGSCRNCQGSGAVLCDMCGGTGKWKALNRKRAKDVYEFTECPNCYGRGKLVCPVCLGTGLPNNKGLLRRPGARELLEKMYNGRLLPDS

SEQ ID NO: 2679 - DNA, 996 bp, Arabidopsis thaliana
atgggtcgtggttacaatttgctattcgttctagtaacgtttttagtattggttgcagctgtaaccgcacaagggaaccgtggctcaaacagcggtggtggtcgaagaccacatgttgggttttatgggaatagatgccgaaacgtagagtctattgtgagatctgtagttcagtctcatgtccggtctatcccggctaatgcacctggaattttgcgaatgcatttccacgattgctttgtccatggctgcgatggctcggttctcctcgctggtaacacctcagagagaaccgcagttccgaaccgttcattgagagggttcgaagttattgaagaagctaaggctcggcttgagaaggcttgtcctcgtaccgtttcttgtgctgatattctcacccttgcagcccgagacgccgtcgttttgaccggtggacaacgctgggaagtgcccttgggacgtctcgacggccgaatctcgcaagcctcagacgtgaacttgcccggaccaagcgactccgttgctaagcagaagcaagacttcgctgctaaaactctcaacacattagacctcgtgactcttgttggcggacacacaataggaactgctggctgcggtctagtaaggggaaggttcgttaacttcaacggcacaggacaacctgacccatcaatcgacccgagttttgtgccgctgattctggctcagtgccctcaaaatggaggcacccgagtggagttagacgagggaagtgttgacaagtttgacacatcgttcctaaggaaggtgacgtcaagtcgcgtggttctccaatccgatctagtcctatggaaggatcccgagacccgagccatcattgaacgtttattaggattacgccgaccatccttgaggttcggaaccgagttcgggaagtcgatggtcaaaatgagtctcatagaagttaagactggatcagatggggagattcgtcgggtttgttccgccatcaactaa

SEQ ID NO: 2680 - protein, 331 aa, Arabidopsis thaliana
MGRGYNLLFVLVTFLVLVAAVTAQGNRGSNSGGGRRPHVGFYGNRCRNVESIVRSVVQSHVRSIPANAPGILRMHFHDCFVHGCDGSVLLAGNTSERTAVPNRSLRGFEVIEEAKARLEKACPRTVSCADILTLAARDAVVLTGGQRWEVPLGRLDGRISQASDVNLPGPSDSVAKQKQDFAAKTLNTLDLVTLVGGHTIGTAGCGLVRGRFVNFNGTGQPDPSIDPSFVPLILAQCPQNGGTRVELDEGSVDKFDTSFLRKVTSSRVVLQSDLVLWKDPETRAIIERLLGLRRPSLRFGTEFGKSMVKMSLIEVKTGSDGEIRRVCSAIN

SEQ ID NO: 2681 - DNA, 723 bp, Arabidopsis thaliana
atggatgctcgtaagagaggacgccctgaagctgctgcctctcacaactccaatggcggattcaagaggtctaagcaagagatggaatcaatttcaactggtttaggaagcaaatccaagccatgcactaaatttttcagcacttctggatgtccatttggtgacaattgccacttcttgcactatgtgcccggtgggtacaatgctgcagcgcagatgacaaatctccgaccaccggtttctcaagtttccagaaatatgcaaggatctggtggtcccggcggcagattctcagggagaggagatccaggatcaggccctgtttcaatctttggtgcttctacttccaagatcagtgtagatgcttctttagccggtgccatcattggaaaaggtggaatccattccaaacagatatgccgtgaaacaggagcaaaattatcgattaaagatcatgaaagagacccaaacttgaagattatcgagctggaaggaacatttgaacagatcaatgtagcgagtgggatggtgagagagcttatagggaggcttggatcagtgaagaaacctcaagggattggtggtcctgaagggaaaccacatcctgggagcaactacaaaaccaagatctgtgataggtactctaaagggaactgtacatatggagatagatgccattttgctcatggtgaatctgagctgcgcaggtcaggaatcgcttag

SEQ ID NO: 2682 - protein, 240 aa, Arabidopsis thaliana
MDARKRGRPEAAASHNSNGGFKRSKQEMESISTGLGSKSKPCTKFFSTSGCPFGDNCHFLHYVPGGYNAAAQMTNLRPPVSQVSRNMQGSGGPGGRFSGRGDPGSGPVSIFGASTSKISVDASLAGAIIGKGGIHSKQICRETGAKLSIKDHERDPNLKIIELEGTFEQINVASGMVRELIGRLGSVKKPQGIGGPEGKPHPGSNYKTKICDRYSKGNCTYGDRCHFAHGESELRRSGIA

SEQ ID NO: 2683 - DNA, 897 bp, Arabidopsis thaliana
atggttagtgagagaagagtgcatccggattgtataaacgcttcaaatccttatcacgagtgtgtcgagtattgctttaagaaaatcgctgaagcaaaggccagattcgagaagcagaacactggattagctaaagttcacgagcagacgagggagccgctcgatgataaaagaatagaggaagatagttcagaagaagaagaggaggaagaggataaccaagaacctcaagtagatgtaactcaacttacagggagacaaaagaagttgtttgagttgagacttaagatgaatgaagcaagaaaatccaatcagacggatgtcgggagtgaaaagaagaaaatggaagcaccaacagagacaaaaggaatctcaaaacagaaatggttggaggggaggaagaaaaagattgggaaacttcttgatgctaatggtttagatatgacacaggcttatatgctcgatactcaagaagcagctgaatcaaaatacaaaaaatgggaaaaggaacctacgcctgcgggttgggatgtctttaaccagaagacgttatacaacgcatacaagaaacggacaaagaacattcaggttgatctggaggagtataacagaatgagagcagctgatccagagttttaccgtgaggcctcaagcttgcaatatggaaaggctccaaaaacttcgcaagataagatagataagatggcaaaagagctcttagacagagagcaaaagcgacaagagtttagcaggaggaggaagttccgggaagagaaggatatcgattccatcaacgacagaaacgagcatttcaacaagaaaatcgagcgtgcgtttgggaaatacacgctggagatcaaaaacaacttggaacgaggaactgcattacccgactaa

SEQ ID NO: 2684 - protein, 298 aa, Arabidopsis thaliana
MVSERRVHPDCINASNPYHECVEYCFKKIAEAKARFEKQNTGLAKVHEQTREPLDDKRIEEDSSEEEEEEEDNQEPQVDVTQLTGRQKKLFELRLKMNEARKSNQTDVGSEKKKMEAPTETKGISKQKWLEGRKKKIGKLLDANGLDMTQAYMLDTQEAAESKYKKWEKEPTPAGWDVFNQKTLYNAYKKRTKNIQVDLEEYNRMRAADPEFYREASSLQYGKAPKTSQDKIDKMAKELLDREQKRQEFSRRRKFREEKDIDSINDRNEHFNKKIERAFGKYTLEIKNNLERGTALPD

SEQ ID NO: 2685 - DNA, 954 bp, Arabidopsis thaliana
atggcgtctctcaaagtcccaagcaatgttcctcttcccgaagatgacgccgagcaactccacaaggctttttcaggatggggtaccaacgagaagctgatcatatcaatactagctcacaggaacgcagcacaacgcagcttgatccgcagcgtttatgcagctacctacaatgaggatcttctcaaagcattagacaaagagctttctagcgactttgagagagctgtgatgttgtggactcttgatccaccagagagagatgcttatttggctaaagaatccaccaagatgttcaccaagaacaattgggttcttgttgaaatcgcttgcacaaggcctgctcttgagcttatcaaggtcaagcaagcttaccaagctcgatacaagaaatcaatcgaggaagatgtcgcgcaacacacatctggtgaccttcgtaagctcttgcttcctcttgtgagcactttcaggtatgaaggagatgatgtgaacatgatgcttgcaagatctgaagctaagatacttcacgagaaggtctcagagaaatcttacagtgacgatgacttcatcagaatcttgacaacaagaagcaaagcacagctcggtgcaacactcaaccactacaacaacgagtatggaaacgccattaacaagaacttgaaggaagagtcggacgacaatgactacatgaaactactaagagctgtaatcacatgtttgacataccctgagaagcattttgagaaggttcttcgtctatcaatcaacaaaatgggaacagacgaatggggactaacccgagtcgtgactacacgaactgaagttgacatggaacgcatcaaagaggaatatcagcgaagaaacagcattcctttggaccgtgctatcgccaaagacacttctggtgactatgaggacatgcttgttgctcttctcggacatggcgatgcttga

SEQ ID NO: 2686 - protein, 317 aa, Arabidopsis thaliana
MASLKVPSNVPLPEDDAEQLHKAFSGWGTNEKLIISILAHRNAAQRSLIRSVYAATYNEDLLKALDKELSSDFERAVMLWTLDPPERDAYLAKESTKMFTKNNWVLVEIACTRPALELIKVKQAYQARYKKSIEEDVAQHTSGDLRKLLLPLVSTFRYEGDDVNMMLARSEAKILHEKVSEKSYSDDDFIRILTTRSKAQLGATLNHYNNEYGNAINKNLKEESDDNDYMKLLRAVITCLTYPEKHFEKVLRLSINKMGTDEWGLTRVVTTRTEVDMERIKEEYQRRNSIPLDRAIAKDTSGDYEDMLVALLGHGDA

SEQ ID NO: 2687 - DNA, 549 bp, Arabidopsis thaliana
atggactctatcgtctccagttcgacgattcttatgcgatcatatctcactcctccggttcgttcatgttctccggcaacctccgtttccgtcaaacctctgagctcagtccaggtcacctccgtcgcggctaaccgccacctgctttcgttaagctccggtgctagaagaaccagaaaaagctctagttcggtgataagatgcggcggaatcaaagagattggagagagtgagttttcgagtacggttctcgaatcagcccagccggttttggttgaattcgtcgctacttggtgcggtccctgcaaattgatctatccagctatggaagccttatctcaggaatatggtgacaaattgacgattgtaaagattgatcacgacgctaatccaaagttaatagcggagttcaaggtttatggtttaccgcatttcattctcttcaaggacgggaaggaagttccagggagcagaagggaaggtgctattacaaaggccaagcttaaggagtacattgatggtctcttgaactcaatatctgttgcttaa

SEQ ID NO: 2688 - protein, 182 aa, Arabidopsis thaliana
MDSIVSSSTILMRSYLTPPVRSCSPATSVSVKPLSSVQVTSVAANRHLLSLSSGARRTRKSSSSVIRCGGIKEIGESEFSSTVLESAQPVLVEFVATWCGPCKLIYPAMEALSQEYGDKLTIVKIDHDANPKLIAEFKVYGLPHFILFKDGKEVPGSRREGAITKAKLKEYIDGLLNSISVA

SEQ ID NO: 2689 - DNA, 528 bp, Arabidopsis thaliana
atgggtgatcaaagtatatctaataagcctctggatgagaaggtttcaatggatttgacttgtggtcaggaggcgattttggaagagcttaggatttgtttacccaaatgggttacacaagaacaagtcacagatatgattagagggacatgtaggaatatagtcgaaattgttgataatttttacgagcacgagactaaattctatgagcaagtttctgctgttatatctttcacttctagagatggaattagttcgagtaaccacgatgcatttgtttcgaaactggagtttattcactgtgaaacagagcggagtgaaagttgtcagccatcgcagtttcacaagcttaagagcatgagtagttcacagaagagcagtatttctcctgtgaagaggaacagaaagattaaaggtaaaccaaagaagaaaggaaaagcttcttctaaggtagaatctggaggcccaaagcaagcttcaataactaaattcttcaacaaagtttcttcagaaggaaccaagtcttag

SEQ ID NO: 2690 - protein, 175 aa, Arabidopsis thaliana
MGDQSISNKPLDEKVSMDLTCGQEAILEELRICLPKWVTQEQVTDMIRGTCRNIVEIVDNFYEHETKFYEQVSAVISFTSRDGISSSNHDAFVSKLEFIHCETERSESCQPSQFHKLKSMSSSQKSSISPVKRNRKIKGKPKKKGKASSKVESGGPKQASITKFFNKVSSEGTKS

SEQ ID NO: 2691 - DNA, 717 bp, Arabidopsis thaliana
atgagctctcaaatctgcagatctgcttccaaagcagccaaatctcttctctcttcagctaaaaatgctcgcttcttctctgaaggacgagccattggtgctgcggcagcggtttcggcgtcaggaaaaattcctttgtatgcatctaactttgcaagatcatcaggttctggtgttgcttctaagagttggatcactggactcttagctcttcctgctgcagcttatatgattcaagatcaagaggttcttgctgctgagatggaacgaacttttattgctatcaagcctgatggtgtgcaaagaggactgatatcagagatcatttctcgattcgaacgcaagggattcaagctagttggtatcaaagtcattgttccttctaaagatttcgcacaaaagcattaccatgatcttaaggaaagacctttcttcaatggtttgtgtgacttccttagctctggtcctgttattgccatggtctgggaaggagatggtgtgatcagatacggacgtaaactgattggagccactgatcctcagaaatctgagcctggaacaatccgaggagatcttgcagttactgttggcaggaacataatccatggaagtgatggaccagagactgcaaaggatgagatcagtctgtggtttaagcctcaagaacttgtttcttacactagtaactctgagaagtggctctatggtgacaactaa

SEQ ID NO: 2692 - protein, 238 aa, Arabidopsis thaliana
MSSQICRSASKAAKSLLSSAKNARFFSEGRAIGAAAAVSASGKIPLYASNFARSSGSGVASKSWITGLLALPAAAYMIQDQEVLAAEMERTFIAIKPDGVQRGLISEIISRFERKGFKLVGIKVIVPSKDFAQKHYHDLKERPFFNGLCDFLSSGPVIAMVWEGDGVIRYGRKLIGATDPQKSEPGTIRGDLAVTVGRNIIHGSDGPETAKDEISLWFKPQELVSYTSNSEKWLYGDN

SEQ ID NO: 2693 - DNA, 1464 bp, Arabidopsis thaliana
atggagaaatcaatggagaaaagcgtgagctctgctgcttctggtaattcaataaactcgaagctgaggtatcctctcagatcggctcttagatccaaggaagggaagcctcctgttcctgatttctctgcttcttctatgcccagaagggcacgagttgtatctgctgttagtcagagtacaacagttcttgatttgtctgggaagaagagtgttgatcgaaccaagctaccaccaagaagactttcgattccaaacaagcccacaagcaattcttctgttaaatcagtgagcagcagcgtcacttctctttctgaagtcaagccaaagagatcacgcattgttcctagaagcttcaatgaaacaacaacacctgtctctagtaatctcagatcatcagtgactcgaaagaaagttgaagacttgtcttcctctacttattggctgactcatatcaagctagctgaatccgtggcgaaacattcgatctctctcggtttctttaaacttgctcttcatgcagggtgtgagccacttgacaagatgaaagaagagttgaaattgtatgctcgtcgcaataacatggatgggcttgctgatgctatgaaggaactttcggaactgtacaatatctctgaagaatccaatcaggtgcaggtctcggagactagttctgttgtagctgaagaaacagctatgtctctgaacaacgataatgatgtccagagttcattctccactcctggaaattcgaacatcacatcagagatcacgaaagacgatgctttgcaagattcaaccgtcacaaaaacaactaaggaaaaagatgctttgcaagattcatctgtcacagaaacaactaaggaaaaagatgctttgcaagattcatctgtcacagaaacatctaaggaagaaggtgctttgcaagattcatctgtcacagaaacaactaaggaagaagatgctttgcaagattcatctgtcacagaaacaactaaggaagagcaggcgttggaaactgtaacacaaggaagaactagaaagtctctggaggtaatcaatgtgaaccaagagaatgattcagaggttgttcaggaatccgaagaagggctccgtccatcagcagatggtgttcagatcgtgactgttgttaaaccttcagacaagaaacgtgccagaaaggagactgttcctaagaacaacctgccggtgaggacaaagaaatcactagcaaccaactctgctaattcaaaaacagttcaagtaaacaaggatgataagtctcagaagaagtctgagaggatcactaaacccaggactaagagagttcaagaagagtcaaagaagtcaattaagaaatctactgctaaagaaggtgaagttaaatctctgaagcaaacagagaaaatggagaacaaagaaaacacggttgttgttggtgcaggagaagacatccaggtttaa

SEQ ID NO: 2694 - protein, 487 aa, Arabidopsis thaliana
MEKSMEKSVSSAASGNSINSKLRYPLRSALRSKEGKPPVPDFSASSMPRRARVVSAVSQSTTVLDLSGKKSVDRTKLPPRRLSIPNKPTSNSSVKSVSSSVTSLSEVKPKRSRIVPRSFNETTTPVSSNLRSSVTRKKVEDLSSSTYWLTHIKLAESVAKHSISLGFFKLALHAGCEPLDKMKEELKLYARRNNMDGLADAMKELSELYNISEESNQVQVSETSSVVAEETAMSLNNDNDVQSSFSTPGNSNITSEITKDDALQDSTVTKTTKEKDALQDSSVTETTKEKDALQDSSVTETSKEEGALQDSSVTETTKEEDALQDSSVTETTKEEQALETVTQGRTRKSLEVINVNQENDSEVVQESEEGLRPSADGVQIVTVVKPSDKKRARKETVPKNNLPVRTKKSLATNSANSKTVQVNKDDKSQKKSERITKPRTKRVQEESKKSIKKSTAKEGEVKSLKQTEKMENKENTVVVGAGEDIQV

SEQ ID NO: 2695 - DNA, 921 bp, Arabidopsis thaliana
atgacttatcacgaagaagacgatacagtttctgaatttcgagttagagttgaagaagatggagttgataaattaggtcattatgttaaacttactgaagatttcgaagtacatcgacaagaaacagaacaagaatcttcatcatcaccgtcttcttcttcttcatgtggacagaaacgatctgtttggttttggatcaagcttggtcttttcttcacttttctaactgctttgggtctcgctggttacaaatggctataccctttaatcatggataaggagctaatcccactcataaaatgggagatggagacatttacacaccctgtgtgcggtattcttgtgtttgcatcagtctctttattccctgtgatacttattccaactacgccgtcaatgtgggtggctgggattacatttggttatttctatggccttctccttactcttccagctgtagctattggtgtttcacttccttacttcatcagctatctcttcctcaacaaaattcaaggttggttagaaagatatccagatcaagctgcaatgttgagagctgctggtggaggcagttggtttcatcagtttcgtgcagttaccttaatccggatttctccatttccttttgctgtatataattactgcgctgttgcaactcgtgtgaagttcggtccttacatggctggttctctcgtaggcatggcgccggagatttttgtcgcaatttatacagggattcttataaggacattggcagatgcatccactgcggaacaaaagggtctctcgattcttcaaattgttctcaacatttttggttttgtagcaactgttgtgacaactgttctcatcactaagtatgcgaaaagacagcttgaagttatgaagaaggagaaggaagctttgttgttacagtaa

SEQ ID NO: 2696 - protein, 306 aa, Arabidopsis thaliana
MTYHEEDDTVSEFRVRVEEDGVDKLGHYVKLTEDFEVHRQETEQESSSSPSSSSSCGQKRSVWFWIKLGLFFTFLTALGLAGYKWLYPLIMDKELIPLIKWEMETFTHPVCGILVFASVSLFPVILIPTTPSMWVAGITFGYFYGLLLTLPAVAIGVSLPYFISYLFLNKIQGWLERYPDQAAMLRAAGGGSWFHQFRAVTLIRISPFPFAVYNYCAVATRVKFGPYMAGSLVGMAPEIFVAIYTGILIRTLADASTAEQKGLSILQIVLNIFGFVATVVTTVLITKYAKRQLEVMKKEKEALLLQ

SEQ ID NO: 2697 - DNA, 270 bp, Arabidopsis thaliana
atgatggcaagaaactcaatgtctgagaagcttgcaaatgatattgatacagcggtgaagacattatcagacaaagcgtacgagatagctttgagccagattagaaacaatcgtgaagccatggacaagattgttgaaatacttcttgagaaagagactatgtcaggcgatgaattccgagcaatcctatctgaattcacagaaatcccacctgaaaaccgtgttgcttcttcaacatccacatcaacaccaacaccagcgtctgtctga

SEQ ID NO: 2698 - protein, 89 aa, Arabidopsis thaliana
MMARNSMSEKLANDIDTAVKTLSDKAYEIALSQIRNNREAMDKIVEILLEKETMSGDEFRAILSEFTEIPPENRVASSTSTSTPTPASV

SEQ ID NO: 2699 - DNA, 477 bp, Arabidopsis thaliana
atggctttctctgcgactgtgtctcagctttcttctctttcaaccatctcctcttcattaccaatttcttctagaagactccctcatcgatctcttcctcaattcacagtcaaagcagaagcagagaaagagaaacagagcacacagggcaagtctgatggggaagcatcaccagctgcaaccaaaacccctaaaaccctccccaagaaaccggtttactcgatgaagaagggccaaatcgttcgtgtggaaaaagagaagtacctcaacagcatcaattacttatcagttggacatcctcctttctacaaaggacttgattacatatacgaagatcgcggcgaggtcttggaccttcgtgtctttgagacaggagagtatgcacttgttggatgggttggtatccccaccgcaccagcttggctcccaacagatatgctcatcaagtgtgagaaacttgtttacgagcgaatgtag

SEQ ID NO: 2700 - protein, 158 aa, Arabidopsis thaliana
MAFSATVSQLSSLSTISSSLPISSRRLPHRSLPQFTVKAEAEKEKQSTQGKSDGEASPAATKTPKTLPKKPVYSMKKGQIVRVEKEKYLNSINYLSVGHPPFYKGLDYIYEDRGEVLDLRVFETGEYALVGWVGIPTAPAWLPTDMLIKCEKLVYERM

SEQ ID NO: 2701 - DNA, 183 bp, Arabidopsis thaliana
atggaggcaatgaagatgaagctttacgtggtggttttggtggcagtgatagcgttctctacagttcaccagacggttgcagcggttgacgctcccgcgcctagccctacctccgatgcttcctcatttatccctactttcttcgcctccgtagcggtgatggcctttggattcttcttttaa

SEQ ID NO: 2702 - protein, 60 aa, Arabidopsis thaliana
MEAMKMKLYVVVLVAVIAFSTVHQTVAAVDAPAPSPTSDASSFIPTFFASVAVMAFGFFF

SEQ ID NO: 2703 - DNA, 1299 bp, Arabidopsis thaliana
atgaagatgctgagacttagaaagaagcaacatttggtgtttctactatgcgtgtggtgtttggtggtggattggagcaaagcagaaacagaggaaagtgatggaagtcccatggagaaaacagagcaagctgctctatactctaccattcaaggctttgttggtgaatcttggaatggctcttatctttatcctgacccttgtggctggactcctatccagggtgtgacttgtgatatctatgatgagctttggtatgtaactgctctaagctttgggactatgaaagacaactctcttgcttgttctgaaagtccagtgatcagaccacaactctttgagctcaagcacctcaagtctctctctcttttcaactgcttcacaacgcctaaccgatatctagcttcaatctccgatgaaaagtggttggatctctctaaaagcttggagagacttgagatcagatcaaacccgggactgataggtgaactcccttctgtcatcactaacctcaccaaccttcaatctctggtggtgctagaaaacaagttaacaggtccattgccagtgaatttggccaagttaaccagattgagacgtttagtactgtctggaaaccggttcacagggagaatacctgaggtctacgggttaaccggattgttgatattggatgtgagcaggaatttcttatctggggcgttgcctttaagcgttggaggattgtattctctgctgaaacttgatcttagtaacaattacttggaaggaaagttacctagagagctagagtccttgaagaatctcactctattggacttgagaaacaacagattatcaggtgggttgagtaaagagatccaagagatgacttctttggtagaactggttctgtccaataatcgcctagccggggacttgacaggaataaagtggagaaatctgaagaatttagtggttcttgatctctccaacacaggcttaaaaggggagattcctggttcaatcttggagctcaagaaactgaggtttttgggtttgagcaacaacaatctcggaggcaaactcattccacaaatggaaaccgaaatgcctagtctcagcgcgctttacgtgaatggaaataacatcagcggagagttggaattctctaggtacttttatgagagaatgggaaggagacttggtgtttgggggaaccctaatctgtgttacaacggagatgagaccaagaaccttagcgatcatgttcctttcggagtgaaccaatgtaagagaattaaggcagataaatattag

SEQ ID NO: 2704 - protein, 432 aa, Arabidopsis thaliana
MKMLRLRKKQHLVFLLCVWCLVVDWSKAETEESDGSPMEKTEQAALYSTIQGFVGESWNGSYLYPDPCGWTPIQGVTCDIYDELWYVTALSFGTMKDNSLACSESPVIRPQLFELKHLKSLSLFNCFTTPNRYLASISDEKWLDLSKSLERLEIRSNPGLIGELPSVITNLTNLQSLVVLENKLTGPLPVNLAKLTRLRRLVLSGNRFTGRIPEVYGLTGLLILDVSRNFLSGALPLSVGGLYSLLKLDLSNNYLEGKLPRELESLKNLTLLDLRNNRLSGGLSKEIQEMTSLVELVLSNNRLAGDLTGIKWRNLKNLVVLDLSNTGLKGEIPGSILELKKLRFLGLSNNNLGGKLIPQMETEMPSLSALYVNGNNISGELEFSRYFYERMGRRLGVWGNPNLCYNGDETKNLSDHVPFGVNQCKRIKADKY

SEQ ID NO: 2705 - DNA, 876 bp, Arabidopsis thaliana
atggcaaaagacttggatgtgaacgagagtggaccaccggcggcgagagactacaaggatccgcctcccgcaccatttttcgacatggaggagcttaggaaatggccgctttatagagcggtcatagctgagtttgtagcaacacttctgttcctctacgtctcaatcctgactgtaatcggctacaaagctcaaaccgatgcaaccgccggaggagtggattgtggcggcgtaggaatattgggtattgcgtgggctttcggtggaatgatctttgttctcgtttactgtaccgccggtatctccggtggtcatataaatccggctgtgacggtgggactattcctggctcgtaaagtgtcattggtgcggacagtgttatacattgtggctcagtgccttggtgccatctgcggttgcggtttcgtcaaagcattccaaagttcttactacaccagatatggaggtggagccaacgagctagccgatggctacaacaaaggtaccggactcggtgccgagatcattggaacttttgtccttgtatacaccgtcttctcggcaaccgatcccaagcgaaatgctcgtgactctcacgtgccagttttggctccacttcccattggctttgccgtcttcatggttcatttagccaccattcccatcaccggaaccggtatcaacccggctcgtagctttggagctgccgttatttacaacaacgaaaaggcctgggacgaccaatggattttttgggttggaccgatgatcggagcagcagcagcagcgttttaccatcagtttattttaagagcggctgcgattaaagctcttggctcatttggctcctttggctcctttaggagctttgcttaa

SEQ ID NO: 2706 - protein, 291 aa, Arabidopsis thaliana
MAKDLDVNESGPPAARDYKDPPPAPFFDMEELRKWPLYRAVIAEFVATLLFLYVSILTVIGYKAQTDATAGGVDCGGVGILGIAWAFGGMIFVLVYCTAGISGGHINPAVTVGLFLARKVSLVRTVLYIVAQCLGAICGCGFVKAFQSSYYTRYGGGANELADGYNKGTGLGAEIIGTFVLVYTVFSATDPKRNARDSHVPVLAPLPIGFAVFMVHLATIPITGTGINPARSFGAAVIYNNEKAWDDQWIFWVGPMIGAAAAAFYHQFILRAAAIKALGSFGSFGSFRSFA

SEQ ID NO: 2707 - DNA, 693 bp, Arabidopsis thaliana
atggctcaagcagtgacttcgatggctggcttacgtggagcatctcaggctgtccttgaaggaagtttacagatcaacggctcaaaccgtttgaacatctcaagagtctcggttgggtctcagagaaccggacttgtgatcagggctcagcagaacgtgtcagtaccagaaagtagtcgccggtcagtgattggactcgtggcggctggtttagccggtggttcattcgttaaagctgttttcgccgaagctattccgatcaaagttggtggtcctccacttccttccggtggcctacctggaacagataactcagaccaagcaagagacttttcattggcattgaaagatagattttacatacaaccattgtcaccaacagaagctgcagctagagccaaagattctgctaaagagatcatcaacgttaagtcatttatcgacaaaaaagcttggccctatgttcagaacgatctccgtttaagagcatcgtacctccgttacgatctcaacaccgttatctccgctaagcctaaggaagagaagcaaagccttaaagatctcaccgcaaagcttttccaaaccattgacaacttggactatgcggcgagatcaaagagtagcccagatgctgagaagtattactcagaaactgtctcgagtttgaacaatgttcttgccaagctcggttaa

SEQ ID NO: 2708 - protein, 230 aa, Arabidopsis thaliana
MAQAVTSMAGLRGASQAVLEGSLQINGSNRLNISRVSVGSQRTGLVIRAQQNVSVPESSRRSVIGLVAAGLAGGSFVKAVFAEAIPIKVGGPPLPSGGLPGTDNSDQARDFSLALKDRFYIQPLSPTEAAARAKDSAKEIINVKSFIDKKAWPYVQNDLRLRASYLRYDLNTVISAKPKEEKQSLKDLTAKLFQTIDNLDYAARSKSSPDAEKYYSETVSSLNNVLAKLG

SEQ ID NO: 2709 - DNA, 1509 bp, Arabidopsis thaliana
atggccatctctttcctctgtttttgcctcattaccctcgcttcgttaatctttttcgccaagaagattaaacacttgaaatggaatcttcctccaagccctccaaagtttccggtcatcggaaatttacaccagattggagaattgcctcacaggtcacttcaacatctcgccgaaagatacggacctgtgatgcttcttcactttgggtttgtccctgtaactgtggtctcatcaagagaagcagctgaagaagtgctcagaactcatgacctagactgttgcagcaggcctaaacttgtcgggacaaggttactctcgcggaattttaaagatgtctgttttacgccatacggtaacgagtggaaggcgcggcgtaagtttgccctgcgtgagcttttctgtttgaaaaaggttcagtcctttaggcatatccgagaggaagaatgtaactttctggtcaagcaactgtcggaatccgcggttaatcgctctccggtcgatttgagcaaatcacttttctggctaaccgctagtatctttttcagagttgccttaggacagaattttcatgagagcaattttatcgataaagaaaagatcgaagagctcgtgttcgaagctgagactgccctagcaagtttcacttgttctgatttcttccctgttgccggacttggatggcttgttgattggttttccggacaacacaagagactcaacgatgttttttacaagctcgatgctctgtttcaacatgtcatagatgatcatttaaatccaggaagatcaaaagagcacgaagacatcatcgattcaatgttggatgcgattcataaagaaggaaaagatagttccttagagctcataatagatcatattaaggggtttctcgcgaatatatttcttgcagggatagacacaggggccctcaccatgatatgggcaatgacggagctcgttaaaaacccgaaacttataaagaaagttcaaggcgagatccgagaacaacttggcagcaataaggcgagaatcaccgaggaagatatcgataaagttccttacttgaagatggtaatcaaagaaacattcaggttacacccggcagctcctcttatacttccaagagaaacaatggctcacatcaaagttcaagggtatgatattcctcccaagaggcggatcttggtcaatgtttcggctatcggaagagatcccaaactctggacaaacccggaagagtttgaccctgagaggtttatggatagctctgttgattataggggacaacattacgagctcttaccatttgggtccggtcgaaggatatgtcccgggatgccaatggggattgctgccgtcgaattgggactcttgaacttactttacttcttcgattggaagttgcctgatgggatgacacataaagatattgatactgaagaagctggtactcttacaatcgtcaagaaagtacctctccagctcgttccagttcgagttcagtga

SEQ ID NO: 2710 - protein, 502 aa, Arabidopsis thaliana
MAISFLCFCLITLASLIFFAKKIKHLKWNLPPSPPKFPVIGNLHQIGELPHRSLQHLAERYGPVMLLHFGFVPVTVVSSREAAEEVLRTHDLDCCSRPKLVGTRLLSRNFKDVCFTPYGNEWKARRKFALRELFCLKKVQSFRHIREEECNFLVKQLSESAVNRSPVDLSKSLFWLTASIFFRVALGQNFHESNFIDKEKIEELVFEAETALASFTCSDFFPVAGLGWLVDWFSGQHKRLNDVFYKLDALFQHVIDDHLNPGRSKEHEDIIDSMLDAIHKEGKDSSLELIIDHIKGFLANIFLAGIDTGALTMIWAMTELVKNPKLIKKVQGEIREQLGSNKARITEEDIDKVPYLKMVIKETFRLHPAAPLILPRETMAHIKVQGYDIPPKRRILVNVSAIGRDPKLWTNPEEFDPERFMDSSVDYRGQHYELLPFGSGRRICPGMPMGIAAVELGLLNLLYFFDWKLPDGMTHKDIDTEEAGTLTIVKKVPLQLVPVRVQ

SEQ ID NO: 2711 - DNA, 243 bp, Arabidopsis thaliana
atgggaaacaaagctacaacggtgaaagaagaacgcgaagagatccatttgaagattgtacctccattggacaaagtttttctgcgttggctcgcaagagatctccagagagttcatggattcaaaccgaagaacaacactcgtgcgatcactcctccagatagctacatcgagtttatgcggttaaatggatcgcttgatgtagatttagatgaccctgatcttgcccatttgttcaagtaa

SEQ ID NO: 2712 - protein, 80 aa, Arabidopsis thaliana
MGNKATTVKEEREEIHLKIVPPLDKVFLRWLARDLQRVHGFKPKNNTRAITPPDSYIEFMRLNGSLDVDLDDPDLAHLFK

SEQ ID NO: 2713 - DNA, 1440 bp, Arabidopsis thaliana
atgtcaccacaaacagagactaaagcaagtgttgggttcaaagctggtgttaaagagtataaattgacttactatactcctgaatatgaaaccaaggatactgatatcttggcagcattccgagtaactcctcaacctggagttccacctgaagaagcaggggctgcggtagctgctgaatcttctactggtacatggacaactgtgtggaccgatgggcttaccagccttgatcgttacaaaggacgatgctaccacatcgagcccgttccaggagaagaaactcaatttattgcgtatgtagcttatcccttagacctttttgaagaaggttcggttactaacatgtttacctcgattgtgggtaatgtatttgggttcaaagccctggctgctctacgtctagaggatctgcgaatccctcctgcttatactaaaactttccaaggaccacctcatggtatccaagttgaaagagataaattgaacaagtatggacgtcccctattaggatgtactattaaaccaaaattggggttatccgcgaaaaactatggtagagcagtttatgaatgtctacgtggtggacttgattttaccaaagatgatgagaatgtgaactcccaaccatttatgcgttggagagaccgtttcttattttgtgccgaagctatttataaatcacaggctgaaacaggtgaaatcaaagggcattatttgaatgctactgcgggtacatgcgaagaaatgatcaaaagagctgtatttgccagagaattgggagttcctatcgtaatgcatgactacttaacagggggattcaccgcaaatactagtttgtctcattattgccgagataatggcctacttcttcacatccaccgtgcaatgcacgctgttattgatagacagaagaatcatggtatgcacttccgtgtactagctaaagctttacgtctatctggtggagatcatattcacgcgggtacagtagtaggtaaacttgaaggagacagggagtcaactttgggctttgttgatttactgcgcgatgattatgttgaaaaagatcgaagccgcggtatctttttcactcaagattgggtctcactacctggtgttctgcctgtggcttcagggggtattcacgtttggcatatgcctgctttgaccgagatctttggagatgattctgtactacaattcggtggaggaactttaggccacccttggggaaatgcaccgggtgccgtagccaaccgagtagctctggaagcatgtgtacaagctcgtaatgagggacgtgatcttgcagtcgagggtaatgaaattatccgtgaagcttgcaaatggagtcctgaactagctgctgcttgtgaagtatggaaagagatcacatttaacttcccaaccatcgataaattagatggccaagagtag

SEQ ID NO: 2714 - protein, 479 aa, Arabidopsis thaliana
MSPQTETKASVGFKAGVKEYKLTYYTPEYETKDTDILAAFRVTPQPGVPPEEAGAAVAAESSTGTWTTVWTDGLTSLDRYKGRCYHIEPVPGEETQFIAYVAYPLDLFEEGSVTNMFTSIVGNVFGFKALAALRLEDLRIPPAYTKTFQGPPHGIQVERDKLNKYGRPLLGCTIKPKLGLSAKNYGRAVYECLRGGLDFTKDDENVNSQPFMRWRDRFLFCAEAIYKSQAETGEIKGHYLNATAGTCEEMIKRAVFARELGVPIVMHDYLTGGFTANTSLSHYCRDNGLLLHIHRAMHAVIDRQKNHGMHFRVLAKALRLSGGDHIHAGTVVGKLEGDRESTLGFVDLLRDDYVEKDRSRGIFFTQDWVSLPGVLPVASGGIHVWHMPALTEIFGDDSVLQFGGGTLGHPWGNAPGAVANRVALEACVQARNEGRDLAVEGNEIIREACKWSPELAAACEVWKEITFNFPTIDKLDGQE

SEQ ID NO: 2715 - DNA, 201 bp, Arabidopsis thaliana
atggccaagggtaaagatgttcgagtaacaattattttggaatgtaccagttgtgttcgaaatgatattaagaaagaagccgcgggaatttccagatatattactcaaaagaatcggcataacacccctagtcgattggaattgagaaaattctgtccctattgttataaacatacaattcacggggaaatcaagaaatag

SEQ ID NO: 2716 - protein, 66 aa, Arabidopsis thaliana
MAKGKDVRVTIILECTSCVRNDIKKEAAGISRYITQKNRHNTPSRLELRKFCPYCYKHTIHGEIKK

SEQ ID NO: 2717 - DNA, 117 bp, Arabidopsis thaliana
atgacacaatcaaatccgaacgaacaaagtgttgaattaaatcgtaccagtctctattgggggttattactcatttttgtacttgctgttttattttcgaattatttcttcaattaa

SEQ ID NO: 2718 - protein, 38 aa, Arabidopsis thaliana
MTQSNPNEQSVELNRTSLYWGLLLIFVLAVLFSNYFFN

SEQ ID NO: 2719 - DNA, 825 bp, Arabidopsis thaliana
atggcgatacatttatacaaaacttctaccccgagcacacgcaatggagccgtagacagtcaagtgaaatccaatccacgaaataatttgatctgtgggcagcatcattgtggtaaaggtcgtaatgccagaggaataattaccgcaaggcatagagggggaggtcataagcgtctataccgtaaaatagattttcgacgaaatgcaaaagacatatatggtagaatcgtaaccatagaatacgaccctaatcgaaatgcatacatttgtctcatacactatggggatggtgagaagagatatattttacatcccagaggggctataattggagataccattgtttctggtacagaagttcctataaaaatgggaaatgccctacctttgaccgatatgcccttaggcacggccatacataatatagaaatcacacttggaaggggtggacaattagctagagcagcgggtgctgtagcgaaactgattgcaaaagaggggaaatcggccacattaaaattaccttctggagaggtccgtttgatatccaaaaactgctcagcaacagtcggacaagtgggaaatgttggggtaaaccagaaaagtttgggtagagccggatcgaaatgttggctaggtaaacgtcctgtagtaagaggagtagttatgaaccctgtcgaccatccccatggaggtggtgaagggagggctccaattggtagaaaaaaacccgtaaccccctggggttatcctgcacttggaagaagaactagaaaaaggaaaaaatatagtgagactttgattcttcgtcgccgtagtaaatag

SEQ ID NO: 2720 - protein, 274 aa, Arabidopsis thaliana
MAIHLYKTSTPSTRNGAVDSQVKSNPRNNLICGQHHCGKGRNARGIITARHRGGGHKRLYRKIDFRRNAKDIYGRIVTIEYDPNRNAYICLIHYGDGEKRYILHPRGAIIGDTIVSGTEVPIKMGNALPLTDMPLGTAIHNIEITLGRGGQLARAAGAVAKLIAKEGKSATLKLPSGEVRLISKNCSATVGQVGNVGVNQKSLGRAGSKCWLGKRPVVRGVVMNPVDHPHGGGEGRAPIGRKKPVTPWGYPALGRRTRKRKKYSETLILRRRSK

SEQ ID NO: 2721 - DNA, 591 bp, Arabidopsis thaliana
atgcctattggcgttccaaaagtaccttttcgaagtcctggagaaggagatacatcttgggttgacatatacaaccgactttatcgagaaagattattttttttaggccaagaggttgataccgaaatctcgaatcaacttattagtcttatgatatatctcagtatagaaaaggataccaaagatctttatttgtttataaactctcctggtggatgggtaatatctggaatggctatttatgatactatgcaatttgtgcgacccgatgtacagacaatatgcatgggattggccgcttcaatagcatcctttatcctagtcggaggagcaattaccaaacgtatagcattccctcacgctagggtaatgatccatcaacccgctagttcgttttatgaggcacaaacgggagaatttatcttggaagcggaagaattacttaaacttcgcgaaaccatcacaagggtttatgtacaaagaacgggcaaacctatatgggttatatccgaagacatggaacgggatgtttttatgtcagcaacagaagcccaagctcatggaattgttgatcttgtagcggttcaataa

SEQ ID NO: 2722 - protein, 196 aa, Arabidopsis thaliana
MPIGVPKVPFRSPGEGDTSWVDIYNRLYRERLFFLGQEVDTEISNQLISLMIYLSIEKDTKDLYLFINSPGGWVISGMAIYDTMQFVRPDVQTICMGLAASIASFILVGGAITKRIAFPHARVMIHQPASSFYEAQTGEFILEAEELLKLRETITRVYVQRTGKPIWVISEDMERDVFMSATEAQAHGIVDLVAVQ

SEQ ID NO: 2723 - DNA, 648 bp, Arabidopsis thaliana
atgagtaaagtttatgattggttcgaagaacgtcttgagattcaggcgattgcagatgatataactagtaaatatgttcctccgcatgtcaacatattttattgtctaggcggaattacccttacttgttttttagtacaagtagctacgggatttgctatgactttttattaccgtccaaccgttactgaagcttttgcttctgttcaatatataatgactgaagctaactttggttggttaatccgatcagttcatcgatggtcggcaagtatgatggtcctaatgatgatcctgcacgtatttcgtgtatacctcaccggtggttttaaaaaacctcgcgaattaacttgggttactggtgtggttctgggtgtattgaccgcatcttttggtgtaacaggttattctttaccttgggatcaaattggttattgggcggtcaaaattgtaacaggtgtacctgacgctattccggtaataggatcacctcttgtagaattattacgcggaagtgctagtgttggacaatccactttgactcgtttttatagtttacacacttttgtattacctcttcttacggccgtctttatgttaatgcatttcctaatgatacgtaagcaaggtatttctggtcccttataa

SEQ ID NO: 2724 - protein, 215 aa, Arabidopsis thaliana
MSKVYDWFEERLEIQAIADDITSKYVPPHVNIFYCLGGITLTCFLVQVATGFAMTFYYRPTVTEAFASVQYIMTEANFGWLIRSVHRWSASMMVLMMILHVFRVYLTGGFKKPRELTWVTGVVLGVLTASFGVTGYSLPWDQIGYWAVKIVTGVPDAIPVIGSPLVELLRGSASVGQSTLTRFYSLHTFVLPLLTAVFMLMHFLMIRKQGISGPL

SEQ ID NO: 2725 - DNA, 399 bp, Arabidopsis thaliana
atgaccttaaatctttgtgtactgactccgaatcgaattgtttgggattcagaagtaaaagaaatcattttatctactaatagtggacaaattggtgtattagcaaaccacgcgccgattgccacagctgttgatataggtattttgaaaatacgccttgctaaccaatggttaacgatggctctgatgggcggttttgctagaataggcaataatgaaatcactattttagtaaatgatgcagagaagaatagtgacattgatccacaagaagctcagcaaactcttgaaatagcagaagctaacttgagaaaagctgaaggtaagagacagacaattgaggctaatctagctctcagacgagctcggacacgagtcgaggctctcaatacgatttga

SEQ ID NO: 2726 - protein, 132 aa, Arabidopsis thaliana
MTLNLCVLTPNRIVWDSEVKEIILSTNSGQIGVLANHAPIATAVDIGILKIRLANQWLTMALMGGFARIGNNEITILVNDAEKNSDIDPQEAQQTLEIAEANLRKAEGKRQTIEANLALRRARTRVEALNTI

SEQ ID NO: 2727 - DNA, 324 bp, Arabidopsis thaliana
atgtttcagttcgctaagttttcaaagtccaaagagcgcagactagccacggagcttggatacggtttcccgatcggagatccatggatcacagacggtatctccccatggcctttcgcctctgaaagcgtccttccttctcaatgcccgggcatccatccaatgcattcttttcgatcttgtactcagggtacactgaacaccacaaaaatatcgatgaaactaactataagtgattgcggattcgaaccgctcacagaaggatttacagtcctgcactctaccagagctactacctgttaccactttcttttcaactcgtaa

SEQ ID NO: 2728 - protein, 107 aa, Arabidopsis thaliana
MFQFAKFSKSKERRLATELGYGFPIGDPWITDGISPWPFASESVLPSQCPGIHPMHSFRSCTQGTLNTTKISMKLTISDCGFEPLTEGFTVLHSTRATTCYHFLFNS

SEQ ID NO: 2729 - DNA, 573 bp, Arabidopsis thaliana
atgtctgagggatcagaagatacgaaaacaaaactcgactctgccggagagttatcagatgttgataacgagaactgcagtagcagcggaagtggcggtggtagtagttctggtgataccaaaaggacttgcgttgattgcggaactatccgaactcctctttggcgtggtggtcctgccggaccaaagtcattgtgcaatgcttgtgggatcaagagtaggaagaagagacaagcagcacttggtatgagatcagaggagaagaagaagaacagaaaaagcaattgcaataatgatctaaacctcgaccatcgaaacgccaagaaatacaaaatcaacatagttgatgatggcaagatcgacatcgatgatgatccgaaaatttgcaataacaagcgtagtagtagtagtagcagtaacaaaggagtgagtaagtttttggatttagggtttaaagtaccggtgatgaagagatcagcggttgagaagaagaggttatggagaaaactcggtgaggaagaaagagctgctgtgcttctcatggctctctcttgtagctctgtttacgcctaa

SEQ ID NO: 2730 - protein, 190 aa, Arabidopsis thaliana
MSEGSEDTKTKLDSAGELSDVDNENCSSSGSGGGSSSGDTKRTCVDCGTIRTPLWRGGPAGPKSLCNACGIKSRKKRQAALGMRSEEKKKNRKSNCNNDLNLDHRNAKKYKINIVDDGKIDIDDDPKICNNKRSSSSSSNKGVSKFLDLGFKVPVMKRSAVEKKRLWRKLGEEERAAVLLMALSCSSVYA

SEQ ID NO: 2731 - DNA, 828 bp, Arabidopsis thaliana
atgcaacttggaatctccattattcgctctgcaccggatgcgtccgaggacaatcgtagccgtcaatcacgctctagccgcacggtcatggttcatcaaccagggtttagggcctgtctcttgagaaatcaaggaaacagagatttgacgtctctcagtgactgcatagccgctcgttgtgatagcttgcttctggggaagtctcacataataaacctttccaaaaataggcgtatgccgtttaaaagcagagagaacacgatattctttagtaaaaggcgaaagaatagttcgctatgccctcactgcacggctcccccatttcagttaagcccaactatgttgttaatgttctgccatgacggagctagattgaaaggaatgaatcctagaaatgctgaagaaagaaagtacagacaagccgagggactcgtgacaccgcaatttctttctattcctggttctccaattgatctcacaaaatgttggtcatcactcctcaacattcaaggttgtaaaatcgagatctttaaatctgtttttaagtggaatgttctcctatcaacgcagccactcctacacacaaatgaaagtaactacaaaacctgtcagaccgccgtgcgaccaccccagcaaggtagaaccgaaccgagtaacgatcctctacagcaccgaatgcgtccgaggacgatcgtagccgtcaatcacgctctagccgcacggtcatggttcatcaaccagggagaagacggtgcctccgacggtggaaatgaaaacgacgaagatgtcggcatgttaagggatggaggttacgtgattgtttcttaa

SEQ ID NO: 2732 - protein, 275 aa, Arabidopsis thaliana
MQLGISIIRSAPDASEDNRSRQSRSSRTVMVHQPGFRACLLRNQGNRDLTSLSDCIAARCDSLLLGKSHIINLSKNRRMPFKSRENTIFFSKRRKNSSLCPHCTAPPFQLSPTMLLMFCHDGARLKGMNPRNAEERKYRQAEGLVTPQFLSIPGSPIDLTKCWSSLLNIQGCKIEIFKSVFKWNVLLSTQPLLHTNESNYKTCQTAVRPPQQGRTEPSNDPLQHRMRPRTIVAVNHALAARSWFINQGEDGASDGGNENDEDVGMLRDGGYVIVS

SEQ ID NO: 2733 - DNA, 1119 bp, Arabidopsis thaliana
atgaaacaacagttggagagtttcattgaaacaaccaaaccaagtgctcttgttgccgatatgttcttcccttgggcgacagaatctgctgagaagctcggtgtaccaagacttgtgttccacggtacatctttcttttctttgtgttgttcgtataacatgaggattcataagccacacaagaaagtcgctacgagttctactccttttgtaatccctggtctcccaggagacatagttattacagaagaccaagccaatgttgccaaagaagaaacgccaatgggaaagtttatgaaagaggttagggaatcagagaccaatagctttggtgtattggttaatagcttctacgagctggaatcagcttatgctgatttttatcgtagttttgtggcgaaaagagcttggcatatcggtccgctttcgctatctaacagagagttaggagagaaagccagaagagggaaaaaggctaacattgatgagcaagaatgcctaaaatggctggactctaagacacctggttcagtagtttacttgtcctttgggagcggaactaatttcaccaacgaccagctgttagagatcgcttttggtcttgaaggttctggacaaagtttcatctgggtggttaggaaaaatgaaaaccaaggtgacaatgaagagtggttgcctgaagggtttaaagagaggacaacagggaaagggctaataatacctggatgggcgccgcaagtgctgatacttgaccataaagcaattggaggatttgtgactcattgcggatggaactcggctatagagggcattgccgcggggctgcctatggtaacatggccaatgggggcagaacagttctacaatgagaagctattgacaaaagtgttgagaataggagtgaacgttggagctaccgagttggtgaaaaaaggaaagttgattagtagagcacaagtggagaaggcagtaagggaagtgattggtggtgagaaggcagaggaaaggcggctatgggctaagaagctgggcgagatggctaaagccgctgtggaagaaggagggtcctcttataatgatgtgaacaagtttatggaagagctgaatggtagaaagtag

SEQ ID NO: 2734 - protein, 372 aa, Arabidopsis thaliana
MKQQLESFIETTKPSALVADMFFPWATESAEKLGVPRLVFHGTSFFSLCCSYNMRIHKPHKKVATSSTPFVIPGLPGDIVITEDQANVAKEETPMGKFMKEVRESETNSFGVLVNSFYELESAYADFYRSFVAKRAWHIGPLSLSNRELGEKARRGKKANIDEQECLKWLDSKTPGSVVYLSFGSGTNFTNDQLLEIAFGLEGSGQSFIWVVRKNENQGDNEEWLPEGFKERTTGKGLIIPGWAPQVLILDHKAIGGFVTHCGWNSAIEGIAAGLPMVTWPMGAEQFYNEKLLTKVLRIGVNVGATELVKKGKLISRAQVEKAVREVIGGEKAEERRLWAKKLGEMAKAAVEEGGSSYNDVNKFMEELNGRK

SEQ ID NO: 2735 - DNA, 2409 bp, Arabidopsis thaliana
atgaacttcggtagtctcttcgataacacacccggtggtggctctaccggagcaagacttctctccggtttaagttatggcaaccacaccgccgcaactaacgtcttacccggtggtgctatggctcaagcggcagcggctgctagtctcttctctcctcctctaacgaaatctgtttacgcttcttctggcctctctctagccctcgagcaaccggagagaggaaccaaccgtggagaagcatcgatgaggaacaataataacgtcggaggaggaggcgatactttcgatgggagtgtgaacagaagaagccgagaagaagaacatgagagtagatctggtagtgataacgttgaaggtatctccggtgaagatcaagacgctgctgataagcctcctcggaagaaacgttatcaccgacacactcctcaacaaatccaagaactcgaatctatgttcaaagagtgtccgcatccagacgagaaacaaagattagaactaagtaagagactttgcttagagacaagacaagtcaagttctggttccagaatcgtcgcactcagatgaagactcaattagagaggcatgagaacgcgttattgagacaagagaacgataagttaagagctgagaacatgtctattcgtgaagcaatgaggaatccaatctgcaccaattgtggtggacctgccatgcttggtgatgtctctcttgaagaacatcatctccgtatcgaaaacgctcgtttaaaagacgagcttgatcgtgtctgtaacctcaccggtaagttccttggccaccaccataatcaccactacaactcctccttagaactcgctgtcggcaccaacaacaacggtggacatttcgctttccctcctgatttcggcggtggtggtggttgcttacctccgcagcagcagcagtcgacggtgattaatgggattgatcagaagtcagttttgctggagctggctttaactgctatggatgagttagtgaagcttgctcagagtgaagaaccgttatgggtcaaaagcttggacggtgagagagacgagcttaaccaagatgagtacatgagaacattttcatctactaaaccaaccggtttagctactgaagcttctagaacctctggtatggtcatcatcaatagcttagctctcgtcgagactttaatggactccaatcggtggacggagatgttcccgtgtaacgtcgcaagagctacaaccaccgacgttatatccggtgggatggctggaacaataaatggtgcacttcaactgatgaatgcagagctacaagttttgtctccactggttccggttcgtaatgttaatttcctccggttctgcaaacagcacgcggagggtgtgtgggcggtggtggatgtatcaattgatcctgtcagggaaaactctggtggtgccccggtaatccggcgactaccatcaggatgtgtggtgcaggatgtgtctaatggatactctaaggtcacgtgggtggagcatgcagaatacgacgagaaccaaatccaccagctgtacaggccgttgctacggtcaggccttggttttggctctcaaagatggctcgctacacttcagagacagtgcgagtgtctcgccatcctcatttcttcctccgttacatctcacgacaacacatcaataacgcctggtggtcgaaaaagcatgctgaagttagctcaacgcatgacgttcaacttctgttcgggaatctcggcgccgtcggtccacaattggagcaagctcactgttggaaatgttgacccggacgttcgagttatgacccgtaagagtgtggacgatccaggagagcctccggggattgttttgagtgctgccacttctgtttggctacctgctgcaccacagcgtctgtatgatttcttgcggaacgaacggatgagatgcgaatgggatattctatccaacggtggtcccatgcaggagatggcccatatcaccaaaggtcaagatcagggtgtctctctgctccgctccaatgcaatgaacgcgaatcagagtagtatgctaattcttcaggagacatgcattgacgcatctggagcgcttgtagtatacgcgcctgtcgacattcccgccatgcatgtggtgatgaacggtggtgattcatcctacgtggctctccttccgtccggtttcgctgttcttcctgacggaggcattgacggtggtgggtcaggtgatggtgaccagcgaccggttggtggtggatccctcttgacagtggcgtttcaaatccttgtaaacaatctcccaacggcaaaactcacggttgagtcggtggagactgtcaacaacctaatatcatgcaccgttcagaagattcgtgccgctttacaatgcgaaagctga

SEQ ID NO: 2736 - protein, 802 aa, Arabidopsis thaliana
MNFGSLFDNTPGGGSTGARLLSGLSYGNHTAATNVLPGGAMAQAAAAASLFSPPLTKSVYASSGLSLALEQPERGTNRGEASMRNNNNVGGGGDTFDGSVNRRSREEEHESRSGSDNVEGISGEDQDAADKPPRKKRYHRHTPQQIQELESMFKECPHPDEKQRLELSKRLCLETRQVKFWFQNRRTQMKTQLERHENALLRQENDKLRAENMSIREAMRNPICTNCGGPAMLGDVSLEEHHLRIENARLKDELDRVCNLTGKFLGHHHNHHYNSSLELAVGTNNNGGHFAFPPDFGGGGGCLPPQQQQSTVINGIDQKSVLLELALTAMDELVKLAQSEEPLWVKSLDGERDELNQDEYMRTFSSTKPTGLATEASRTSGMVIINSLALVETLMDSNRWTEMFPCNVARATTTDVISGGMAGTINGALQLMNAELQVLSPLVPVRNVNFLRFCKQHAEGVWAVVDVSIDPVRENSGGAPVIRRLPSGCVVQDVSNGYSKVTWVEHAEYDENQIHQLYRPLLRSGLGFGSQRWLATLQRQCECLAILISSSVTSHDNTSITPGGRKSMLKLAQRMTFNFCSGISAPSVHNWSKLTVGNVDPDVRVMTRKSVDDPGEPPGIVLSAATSVWLPAAPQRLYDFLRNERMRCEWDILSNGGPMQEMAHITKGQDQGVSLLRSNAMNANQSSMLILQETCIDASGALVVYAPVDIPAMHVVMNGGDSSYVALLPSGFAVLPDGGIDGGGSGDGDQRPVGGGSLLTVAFQILVNNLPTAKLTVESVETVNNLISCTVQKIRAALQCES

SEQ ID NO: 2737 - DNA, 1506 bp, Arabidopsis thaliana
atgcttcttcaaaacttctccaacaccattttccttctctgcctcttcttcacactcctctccgccactaaacccctaaatctcactctccctcaccaacacccttcccctgattccgtcgctctccatgtcatcaggagtgtaaatgaatctcttgcaagaagacaactaagctcaccatcatcatcctcatcatcatcatcctcctcatcatcatcctcttgccgtaccggaaacccaatcgacgattgctggagatgcagcgacgcagactggtcaacaaaccgacaaagactagcagactgttcaatcggcttcggacacggcacactcggaggcaaaaacggcaagatctacgtcgtaactgactcatccgacaacaacccaacaaacccaacaccaggaacactccgttacggcgtaatccaagaagagccactctggatcgtcttctcttcaaacatgctcatcagactaaaacaagaactcatcatcaacagctacaaaaccttagatggtcgtggctcagccgttcacattaccggaaacggttgcttaactctccaatacgttcaacacatcatcatccacaacctccatatctatgactgtaaaccttcagctggattcgagaaacgtggtagatccgatggagatgggatctcgatcttcggatctcagaagatctgggttgatcattgttcaatgagtcattgcaccgacgggctaattgatgctgtgatgggttctacagctataactatatctaacaattacttcacccaccacgacgaggttatgttgttgggtcatgatgataactatgctcctgatacggggatgcaagtgacgatagcgtttaatcatttcggacaagggcttgttcagaggatgcctaggtgtcggagaggttacattcatgtagtgaataatgatttcactgagtggaaaatgtatgctattggtggtagtggtaatcccaccattaacagtcaaggaaatcgttactctgctccttctgatcctagcgccaaagaggtgacgaagcgagtggactcgaaggacgatggtgaatggtcgaattggaattggagaacagaaggggatttgatggagaatggagctttctttgtggcctctggtgaaggaatgagctcaatgtactctaaagcttctagtgttgaccctaaagctgcttctctcgtagaccagctcactcgaaacgctggcgtttttggcggtcccagggatgatcaaggtcagagtggcaattcttactctccttatggaggcgacggcggtggcggtgggagcagcggtgggagcagcggtggagggatggacgttatgggaggtacgacgagaggaagcagcagcagcagcggcgatgacagcaatgtcttccagatgatatttggaagcgatgcaccgtctcggccgcgtttaacgttattgttttctttgttaatgatttcggttttgtcgttatcaactctattattgtga

SEQ ID NO: 2738 - protein, 501 aa, Arabidopsis thaliana
MLLQNFSNTIFLLCLFFTLLSATKPLNLTLPHQHPSPDSVALHVIRSVNESLARRQLSSPSSSSSSSSSSSSSSCRTGNPIDDCWRCSDADWSTNRQRLADCSIGFGHGTLGGKNGKIYVVTDSSDNNPTNPTPGTLRYGVIQEEPLWIVFSSNMLIRLKQELIINSYKTLDGRGSAVHITGNGCLTLQYVQHIIIHNLHIYDCKPSAGFEKRGRSDGDGISIFGSQKIWVDHCSMSHCTDGLIDAVMGSTAITISNNYFTHHDEVMLLGHDDNYAPDTGMQVTIAFNHFGQGLVQRMPRCRRGYIHVVNNDFTEWKMYAIGGSGNPTINSQGNRYSAPSDPSAKEVTKRVDSKDDGEWSNWNWRTEGDLMENGAFFVASGEGMSSMYSKASSVDPKAASLVDQLTRNAGVFGGPRDDQGQSGNSYSPYGGDGGGGGSSGGSSGGGMDVMGGTTRGSSSSSGDDSNVFQMIFGSDAPSRPRLTLLFSLLMISVLSLSTLLL

SEQ ID NO: 2739 - DNA, 1686 bp, Arabidopsis thaliana
atggacgaagattccgtccatggcgattctcacctcaagacatgtgtcgtcctcggcggacgagggttcattggtcgatcgcttgtctccagattgcttcgtctcggaaactggacagtccgagtcgcagattccggtcacactctccatcttgatgaatccgattcgctcctcgaggatgctctctcctccggccgcgcttcttatcactgcgtcgatgttcgtgataaacctcagatcgttaaagttaccgagggttcctatgttgtattttacatgggagctactgatttacgttcccatgattactttgactgctacaaggttatagttcaaggtacaagaaatgtgatttctgcctgtcgtgaatctggagtcagaaaacttatctacaacagtacagctgatgttgtttttgatggttcccaacctatacgtgatggtgatgaatccttgagacgtcctttgaagttccaatctatgttgacagacttcaaagctcaagcagaagcgttgatcaaattggctaacaaccgagatggtctcttaacttgtgcacttcgctctagcattgtatttggacctggtgacacagagtttgtaccttttttggtgaatctagccaagtccggatatgcaaagtttatactcgggagtggtgaaaatatctctgatttcacttactcggagaacgtttctcatgcacatatttgcgccgttaaagcattagattcacagatggagtttgtggctggaaaggaattttttatcacaaacctcaagccggtcagattttgggactttgtaagccatatagttgaaggtctgggatacccaagaccatccattaaacttcctgttcggctggttttgtatgttttctcacttcttaagtggacacatgaaaaggagggccttgggagtaattatgacacagcacatcagtatgctctgttagcttcatcaacgagaacttttaactgcaatgcagctaagaagcatcttggttacacacctgttgtgacacttgaagatggtattgcatcaacgcttcaatggttctctcgggatcttgagaagtctgatgacacaatcattcaatctactgcagatcagcttcttggttgtgggaaagttgcagacatcttgctgtggagaaatgagaagaaaaccttcgtttcttttcttgtcctaaacttgttttattactggttcttcttttctggaaacacatttacttcatctgcagcccaacttctgtttatatttgctgttgctctctatggagtctcttttgtgccgtcaaagattttcgggtttcaagtcaacaaaatacccccatggagatttgagatctccgaatccgctgtgagagatcttagtagtgatatcgtagttgtctggaatcaaggagttcgcagttttaaatccttaagcagtggaggagactggatcaagttcttcaagattgcaggatcactgtatctcctcaaactgattgtatcccgttcattggcagcatttcttttcacagttatgtcgttctcattcaccggtttcttcatctacgagcaatacgagcttgagctctaccacctagcccggatattcgtcgaatgcttaacatttattaaaaggatggtgatacctgtttctgatgcttcatctaaaccaatgttcatgtga

SEQ ID NO: 2740 - protein, 561 aa, Arabidopsis thaliana
MDEDSVHGDSHLKTCVVLGGRGFIGRSLVSRLLRLGNWTVRVADSGHTLHLDESDSLLEDALSSGRASYHCVDVRDKPQIVKVTEGSYVVFYMGATDLRSHDYFDCYKVIVQGTRNVISACRESGVRKLIYNSTADVVFDGSQPIRDGDESLRRPLKFQSMLTDFKAQAEALIKLANNRDGLLTCALRSSIVFGPGDTEFVPFLVNLAKSGYAKFILGSGENISDFTYSENVSHAHICAVKALDSQMEFVAGKEFFITNLKPVRFWDFVSHIVEGLGYPRPSIKLPVRLVLYVFSLLKWTHEKEGLGSNYDTAHQYALLASSTRTFNCNAAKKHLGYTPVVTLEDGIASTLQWFSRDLEKSDDTIIQSTADQLLGCGKVADILLWRNEKKTFVSFLVLNLFYYWFFFSGNTFTSSAAQLLFIFAVALYGVSFVPSKIFGFQVNKIPPWRFEISESAVRDLSSDIVVVWNQGVRSFKSLSSGGDWIKFFKIAGSLYLLKLIVSRSLAAFLFTVMSFSFTGFFIYEQYELELYHLARIFVECLTFIKRMVIPVSDASSKPMFM

SEQ ID NO: 2741 - DNA, 1647 bp, Arabidopsis thaliana; identical to SEQ ID NO: 23

SEQ ID NO: 2742 - protein, 479 aa, Arabidopsis thaliana; identical to SEQ ID NO: 24

SEQ ID NO: 2743 - DNA, 219 bp, Arabidopsis thaliana
atggcaagcatatgcgaagatccaggaaaaagctcatggccagagcttttgggggcaaaaggagaagatgcaaaagaagtgatcgagagagagaatccaaaaatgaaagcagttatcattttggatggaacagttgttccggagatctttatttgctctcgtgtttacgtttgggtcaacgattgcggaatcgttgttcaaattcctatcatcggttaa

SEQ ID NO: 2744 - protein, 72 aa, Arabidopsis thaliana
MASICEDPGKSSWPELLGAKGEDAKEVIERENPKMKAVIILDGTVVPEIFICSRVYVWVNDCGIVVQIPIIG

SEQ ID NO: 2745 - DNA, 1917 bp, Arabidopsis thaliana
atggctgttgatagcagaatggatctgctaagcgaaagagctgtgttgatgagagcatctcttcaaaagagtcaaaccatcaccgataatgttgtttctatcctcggctccttcgatagtcgtctgtctgctcttgaaaccgccatgcgtcctactcagattaggactcatgctataaggaaagctcatgagaatattgataggactcttaaggctgctgaagttattttgtctcaattcgatctcctccgtcaggcagagactaaagtactcaaggggccacatgaggacctggaaagttatctggatgcaattgctcaactcagaaagattattcgttattttatgagcaacaaaagctttaagagtagtgatggagttctcaaccacgcaaatagtttgcttgctaaagcacagtcaaagctggaggaagagtttaagcagttgctagcttcttacagtaaagcggtggagcctgatcgcctatttgatggccttcccaactcactgagaccatcctcagacggggatggaggtggaaaaccccacggaggacatcacaatgatgacgcggaaactgctgcttatacacttccaatcctcattccgtcacgggtgttgccacttttgcatgacttggcacagcaaatggttcaggctggtcaccaacaacagttgctacaaatttatagggacacacgttcctttgtcttggaagaaagcttaaagaaattgggagttgaaaaacttagcaaagaggatgtccagaggatgcagtgggaagttttggaggccaaaattggaaattggatccatttcatgcgcattgctgttaaattactctttgctggagaaagacaagtatgtgaccagatattccgaggcttcgattctctaagtgatcagtgttttgcagaagttacagtgagcagtgtctcaatgctacttagctttggggatgctatagccaggagcaagagatctccagaaaagttgtttgtactcttagacatgtatgagataatgcgggagcttcatacagagattgagacaattttcaaagggaaagcatgcctcgaaattagagattctgcgacgggcttgacaaagcggttggcgcaaactgctcaggaaacatttggtgattttgaagaagctgttgagaaagatgctacaaagactgctgttctagatggaactgtccacccactaacaagctatgtcatcaattatgtcaagtttttattcgactaccaaacaacattgaagcaacttttcttggaatttggaaatggagatgactcaaattcgcagctagcatccgtaacgatgcggataatgcaggcgcttcaaaacaacttggacggaaaatcgaaacagtacaaagatcctgcattgacacacttgttcctgatgaacaacattcattacatggtcagatctgtgcgcaggtcagaagccaaggatttgttaggcgatgattgggttcaaagacataggcgtatcgtgcagcaacatgcaaaccaatacaaaagagttgcctggacaaagatactacaaagctcatcggcgcaaggtttgacctcatctgggggaggaagtttagagggaggaaacagcagtggagtttcaagaggattattaaaagagaggttcaagatgttcaatatgcagtttgatgagttgcatcagagacaatcgcaatggacagttccagacacagagttaagagagtcactaagacttgctgttgctgaagtattattgcctgcttatagatcattcctcaaacgctttgggcctttggttgagagtgggaagaatcctcagaaatacataaagtatacagctgaagatcttgaaagattgttgggtgagttgtttgaaggaaagtctatgaatgaaccacgccggtaa

SEQ ID NO: 2746 - protein, 638 aa, Arabidopsis thaliana
MAVDSRMDLLSERAVLMRASLQKSQTITDNVVSILGSFDSRLSALETAMRPTQIRTHAIRKAHENIDRTLKAAEVILSQFDLLRQAETKVLKGPHEDLESYLDAIAQLRKIIRYFMSNKSFKSSDGVLNHANSLLAKAQSKLEEEFKQLLASYSKAVEPDRLFDGLPNSLRPSSDGDGGGKPHGGHHNDDAETAAYTLPILIPSRVLPLLHDLAQQMVQAGHQQQLLQIYRDTRSFVLEESLKKLGVEKLSKEDVQRMQWEVLEAKIGNWIHFMRIAVKLLFAGERQVCDQIFRGFDSLSDQCFAEVTVSSVSMLLSFGDAIARSKRSPEKLFVLLDMYEIMRELHTEIETIFKGKACLEIRDSATGLTKRLAQTAQETFGDFEEAVEKDATKTAVLDGTVHPLTSYVINYVKFLFDYQTTLKQLFLEFGNGDDSNSQLASVTMRIMQALQNNLDGKSKQYKDPALTHLFLMNNIHYMVRSVRRSEAKDLLGDDWVQRHRRIVQQHANQYKRVAWTKILQSSSAQGLTSSGGGSLEGGNSSGVSRGLLKERFKMFNMQFDELHQRQSQWTVPDTELRESLRLAVAEVLLPAYRSFLKRFGPLVESGKNPQKYIKYTAEDLERLLGELFEGKSMNEPRR

SEQ ID NO: 2747 - DNA, 3414 bp, Arabidopsis thaliana
atgtcgtcactcagcagagaactcgtgtttttaatacttcagtttctcgatgaagagaaattcaaagatactgttcacaggttggagaaagagtctggttttttcttcaacatgaggtactttgaagatagtgtaacagctggtgaatgggatgatgtagagaagtatctttctggattcactaaagttgatgataatagatactctatgaaaatatttttcgagattcggaagcagaagtaccttgaagcacttgacaagaaagatcatgccaaggcggttgatattcttgttaaggagttgaaagtgttctcgacattcaacgaagagctttttaaggagattaccatgcttttaaccttgactaacttcagggaaaatgagcagctttccaagtatggagatactaagtccgcaagaggtatcatgcttggggaacttaaaaaactgattgaagcaaatcctctcttccgagacaaacttcaatttcccagtttgaagaattctagattgagaaccttaataaatcaaagtttgaactggcaacatcagctttgcaagaatcctaggcctaacccggatataaaaacactatttgttgaccatacgtgtgggcatcccaatggtgcacacactccttcccctacaactaatcatttaatgggttcagtccctaaagttggaggcttcccaccattaggtgctcacggtccatttcagccaacaccagctcctcttacaacatctcttgcaggatggatgcctaatccatcggtacaacaccctactgtttccgctgggcctatcggcttaggtgcccccaacagtgctgtgtctatgttaaagcgtgagcgtcccaggagtcctccaactaatagcctatcaatggattatcagacggcagattctgaaagtgtgttgaagagacccagaccttttggtatttcagatggggttaataatcttccagtcaatgtcttgccagtcacatatccagggcaaagccatgctcatgcaacttattctactgatgacttgcccaaaaacgttagcaggattttgagtcagggttctgccattaagagcatggattttcatccagtacagcaaactatgctccttgttggcaccaatcttggtgatattgcaatatgggaggtgggtagcagggagaagctcgtttctagaagctttaaagtttgggatcttgctacttgcactgtgaaccttcaggcttcacttgctagcgagtatactgcagcagtaaaccgagttgtttggagtcctgatggaggtctactgggtgtcgcatattccaagcatattgtgcatatatattcatatcatggtggcgaggatttacggaatcatctagagattgatgcccatgctggtaatgtcaacgatcttgctttctcccaaccaaaccagcaattatgtgttgtgacttgtggagaagacaagacaatcaaggtctgggatgctgttaccggaaataaattgcacacttttgaaggtcatgaggcacctgtttattccgtgtgcccacaccagaaagagaatattcagttcatattctcaactgctgttgatgggaaaataaaggcttggttatatgacaacatgggttctagagtggattatgatgcccccggtcgatcttgcacgtcgatggcatattgtgctgatgggactagattattttcttgtggtactagtaaggagggggagtcattcattgttgaatggaatgaaagtgaaggagctgtgaagcggacttatcttggactggggaaacggtctgtgggggttgtccagttcgacaccatgaagaataaatttttggtagctggtgatgaattccaagtcaaattttgggatatggatagtgttgatctcttgagttcaacggctgcagaagggggtttaccgtcttccccttgcttaaggatcaataaagaaggaactctgctggccgtctcaactactgataacggaattaagattctagcgaatgctgaaggttccagaattttgcattccatggcaaaccgtggccttgatagctctagagctcctcctgggtcagttgctaagggtcctattgttggcacatttggcactccaaattcaagcactggaatgagtctatcaatgggtgaaagaagtggaccagtggcatctgttactggattgaatggagataatcgcagtctgccagatgtcaaaccacgaatcgctgatgatgcagagaaatcaaagacttggaagctgactgagatcagtgaacgttcccagcttcgtactctgcggcttcctgacaccctgctaccagcaagagttgttaagttgatatatacaaattctggaggtgctatattggcattagcagaaaatgctgcacataaactatggaaatggcaaaagagtgagcggaatcttttgggaaaggcaaacagcaatgtcccaccacagctttggcagccatctagtggagtattaatgacaaatgatacacgtgagggaaacaaagaggatgtagttccatgctttgcactctcaaaaaatgattcttatgtcatgtcagcctctggaggaaaaatttccttattcaacatgatgacttttaagacgatgacgacattcatggctcctcctccagcagcgacttcccttgccttccatcctcaagacaataatataattgctatcggaatggatgactcttctattcaaatctacaatgtcagagttgatgaggttaaaagtaaattgaaaggtcatcagaagagagtgactggtttagcattctcaaacgtgctaaatgttcttgtttcctctggtgctgattctcagctttgtgtatggagcatggatggatgggaaaaacaagctagcaaacagatacaaattccaagcgggcattcaccaaatccacttgctcatacacgcgttcagttccatcaagaccagatacatgtacttgttgtccatgccagccagttagccatatatgaggctcctaaattagagaacatgaagcagtggataccgaaagagtcaagtggttcagtcacagatgcagtatattcatgtgatagccagtcaatctatgcagcctttgatgatggaagtgtgagtatcttgacggcaacaacattgcaactgaagtgccgcattggtcccaattcatatttgccttcaaacccgagctcgagagtatatccagccacagttgcagcacatccgtctgaaccaaaccagtttgcagttggactaaccgatggtggggtccacgtgatcgaaccaccaggtccagaagggaagtggggaatatccgcaccaccagaaaacggagcagggccaagcgtctcctcagctcccgggtcagatcaacaaccgagtgattcgtag

SEQ ID NO: 2748 - protein, 1137 aa, Arabidopsis thaliana
MSSLSRELVFLILQFLDEEKFKDTVHRLEKESGFFFNMRYFEDSVTAGEWDDVEKYLSGFTKVDDNRYSMKIFFEIRKQKYLEALDKKDHAKAVDILVKELKVFSTFNEELFKEITMLLTLTNFRENEQLSKYGDTKSARGIMLGELKKLIEANPLFRDKLQFPSLKNSRLRTLINQSLNWQHQLCKNPRPNPDIKTLFVDHTCGHPNGAHTPSPTTNHLMGSVPKVGGFPPLGAHGPFQPTPAPLTTSLAGWMPNPSVQHPTVSAGPIGLGAPNSAVSMLKRERPRSPPTNSLSMDYQTADSESVLKRPRPFGISDGVNNLPVNVLPVTYPGQSHAHATYSTDDLPKNVSRILSQGSAIKSMDFHPVQQTMLLVGTNLGDIAIWEVGSREKLVSRSFKVWDLATCTVNLQASLASEYTAAVNRVVWSPDGGLLGVAYSKHIVHIYSYHGGEDLRNHLEIDAHAGNVNDLAFSQPNQQLCVVTCGEDKTIKVWDAVTGNKLHTFEGHEAPVYSVCPHQKENIQFIFSTAVDGKIKAWLYDNMGSRVDYDAPGRSCTSMAYCADGTRLFSCGTSKEGESFIVEWNESEGAVKRTYLGLGKRSVGVVQFDTMKNKFLVAGDEFQVKFWDMDSVDLLSSTAAEGGLPSSPCLRINKEGTLLAVSTTDNGIKILANAEGSRILHSMANRGLDSSRAPPGSVAKGPIVGTFGTPNSSTGMSLSMGERSGPVASVTGLNGDNRSLPDVKPRIADDAEKSKTWKLTEISERSQLRTLRLPDTLLPARVVKLIYTNSGGAILALAENAAHKLWKWQKSERNLLGKANSNVPPQLWQPSSGVLMTNDTREGNKEDVVPCFALSKNDSYVMSASGGKISLFNMMTFKTMTTFMAPPPAATSLAFHPQDNNIIAIGMDDSSIQIYNVRVDEVKSKLKGHQKRVTGLAFSNVLNVLVSSGADSQLCVWSMDGWEKQASKQIQIPSGHSPNPLAHTRVQFHQDQIHVLVVHASQLAIYEAPKLENMKQWIPKESSGSVTDAVYSCDSQSIYAAFDDGSVSILTATTLQLKCRIGPNSYLPSNPSSRVYPATVAAHPSEPNQFAVGLTDGGVHVIEPPGPEGKWGISAPPENGAGPSVSSAPGSDQQPSDS

SEQ ID NO: 2749 - DNA, 630 bp, Arabidopsis thaliana
atgaaggccaccatatccatcactaccatctttctcgtggtcgctttggccgcaccctccctagctcgtcctgacaaccatgtcgaggactctgtaggccgtctacttcgtcctggtcaaacgtaccacatcgtacctgcgaatcccgagacaggaggaggtattttctcgaacagtgaagaaatctgtcctcttgacatcttccagtcaaacaatccgcttgacttgggcctacccatcaaatttaagtccgagttatggtttgttaaggaaatgaatagtatcaccatcgagtttgaggctccgaactggtttttgtgtcctaaagaatccaaggggtggagagttgtgtactctgaagaattcaaaaagagtcttataataagcactggtggttcatcaaacccaagtggcttccagatccatcgagtcgacggaggtgcttacaagattgtatattgtacaaacatctcgactactacgtgcatgaacgttggcatattcaccgatatctctggtgcacgacgcttagccttgaccagcgatgaggctctcctagttaagttccagaaggcagcaactccaaaagctgatttgaagactaagctgaggatgttccctttctactga

SEQ ID NO: 2750 - protein, 209 aa, Arabidopsis thaliana
MKATISITTIFLVVALAAPSLARPDNHVEDSVGRLLRPGQTYHIVPANPETGGGIFSNSEEICPLDIFQSNNPLDLGLPIKFKSELWFVKEMNSITIEFEAPNWFLCPKESKGWRVVYSEEFKKSLIISTGGSSNPSGFQIHRVDGGAYKIVYCTNISTTTCMNVGIFTDISGARRLALTSDEALLVKFQKAATPKADLKTKLRMFPFY

SEQ ID NO: 2751 - DNA, 366 bp, Arabidopsis thaliana
atgggcaccggagaaaaaaccctgaagagcttccagttacatcgcaaacaatcagtcaaagtcaaagatgttccaaaagggtgtttagcgatcaaagtgggatcgcaaggagaagagcaacagagatttatcgttcctgttttgtattttaaccatccattgttcatgcagctcctgaaagaagcagaagacgagtatggattcgatcaaaagggcaccatcacaattccttgtcacgtggaggagtttcgttacgttcaagctttgatagatggagagagatcagtttacaatggtaacaaccatcatcatagacatggtggccgtgaccagtatcatcatcttgttggatgcttcagagcttga

SEQ ID NO: 2752 - protein, 121 aa, Arabidopsis thaliana
MGTGEKTLKSFQLHRKQSVKVKDVPKGCLAIKVGSQGEEQQRFIVPVLYFNHPLFMQLLKEAEDEYGFDQKGTITIPCHVEEFRYVQALIDGERSVYNGNNHHHRHGGRDQYHHLVGCFRA

SEQ ID NO: 2753 - DNA, 339 bp, Arabidopsis thaliana
atggttgagctagacattcagattccatcagcatacgatccatttgcagaagctaaagattcagatgcaccaggagctaaagagaacattcacattcgaatccagcagaggaatgggaaaaagagcttgacgactgttcaagggcttaagaaagagtacagctacgagaggattctcaaggatttgaagaaagatttctgctgcaacggtaacgttgtgcaggacaaagaactaggcaagatcatccagcttcaaggtgatcaaaggaagaaagtgtctcagttcttggtccaaactgggattgctaagaaggatcagatcaagatccacggtttctaa

SEQ ID NO: 2754 - protein, 112 aa, Arabidopsis thaliana
MVELDIQIPSAYDPFAEAKDSDAPGAKENIHIRIQQRNGKKSLTTVQGLKKEYSYERILKDLKKDFCCNGNVVQDKELGKIIQLQGDQRKKVSQFLVQTGIAKKDQIKIHGF

SEQ ID NO: 2755 - DNA, 861 bp, Arabidopsis thaliana
atcatattatttcttaaaatgtcaggagctctctttcttctctcttacatatctttcagagagacaacttcttatctttaatcgctgtccgaattatattgtcggtttttgtgcccagacgagatctgattttgctatcaacacggcttttccgttgccgtgttcttgccgttaacacgaagtagttgttggattttccatagagaggtggaggacgtcaaacaagagacctacagatcttcaaaggagaagagaaaccaccagatctgcaaacaacaagacacatcggaaggaaacgaagaggacaaacgaaagactttatacgtgaggcgaaaccagtttggattctgcgggagaggagcggagcaacaaagagaagacaaaattcgacgccggggagacatagctacaccggcgccagaagacggtgaatcttttggagtctcgtgtatgtcgcatggcagagtttttactctttttttagtactagaataaacatttaacgttaatcattacatctaagttcataagctactattaaaagtgacaagccgtgcattggattttattctcttattgagtctaattatttttgtgtatcttcatggtgttgttttgctattactggtgaaaaacagatgatctaccaacgatttcgttacgacgtggtttctcactgaaaaaccgtatctccgatggcgaaagatgacgatgggaatctttcttttgctcaccttacacgtgtcttttggtgatctttcttgatccaatcttcttctataaacgatgcattattgggctcttcttgggcatgcgtttgttcgtagtttatttatccgtgttcggctgtacttggccttg

SEQ ID NO: 2756 - DNA, 64 bp, Artificial sequence
  T7 promoter and oligo dT
ggccagtgaattgtaatacgactcactatagggaggcggttttttttttttttttttttttttv

SEQ ID NO: 2757 - DNA, 34 bp, Artificial sequence
  primer 1 for E2Fa
aaaaagcaggctgtgtcgtacgatcttctcccgg

SEQ ID NO: 2758 - DNA, 33 bp, Artificial sequence
  primer 2 for E2Fa
agaaagctgggtcatgtgataggagaaccagcg

SEQ ID NO: 2759 - DNA, 30 bp, Artificial sequence
  primer 1 for DPa
atagaattcgcttacattttgaaactgatg

SEQ ID NO: 2760 - DNA, 30 bp, Artificial sequence
  primer 2 for DPa
atagtcgactcagcgagtatcaatggatcc

SEQ ID NO: 2761 - DNA, 27 bp, Artificial sequence
  primer 1 for glutamine synthetase
cagatcttgttaaccttgacatctcag

SEQ ID NO: 2762 - DNA, 25 bp, Artificial sequence
  primer 2 for glutamine synthetase
gggtcaaaagatacaaccacaccag

SEQ ID NO: 2763 - DNA, 21 bp, Artificial sequence
  primer 1 for glutamate synthase
ggtttacgagctacatggccc

SEQ ID NO: 2764 - DNA, 20 bp, Artificial sequence
  primer 2 for glutamate synthase
gagcaatccgttcagcctcc

SEQ ID NO: 2765 - DNA, 22 bp, Artificial sequence
  primer 1 for histone acetylase
gcgtttgaccactcttggagac

SEQ ID NO: 2766 - DNA, 22 bp, Artificial sequence
  primer 2 for histone acetylase
gaacgccattgagaaagtccgc

SEQ ID NO: 2767 - DNA, 23 bp, Artificial sequence
  primer 1 for LOB domain protein 41
gttaccggctcgacttgaagatc

SEQ ID NO: 2768 - DNA, 22 bp, Artificial sequence
  primer 2 for LOB domain protein 41
gaatcggagggaaagtctgacg

SEQ ID NO: 2769 - DNA, 24 bp, Artificial sequence
  primer 1 for isocitrate lyase
gtgtggtttccaagctttcctacg

SEQ ID NO: 2770 - DNA, 22 bp, Artificial sequence
  primer 2 for isocitrate lyase
ggtgaagggactagccttgtgg

SEQ ID NO: 2771 - DNA, 22 bp, Artificial sequence
  primer 1 for nitrite reductase
gggatcaatcctcaggagaagg

SEQ ID NO: 2772 - DNA, 24 bp, Artificial sequence
  primer 2 for nitrite reductase
ccgtccatctttattagcggcatg

SEQ ID NO: 2773 - DNA, 22 bp, Artificial sequence
  primer 1 for actin 2
ttaccgaggctcctcttaaccc

SEQ ID NO: 2774 - DNA, 22 bp, Artificial sequence
  primer 2 for actin 2
accaccgatccagacactgtac

SEQ ID NO: 2775 - DNA, 8 bp, Artificial sequence
  E2F-like binding site
wttsscss

SEQ ID NO: 2776 - DNA, 8 bp, Artificial sequence
  preferred binding site of E2Fa/DPa complex
tttcccgc

The invention claimed is:

1. A method to increase yield and/or biomass, said method comprising introducing and expressing in a plant a recombinant nucleic acid comprising a nucleic acid which is at least 95% identical to SEQ ID NO:1835 operably linked to a plant-expressible promoter, wherein said yield and/or biomass are increased relative to corresponding wild type plants.

2. The method according to claim 1, wherein said increased yield and/or biomass comprises increased seed yield.

3. The method according to claim 1, comprising overexpression of said nucleic acid.

4. A transgenic plant obtainable by the method according to claim 1.

5. A plant which is transgenic for an isolated nucleic acid sequence which is at least 95% identical to SEQ ID NO:1835, wherein said transgenic plant has increased yield and/or biomass relative to corresponding wild type plants.

6. A method to increase yield and/or biomass, said method comprising introducing and expressing in a plant a recombinant nucleic acid comprising a nucleic acid which is at least 95% identical to a sequence encoding SEQ ID NO:1836 operably linked to a plant-expressible promoter, wherein the yield and/or biomass are increased relative to corresponding wild type plants.

7. The method according to claim 6, wherein said increased yield and/or biomass comprises increased seed yield.

8. The method according to claim 6, comprising overexpression of said nucleic acid.

9. A transgenic plant obtainable by the method according to claim 6.

10. A transgenic plant comprising a heterologous nucleic acid sequence which is at least 95% identical to a sequence encoding SEQ ID NO: 1836, wherein said transgenic plant has increased yield and/or biomass relative to corresponding wild type plants.

11. The method according to claim 1 or 6, wherein said plant expressible promoter is a constitutive GOS2 promoter or a seed-preferred prolamin promoter.

12. The transgenic plant according to claim 4, 5, 9 or 10, wherein the plant is a rice plant.

* * * * *